United States Patent 8,541,208 (PROCESS FOR THE PRODUCTION OF FINE CHEMICALS) - sequence listing, part 5

SEQ ID NO: 15350 - DNA, 1980 bp, Pseudomonas tolaasii; identical to SEQ ID NO: 2984
  CDS (414)..(1472)

SEQ ID NO: 15351 - protein, 352 aa, Pseudomonas tolaasii; identical to SEQ ID NO: 2985

SEQ ID NO: 15352 - DNA, 1501 bp, Rhizobium etli; identical to SEQ ID NO: 2986
  CDS (242)..(1327)

SEQ ID NO: 15353 - protein, 361 aa, Rhizobium etli; identical to SEQ ID NO: 2987

SEQ ID NO: 15354 - DNA, 1098 bp, Rhizobium loti; identical to SEQ ID NO: 2988
  CDS (1)..(1098)

SEQ ID NO: 15355 - protein, 365 aa, Rhizobium loti; identical to SEQ ID NO: 2989

SEQ ID NO: 15356 - DNA, 1092 bp, Rhodopseudomonas palustris; identical to SEQ ID NO: 2990
  CDS (1)..(1092)

SEQ ID NO: 15357 - protein, 363 aa, Rhodopseudomonas palustris; identical to SEQ ID NO: 2991

SEQ ID NO: 15358 - DNA, 1047 bp, Rhodopseudomonas viridis; identical to SEQ ID NO: 2992
  CDS (1)..(1047)

SEQ ID NO: 15359 - protein, 348 aa, Rhodopseudomonas viridis; identical to SEQ ID NO: 2993

SEQ ID NO: 15360 - DNA, 1074 bp, Shewanella oneidensis; identical to SEQ ID NO: 2994
  CDS (1)..(1074)

SEQ ID NO: 15361 - protein, 357 aa, Shewanella oneidensis; identical to SEQ ID NO: 2995

SEQ ID NO: 15362 - DNA, 1235 bp, Spirulina platensis; identical to SEQ ID NO: 2996
  CDS (54)..(1151)

SEQ ID NO: 15363 - protein, 365 aa, Spirulina platensis; identical to SEQ ID NO: 2997

SEQ ID NO: 15364 - DNA, 1074 bp, Staphylococcus epidermidis; identical to SEQ ID NO: 2998
  CDS (25)..(1074)

SEQ ID NO: 15365 - protein, 349 aa, Staphylococcus epidermidis; identical to SEQ ID NO: 2999

SEQ ID NO: 15366 - DNA, 1140 bp, Streptococcus agalactiae; identical to SEQ ID NO: 3000
  CDS (1)..(1140)

SEQ ID NO: 15367 - protein, 379 aa, Streptococcus agalactiae; identical to SEQ ID NO: 3001

SEQ ID NO: 15368 - DNA, 1119 bp, Streptomyces ambofaciens; identical to SEQ ID NO: 3002
  CDS (1)..(1119)

SEQ ID NO: 15369 - protein, 372 aa, Streptomyces ambofaciens; identical to SEQ ID NO: 3003

SEQ ID NO: 15370 - DNA, 1134 bp, Streptomyces avermitilis; identical to SEQ ID NO: 3004
  CDS (1)..(1134)

SEQ ID NO: 15371 - protein, 377 aa, Streptomyces avermitilis; identical to SEQ ID NO: 3005

SEQ ID NO: 15372 - DNA, 1152 bp, Streptococcus mutans; identical to SEQ ID NO: 3006
  CDS (1)..(1152)

SEQ ID NO: 15373 - protein, 383 aa, Streptococcus mutans; identical to SEQ ID NO: 3007

SEQ ID NO: 15374 - DNA, 1137 bp, Streptococcus pyogenes; identical to SEQ ID NO: 3008
  CDS (1)..(1137)

SEQ ID NO: 15375 - protein, 378 aa, Streptococcus pyogenes; identical to SEQ ID NO: 3009

SEQ ID NO: 15376 - DNA, 1356 bp, Streptococcus parasanguis; identical to SEQ ID NO: 3010
  CDS (118)..(1263)

SEQ ID NO: 15377 - protein, 381 aa, Streptococcus parasanguis; identical to SEQ ID NO: 3011

SEQ ID NO: 15378 - DNA, 1416 bp, Streptomyces rimosus; identical to SEQ ID NO: 3012
  CDS (229)..(1359)

SEQ ID NO: 15379 - protein, 376 aa, Streptomyces rimosus; identical to SEQ ID NO: 3013

SEQ ID NO: 15380 - DNA, 1916 bp, Streptococcus thermophilus; identical to SEQ ID NO: 3014
  CDS (555)..(1694)

SEQ ID NO: 15381 - protein, 379 aa, Streptococcus thermophilus; identical to SEQ ID NO: 3015

SEQ ID NO: 15382 - DNA, 1271 bp, Streptomyces violaceus; identical to SEQ ID NO: 3016
  CDS (75)..(1208)

SEQ ID NO: 15383 - protein, 377 aa, Streptomyces violaceus; identical to SEQ ID NO: 3017

SEQ ID NO: 15384 - DNA, 1068 bp, Synechococcus elongatus; identical to SEQ ID NO: 3018
  CDS (1)..(1068)

SEQ ID NO: 15385 - protein, 355 aa, Synechococcus elongatus; identical to SEQ ID NO: 3019

SEQ ID NO: 15386 - DNA, 1023 bp, Thermus thermophilus; identical to SEQ ID NO: 3020
  CDS (1)..(1023)

SEQ ID NO: 15387 - protein, 340 aa, Thermus thermophilus; identical to SEQ ID NO: 3021

SEQ ID NO: 15388 - DNA, 1405 bp, Thiobacillus ferrooxidans; identical to SEQ ID NO: 3022
  CDS (196)..(1236)

SEQ ID NO: 15389 - protein, 346 aa, Thiobacillus ferrooxidans; identical to SEQ ID NO: 3023

SEQ ID NO: 15390 - DNA, 1314 bp, Tropheryma whipplei; identical to SEQ ID NO: 3024
  CDS (1)..(1314)

SEQ ID NO: 15391 - protein, 437 aa, Tropheryma whipplei; identical to SEQ ID NO: 3025

SEQ ID NO: 15392 - DNA, 1411 bp, Vibrio cholerae; identical to SEQ ID NO: 3026
  CDS (183)..(1247)

SEQ ID NO: 15393 - protein, 354 aa, Vibrio cholerae; identical to SEQ ID NO: 3027

SEQ ID NO: 15394 - DNA, 1044 bp, Vibrio parahaemolyticus; identical to SEQ ID NO: 3028
  CDS (1)..(1044)

SEQ ID NO: 15395 - protein, 347 aa, Vibrio parahaemolyticus; identical to SEQ ID NO: 3029

SEQ ID NO: 15396 - DNA, 996 bp, Wigglesworthia glossinidia brevipalpis; identical to SEQ ID NO: 3030
  CDS (1)..(996)

SEQ ID NO: 15397 - protein, 331 aa, Wigglesworthia glossinidia brevipalpis; identical to SEQ ID NO: 3031

SEQ ID NO: 15398 - DNA, 1035 bp, Xanthomonas axonopodis; identical to SEQ ID NO: 3032
  CDS (1)..(1035)

SEQ ID NO: 15399 - protein, 344 aa, Xanthomonas axonopodis; identical to SEQ ID NO: 3033

SEQ ID NO: 15400 - DNA, 1594 bp, Xenorhabdus nematophilus; identical to SEQ ID NO: 3034
  CDS (142)..(1218)

SEQ ID NO: 15401 - protein, 358 aa, Xenorhabdus nematophilus; identical to SEQ ID NO: 3035

SEQ ID NO: 15402 - DNA, 1044 bp, Xylella fastidiosa; identical to SEQ ID NO: 3036
  CDS (1)..(1044)

SEQ ID NO: 15403 - protein, 347 aa, Xylella fastidiosa; identical to SEQ ID NO: 3037

SEQ ID NO: 15404 - DNA, 1020 bp, Zymomonas mobilis; identical to SEQ ID NO: 3038
  CDS (1)..(1020)

SEQ ID NO: 15405 - protein, 339 aa, Zymomonas mobilis; identical to SEQ ID NO: 3039

SEQ ID NO: 15406 - DNA, 1660 bp, primary endosymbiont of Sitophilus oryzae; identical to SEQ ID NO: 3040
  CDS (11)..(1078)

SEQ ID NO: 15407 - protein, 355 aa, primary endosymbiont of Sitophilus oryzae; identical to SEQ ID NO: 3041

SEQ ID NO: 15408 - DNA, 1110 bp, Azospirillum lipoferum; identical to SEQ ID NO: 3042
  CDS (1)..(1110)

SEQ ID NO: 15409 - protein, 369 aa, Azospirillum lipoferum; identical to SEQ ID NO: 3043

SEQ ID NO: 15410 - DNA, 1017 bp, Geobacter sulfurreducens; identical to SEQ ID NO: 3044
  CDS (1)..(1017)

SEQ ID NO: 15411 - protein, 338 aa, Geobacter sulfurreducens; identical to SEQ ID NO: 3045

SEQ ID NO: 15412 - DNA, 1230 bp, Mycobacterium paratuberculosis; identical to SEQ ID NO: 3046
  CDS (1)..(1230)

SEQ ID NO: 15413 - protein, 409 aa, Mycobacterium paratuberculosis; identical to SEQ ID NO: 3047

SEQ ID NO: 15414 - DNA, 1083 bp, Lactobacillus johnsonii; identical to SEQ ID NO: 3048
  CDS (1)..(1083)

SEQ ID NO: 15415 - protein, 360 aa, Lactobacillus johnsonii; identical to SEQ ID NO: 3049

SEQ ID NO: 15416 - DNA, 1245 bp, Treponema denticola; identical to SEQ ID NO: 3050
  CDS (1)..(1245)

SEQ ID NO: 15417 - protein, 414 aa, Treponema denticola; identical to SEQ ID NO: 3051

SEQ ID NO: 15418 - DNA, 1068 bp, Wolbachia pipientis wMel; identical to SEQ ID NO: 3052
  CDS (1)..(1068)

SEQ ID NO: 15419 - protein, 355 aa, Wolbachia pipientis wMel; identical to SEQ ID NO: 3053

SEQ ID NO: 15420 - DNA, 1074 bp, Desulfovibrio vulgaris; identical to SEQ ID NO: 3054
  CDS (1)..(1074)

SEQ ID NO: 15421 - protein, 357 aa, Desulfovibrio vulgaris; identical to SEQ ID NO: 3055

SEQ ID NO: 15422 - DNA, 1557 bp, Bacillus licheniformis; identical to SEQ ID NO: 3056
  CDS (369)..(1415)

SEQ ID NO: 15423 - protein, 348 aa, Bacillus licheniformis; identical to SEQ ID NO: 3057

SEQ ID NO: 15424 - DNA, 1119 bp, Corynebacterium diphtheriae; identical to SEQ ID NO: 3058
  CDS (1)..(1119)

SEQ ID NO: 15425 - protein, 372 aa, Corynebacterium diphtheriae; identical to SEQ ID NO: 3059

SEQ ID NO: 15426 - DNA, 1038 bp, Mycoplasma mycoides; identical to SEQ ID NO: 3060
  CDS (1)..(1038)

SEQ ID NO: 15427 - protein, 345 aa, Mycoplasma mycoides; identical to SEQ ID NO: 3061

SEQ ID NO: 15428 - DNA, 1134 bp, Bdellovibrio bacteriovorus; identical to SEQ ID NO: 3062
  CDS (1)..(1134)

SEQ ID NO: 15429 - protein, 377 aa, Bdellovibrio bacteriovorus; identical to SEQ ID NO: 3063

SEQ ID NO: 15430 - DNA, 1086 bp, Parachlamydia sp; identical to SEQ ID NO: 3064
  CDS (1)..(1086)

SEQ ID NO: 15431 - protein, 361 aa, Parachlamydia sp; identical to SEQ ID NO: 3065

SEQ ID NO: 15432 - DNA, 1071 bp, Photobacterium profundum; identical to SEQ ID NO: 3066

SEQ ID NO: 15433 - protein, 356 aa, Photobacterium profundum; identical to SEQ ID NO: 3067

SEQ ID NO: 15434 - DNA, 24 bp, Primer
atggctatcgacgaaaacaaacag

SEQ ID NO: 15435 - DNA, 27 bp, Primer
ttaaaaatcttcgttagtttctgctac

SEQ ID NO: 15436 - DNA, 1017 bp, Saccharomyces cerevisiae; identical to SEQ ID NO: 13239
  CDS (1)..(1017)

SEQ ID NO: 15437 - protein, 338 aa, Saccharomyces cerevisiae; identical to SEQ ID NO: 13240

SEQ ID NO: 15438 - DNA, 903 bp, Chlamydophila pneumoniae, Chlamydia pneumoniae; identical to SEQ ID NO: 13241
  CDS (1)..(903)

SEQ ID NO: 15439 - protein, 300 aa, Chlamydophila pneumoniae, Chlamydia pneumoniae; identical to SEQ ID NO: 13242

SEQ ID NO: 15440 - DNA, 948 bp, Agrobacterium tumefaciens; identical to SEQ ID NO: 13243
  CDS (1)..(948)

SEQ ID NO: 15441 - protein, 315 aa, Agrobacterium tumefaciens; identical to SEQ ID NO: 13244

SEQ ID NO: 15442 - DNA, 876 bp, Chlamydia muridarum, Chlamydia trachomatis MoPn; identical to SEQ ID NO: 13245
  CDS (1)..(876)

SEQ ID NO: 15443 - protein, 291 aa, Chlamydia muridarum, Chlamydia trachomatis MoPn; identical to SEQ ID NO: 13246

SEQ ID NO: 15444 - DNA, 876 bp, Chlamydia trachomatis; identical to SEQ ID NO: 13247
  CDS (1)..(876)

SEQ ID NO: 15445 - protein, 291 aa, Chlamydia trachomatis; identical to SEQ ID NO: 13248

SEQ ID NO: 15446 - DNA, 1023 bp, Caenorhabditis elegans; identical to SEQ ID NO: 13249
  CDS (1)..(1023)

SEQ ID NO: 15447 - protein, 340 aa, Caenorhabditis elegans; identical to SEQ ID NO: 13250

SEQ ID NO: 15448 - DNA, 1228 bp, Arabidopsis thaliana (mouse-ear cress); identical to SEQ ID NO: 13251
  CDS (30)..(1094)

SEQ ID NO: 15449 - protein, 354 aa, Arabidopsis thaliana (mouse-ear cress); identical to SEQ ID NO: 13252

SEQ ID NO: 15450 - DNA, 975 bp, Schizosaccharomyces pombe; identical to SEQ ID NO: 13253
  CDS (1)..(975)

SEQ ID NO: 15451 - protein, 324 aa, Schizosaccharomyces pombe; identical to SEQ ID NO: 13254

SEQ ID NO: 15452 - DNA, 1086 bp, Giardia lamblia ATCC 50803; identical to SEQ ID NO: 13255
  CDS (1)..(1086)

SEQ ID NO: 15453 - protein, 361 aa, Giardia lamblia ATCC 50803; identical to SEQ ID NO: 13256

SEQ ID NO: 15454 - DNA, 1107 bp, Plasmodium yoelii yoelii; identical to SEQ ID NO: 13257
  CDS (1)..(1107)

SEQ ID NO: 15455 - protein, 368 aa, Plasmodium yoelii yoelii; identical to SEQ ID NO: 13258

SEQ ID NO: 15456 - DNA, 1068 bp, Neurospora crassa; identical to SEQ ID NO: 13259
  CDS (1)..(1068)

SEQ ID NO: 15457 - protein, 355 aa, Neurospora crassa; identical to SEQ ID NO: 13260

SEQ ID NO: 15458 - DNA, 879 bp, Chlamydophila caviae; identical to SEQ ID NO: 13261
  CDS (1)..(879)

SEQ ID NO: 15459 - protein, 292 aa, Chlamydophila caviae; identical to SEQ ID NO: 13262

SEQ ID NO: 15460 - DNA, 936 bp, Encephalitozoon cuniculi; identical to SEQ ID NO: 13263
  CDS (1)..(936)

SEQ ID NO: 15461 - protein, 311 aa, Encephalitozoon cuniculi; identical to SEQ ID NO: 13264

SEQ ID NO: 15462 - DNA, 918 bp, Encephalitozoon cuniculi; identical to SEQ ID NO: 13265
  CDS (1)..(918)

SEQ ID NO: 15463 - protein, 305 aa, Encephalitozoon cuniculi; identical to SEQ ID NO: 13266

SEQ ID NO: 15464 - DNA, 1317 bp, Arabidopsis thaliana; identical to SEQ ID NO: 13267
  CDS (44)..(1084)

SEQ ID NO: 15465 - protein, 346 aa, Arabidopsis thaliana; identical to SEQ ID NO: 13268

SEQ ID NO: 15466 - DNA, 1179 bp, Drosophila melanogaster; identical to SEQ ID NO: 13269
  CDS (151)..(1098)

SEQ ID NO: 15467 - protein, 315 aa, Drosophila melanogaster; identical to SEQ ID NO: 13270

SEQ ID NO: 15468 - DNA, 1552 bp, Mus musculus; identical to SEQ ID NO: 13271
  CDS (380)..(1522)

SEQ ID NO: 15469 - protein, 380 aa, Mus musculus; identical to SEQ ID NO: 13272

SEQ ID NO: 15470 - DNA, 1233 bp, Ashbya gossypii; identical to SEQ ID NO: 13273
  CDS (1)..(1233)

SEQ ID NO: 15471 - protein, 410 aa, Ashbya gossypii; identical to SEQ ID NO: 13274

SEQ ID NO: 15472 - DNA, 1368 bp, Oryza sativa; identical to SEQ ID NO: 13275
  CDS (60)..(1118)

SEQ ID NO: 15473 - protein, 352 aa, Oryza sativa; identical to SEQ ID NO: 13276

SEQ ID NO: 15474 - DNA, 873 bp, Parachlamydia sp; identical to SEQ ID NO: 13277
  CDS (1)..(873)

SEQ ID NO: 15475 - protein, 290 aa, Parachlamydia sp; identical to SEQ ID NO: 13278

SEQ ID NO: 15476 - DNA, 26 bp, Primer
atgaatagcgtaaaaagagtaaagct

SEQ ID NO: 15477 - DNA, 23 bp, Primer
ctaggccaaagacatcttagcca

SEQ ID NO: 15478 - DNA, 1224 bp, Escherichia coli; identical to SEQ ID NO: 1403
  CDS (285)..(1166)

SEQ ID NO: 15479 - protein, 293 aa, Escherichia coli; identical to SEQ ID NO: 514

SEQ ID NO: 15480 - DNA, 882 bp, Yersinia pestis; identical to SEQ ID NO: 525
  CDS (1)..(882)

SEQ ID NO: 15481 - protein, 293 aa, Yersinia pestis; identical to SEQ ID NO: 526

SEQ ID NO: 15482 - DNA, 882 bp, Salmonella typhimurium; identical to SEQ ID NO: 1407
  CDS (1)..(882)

SEQ ID NO: 15483 - protein, 293 aa, Salmonella typhimurium; identical to SEQ ID NO: 524

SEQ ID NO: 15484 - DNA, 882 bp, Escherichia coli; identical to SEQ ID NO: 519
  CDS (1)..(882)

SEQ ID NO: 15485 - protein, 293 aa, Escherichia coli; identical to SEQ ID NO: 520

SEQ ID NO: 15486 - DNA, 864 bp, Vibrio cholerae; identical to SEQ ID NO: 531
  CDS (1)..(864)

SEQ ID NO: 15487 - protein, 287 aa, Vibrio cholerae; identical to SEQ ID NO: 532

SEQ ID NO: 15488 - DNA, 879 bp, Buchnera aphidicola str. APS (Acyrthosiphon pisum); identical to SEQ ID NO: 1413
  CDS (1)..(879)

SEQ ID NO: 15489 - protein, 292 aa, Buchnera aphidicola str. APS (Acyrthosiphon pisum); identical to SEQ ID NO: 528

SEQ ID NO: 15490 - DNA, 852 bp, Haemophilus influenzae; identical to SEQ ID NO: 533
  CDS (1)..(852)

SEQ ID NO: 15491 - protein, 283 aa, Haemophilus influenzae; identical to SEQ ID NO: 534

SEQ ID NO: 15492 - DNA, 879 bp, Buchnera aphidicola str. Sg (Schizaphis graminum); identical to SEQ ID NO: 537
  CDS (1)..(879)

SEQ ID NO: 15493 - protein, 292 aa, Buchnera aphidicola str. Sg (Schizaphis graminum); identical to SEQ ID NO: 538

SEQ ID NO: 15494 - DNA, 861 bp, Pasteurella multocida; identical to SEQ ID NO: 535
  CDS (1)..(861)

SEQ ID NO: 15495 - protein, 286 aa, Pasteurella multocida; identical to SEQ ID NO: 536

SEQ ID NO: 15496 - DNA, 882 bp, Escherichia coli; identical to SEQ ID NO: 1421
  CDS (1)..(882): r means g or a

SEQ ID NO: 15497 - protein, 293 aa, Escherichia coli; identical to SEQ ID NO: 1422
  misc_feature (288)..(288): Xaa can be Ala or Thr

SEQ ID NO: 15498 - DNA, 870 bp, Haemophilus ducreyi; identical to SEQ ID NO: 539
  CDS (1)..(870)

SEQ ID NO: 15499 - protein, 289 aa, Haemophilus ducreyi; identical to SEQ ID NO: 540

SEQ ID NO: 15500 - DNA, 777 bp, Vibrio vulnificus; identical to SEQ ID NO: 1425
  CDS (1)..(777)

SEQ ID NO: 15501 - protein, 258 aa, Vibrio vulnificus; identical to SEQ ID NO: 530

SEQ ID NO: 15502 - DNA, 879 bp, Xanthomonas axonopodis (pv. citri); identical to SEQ ID NO: 543
  CDS (1)..(879)

SEQ ID NO: 15503 - protein, 292 aa, Xanthomonas axonopodis (pv. citri); identical to SEQ ID NO: 544

SEQ ID NO: 15504 - DNA, 879 bp, Xanthomonas campestris (pv. campestris); identical to SEQ ID NO: 541
  CDS (1)..(879)

SEQ ID NO: 15505 - protein, 292 aa, Xanthomonas campestris (pv. campestris); identical to SEQ ID NO: 542

SEQ ID NO: 15506 - DNA, 22 bp, Primer
atgatgcgaatcgcgctcttcc

SEQ ID NO: 15507 - DNA, 24 bp, Primer
ttacttcaggtattcacccgtacg

SEQ ID NO: 15508 - DNA, 4195 bp, Saccharomyces cerevisiae; identical to SEQ ID NO: 5646
  CDS (654)..(2900)

SEQ ID NO: 15509 - protein, 748 aa, Saccharomyces cerevisiae; identical to SEQ ID NO: 5647

SEQ ID NO: 15510 - DNA, 2026 bp, Arabidopsis thaliana (mouse-ear cress); identical to SEQ ID NO: 5648
  CDS (1)..(1995)

SEQ ID NO: 15511 - protein, 664 aa, Arabidopsis thaliana (mouse-ear cress); identical to SEQ ID NO: 5649

SEQ ID NO: 15512 - DNA, 2070 bp, Arabidopsis thaliana (mouse-ear cress); identical to SEQ ID NO: 5650
  CDS (12)..(2039)

SEQ ID NO: 15513 - protein, 675 aa, Arabidopsis thaliana (mouse-ear cress); identical to SEQ ID NO: 5651

SEQ ID NO: 15514 - DNA, 2070 bp, Homo sapiens (man); identical to SEQ ID NO: 5652
  CDS (14)..(1996)

SEQ ID NO: 15515 - protein, 660 aa, Homo sapiens (man) [sequence omitted]

SEQ ID NO: 15516 - DNA, 2723 bp, Candida maltosa; identical to SEQ ID NO: 5654
  CDS (445)..(2619)

SEQ ID NO: 15517 - protein, 724 aa, Candida maltosa; identical to SEQ ID NO: 5655

SEQ ID NO: 15518 - DNA, 2975 bp, Candida maltosa; identical to SEQ ID NO: 5656
  CDS (406)..(2535)

SEQ ID NO: 15519 - protein, 709 aa, Candida maltosa; identical to SEQ ID NO: 5657

SEQ ID NO: 15520 - DNA, 2288 bp, Candida tropicalis; identical to SEQ ID NO: 5658
  CDS (153)..(2282)

SEQ ID NO: 15521 - protein, 709 aa, Candida tropicalis; identical to SEQ ID NO: 5659

SEQ ID NO: 15522 - DNA, 2845 bp, Candida tropicalis; identical to SEQ ID NO: 5660
  CDS (532)..(2661)

SEQ ID NO: 15523 - protein, 709 aa, Candida tropicalis; identical to SEQ ID NO: 5661

SEQ ID NO: 15524 - DNA, 2624 bp, Candida tropicalis; identical to SEQ ID NO: 5662
  CDS (457)..(2445)

SEQ ID NO: 15525 - protein, 662 aa, Candida tropicalis; identical to SEQ ID NO: 5663

SEQ ID NO: 15526 - DNA, 3741 bp, Rattus norvegicus (Norway rat); identical to SEQ ID NO: 5664
  CDS (74)..(2059)

SEQ ID NO: 15527 - protein, 661 aa, Rattus norvegicus (Norway rat); identical to SEQ ID NO: 5665

SEQ ID NO: 15528 - DNA, 1980 bp, Caenorhabditis elegans; identical to SEQ ID NO: 5666
  CDS (1)..(1980)

SEQ ID NO: 15529 - protein, 659 aa, Caenorhabditis elegans [sequence omitted]

SEQ ID NO: 15530 - DNA, 2273 bp, Hordeum vulgare (barley); identical to SEQ ID NO: 5668
  CDS (61)..(1992)

SEQ ID NO: 15531 - protein, 643 aa, Hordeum vulgare (barley); identical to SEQ ID NO: 5669

SEQ ID NO: 15532 - DNA, 2324 bp, Cucurbita sp. (cucurbit); identical to SEQ ID NO: 5670
  CDS (24)..(2096)

SEQ ID NO: 15533 - protein, 690 aa, Cucurbita sp. (cucurbit); identical to SEQ ID NO: 5671

SEQ ID NO: 15534 - DNA, 2040 bp, Caenorhabditis elegans; identical to SEQ ID NO: 5672
  CDS (1)..(2040)

SEQ ID NO: 15535 - protein, 679 aa, Caenorhabditis elegans; identical to SEQ ID NO: 5673

SEQ ID NO: 15536 - DNA, 1983 bp, Caenorhabditis elegans; identical to SEQ ID NO: 5674
  CDS (1)..(1983)

SEQ ID NO: 15537 - protein, 660 aa, Caenorhabditis elegans; identical to SEQ ID NO: 5675

SEQ ID NO: 15538 - DNA, 1989 bp, Caenorhabditis elegans; identical to SEQ ID NO: 5676
  CDS (1)..(1989)

SEQ ID NO: 15539 - protein, 662 aa, Caenorhabditis elegans; identical to SEQ ID NO: 5677

SEQ ID NO: 15540 - DNA, 2025 bp, Caenorhabditis elegans; identical to SEQ ID NO: 5678
  CDS (1)..(2025)

SEQ ID NO: 15541 - protein, 674 aa, Caenorhabditis elegans; identical to SEQ ID NO: 5679

SEQ ID NO: 15542 - DNA, 1806 bp, Caenorhabditis elegans; identical to SEQ ID NO: 5680
  CDS (1)..(1806)

SEQ ID NO: 15543 - protein, 601 aa, Caenorhabditis elegans; identical to SEQ ID NO: 5681

SEQ ID NO: 15544 - DNA, 2004 bp, Caenorhabditis elegans; identical to SEQ ID NO: 5682
  CDS (1)..(2004)

SEQ ID NO: 15545 - protein, 667 aa, Caenorhabditis elegans; identical to SEQ ID NO: 5683

SEQ ID NO: 15546 - DNA, 2004 bp, Caenorhabditis elegans; identical to SEQ ID NO: 5684
  CDS (1)..(2004)

SEQ ID NO: 15547 - protein, 667 aa, Caenorhabditis elegans; identical to SEQ ID NO: 5685

SEQ ID NO: 15548 - DNA, 1803 bp, Streptomyces coelicolor; identical to SEQ ID NO: 5686
  CDS (1)..(1803)

SEQ ID NO: 15549 - protein, 600 aa, Streptomyces coelicolor; identical to SEQ ID NO: 5687

SEQ ID NO: 15550 - DNA, 1926 bp, Streptomyces fradiae; identical to SEQ ID NO: 5688
  CDS (1)..(1926)

SEQ ID NO: 15551 - protein, 641 aa, Streptomyces fradiae; identical to SEQ ID NO: 5689

SEQ ID NO: 15552 - DNA, 2267 bp, Arabidopsis thaliana (mouse-ear cress); identical to SEQ ID NO: 5690
  CDS (8)..(2086)

SEQ ID NO: 15553 - protein, 692 aa, Arabidopsis thaliana (mouse-ear cress); identical to SEQ ID NO: 5691

SEQ ID NO: 15554 - DNA, 1995 bp, Arabidopsis thaliana (mouse-ear cress); identical to SEQ ID NO: 5692
  CDS (1)..(1995)

SEQ ID NO: 15555 - protein, 664 aa, Arabidopsis thaliana (mouse-ear cress); identical to SEQ ID NO: 5693

SEQ ID NO: 15556 - DNA, 2070 bp, Yarrowia lipolytica; identical to SEQ ID NO: 5694
  CDS (1)..(2070)

SEQ ID NO: 15557 - protein, 689 aa, Yarrowia lipolytica; identical to SEQ ID NO: 5695

SEQ ID NO: 15558 - DNA, 2103 bp, Yarrowia lipolytica; identical to SEQ ID NO: 5696
  CDS (1)..(2103)

SEQ ID NO: 15559 - protein, 700 aa, Yarrowia lipolytica; identical to SEQ ID NO: 5697

SEQ ID NO: 15560 - DNA, 2103 bp, Yarrowia lipolytica; identical to SEQ ID NO: 5698
  CDS (1)..(2103)

SEQ ID NO: 15561 - protein, 700 aa, Yarrowia lipolytica; identical to SEQ ID NO: 5699

SEQ ID NO: 15562 - DNA, 2106 bp, Yarrowia lipolytica; identical to SEQ ID NO: 5700
  CDS (1)..(2106)

SEQ ID NO: 15563 - protein, 701 aa, Yarrowia lipolytica; identical to SEQ ID NO: 5701

SEQ ID NO: 15564 - DNA, 2100 bp, Yarrowia lipolytica; identical to SEQ ID NO: 5702
  CDS (1)..(2100)

SEQ ID NO: 15565 - protein, 699 aa, Yarrowia lipolytica; identical to SEQ ID NO: 5703

SEQ ID NO: 15566 - DNA, 2365 bp, Phalaenopsis cv; identical to SEQ ID NO: 5704
  CDS (4)..(2103)

SEQ ID NO: 15567 - protein, 699 aa, Phalaenopsis cv; identical to SEQ ID NO: 5705

SEQ ID NO: 15568 - DNA, 1764 bp, Photorhabdus luminescens; identical to SEQ ID NO: 5706
  CDS (1)..(1764)

SEQ ID NO: 15569 - protein, 587 aa, Photorhabdus luminescens; identical to SEQ ID NO: 5707

SEQ ID NO: 15570 - DNA, 2085 bp, Anopheles gambiae str; identical to SEQ ID NO: 5708
  CDS (1)..(2085)

SEQ ID NO: 15571 - protein, 694 aa, Anopheles gambiae str; identical to SEQ ID NO: 5709

SEQ ID NO: 15572 - DNA, 3798 bp, Brachydanio rerio; identical to SEQ ID NO: 5710
  CDS (73)..(2151)

SEQ ID NO: 15573 - protein, 692 aa, Brachydanio rerio; identical to SEQ ID NO: 5711

SEQ ID NO: 15574 - DNA, 3977 bp, Mus musculus; identical to SEQ ID NO: 5712
  CDS (187)..(2289)

SEQ ID NO: 15575 - protein, 700 aa, Mus musculus; identical to SEQ ID NO: 5713

SEQ ID NO: 15576 - DNA, 1710 bp, Bacillus cereus; identical to SEQ ID NO: 5714
  CDS (1)..(1710)

SEQ ID NO: 15577 - protein, 569 aa, Bacillus cereus; identical to SEQ ID NO: 5715

SEQ ID NO: 15578 - DNA, 1710 bp, Bacillus anthracis; identical to SEQ ID NO: 5716
  CDS (1)..(1710)

SEQ ID NO: 15579 - protein, 569 aa, Bacillus anthracis; identical to SEQ ID NO: 5717

SEQ ID NO: 15580 - DNA, 1152 bp, Streptomyces avermitilis; identical to SEQ ID NO: 5718
  CDS (1)..(1152)

SEQ ID NO: 15581 - protein, 383 aa, Streptomyces avermitilis; identical to SEQ ID NO: 5719

SEQ ID NO: 15582 - DNA, 2022 bp, Streptomyces avermitilis; identical to SEQ ID NO: 5720
  CDS (1)..(2022)

SEQ ID NO: 15583 - protein, 673 aa, Streptomyces avermitilis; identical to SEQ ID NO: 5721

SEQ ID NO: 15584 - DNA, 1863 bp, Dictyostelium discoideum; identical to SEQ ID NO: 5722
  CDS (211)..(1863)

SEQ ID NO: 15585 - protein, 550 aa, Dictyostelium discoideum; identical to SEQ ID NO: 5723

SEQ ID NO: 15586 - DNA, 1866 bp, Dictyostelium discoideum; identical to SEQ ID NO: 5724
  CDS (214)..(1866)

SEQ ID NO: 15587 - protein, 550 aa, Dictyostelium discoideum; identical to SEQ ID NO: 5725

SEQ ID NO: 15588 - DNA, 1986 bp, Mus musculus; identical to SEQ ID NO: 5726
  CDS (1)..(1986)

SEQ ID NO: 15589 - protein, 661 aa, Mus musculus; identical to SEQ ID NO: 5727

SEQ ID NO: 15590 - DNA, 3977 bp, Mus musculus; identical to SEQ ID NO: 5712
  CDS (187)..(2289)

SEQ ID NO: 15591 - protein, 700 aa, Mus musculus; identical to SEQ ID NO: 5713

SEQ ID NO: 15592 - DNA, 2323 bp, Oryza sativa; identical to SEQ ID NO: 5730
  CDS (43)..(2052)

SEQ ID NO: 15593 - protein, 669 aa, Oryza sativa; identical to SEQ ID NO: 5731

SEQ ID NO: 15594 - DNA, 2466 bp, Mus musculus; identical to SEQ ID NO: 5732
  CDS (152)..(2197)

SEQ ID NO: 15595 - protein, 681 aa, Mus musculus; identical to SEQ ID NO: 5733

SEQ ID NO: 15596 - DNA, 2254 bp, Glycine max; identical to SEQ ID NO: 5734
  CDS (119)..(2116)

SEQ ID NO: 15597 - protein, 665 aa, Glycine max; identical to SEQ ID NO: 5735

SEQ ID NO: 15598 - DNA, 2263 bp, Glycine max; identical to SEQ ID NO: 5736
  CDS (140)..(2134)

SEQ ID NO: 15599 - protein, 664 aa, Glycine max; identical to SEQ ID NO: 5737

SEQ ID NO: 15600 - DNA, 2549 bp, Drosophila melanogaster; identical to SEQ ID NO: 5738
  CDS (337)..(2346)

SEQ ID NO: 15601 - protein, 669 aa, Drosophila melanogaster; identical to SEQ ID NO: 5739

SEQ ID NO: 15602 - DNA, 2371 bp, Homo sapiens; identical to SEQ ID NO: 5740
  CDS (79)..(1953)

SEQ ID NO: 15603 - protein, 624 aa, Homo sapiens; identical to SEQ ID NO: 5741

SEQ ID NO: 15604 - DNA, 2844 bp, Mus musculus; identical to SEQ ID NO: 5742
  CDS (209)..(2107)

SEQ ID NO: 15605 - protein, 632 aa, Mus musculus; identical to SEQ ID NO: 5743

SEQ ID NO: 15606 - DNA, 2028 bp, Arabidopsis thaliana; identical to SEQ ID NO: 5744
  CDS (1)..(2028)

SEQ ID NO: 15607 - protein, 675 aa, Arabidopsis thaliana; identical to SEQ ID NO: 5745

SEQ ID NO: 15608 - DNA, 2085 bp, Petroselinum crispum; identical to SEQ ID NO: 5746
  CDS (1)..(2085)

SEQ ID NO: 15609 - protein, 694 aa, Petroselinum crispum; identical to SEQ ID NO: 5747

SEQ ID NO: 15610 - DNA, 2464 bp, Drosophila melanogaster; identical to SEQ ID NO: 5748
  CDS (80)..(2161)

SEQ ID NO: 15611 - protein, 693 aa, Drosophila melanogaster; identical to SEQ ID NO: 5749

SEQ ID NO: 15612 - DNA, 2216 bp, Drosophila melanogaster; identical to SEQ ID NO: 5750
  CDS (56)..(2167)

SEQ ID NO: 15613 - protein, 703 aa, Drosophila melanogaster; identical to SEQ ID NO: 5751

SEQ ID NO: 15614 - DNA, 2137 bp, Drosophila melanogaster; identical to SEQ ID NO: 5752
  CDS (104)..(2137)

SEQ ID NO: 15615 - protein, 677 aa, Drosophila melanogaster; identical to SEQ ID NO: 5753

SEQ ID NO: 15616 - DNA, 2352 bp, Drosophila melanogaster; identical to SEQ ID NO: 5754
  CDS (319)..(2352)

SEQ ID NO: 15617 - protein, 677 aa, Drosophila melanogaster; identical to SEQ ID NO: 5755

SEQ ID NO: 15618 - DNA, 2142 bp, Drosophila melanogaster; identical to SEQ ID NO: 5756
  CDS (1)..(963)

SEQ ID NO: 15619 - protein, 320 aa, Drosophila melanogaster; identical to SEQ ID NO: 5757

SEQ ID NO: 15620 - DNA, 2378 bp, Pichia pastoris; identical to SEQ ID NO: 5758
  CDS (100)..(2259)

SEQ ID NO: 15621 - protein, 719 aa, Pichia pastoris; identical to SEQ ID NO: 5759

SEQ ID NO: 15622 - DNA, 2210 bp, Cavia porcellus; identical to SEQ ID NO: 5760
  CDS (40)..(2025)

SEQ ID NO: 15623 - protein, 661 aa, Cavia porcellus; identical to SEQ ID NO: 5761

SEQ ID NO: 15624 - DNA, 3445 bp, Homo sapiens; identical to SEQ ID NO: 5762
  CDS (272)..(2254)

SEQ ID NO: 15625 - protein, 660 aa, Homo sapiens; identical to SEQ ID NO: 5763

SEQ ID NO: 15626 - DNA, 3778 bp, Mus musculus; identical to SEQ ID NO: 5764
  CDS (81)..(2066): k means g or t/u, r means g or a

SEQ ID NO: 15627 - protein, 661 aa, Mus musculus; identical to SEQ ID NO: 5765
  misc_feature (277)..(277): Xaa can be Ala or Thr
  misc_feature (279)..(279): Xaa can be Gly or Val

SEQ ID NO: 15628 - DNA, 2039 bp, Phascolarctos cinereus; identical to SEQ ID NO: 5766
  CDS (52)..(2037)

SEQ ID NO: 15629 - protein, 661 aa, Phascolarctos cinereus; identical to SEQ ID NO: 5767

SEQ ID NO: 15630 - DNA, 2225 bp, Homo sapiens; identical to SEQ ID NO: 5768
  CDS (93)..(2138)

SEQ ID NO: 15631 - protein, 681 aa, Homo sapiens; identical to SEQ ID NO: 5769

SEQ ID NO: 15632 - DNA, 2139 bp, Oryctolagus cuniculus; identical to SEQ ID NO: 5770
  CDS (77)..(2122)

SEQ ID NO: 15633 - protein, 681 aa, Oryctolagus cuniculus; identical to SEQ ID NO: 5771

SEQ ID NO: 15634 - DNA, 2509 bp, Rattus norvegicus; identical to SEQ ID NO: 5772
  CDS (198)..(2243)

SEQ ID NO: 15635 - protein, 681 aa, Rattus norvegicus; identical to SEQ ID NO: 5773

SEQ ID NO: 15636 - DNA, 2415 bp, Homo sapiens; identical to SEQ ID NO: 5774
  CDS (71)..(2173)

SEQ ID NO: 15637 - protein, 700 aa, Homo sapiens; identical to SEQ ID NO: 5775

SEQ ID NO: 15638 - DNA, 2600 bp, Rattus norvegicus; identical to SEQ ID NO: 5776
  CDS (41)..(2143)

SEQ ID NO: 15639 - protein, 700 aa, Rattus norvegicus; identical to SEQ ID NO: 5777

SEQ ID NO: 15640 - DNA, 2178 bp, Candida tropicalis; identical to SEQ ID NO: 5778

SEQ ID NO: 15641 - protein, 718 aa, Candida tropicalis; identical to SEQ ID NO: 5779

SEQ ID NO: 15642 - DNA, 3670 bp, Xenopus laevis; identical to SEQ ID NO: 5780
  CDS (10)..(1995)

SEQ ID NO: 15643 - protein, 661 aa, Xenopus laevis; identical to SEQ ID NO: 5781

SEQ ID NO: 15644 - DNA, 2476 bp, Xenopus laevis; identical to SEQ ID NO: 5782
  CDS (69)..(2081)

SEQ ID NO: 15645 - protein, 670 aa, Xenopus laevis; identical to SEQ ID NO: 5783

SEQ ID NO: 15646 - DNA, 1953 bp, Mycobacterium paratuberculosis; identical to SEQ ID NO: 5784
  CDS (1)..(1953)

SEQ ID NO: 15647 - protein, 650 aa, Mycobacterium paratuberculosis; identical to SEQ ID NO: 5785

SEQ ID NO: 15648 - DNA, 2166 bp, Ashbya gossypii; identical to SEQ ID NO: 5786
  CDS (1)..(2166)

SEQ ID NO: 15649 - protein, 721 aa, Ashbya gossypii; identical to SEQ ID NO: 5787

SEQ ID NO: 15650 - DNA, 2025 bp, Caenorhabditis elegans; identical to SEQ ID NO: 5678
  CDS (337)..(2025)

SEQ ID NO: 15651 - protein, 562 aa, Caenorhabditis elegans; identical to SEQ ID NO: 5789

SEQ ID NO: 15652 - DNA, 25 bp, Primer
atgacgagacgtactactattaatc

SEQ ID NO: 15653 - DNA, 28 bp, Primer
tcacttgtttattttcgataaaatttcc

SEQ ID NO: 15654 - DNA, 1980 bp, Saccharomyces cerevisiae; identical to SEQ ID NO: 13
  CDS (1)..(1980)

SEQ ID NO: 15655 - protein, 659 aa, Saccharomyces cerevisiae; identical to SEQ ID NO: 14

SEQ ID NO: 15656 - DNA, 26 bp, Primer
atggatagtacgaatttgaacaaacg

SEQ ID NO: 15657 - DNA, 26 bp, Primer
ttagagtatttccagatctgaatctg

SEQ ID NO: 15658 - protein, 29 aa, consensus
  MISC_FEATURE (1)..(29): consensus for the disclosure of xaa see table XV
XXXHXXXEXXXRXXXXXXXXXLXXXXPXX

SEQ ID NO: 15659 - protein, 18 aa, consensus
  MISC_FEATURE (1)..(18): consensus for the disclosure of xaa see table XV
KXXXXXXXXKXXXXXXXX

SEQ ID NO: 15660 - protein, 110 aa, consensus
  MISC_FEATURE (1)..(110): Xaa in all positions is any amino acid.
KXXXXXXXXXXXXXXHNXIEKXYRXNINXKXXXLXXXXPXXXXXXXXXXXXXXXXXXXXXXXXXXXXXXXXXXXXXXXKLNKXXILXKAXXYIXXLXXXXXXXXXXXXXL

SEQ ID NO: 15661 - protein, 13 aa, consensus
  MISC_FEATURE (1)..(13): consensus for the disclosure of xaa see table XV
XXXXXGXXXXXKG

SEQ ID NO: 15662 - protein, 5 aa, consensus
  MISC_FEATURE (1)..(5): consensus for the disclosure of xaa see table XV
XGXXE

SEQ ID NO: 15663 - protein, 7 aa, consensus
  MISC_FEATURE (1)..(7): consensus for the disclosure of xaa see table XV
XXXXGDX

SEQ ID NO: 15664 - protein, 57 aa, consensus
  MISC_FEATURE (1)..(57): consensus for the disclosure of xaa see table XV
XXSGXXXXXXGXXXXXXXXXXXXXXXXXXXXXXXXXXXXXXXXXXXXXXXXPXXHXX

SEQ ID NO: 15665 - protein, 72 aa, consensus
  MISC_FEATURE (1)..(72): consensus for the disclosure of xaa see table XV
XXGXTEXXXXXXXXXXXXXXXXXXXXXXXGXXXXXXXXXXXXXXXXXXXXXXXXXXXXGXXXXXXXXXGXXY

SEQ ID NO: 15666 - protein, 51 aa, consensus
  MISC_FEATURE (1)..(51): consensus for the disclosure of xaa see table XV
XXXXXGDXXXXXXXXXXXXXXXXXXXXXXXXRXKXXXXXXXGXXXXXXXXE

SEQ ID NO: 15667 - protein, 71 aa, consensus
  MISC_FEATURE (1)..(71): consensus for the disclosure of xaa see table XV
MXLPXEIXLXXXXXXPXXXRXXNXYXXXLXNXXYXXKXXXXXXXXXYXXXXXKXXLXXYVXSXDXXRXXXR

SEQ ID NO: 15668 - protein, 19 aa, consensus
  MISC_FEATURE (1)..(19): Xaa in all positions is any amino acid.
PLXXXXYXXDSWXIXYNXL

SEQ ID NO: 15669 - protein, 47 aa, consensus
  MISC_FEATURE (1)..(47): consensus for the disclosure of xaa see table XV
RYIPKXXTXIXXXXXXXXXXXXXXXXIXELIXSXXXXXVNXXXLXRL

SEQ ID NO: 15670 - protein, 345 aa, consensus
  MISC_FEATURE (1)..(345): Xaa in all positions is any amino acid.
MXLPXEIXLXXXXXXPXXXRXXNXYXXXLXNXXYXXKXXXXXXXXXYXXXXXKXXLXXYVXSXDXXRXXXRXXXXXXXXXXXXXPLXXXXYXXDSWXIXYNXLXXXXXIXXXXXXXXXKXXXXXXXXSXSXXXXXPXXXXLXXSXXAXXXXXXXXXXXXXXXVXXXFXXXXXXXXRYIPKXXTXIXXXXXXXXXXXXXXXXIXELIXSXXXXXVNXXXLXRLXXXXXXEXXXXXXXXXXXXXXXXXXXXXXXNXXXXXLGYXXXXXXXXXXXLXXXXXXXXXXXXXXXXXXXXXXXXXXXXLXXXXXXXXISXXXXXXXXXXLXXXXXXXXXXXXXXXXXXXXDL

SEQ ID NO: 15671 - protein, 73 aa, consensus
  MISC_FEATURE (1)..(73): consensus for the disclosure of xaa see table XV
MXXXFXXXXXHXXXVLXXYRXXLRXXXXXXXSXXXXXXXXXXXXXXXXKHXXXXSSWXXXXXLXXXXXLXXXL

SEQ ID NO: 15672 - protein, 41 aa, consensus
  MISC_FEATURE (1)..(41): consensus for the disclosure of xaa see table XV
DXXXXXXXXXXXXYXXXXXXXXLLXXXIPXXYXXKLXXPLA

SEQ ID NO: 15673 - protein, 39 aa, consensus
  MISC_FEATURE (1)..(39): consensus for the disclosure of xaa see table XV
AXLSXTXXGXXXXWFXRSXXNXXXXQSXXLXXXIXXXXX

SEQ ID NO: 15674 - protein, 17 aa, consensus
  MISC_FEATURE (1)..(17): consensus for the disclosure of xaa see table XV
WAXHEAXWEXXLXXXXX

SEQ ID NO: 15675 - protein, 64 aa, consensus
  MISC_FEATURE (1)..(64): consensus for the disclosure of xaa see table XV
XRXXXXXKXKXXXXXXXXXXXXXXXKXXXXXXXXXXXXXXXXXXXLXXVXXFXXXXXXXSXLXX

SEQ ID NO: 15676 - protein, 369 aa, consensus
  MISC_FEATURE (1)..(369): Xaa in all positions is any amino acid.
MXXXFXXXXXHXXXVLXXYRXXLRXXXXXXXSXXXXXXXXXXXXXXXXKHXXXXSSWXXXXXLXXXXXLXXXLXXXXXXXXXXXXXXXXXXXXXXXXXXXXXXXXXXXXXXXXXXXXDXXXXXXXXXXXXYXXXXXXXXLLXXXIPXXYXXKLXXPLAXXXXXXXXLXXXXXXXXXXXXXAXLSXTXXGXXXXWFXRSXXNXXXXQSXXLXXXIXXXXXXXXXXXXXXXXXXXXXXWAXHEAXWEXXLXXXXXXXXXXXXXXXXXXXXXXXXXXXXXXXXXXXXXXXXXXWXXPXXXXXXXXXXXXXXRXXXXXKXKXXXXXXXXXXXXXXXKXXXXXXXXXXXXXXXXXXXLXXVXXFXXXXXXXSXL

SEQ ID NO: 15677 - protein, 57 aa, consensus
  MISC_FEATURE (1)..(57): consensus for the disclosure of xaa see table XV
XXXLXXLXXXXAXXAVPXGXXYRXXDXPXSNCXNSXXXKXXXXXXQXNXXXXXXXXX

SEQ ID NO: 15678 - protein, 68 aa, consensus
  MISC_FEATURE (1)..(68): consensus for the disclosure of xaa see table XV
GXVXXXAXXXXXXXXXXXWFXXXAXXXXXXXWXXXXXXXXXXXXXXXXXLXGXXXXXXXXDXXYXMXY

SEQ ID NO: 15679 - protein, 31 aa, consensus
  MISC_FEATURE (1)..(31): consensus for the disclosure of xaa see table XV
XXXXXGLXXXDXXGXXXXFXEXXXXXXXXXM

SEQ ID NO: 15680 - protein, 68 aa, consensus
  MISC_FEATURE (1)..(68): consensus for the disclosure of xaa see table XV
DFGXEXXPXXXXXXXXXXXXXXXXYWEDXGXXXXFXXXXXXXXXXXXXXFXXXXXXXXXXTXXXXXPP

SEQ ID NO: 15681 - protein, 527 aa, consensus
  MISC_FEATURE (1)..(527): Xaa in all positions is any amino acid.
VXXXILGGGXGTXLXPLTXXRAXPAVPXGXXYRLIDIPXSNCXNSXIXKXIXXLTQFNSASXLNRHXXXXXXXXXGXXXXXGXVEVLAAXQXPXXXXXXWFQGTADAVRXXXWXFEXXXXXXXXXXXLXLXGXXXXXXXXDHLYRMDYXXXXQXHXXXXADITXXXXPXXXXXXXXXXXXXXXXXXXXXXXXXXXXXRAXXXGLXKIDXXGRXXXFXEKPKGXXLXXMXVDTXXLGLXXXXXAXXXPYIASMGXXYVXXXXXXLXLLXXXXXXXXXXXXXXXXXXXPXXNDFGSEXIPXAXXXXXXXXAYXXXXYWEDIGTIXXFXXANLXXTXXXXPXFXFYDXXXPXXTXXRXLPPXKXXXXXXXXXDXXIXXGCXXXXXCXXXHSXXGXRSXXXXGXXXXDXXXMGADXYXTXXXXXXLXXXGXXPIGXGXNXXIXXXXXXXXXXXXXXXXXXXXXXXXXXXXXXXXIIDKNAXIGXXVXIXNXXXXVQEAXRXXXGXXXXIXSGIXXXXXXAXXXXIXXGXXI

SEQ ID NO: 15682 - protein, 20 aa, consensus
  MISC_FEATURE (1)..(20): consensus for the disclosure of xaa see table XV
PXXXXXXXXXXXXGXNGKXX

SEQ ID NO: 15683 - protein, 74 aa, consensus
  MISC_FEATURE (1)..(74): consensus for the disclosure of xaa see table XV
XXFEXXXXXXXXXXXXXXXXXXXXXEXGXXGXXDXTXXXXXXXXXXXXXXXXXXXHXXXLGXXXXXXXXXKXXX

SEQ ID NO: 15684 - protein, 8 aa, consensus
  MISC_FEATURE (1)..(8): consensus for the disclosure of xaa see table XV
XXXDXXHN

SEQ ID NO: 15685 - protein, 542 aa, consensus
  MISC_FEATURE (1)..(542): Xaa in all positions is any amino acid.
LXXXXXXXXXXXXXXXXXXXXXXXXXXXXXXXXXXXXXXXXXXXXXXXPXXXXXXXXXHXXGTNGKGSXXXXXXXXXXXXXXXXXXXXXGXXTSPXXXXXXERXXXXIXXXXXXXXXXXXXXXXXXXXXXXXXXXXXXXXXXXXXXXXXXXFEXXTXXXXXXFXXXXXXDXXXXEXGXGGXXDXTNXXXXXXXXXXXXXXXXXDHXXXLGXXXXXIAXXKXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXQXXNXXXAXXXXXXXXXXXXXXXXXXXXXXXXXXXXXXXXXXRXXXXXXXXXXXXXXXXXXXXXXXXXDXAHNXXXXXXLXXXXXXXXXXXXXXXXXXXXXXXXXXXKXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGS

SEQ ID NO: 15686 - protein, 11 aa, consensus
  MISC_FEATURE (1)..(11): consensus for the disclosure of xaa see table XV
XXXXXXXXXXX

SEQ ID NO: 15687 - protein, 14 aa, consensus
  MISC_FEATURE (1)..(14): consensus for the disclosure of xaa see table XV
XXPXXXXXXXXXGX

SEQ ID NO: 15688 - protein, 80 aa, consensus; identical to SEQ ID NO: 7429
  MISC_FEATURE (1)..(80): Xaa in all positions is any amino acid.

SEQ ID NO: 15689 - protein, 60 aa, consensus; identical to SEQ ID NO: 1957
  MISC_FEATURE (1)..(60): consensus for the disclosure of xaa see table XV
  for the disclosure of the amendment in position 16 see table XVI

SEQ ID NO: 15690 - protein, 569 aa, consensus; identical to SEQ ID NO: 5817
  MISC_FEATURE (1)..(569): Xaa in all position is any amino acid

SEQ ID NO: 15691 - protein, 197 aa, consensus; identical to SEQ ID NO: 7423
  MISC_FEATURE (1)..(197): consensus for the disclosure of xaa see table XV

SEQ ID NO: 15692 - protein, 196 aa, consensus; identical to SEQ ID NO: 1959
  MISC_FEATURE (1)..(196): xaa in all positions is any amino acid
  for the disclosure of the amendment in position 106 see table XVI

SEQ ID NO: 15693 - protein, 33 aa, consensus; identical to SEQ ID NO: 4356
  MISC_FEATURE (1)..(33): consensus for the disclosure of xaa see table XV

SEQ ID NO: 15694 - protein, 36 aa, consensus; identical to SEQ ID NO: 4357
  MISC_FEATURE (1)..(36): consensus for the disclosure of xaa see table XV

SEQ ID NO: 15695 - protein, 39 aa, consensus; identical to SEQ ID NO: 4358
  MISC_FEATURE (1)..(39): consensus for the disclosure of xaa see table XV

SEQ ID NO: 15696 - protein, 323 aa, consensus; identical to SEQ ID NO: 5813
  MISC_FEATURE (1)..(323): Xaa in all positions is any amino acid.

SEQ ID NO: 15697 - protein, 35 aa, consensus; identical to SEQ ID NO: 13778
  MISC_FEATURE (1)..(35): consensus for the disclosure of xaa see table XV

SEQ ID NO: 15698 - protein, 20 aa, consensus
  MISC_FEATURE (1)..(20): consensus for the disclosure of xaa see table XV
DVXXXXXXXDXXXDHHXXXX

SEQ ID NO: 15699 - protein, 9 aa, consensus
  MISC_FEATURE (1)..(9): consensus for the disclosure of xaa see table XV
SSXGXXXXX

SEQ ID NO: 15700 - protein, 15 aa, consensus
  MISC_FEATURE (1)..(15): consensus for the disclosure of xaa see table XV
XXXXXXXXXDXXDNG

SEQ ID NO: 15701 - protein, 42 aa, consensus; identical to SEQ ID NO: 13782
  MISC_FEATURE (1)..(42): consensus for the disclosure of xaa see table XV

SEQ ID NO: 15702 - protein, 344 aa, consensus; identical to SEQ ID NO: 13783
  MISC_FEATURE (1)..(344): Xaa in all positions is any amino acid.

SEQ ID NO: 15703 - protein, 136 aa, consensus; identical to SEQ ID NO: 10195
  MISC_FEATURE (1)..(136): Xaa in all positions is any amino acid.

SEQ ID NO: 15704 - protein, 46 aa, consensus; identical to SEQ ID NO: 546
  MISC_FEATURE (1)..(46): xaa in  all positions is any amino acid.

SEQ ID NO: 15705 - protein, 289 aa, consensus; identical to SEQ ID NO: 10197
  MISC_FEATURE (1)..(289): Xaa in all positions is any amino acid.

SEQ ID NO: 15706 - protein, 19 aa, consensus
  MISC_FEATURE (1)..(19): consensus for the disclosure of xaa see table XV
  for the disclosure of the amendment in position 4 see table XVI
XXXXEXXXGXXXXXXXXXX

SEQ ID NO: 15707 - protein, 607 aa, consensus; identical to SEQ ID NO: 5815
  MISC_FEATURE (1)..(607): Xaa in all positions is any amino acid
  for the disclosure of the amendment in position 223 see table XVI

SEQ ID NO: 15708 - DNA, 1612 bp, Saccharomyces cerevisiae; identical to SEQ ID NO: 1
  CDS (167)..(1330)

SEQ ID NO: 15709 - protein, 387 aa, Saccharomyces cerevisiae; identical to SEQ ID NO: 2

SEQ ID NO: 15710 - DNA, 25 bp, Primer
atggaacagaacaggttcaagaaag

SEQ ID NO: 15711 - DNA, 27 bp, Primer
ttacagtttttgtttagtcgttttaac

SEQ ID NO: 15712 - DNA, 1032 bp, Saccharomyces cerevisiae; identical to SEQ ID NO: 5
  CDS (1)..(1032)

SEQ ID NO: 15713 - protein, 343 aa, Saccharomyces cerevisiae; identical to SEQ ID NO: 6

SEQ ID NO: 15714 - DNA, 960 bp, Eremothecium gossypii; identical to SEQ ID NO: 7
  CDS (1)..(960)

SEQ ID NO: 15715 - protein, 319 aa, Eremothecium gossypii; identical to SEQ ID NO: 8

SEQ ID NO: 15716 - DNA, 1473 bp, Saccharomyces cerevisiae; identical to SEQ ID NO: 9
  CDS (1)..(1473)

SEQ ID NO: 15717 - protein, 490 aa, Saccharomyces cerevisiae; identical to SEQ ID NO: 10

SEQ ID NO: 15718 - DNA, 26 bp, Primer
atgagtaatgcaaacaatagtgctat

SEQ ID NO: 15719 - DNA, 25 bp, Primer
tcaatggtatttatagccgcattgt

SEQ ID NO: 15720 - DNA, 1017 bp, Saccharomyces cerevisiae; identical to SEQ ID NO: 13239
  CDS (1)..(1017)

SEQ ID NO: 15721 - protein, 338 aa, Saccharomyces cerevisiae; identical to SEQ ID NO: 13240

SEQ ID NO: 15722 - DNA, 903 bp, Chlamydophila pneumoniae, Chlamydia pneumoniae; identical to SEQ ID NO: 13241
  CDS (1)..(903)

SEQ ID NO: 15723 - protein, 300 aa, Chlamydophila pneumoniae, Chlamydia pneumoniae; identical to SEQ ID NO: 13242

SEQ ID NO: 15724 - DNA, 948 bp, Agrobacterium tumefaciens; identical to SEQ ID NO: 13243
  CDS (1)..(948)

SEQ ID NO: 15725 - protein, 315 aa, Agrobacterium tumefaciens; identical to SEQ ID NO: 13244

SEQ ID NO: 15726 - DNA, 876 bp, Chlamydia muridarum, Chlamydia trachomatis MoPn; identical to SEQ ID NO: 13245
  CDS (1)..(876)

SEQ ID NO: 15727 - protein, 291 aa, Chlamydia muridarum, Chlamydia trachomatis MoPn; identical to SEQ ID NO: 13246

SEQ ID NO: 15728 - DNA, 876 bp, Chlamydia trachomatis; identical to SEQ ID NO: 13247
  CDS (1)..(876)

SEQ ID NO: 15729 - protein, 291 aa, Chlamydia trachomatis; identical to SEQ ID NO: 13248

SEQ ID NO: 15730 - DNA, 1023 bp, Caenorhabditis elegans; identical to SEQ ID NO: 13249
  CDS (1)..(1023)

SEQ ID NO: 15731 - protein, 340 aa, Caenorhabditis elegans; identical to SEQ ID NO: 13250

SEQ ID NO: 15732 - DNA, 1228 bp, Arabidopsis thaliana (mouse-ear cress); identical to SEQ ID NO: 13251
  CDS (30)..(1094)

SEQ ID NO: 15733 - protein, 354 aa, Arabidopsis thaliana (mouse-ear cress); identical to SEQ ID NO: 13252

SEQ ID NO: 15734 - DNA, 975 bp, Schizosaccharomyces pombe; identical to SEQ ID NO: 13253
  CDS (1)..(975)

SEQ ID NO: 15735 - protein, 324 aa, Schizosaccharomyces pombe; identical to SEQ ID NO: 13254

SEQ ID NO: 15736 - DNA, 1086 bp, Giardia lamblia ATCC 50803; identical to SEQ ID NO: 13255
  CDS (1)..(1086)

SEQ ID NO: 15737 - protein, 361 aa, Giardia lamblia ATCC 50803; identical to SEQ ID NO: 13256

SEQ ID NO: 15738 - DNA, 1107 bp, Plasmodium yoelii yoelii; identical to SEQ ID NO: 13257
  CDS (1)..(1107)

SEQ ID NO: 15739 - protein, 368 aa, Plasmodium yoelii yoelii; identical to SEQ ID NO: 13258

SEQ ID NO: 15740 - DNA, 1068 bp, Neurospora crassa; identical to SEQ ID NO: 13259
  CDS (1)..(1068)

SEQ ID NO: 15741 - protein, 355 aa, Neurospora crassa; identical to SEQ ID NO: 13260

SEQ ID NO: 15742 - DNA, 879 bp, Chlamydophila caviae; identical to SEQ ID NO: 13261
  CDS (1)..(879)

SEQ ID NO: 15743 - protein, 292 aa, Chlamydophila caviae; identical to SEQ ID NO: 13262

SEQ ID NO: 15744 - DNA, 936 bp, Encephalitozoon cuniculi; identical to SEQ ID NO: 13263
  CDS (1)..(936)

SEQ ID NO: 15745 - protein, 311 aa, Encephalitozoon cuniculi; identical to SEQ ID NO: 13264

SEQ ID NO: 15746 - DNA, 918 bp, Encephalitozoon cuniculi; identical to SEQ ID NO: 13265
  CDS (1)..(918)

SEQ ID NO: 15747 - protein, 305 aa, Encephalitozoon cuniculi; identical to SEQ ID NO: 13266

SEQ ID NO: 15748 - DNA, 1317 bp, Arabidopsis thaliana; identical to SEQ ID NO: 13267
  CDS (44)..(1084)

SEQ ID NO: 15749 - protein, 346 aa, Arabidopsis thaliana; identical to SEQ ID NO: 13268

SEQ ID NO: 15750 - DNA, 1179 bp, Drosophila melanogaster; identical to SEQ ID NO: 13269
  CDS (151)..(1098)

SEQ ID NO: 15751 - protein, 315 aa, Drosophila melanogaster; identical to SEQ ID NO: 13270

SEQ ID NO: 15752 - DNA, 1552 bp, Mus musculus; identical to SEQ ID NO: 13271
  CDS (380)..(1522)

SEQ ID NO: 15753 - protein, 380 aa, Mus musculus; identical to SEQ ID NO: 13272

SEQ ID NO: 15754 - DNA, 1233 bp, Ashbya gossypii; identical to SEQ ID NO: 13273
  CDS (1)..(1233)

SEQ ID NO: 15755 - protein, 410 aa, Ashbya gossypii; identical to SEQ ID NO: 13274

SEQ ID NO: 15756 - DNA, 1368 bp, Oryza sativa; identical to SEQ ID NO: 13275
  CDS (60)..(1118)

SEQ ID NO: 15757 - protein, 352 aa, Oryza sativa; identical to SEQ ID NO: 13276

SEQ ID NO: 15758 - DNA, 873 bp, Parachlamydia sp; identical to SEQ ID NO: 13277
  CDS (1)..(873)

SEQ ID NO: 15759 - protein, 290 aa, Parachlamydia sp; identical to SEQ ID NO: 13278

SEQ ID NO: 15760 - DNA, 26 bp, Primer
atgaatagcgtaaaaagagtaaagct

SEQ ID NO: 15761 - DNA, 23 bp, Primer
ctaggccaaagacatcttagcca

SEQ ID NO: 15762 - DNA, 603 bp, Saccharomyces cerevisiae; identical to SEQ ID NO: 1305
  CDS (1)..(603)

SEQ ID NO: 15763 - protein, 200 aa, Saccharomyces cerevisiae; identical to SEQ ID NO: 1306

SEQ ID NO: 15764 - DNA, 714 bp, Candida albicans; identical to SEQ ID NO: 1307
  CDS (1)..(714)

SEQ ID NO: 15765 - protein, 237 aa, Candida albicans; identical to SEQ ID NO: 1308

SEQ ID NO: 15766 - DNA, 24 bp, Primer
atggcaggtatcaagttgacgcat

SEQ ID NO: 15767 - DNA, 28 bp, Primer
tcattttgttaatagttttttgtatgct

SEQ ID NO: 15768 - protein, 17 aa, consensus
  MISC_FEATURE (1)..(17): consensus for the disclosure of xaa see table XV
HXXLPPISSFXNLIXXA

SEQ ID NO: 15769 - protein, 68 aa, consensus; identical to SEQ ID NO: 4445
  MISC_FEATURE (1)..(68): consensus for the disclosure of xaa see table XV

SEQ ID NO: 15770 - protein, 108 aa, consensus; identical to SEQ ID NO: 4446
  MISC_FEATURE (1)..(108): consensus for the disclosure of xaa see table XV

SEQ ID NO: 15771 - protein, 490 aa, consensus; identical to SEQ ID NO: 4447
  MISC_FEATURE (1)..(490): Xaa in all positions is any amino acid.

SEQ ID NO: 15772 - protein, 35 aa, consensus; identical to SEQ ID NO: 13778
  MISC_FEATURE (1)..(35): consensus for the disclosure of xaa see table XV

SEQ ID NO: 15773 - protein, 20 aa, consensus
  MISC_FEATURE (1)..(20): consensus for the disclosure of xaa see table XV
DVXXXXXXXDXXXDHHXXXX

SEQ ID NO: 15774 - protein, 9 aa, consensus
  MISC_FEATURE (1)..(9): consensus for the disclosure of xaa see table XV
SSXGXXXXX

SEQ ID NO: 15775 - protein, 15 aa, consensus
  MISC_FEATURE (1)..(15): consensus for the disclosure of xaa see table XV
XXXXXXXXXDXXDNG

SEQ ID NO: 15776 - protein, 42 aa, consensus; identical to SEQ ID NO: 13782
  MISC_FEATURE (1)..(42): consensus for the disclosure of xaa see table XV

SEQ ID NO: 15777 - protein, 344 aa, consensus; identical to SEQ ID NO: 13783
  MISC_FEATURE (1)..(344): Xaa in all positions is any amino acid.

SEQ ID NO: 15778 - protein, 197 aa, consensus; identical to SEQ ID NO: 7423
  MISC_FEATURE (1)..(197): consensus for the disclosure of xaa see table XV

SEQ ID NO: 15779 - protein, 196 aa, consensus; identical to SEQ ID NO: 1959
  MISC_FEATURE (1)..(196): xaa in all positions is any amino acid
  for the disclosure of the amendment in position 106 see table XVI

SEQ ID NO: 15780 - DNA, 945 bp, Saccharomyces cerevisiae
  CDS (1)..(945)
atgccatctaccactaatactgctgcagcaaacgtaatagaaaaaaagccagtctcgttttctaatatcctattgggtgcctgtttaaacttgtcagaggtgactacattagggcaacctttggaggttgttaagaccacaatggctgcaaacagaaacttcacatttttagaatctgttaagcatgtctggtcaagaggtggtatcttgggttactaccaaggtttgattccatgggcatggatcgaagcctccactaaaggtgctgtgttgctgttcgtgtcagctgaggctgagtatcgtttcaaaagtttggggttgaacaactttgcctcaggtatattaggtggtgtcacgggtggtgtcactcaagcctacttaaccatggggttctgtacctgtatgaaaacggtggaaattacaagacataaatctgcctccgcaggtggtgtcccacaatcttcttggagtgtgttcaagaatatttataaaaaggaaggtattagaggtattaataagggtgttaatgctgttgctattagacaaatgaccaactggggttctcgttttggtttgtccagactagtggaagatggtatcagaaagatcaccgggaaaaccaataaagacgacaagttgaatccgttcgagaaaattggtgccagtgctttaggtggtggtttaagtgcttggaatcaaccaatcgaagtcattagagttgaaatgcaatctaagaaggaagatccaaacagaccaaaaaatttgactgttggtaagacatttaaatacatctatcaatcaaatggtctaaagggtctttaccgtggtgtcaccccaagaattggtttaggtatctggcaaactgtcttcatggttggttttggtgatatggcgaaggaatttgtcgccagaatgactggtgaaaccccagttgccaaacattag

SEQ ID NO: 15781 - protein, 314 aa, Saccharomyces cerevisiae
MPSTTNTAAANVIEKKPVSFSNILLGACLNLSEVTTLGQPLEVVKTTMAANRNFTFLESVKHVWSRGGILGYYQGLIPWAWIEASTKGAVLLFVSAEAEYRFKSLGLNNFASGILGGVTGGVTQAYLTMGFCTCMKTVEITRHKSASAGGVPQSSWSVFKNIYKKEGIRGINKGVNAVAIRQMTNWGSRFGLSRLVEDGIRKITGKTNKDDKLNPFEKIGASALGGGLSAWNQPIEVIRVEMQSKKEDPNRPKNLTVGKTFKYIYQSNGLKGLYRGVTPRIGLGIWQTVFMVGFGDMAKEFVARMTGETPVAKH

SEQ ID NO: 15782 - DNA, 1533 bp, Homo sapiens (man)
  CDS (75)..(1010)
caccgcggaccgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggagaaggcgatcctggcaggcggcctggcgggtggcatcgagatctgcatcaccttccccaccgagtacgtgaagacgcagctgcagctggacgagcgctcgcacccgccgcggtaccggggcatcggggactgcgtgcggcagacggttcgcagccatggcgtcctgggcctgtaccgcggccttagctcgctgctctacggttccatccccaaggcggccgtcaggtttggaatgttcgagttcctcagcaaccacatgcgggatgcccagggacggctggacagcacgcgtgggctgctgtgcggcctgggcgctggcgtggccgaggccgtggtggtcgtgtgccccatggagaccatcaaggtgaagttcatccacgaccagacctccccaaaccccaagtacagaggattcttccacggggttagggagattgtgcgggaacaagggctgaaggggacgtaccagggcctcacagccactgtcctgaagcagggctcgaaccaggccatccgcttcttcgtcatgacctccctgcgcaactggtaccgaggggacaaccccaacaagcccatgaaccctctgatcactggggtcttcggagctattgcaggcgcagccagtgtctttggaaacactcctctggatgtgattaagacccggatgcagggcctggaggcgcacaaataccggaacacgtgggactgcggcttgcagatcctgaagaaggaggggctcaaggcattctacaagggcactgtcccccgcctgggccgggtctgcctggatgtggccatagtgtttgtcatctatgatgaagtggtgaagctgctcaacaaagtgtggaagacggactaagcctagagaggccgcaaggggaccgccccaggcaccgccagagtgtcctgctacctttgtctcacgattccagtgcagtagtgccaaaaggccccttcccacgtccctcgagctctgtagcctggtctgtgcattgtggctgtcaaatccatgtgtcccccctgtggtctgtgtgtgacaccaccactgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggccctctctccgccccggacagggtggcacccaccactctcaggaccaccctgccaa

SEQ ID NO: 15783 - protein, 311 aa, Homo sapiens (man) [sequence omitted]

SEQ ID NO: 15784 - DNA, 969 bp, Saccharomyces cerevisiae
  CDS (1)..(969)
atgtctcaaaaaaagaaggcttcccatccagccatcaatctcatggctggcggcacagcaggtttatttgaagcattgtgttgtcatcctttagatacaattaaggtgagaatgcaaatatacagacgggtagctggtattgaacatgttaaacccccaggatttattaaaactgggcgtaccatttatcaaaaagaaggtttcttggctctgtataaaggtctaggtgctgtggtcatcggtattatacctaagatggcaatccgtttctcgtcttatgaattctatagaaccttattggttaacaaggaatcaggaattgtgtctaccggtaatacttttgttgctggtgttggggctggtatcaccgaagctgttcttgtcgtgaacccgatggaagttgtaaagattaggttacaagctcagcatttaactccgagtgagccaaatgctggtcctaaatataacaacgccattcatgcagcctacactattgtcaaagaagaaggtgtttctgccttatatagaggcgtttccttaactgcggcaaggcaagcaactaatcagggtgctaacttcacagtttattctaaactgaaggagtttttgcagaattaccatcagatggatgtcctaccttcatgggaaacttcttgcataggtttgatttcgggtgctattgggccgttttccaacgctccattggatactataaagacaaggctgcaaaaggataagtccatctcattggaaaaacagtccggtatgaagaaaatcataaccattggtgctcaactactgaaagaagaaggttttagagctttgtacaagggtattaccccaagagtgatgagggtggctccaggtcaggctgtcacctttaccgtttatgaatatgtaagggagcatttagaaaatttgggtatattcaagaagaatgacacaccaaagccaaagccattaaagtag

SEQ ID NO: 15785 - protein, 322 aa, Saccharomyces cerevisiae
MSQKKKASHPAINLMAGGTAGLFEALCCHPLDTIKVRMQIYRRVAGIEHVKPPGFIKTGRTIYQKEGFLALYKGLGAVVIGIIPKMAIRFSSYEFYRTLLVNKESGIVSTGNTFVAGVGAGITEAVLVVNPMEVVKIRLQAQHLTPSEPNAGPKYNNAIHAAYTIVKEEGVSALYRGVSLTAARQATNQGANFTVYSKLKEFLQNYHQMDVLPSWETSCIGLISGAIGPFSNAPLDTIKTRLQKDKSISLEKQSGMKKIITIGAQLLKEEGFRALYKGITPRVMRVAPGQAVTFTVYEYVREHLENLGIFKKNDTPKPKPLK

SEQ ID NO: 15786 - DNA, 924 bp, Saccharomyces cerevisiae
  CDS (1)..(924)
atgtcatcagactcaaacgcaaagccattgccttttatatatcagttcatatcaggtgccgtcgccggtatttctgagttaactgttatgtatccgcttgatgttgttaagacaagatttcaactggaggtgacgacgcctactgccgctgcagtaggaaagcaagtagagagatataatggtgtcatcgattgtttgaaaaaaattgtaaagaaggaagggtttagcagactttacagaggtattagttcaccaatgttgatggaagcaccaaagagagccaccaaatttgcatgtaacgatcaatatcaaaaaatcttcaaaaacctattcaacacgaatgaaactacgcagaagatctccattgcggctggtgcatctgctggtatgacagaagctgcagttattgttccatttgaattgatcaaaatcaggatgcaagacgtcaagtccagctatcttggaccaatggactgtttgaaaaaaacaatcaaaaacgaaggtattatggggctatacaagggtatcgaatctaccatgtggagaaacgctctttggaatggtggctacttcggtgttatctaccaagtgagaaattccatgcccgtagcaaagacaaagggacaaaagaccagaaatgaccttattgcaggtgcgatcggtggtacggtcgggaccatgcttaacactccctttgacgtggtgaaatccagaatccaaagtgtggacgcggtcagcagtgctgttaaaaaatacaactggtgcctaccttcgctattggtcatataccgtgaagaaggcttcagagcattgtacaaaggtttcgtccccaaagtatgtagactagcacccggtggttcattaatgttggtggtttttaccggtatgatgaactttttcagggatctgaagtacggacactga

SEQ ID NO: 15787 - protein, 307 aa, Saccharomyces cerevisiae
MSSDSNAKPLPFIYQFISGAVAGISELTVMYPLDVVKTRFQLEVTTPTAAAVGKQVERYNGVIDCLKKIVKKEGFSRLYRGISSPMLMEAPKRATKFACNDQYQKIFKNLFNTNETTQKISIAAGASAGMTEAAVIVPFELIKIRMQDVKSSYLGPMDCLKKTIKNEGIMGLYKGIESTMWRNALWNGGYFGVIYQVRNSMPVAKTKGQKTRNDLIAGAIGGTVGTMLNTPFDVVKSRIQSVDAVSSAVKKYNWCLPSLLVIYREEGFRALYKGFVPKVCRLAPGGSLMLVVFTGMMNFFRDLKYGH

SEQ ID NO: 15788 - DNA, 810 bp, Caenorhabditis elegans
  CDS (1)..(810)
atgccatcagaagaaggatcggtggtacgatggctcgtgtgtggggcgacagctggtttagcagttgatattggattatatccattggatacaattaaatcaagaatgcaatctaaacaaggattcattgcagctggaggttttaaagatatttataggggaatgatctcagtattagttggctcagcacccggagctgccattttcttcctcacttacaaatacattaatggacaaatgaaacaagtaattgaagaaagaaatgctcttgtggatgctgtttctgcaagtttggctgaaattgcagcatgtgctgtaagagtaccaacagagctttgtaagcaaagaggacaagttaataaaaatgaacgactgacgttaatatgcaaagaaataatggaaactaaaggaatacgtggattctatcgaggatacggtagcactgtggctcgagaaattcctttttcaattatccagtttcctatttgggaagctttgaagagggcagtggcaaataaaaaagaatcaggtcgttgtagtccattggaaggagctgcttgtggaagtgtagctggatttattgcagctggtttaacgacaccattagacgtggcaaagacacgtatcatgctcacaaaaaacggtccagctcctggtattttgagcacattaaaagaggtgtacacatcaaatggagtacgtgggctttattctggagtcgtacctcgtgtaatgtggatttcaggcggtggttttgttttcttcggtgcctatgaaacagcaatgcattttaccaaatttttagattag

SEQ ID NO: 15789 - protein, 269 aa, Caenorhabditis elegans
MPSEEGSVVRWLVCGATAGLAVDIGLYPLDTIKSRMQSKQGFIAAGGFKDIYRGMISVLVGSAPGAAIFFLTYKYINGQMKQVIEERNALVDAVSASLAEIAACAVRVPTELCKQRGQVNKNERLTLICKEIMETKGIRGFYRGYGSTVAREIPFSIIQFPIWEALKRAVANKKESGRCSPLEGAACGSVAGFIAAGLTTPLDVAKTRIMLTKNGPAPGILSTLKEVYTSNGVRGLYSGVVPRVMWISGGGFVFFGAYETAMHFTKFLD

SEQ ID NO: 15790 - DNA, 882 bp, Schizosaccharomyces pombe
  CDS (1)..(882)
atgagcaagattgaaaaaaagcaggcttctgcttccaaccttttgcttggagcaggtttgaatcttttcgagacttcctcattgggtcagcctttggaagttacaaaggtgcagatggctgctaaccgtactcaaaccatggctcaagccatcaaggctatcatgtctcgtggcggtattttgggcttctatcagggtcttattccctgggcttggatcgaggcttctacgaagggcgctgttcttttgtttacttccgctgaactcgaatattggggtcgtcggttaggtcttggtgctacctccgcaggtgcaatcgcaggtatgggtggtggtgttgctcaagcgtacgctactatgggattttgcacttgcatgaaaactgccgaggttactcgtgcaaagcaagctgctactggtcaagaagttaaaggcactttccgtgttttcgctgatttgtataaagaaaaaggtattcgtggtatcaatcgtggtgttaatgctgttgctcttcgtcagatgactaactggggaagtcgccttgcattgtcccgttttcttgaaaaacctattcgttacttcactggtcgtactgaagccgagcctttgacaactggtcaacggtttgttgctagtgtgtctgctggtgctcttagttgttggaatcaaccactcgaggtcgctcgcgttgagatgcaaagtttgaccaagggtatacaacattcctcacctggtattatgcaaaccataatgagcatttacaagaataatggaattaagggtctttatcgtggtgccgtcccccgtatgggtcttggtgcttaccaaacattcgtcatggtctttttagcggattgtgttcgtgggtatttagcaaagtga

SEQ ID NO: 15791 - protein, 293 aa, Schizosaccharomyces pombe
MSKIEKKQASASNLLLGAGLNLFETSSLGQPLEVTKVQMAANRTQTMAQAIKAIMSRGGILGFYQGLIPWAWIEASTKGAVLLFTSAELEYWGRRLGLGATSAGAIAGMGGGVAQAYATMGFCTCMKTAEVTRAKQAATGQEVKGTFRVFADLYKEKGIRGINRGVNAVALRQMTNWGSRLALSRFLEKPIRYFTGRTEAEPLTTGQRFVASVSAGALSCWNQPLEVARVEMQSLTKGIQHSSPGIMQTIMSIYKNNGIKGLYRGAVPRMGLGAYQTFVMVFLADCVRGYLAK

SEQ ID NO: 15792 - DNA, 951 bp, Neurospora crassa
  CDS (1)..(951)
atgtccgccgccgtcgcctccgtcccggccccagcgccgaagaagctggaaaagaagcccatcaagttctccaacttgcttctgggtgccggtctcaacctcttcgaggtcaccacgctcggccaacccttggaggtcatcaagaccaccatggctgccaaccgcaacgatggctttacctctgcccttcgccgcatctggaaccgtggtggtatctttggcttctaccagggtcttatcccatgggcctggattgagggctccaccaagggtgccgtgcttctcttcgttgcctcggaggccgaatatcatgctcgtgccgccggcgccggtgacttcgttgccggtatcaccggtggtatcgttggcggtgttgcgcaggcgtatgccaccatgggcttctgcacctgtatgaagacggtcgagattaccaagcacaagatgagcgccgccggccagaaggcccccggcacttgggctaccttcatggacatctaccgccgcgagggtatccgcggtatcaacaagggcgtcaacgccgttgccattcgccagatgaccaactggggttcccgtttcggtctctcccgccttgctgagcagggtatccgcaaggccactggcaaggaggagggacagaagctggccgcgtgggagaagattctcgcctccgcccttggtggtggtctttctgcttggaaccagcccatcgaggtcatccgcgtcgagatgcagagcaagaaggaggaccccaaccgccccaagaagatgactgttggcaacaccttcaggtacatctaccagaccaacggcatcaagggcctgtaccgcggtgtcaccccccgcattggtcttagtatttggcagaccgtctgcatggttgctttcggcgatatggccaagacctacgtcgagaagttgaccggcgatgccgtcaccgcgaagcactaa

SEQ ID NO: 15793 - protein, 316 aa, Neurospora crassa
MSAAVASVPAPAPKKLEKKPIKFSNLLLGAGLNLFEVTTLGQPLEVIKTTMAANRNDGFTSALRRIWNRGGIFGFYQGLIPWAWIEGSTKGAVLLFVASEAEYHARAAGAGDFVAGITGGIVGGVAQAYATMGFCTCMKTVEITKHKMSAAGQKAPGTWATFMDIYRREGIRGINKGVNAVAIRQMTNWGSRFGLSRLAEQGIRKATGKEEGQKLAAWEKILASALGGGLSAWNQPIEVIRVEMQSKKEDPNRPKKMTVGNTFRYIYQTNGIKGLYRGVTPRIGLSIWQTVCMVAFGDMAKTYVEKLTGDAVTAKH

SEQ ID NO: 15794 - DNA, 1440 bp, Arabidopsis thaliana (mouse-ear cress)
  CDS (1)..(1440)
atggagtcatcgaagcccaaaaaccgtaacccgatgaagaaacctgtatccatcacgatggagcatgttctattggcgttacgtgagacaatggatgagagagagatcaggattcgtagtttgtttgatttctttgataattcgaatttagggttcttagattatgcccagatcgaaaagggtcttgcttcgcttcagattcctcctgagtacaagtacgctagagatttgtttagagtctgcgacgctaatcgagatgggcgtgttgattaccaggagtttcgtcgatacattgatgctaaggagcttgagctatacaggattttccaagccattgatgttgagcataatggctgcattttgcctgaggagctttgggaggctcttgttaaggccggcattgagatcgatgatgaggaactcgctcgttttgtggagcatgttgataaggacaacaatggaactataacgtttgaagagtggagagattttcttttgttatatcctcatgaagccacccttgaaaacatatatcatcattgggaaagggtgtgcttgatagatattggggagcaagctgttataccggatggtataagtaaacatgtgaaaagaagcagattacttctcgctggaggactagccggagctgtttctagaactgcaactgcgcctcttgatcgtctgaaggttgttttgcaagttcaaagggcacatgcaggggtcctcccgacaattaagaagatatggagagaagataagttgatgggtttctttagaggtaatgggttaaatgtcatgaaggttgctcctgaaagtgccattaagttttgtgcttacgaaatgctaaaacccatgattggaggggaggatggtgatattggtacaagtgggagacttatggcaggtggaatggctggtgcattggctcaaaccgctatttaccctatggatctcgtgaagactcggttacagacttgtgtcagtgaaggtggaaaggcacctaagttgtggaagcttacaaaagatatatgggttcgggagggacctcgggctttctacaagggtctgtttccttctcttcttgggattgttccttatgcaggaattgacctcgctgcatatgaaacgctaaaagacttgtccagaacatatattcttcaggacactgagccgggtcctctgatacagctgagctgtggaatgacatcaggagcccttggagcatcatgtgtttacccgttacaggtagtaagaacaagaatgcaagcggatagttcgaagacgacaatgaagcaagagtttatgaatacgatgaaaggagaaggtcttagaggtttctacagaggactattacccaatcttctcaaagtagttccagcggcaagcatcacgtacattgtttatgaagctatgaagaaaaatatggctcttgattag

SEQ ID NO: 15795 - protein, 479 aa, Arabidopsis thaliana (mouse-ear cress)
MESSKPKNRNPMKKPVSITMEHVLLALRETMDEREIRIRSLFDFFDNSNLGFLDYAQIEKGLASLQIPPEYKYARDLFRVCDANRDGRVDYQEFRRYIDAKELELYRIFQAIDVEHNGCILPEELWEALVKAGIEIDDEELARFVEHVDKDNNGTITFEEWRDFLLLYPHEATLENIYHHWERVCLIDIGEQAVIPDGISKHVKRSRLLLAGGLAGAVSRTATAPLDRLKVVLQVQRAHAGVLPTIKKIWREDKLMGFFRGNGLNVMKVAPESAIKFCAYEMLKPMIGGEDGDIGTSGRLMAGGMAGALAQTAIYPMDLVKTRLQTCVSEGGKAPKLWKLTKDIWVREGPRAFYKGLFPSLLGIVPYAGIDLAAYETLKDLSRTYILQDTEPGPLIQLSCGMTSGALGASCVYPLQVVRTRMQADSSKTTMKQEFMNTMKGEGLRGFYRGLLPNLLKVVPAASITYIVYEAMKKNMALD

SEQ ID NO: 15796 - DNA, 975 bp, Brachydanio rerio
  CDS (1)..(975)
atgaccgctaccatttccaggcagaggcacgccgcagtcgctgcagactcttctggctcttctttttccattacagcaaacctcctgcaactttcaaaacacatcaaatatgagaatcttgcagccggactcgctggtggtgttatttccacaatggtgctacatccattggatttgatcaaaatcaggtttgcagtaagtgatggtctgaaaatgaggccccaatacgatggcatgttagactgcatgaagaccatctggaagctggaaggcattagaggtctctatcagggagtgacgcccaacatctggggggccggatcatcatggggcctctacttcctcttttataatgctattaaagcatacacacaggagggacggcaaacagagctgagtgcatgtgaacacctggtgtccgcagcggaggcaggcattctgacgctttgcctcaccaatccagtctgggtgacaaagacccggctggtgctgcagtacaatgcagacccttcacggaagcagtacaagggaatgatggacgccctcgtgaaaatataccgtcacgagggtatcccaggactatacaggggttttgtgcctgggctggtcgggacttcccatgctgcactgcagttcatgacctatgaagggctaaaaagagagcagaacaaatgcaagaagatgccctctgaatccctgctgtccccattggaatacatcgccatagcagccatatccaaaatattcgctgtagcagtaacatacccctatcaggtggtccgcgctcgcctgcaggaccagcacaacaactacagtggaatagtggatgtcatgagaaggacctggagcaacgaaggggtggagggcttttacaaagggatggtgccaaacctggtccgagtcattcctgcgtgctgcatcaccttcctggtgttcgaaaatgtgtcacgcttgcttttgggcgagtatcactaa

SEQ ID NO: 15797 - protein, 324 aa, Brachydanio rerio
MTATISRQRHAAVAADSSGSSFSITANLLQLSKHIKYENLAAGLAGGVISTMVLHPLDLIKIRFAVSDGLKMRPQYDGMLDCMKTIWKLEGIRGLYQGVTPNIWGAGSSWGLYFLFYNAIKAYTQEGRQTELSACEHLVSAAEAGILTLCLTNPVWVTKTRLVLQYNADPSRKQYKGMMDALVKIYRHEGIPGLYRGFVPGLVGTSHAALQFMTYEGLKREQNKCKKMPSESLLSPLEYIAIAAISKIFAVAVTYPYQVVRARLQDQHNNYSGIVDVMRRTWSNEGVEGFYKGMVPNLVRVIPACCITFLVFENVSRLLLGEYH

SEQ ID NO: 15798 - DNA, 870 bp, Caenorhabditis elegans
  CDS (1)..(870)
atggagaaactaaaagaaggtggcagacaaatcacagctggcgggtccgcaggtctcgtggaagtatgtcttatgtacccattggatgttgtgaagacgcgacttcaacttggacaacaggataagggaatgatggattgtgtggtgaaaacgttgaaaaatgaaggaatcggagggttttacaagggaatcctgccaccaatccttgcggaaacaccaaaaagagcgacaaaattcttcacatttgagcagtataaaattgcatttactcattcggaaattcctttgcctgttacaatgtcattcgccggtctcttctcgggactcaccgaggccatcgttatctgcccgttcgaggtggtaaaagtgagactgcaagcggacagaaattcaagcgtcaaagagcaaagatcaacggcgtcgatggcaagggagatttataggaacgaaggattcggaaccagtggactttaccgaggattgggggccacactgggaagacatggtgcatggaatatggtctatttcgggttgtatcatagttgcagagaagttattcctgatgccaagcaaaatccaacatcaaacttaattggaagaatcgccttaggattcaccgccggatcgcttgcttcaatcttcaacattccatttgacgtagcaaagagccggatccaaggcccacagccggacccattcactaggaaatacagtggaacaatgcaaacgatttctttggtttacaaggaggaaggattcggtgctctgtacaaaggacttcttcccaaagtgatgagactaggacctggtggagctgttatgctgattgtctacgacgaagtttactcttggctccagaaaaatacctaa

SEQ ID NO: 15799 - protein, 289 aa, Caenorhabditis elegans
MEKLKEGGRQITAGGSAGLVEVCLMYPLDVVKTRLQLGQQDKGMMDCVVKTLKNEGIGGFYKGILPPILAETPKRATKFFTFEQYKIAFTHSEIPLPVTMSFAGLFSGLTEAIVICPFEVVKVRLQADRNSSVKEQRSTASMAREIYRNEGFGTSGLYRGLGATLGRHGAWNMVYFGLYHSCREVIPDAKQNPTSNLIGRIALGFTAGSLASIFNIPFDVAKSRIQGPQPDPFTRKYSGTMQTISLVYKEEGFGALYKGLLPKVMRLGPGGAVMLIVYDEVYSWLQKNT

SEQ ID NO: 15800 - DNA, 1047 bp, Candida glabrata
  CDS (1)..(1047)
atgtcctcttctaaaaagaaatcttctaacccagttgtgaacctggtggctggtggtactgccggtctgtttgaagctctgtgttgtcatccactagatactataaaggtgcggatgcaaatttacaagagacaggcggcacccgctgctgctgcagttgcaagcatggctggcggtgctggaggtgctgcaactgctactgtcggtggtggtgatgccactgccgctattaagccacctggattcattagaaccggtagaaacatatatgcgcaagaagggtttttggccctatataaaggtctaggggccgttgtcatcggtattatcccaaagatggccatcagattttcttcctatgagttttacagaactctgctggctgacaaacaaacaggtgttgtttccacaagtaacactttcatcgcaggtgtaggtgctggtgtcactgaagctgtcttggttgttaaccctatggaagttgttaagattagactgcaggctcagcacttaaaccctaaccatgacttggccaaaccaaaatatacaaatgccgttcaagcaggttacactatcattaaggaggaaggtatctctgctctatacagaggtgtttctttaactgctgccagacaagccacaaaccaaggtgctaactttactgtttactcaaagttgagagagttcctacaggaataccacggtaccgaaacattaccatcttgggaaacatcctgtatcggtttgatctctggtgctattggtccattttcaaatgctccactggacactatcaagactagactacaaaaggataagtctactagcttcaaaggtgaatctggatggaagagaattgctcacattggtactcaattgttaaaggaagaaggtttcagagctctttacaaaggtattaccccaagagtgatgagagttgctccaggtcaagccgttacattcacagtatacgagtttgtcagaagacacctggagaacctgggcgtcttcagtaaacctacaccaaaaccaaagaagttgaactga

SEQ ID NO: 15801 - protein, 348 aa, Candida glabrata
MSSSKKKSSNPVVNLVAGGTAGLFEALCCHPLDTIKVRMQIYKRQAAPAAAAVASMAGGAGGAATATVGGGDATAAIKPPGFIRTGRNIYAQEGFLALYKGLGAVVIGIIPKMAIRFSSYEFYRTLLADKQTGVVSTSNTFIAGVGAGVTEAVLVVNPMEVVKIRLQAQHLNPNHDLAKPKYTNAVQAGYTIIKEEGISALYRGVSLTAARQATNQGANFTVYSKLREFLQEYHGTETLPSWETSCIGLISGAIGPFSNAPLDTIKTRLQKDKSTSFKGESGWKRIAHIGTQLLKEEGFRALYKGITPRVMRVAPGQAVTFTVYEFVRRHLENLGVFSKPTPKPKKLN

SEQ ID NO: 15802 - DNA, 894 bp, Candida glabrata
  CDS (1)..(894)
atgtcaaaggactctaagaaagtggatccaaccaaatcatttgttgctggtgctctggcaggtgctgttgaagcttctataacatatccatttgaatttgcgaagacgaggctgcaactgattgataaatcttctaaggcatcgagaaacccattggtgcttatatataatacagcgaagacacaaggtgtcggtgcaatttatgtgggttgtcccgccttcattgttggtaacacagcgaaggcagctacaagattccttggttatgatacgatcaggaatttattaaaggataagaagactggagaattgagtggtcccagaggtgttcttgctggtctcggggctggactactagaaagtgttgtagcagtaactccctttgaagcaatcaaaacagttttgattgatgataaacagtcggtacgaccaaaatatcagaacaatgggcgtagtatggctcgtaattatatatcacttgtaaaagatgaaggttttcgaggtctttatggtggtgtgctacccgtttcgatgagacaagcagctaatcaagctgttagattgggttgttataataaaatcaaggtgttagttcaggattatactggtgcacctaaggataaacctttgacatctggattgacatttattgtaggtgccttcagtggtgtggtaacagtttatgccaccatgcctatcgatactgtaaaaacacgtatgcaaagtttgactgcaagcaaatactcatcaactctaaattgtttcactacgatctataaggaggaaggtttaaagacgttttggaaaggagcaaccccaagattaggaagattaattttgagtggaggtatcgtatttactatttatgaaaatgtattgctttatttgagctag

SEQ ID NO: 15803 - protein, 297 aa, Candida glabrata
MSKDSKKVDPTKSFVAGALAGAVEASITYPFEFAKTRLQLIDKSSKASRNPLVLIYNTAKTQGVGAIYVGCPAFIVGNTAKAATRFLGYDTIRNLLKDKKTGELSGPRGVLAGLGAGLLESVVAVTPFEAIKTVLIDDKQSVRPKYQNNGRSMARNYISLVKDEGFRGLYGGVLPVSMRQAANQAVRLGCYNKIKVLVQDYTGAPKDKPLTSGLTFIVGAFSGVVTVYATMPIDTVKTRMQSLTASKYSSTLNCFTTIYKEEGLKTFWKGATPRLGRLILSGGIVFTIYENVLLYLS

SEQ ID NO: 15804 - DNA, 924 bp, Candida glabrata
  CDS (1)..(924)
atggctcaaacaatagaaaagaaacctgtttcattctctaatatactgctgggtgctgggttgaacttgtcggaggtcacaactcttggccaaccattagaagtggttaagaccactatggctgctcacagagaattcaatttcttacaagctacaaagcatgtatggtctcgtggtggtatattcggtttttaccaagggctaattccatgggcttggatcgaagcctccactaaaggtgccgtgcttttatttgtttctgctgaggctgaatacagattcaaggtgctagggctcaataactttggtgctggtatcatgggtggtatcactggtggtgtcactcaagcttatttaaccatggggttctgtacctgtatgaagactgtggagatcacaagacaaaaggccgctaatgttccaggtgttattcctcaatcatcatggcaagtgttcaagtccatctataagaaggaaggtattagaggtatcaataaaggtgtaaatgccgttgctattagacaaatgactaactggggttcccgttttggtctatcgagattagttgaagatggtatcagaaaactcactggtaaaactggaaaagatgataagctaactgctcttgaaaagatcatggcaagtgccattggtggtggtttgagtgcatggaatcagccaatcgaggttattagagtagaaatgcaatctaagaaagaagatccaaatagacctaaaaacctaactgttggtaagactttcaagtatatctaccaaagtaacggtcttaagggtttgtaccgtggtgtcacacctagagttggtctaggtatctggcaaactgtcttcatggttggtttcggtgacatggccagagaatttgttgctaaactaactggtgaaaagccagctgcaaagcactga

SEQ ID NO: 15805 - protein, 307 aa, Candida glabrata
MAQTIEKKPVSFSNILLGAGLNLSEVTTLGQPLEVVKTTMAAHREFNFLQATKHVWSRGGIFGFYQGLIPWAWIEASTKGAVLLFVSAEAEYRFKVLGLNNFGAGIMGGITGGVTQAYLTMGFCTCMKTVEITRQKAANVPGVIPQSSWQVFKSIYKKEGIRGINKGVNAVAIRQMTNWGSRFGLSRLVEDGIRKLTGKTGKDDKLTALEKIMASAIGGGLSAWNQPIEVIRVEMQSKKEDPNRPKNLTVGKTFKYIYQSNGLKGLYRGVTPRVGLGIWQTVFMVGFGDMAREFVAKLTGEKPAAKH

SEQ ID NO: 15806 - DNA, 849 bp, Candida glabrata
  CDS (1)..(849)
atgctgaatgggtttcttatatcgttgctgagcggtgctgctgccggtacttccaccgaccttgtgttctttccgattgacactttgaagactaggttgcaagctaaaggcgggttcttcaggaacggtgggtatcggggagtgtaccggggtcttgggagtgctgtggttgcctctgcgcctggtgcgtcgctattctttatcacatatgatacttgtaaagctgagacgcggggcttctttagagggttgcttccatctagcaacgttgccgatgtagtgacgcatatgttctcttcctcgatgggtgagatagctgcctgcatggtcagagtccccgccgaagtggtcaagcagaggtcgcagacccatgcgtcgcactcctcttgggagaccctgagggagattttgaagaatgagaacggtgaaggtgtgcggaggaacttgtatcgcggttggtctaccacgatcatgagggaaatccccttcacttgtattcagttccccttgtatgaatacatgaagaaggtctgggccgaattagacgagagtgatcgtgtagagccatggaaaggcgcagtatgtggttccattgccggtggtattgccgcagccactactacacctctggattttttgaaaactagactaatgctatgcaagaaaagcatacctctagggacactggtctctaccatatataaagaagaagggttcaaagtgtttttcagtggtgttgggcccagaactatgtggataagtgcaggaggtgccatcttccttggaatttacgaaaccgtccattctttgttatccacaaataagaaacctactagaaatgaggcgtga

SEQ ID NO: 15807 - protein, 282 aa, Candida glabrata
MLNGFLISLLSGAAAGTSTDLVFFPIDTLKTRLQAKGGFFRNGGYRGVYRGLGSAVVASAPGASLFFITYDTCKAETRGFFRGLLPSSNVADVVTHMFSSSMGEIAACMVRVPAEVVKQRSQTHASHSSWETLREILKNENGEGVRRNLYRGWSTTIMREIPFTCIQFPLYEYMKKVWAELDESDRVEPWKGAVCGSIAGGIAAATTTPLDFLKTRLMLCKKSIPLGTLVSTIYKEEGFKVFFSGVGPRTMWISAGGAIFLGIYETVHSLLSTNKKPTRNEA

SEQ ID NO: 15808 - DNA, 1431 bp, Oryza sativa
  CDS (1)..(1431)
atggagcacgtgctgctggcgctgcacgagacggaggcggagagggaggcgcggatccgcgccatgttcggcttcttcgacgccgcggggcggggccacctcgaccacgcgcagatcgaggccggcctcgccgcgctccacctcccgccgccgccgccgcccgaggagggcggcggcggctacgcccgcgagctgctccgcgcgtgcgaccgcgaccgcgacggccgcgtcggctacgacgacttccgcaggtacatggacgacaaggagctggagctctaccgcatcttccaggccatcgacgtcgagcacaacggctgcatcctccccgaggagctctggcacgccctcgtcaaggctggcatagaaattgatgacgaggagcttgcaagatttgttgagcatgtggataaggataataatggaattattacttttgaagaatggagggactttcttttgctttaccctcatgaggcaaccattgagaacatctaccatcattgggaaagagtctgccttgtagatataggcgagcaggctgctataccagaacgaataagtaaacatgcaagcgcaagcaaatatctaattgcaggaggtgtttctggtgcaacatcccgtactgctactgcacctcttgaccgtctcaaagtcatcatgcaagtacaaacaaaccgtattacagtattacaagcagtgaaggatatatggagagagggcagtctgcgtggtttcttcagaggaaatggattaaatgtggtaaaggttgctccagaaagtgcaataagattttatgcctacgaaatgctaaaagaatacataatgaaaagtaaaggagaaaataagagcgacattggtacttctggacgtctgatggctggtggtttggctggagcagtggcacagacagcaatttatcccatagatttagtaaagactcgactgcagacttttgcatgtggtagtggtaaaattcctagccttggtgcactatcaagagacatttggatgcaggaaggtcctcgagcattttacagaggcctcgttccatcattgcttggtatggttccgtatgctggaattgatcttactgtttatgaaacactgaaagaaatgtccaagacatatgtcctcaaggatagcgatcctggtcctttagtccaactaggttgtgggacagtctcaggagctctaggagcaacatgtgtttaccctttgcaagtcatcagaacaagactgcaagctcaacgagccaattcagaggctgcatatagagggatgtctgatgttttctggaaaacactgcagcatgagggaatttccggattctacaaagggcttgtaccaaatcttctcaaagtggttccagctgcaagtataacatatcttgtttatgagacaatgaagaaaagtctatcactcgattaa

SEQ ID NO: 15809 - protein, 476 aa, Oryza sativa
MEHVLLALHETEAEREARIRAMFGFFDAAGRGHLDHAQIEAGLAALHLPPPPPPEEGGGGYARELLRACDRDRDGRVGYDDFRRYMDDKELELYRIFQAIDVEHNGCILPEELWHALVKAGIEIDDEELARFVEHVDKDNNGIITFEEWRDFLLLYPHEATIENIYHHWERVCLVDIGEQAAIPERISKHASASKYLIAGGVSGATSRTATAPLDRLKVIMQVQTNRITVLQAVKDIWREGSLRGFFRGNGLNVVKVAPESAIRFYAYEMLKEYIMKSKGENKSDIGTSGRLMAGGLAGAVAQTAIYPIDLVKTRLQTFACGSGKIPSLGALSRDIWMQEGPRAFYRGLVPSLLGMVPYAGIDLTVYETLKEMSKTYVLKDSDPGPLVQLGCGTVSGALGATCVYPLQVIRTRLQAQRANSEAAYRGMSDVFWKTLQHEGISGFYKGLVPNLLKVVPAASITYLVYETMKKSLSLD

SEQ ID NO: 15810 - DNA, 1089 bp, Ashbya gossypii
  CDS (1)..(1089)
atgcgcgagctcctattggcgctgcgtcggagacaaggtgcgggcggcccgccgtcggtgcccgttgtatatataggtgcgcgacgcagaagcgtagcggatccgtgcagcgcagtgtgccagcagccataccctgataaccacatgtcgtctaagaaatctaccaacccggccgtgaacctagttgcgggcgggaccgcgggcctgtttgaggcgctctgctgccacccattggacacgatcaaggtgcgcatgcagatctacaggcgcgcgaacgagggcacgaagccccctgggtttttgcgcacgggggccaacatctacagcggggagggcttgctggctttctacaagggcctcggagctgtggtgatcgggatcatccctaaaatggcgatccggttttcgtcatacgagttctaccggaccttgttggcggaccggcagacgggggtggtctcgacggggaacacgttcttggccggagtgggggcgggtgtcacggaggccgtgctggtggtgaacccgatggaggttgtgaagatccggttgcaggcgcagcacctgcatggcgctgctgagcagcagaagtacagaaacgcgatccaggccgcgtacttgatcgtcaaggaggaggggatcggcgcactctaccgcggcgtgtccttgacggcggcgcgtcaggcgacgaatcagggtgcgaacttcaccgtgtattcgaagctcatggagcggctgcaggagtatcacggtagccagaacctcccatcgtgggagacctcgttgatcggtttggtgtcgggcgcaatcggcccgttctcaaacgcgccgctagacaccatcaagacgcgcttgcagaaggacaagtccacgcgtaacctgtccaattgggtccgcattacgacgattggccgccagctcgtgcaggaggaggggttccgcgcgttgtataagggcatcaccccgcgtgttatgcgtgttgcgccaggccaggccgtgacgttcacggtctacgaatttgtgcgcaggcacctcgaggggctgggcctctttggctccgccaaacctaagccgaagccgcttcactag

SEQ ID NO: 15811 - protein, 362 aa, Ashbya gossypii
MRELLLALRRRQGAGGPPSVPVVYIGARRRSVADPCSAVCQQPYPDNHMSSKKSTNPAVNLVAGGTAGLFEALCCHPLDTIKVRMQIYRRANEGTKPPGFLRTGANIYSGEGLLAFYKGLGAVVIGIIPKMAIRFSSYEFYRTLLADRQTGVVSTGNTFLAGVGAGVTEAVLVVNPMEVVKIRLQAQHLHGAAEQQKYRNAIQAAYLIVKEEGIGALYRGVSLTAARQATNQGANFTVYSKLMERLQEYHGSQNLPSWETSLIGLVSGAIGPFSNAPLDTIKTRLQKDKSTRNLSNWVRITTIGRQLVQEEGFRALYKGITPRVMRVAPGQAVTFTVYEFVRRHLEGLGLFGSAKPKPKPLH

SEQ ID NO: 15812 - DNA, 933 bp, Ashbya gossypii
  CDS (1)..(933)
atgggtgcggaacacggtcctaaggaccttcagaagaagcctgtgagcttttccaacattgccctgggagcggcgttgaatatgtgcgaggtcacgacgcttgggcaaccgcttgaggtcaccaaaacgaccatggccgcaaaccggcagttcggcttttcgcaggcggtgcggcacgtgtggtcgcgtgggggcgtgttcggcttttaccaggggctgattccgtgggcttggattgaggcgtcgaccaagggcgcggtgctgctgtttgtttctgcggaggccgagtaccagtttcggcggcttggtctcagcaacttcggtgcaggcatcctgggcggggtgtctggcggcgtagcgcaggcgtacctgactatgggattctgcacgtgcatgaagacggtcgagatcacgcgcagcaaggctgcgtcagctcccggagtgcccgtgccctcttcgctgcaggtgtttaagcagatcttcgctgccgaggggctgcgcgggattaacaagggggtgaacgcggtggcgataaggcagatgaccaactgggggtcgcgctttggcctgtccagactggtggaggacgggatccggcgcgtgacccacaagcggagcgacgagaagctgagcgcgatggagaaaatagtggcgtctgccctgggcggcgggctgagcgcgtggaaccagcccatcgaggtgatccgggtggagatgcagtcgcgcacgaacgaccccaaccggcccaagaacctgacggtgggcaagacgttccgctacatttacgagaacaacggcctacgcgggctgtaccgcggcgtgacgccgcggattggcctgggtgtgtggcagactatcttcatggtaggctttggagatatcgccagggactttgtggggcggctaacaggtgagactcctgtgggccactag

SEQ ID NO: 15813 - protein, 310 aa, Ashbya gossypii
MGAEHGPKDLQKKPVSFSNIALGAALNMCEVTTLGQPLEVTKTTMAANRQFGFSQAVRHVWSRGGVFGFYQGLIPWAWIEASTKGAVLLFVSAEAEYQFRRLGLSNFGAGILGGVSGGVAQAYLTMGFCTCMKTVEITRSKAASAPGVPVPSSLQVFKQIFAAEGLRGINKGVNAVAIRQMTNWGSRFGLSRLVEDGIRRVTHKRSDEKLSAMEKIVASALGGGLSAWNQPIEVIRVEMQSRTNDPNRPKNLTVGKTFRYIYENNGLRGLYRGVTPRIGLGVWQTIFMVGFGDIARDFVGRLTGETPVGH

SEQ ID NO: 15814 - DNA, 2739 bp, Ashbya gossypii
  CDS (1)..(2739)
atgatggaattgtctagcgcgagtactgtaaagaagaaacgacagttggccatattcaatgcctacgccacgcctctgcgacaagacgaaagacggctgcgggcgtcttatgagcacgggggggttgttgggggccacgtagccagtaatgagaaggttttgttgttcgacgactttgtggacctcatctcgaactcacggtcgttctattcgaagttcacggatcactgctttaacctgaaccagataccgaacacagtgttcgggtgcattttctttgcaatcgatgagaataacaagggctacctcaatgtgaacgactggttctacttcaacaacgtgctagaatatgacaactaccactttatcatcctgtatgagttttttcggaaatttgacgctgcacgggagcgcgcttacggcccctcggtcaagtcaatcaactacggtaaccgctttctttcgttcgacgagctctacttggacctagagcagttccaagccactctgcggctactgcacagctgtgtacgcgacgattttatcgttaacaacaagctgtttctcgactggaagcagttccgttggctcaaatggtaccagttctacccgcggggcctattgcagaacggaccccacatcaccttgaactcgctgatatcaatagtgcagaatgacctgaagtcggaaaagctgctgctgggcttccactgtttatcgcagctggaccaccgtaccaactctatgactatcagcaagaatcagcttgtctatctcatgcggctcttttactcgcacaaaatcccagcggatatattcaactcgctgaacatgtcgacccttagctgcgctaaatgtgataacaaccacatcaattacaacgtctttcgagacttgttctacctgatacaaaactttgatcttctcaaccaaattgtccaccggtacgcggaagttcataaattcagtgatcgtgatgttcgggagcagcatatcagcaggaaggatctgttgaggtttatgaacacggagtacaataagatcaacaacattattgagttctcgcccgcgcagatatccctcctcttctctattgtaactaactctaaaaagctaaactacttgaacaacgcacggcagaataatcctgagctttcataccatcatagagattcggagatagacagcttcatccacaacgagtacataaatgggaatgctgcatcttcgttgcataatgaaagccttgaaaaattcaacgatgacttcgagaatatcatacaagcagatgctggtgatactaaacagcagatatcatctaccgactggcgaagtgtgttctcatggagctcttttctctctagttttgagtggttacatttcaaaaagcggaaatcagtccagactaatgggctgtcagacgagtatgttaacgaagccttgaccttggaagatataatgaagatcgtcaatccgaactaccttaacgacttggttcatcacatggagctgcggcgcattgagagtgaatcacggagctcgaacttatatttctacccgatattcgattctatctataacttcacgttgggttcggtagcgggatgcataggtgctatggttgtatatccaatcgatatggtgaagacacgaatgcaagcccagagagacttctcgaagtataaaaattcgatcgactgccttcttaaaatactatcgaaggaaggcgttagaggattgtattctggattggggcctcagttaatcggcgtcgcacctgaaaaggctatcaagctaacggtaaatgatcatatgcgtgcaactcttgctggtagggacgggaagctgtctcttccctgtgagataatctctggagctacagcgggtgcctgccaggtcgttttcacaaatcccttagagattgtaaagatcaggcttcaggttaagtccgactatgttgccgacgcagcccgtaatagcgtcaatgcaatatcggtgatcaaaaacctcggacttattggtttataccggggagccggcgcctgcttattaagagatattcctttctctgcaatatatttccccacctatgctcacattaaaagtaatgttttcaactttgaccccaaggattctgacaaacgcaataagctcaatacgtggcagttacttgtatccggtggtctagcagggatgccggcggcattcttgactacacctttcgatgttatcaaaacaaggttacagattgatccaaagaaaggtgaatctgtctacaacggaatatgggatgccgcgagaaccatattgaaagaggaaggaatcaagagctttttcaaaggagggcctgccagagttttaagatcctcaccacagtttgggtttacactggccgcctacgaaatatttcacaatctcttcccagcgcctaggtacgatgattctacgactcacagaccgactagagagccggttggcgctcttgctccaataaacaaaacagtcagtgcgtttttccccgatcaactagagcctcatgtgggcaataataagtgggcctctcgcctttatggtccaaacatcgatccatatagcagcagcttcctgaattattactacaaaagttgccaggtagcgaaggcgttcatggatctggattacaactttgcccacttcgatttcaacacataccagcagttccatgatgaattaaacgcaatgaagaataaaaagcactga

SEQ ID NO: 15815 - protein, 912 aa, Ashbya gossypii
MMELSSASTVKKKRQLAIFNAYATPLRQDERRLRASYEHGGVVGGHVASNEKVLLFDDFVDLISNSRSFYSKFTDHCFNLNQIPNTVFGCIFFAIDENNKGYLNVNDWFYFNNVLEYDNYHFIILYEFFRKFDAARERAYGPSVKSINYGNRFLSFDELYLDLEQFQATLRLLHSCVRDDFIVNNKLFLDWKQFRWLKWYQFYPRGLLQNGPHITLNSLISIVQNDLKSEKLLLGFHCLSQLDHRTNSMTISKNQLVYLMRLFYSHKIPADIFNSLNMSTLSCAKCDNNHINYNVFRDLFYLIQNFDLLNQIVHRYAEVHKFSDRDVREQHISRKDLLRFMNTEYNKINNIIEFSPAQISLLFSIVTNSKKLNYLNNARQNNPELSYHHRDSEIDSFIHNEYINGNAASSLHNESLEKFNDDFENIIQADAGDTKQQISSTDWRSVFSWSSFLSSFEWLHFKKRKSVQTNGLSDEYVNEALTLEDIMKIVNPNYLNDLVHHMELRRIESESRSSNLYFYPIFDSIYNFTLGSVAGCIGAMVVYPIDMVKTRMQAQRDFSKYKNSIDCLLKILSKEGVRGLYSGLGPQLIGVAPEKAIKLTVNDHMRATLAGRDGKLSLPCEIISGATAGACQVVFTNPLEIVKIRLQVKSDYVADAARNSVNAISVIKNLGLIGLYRGAGACLLRDIPFSAIYFPTYAHIKSNVFNFDPKDSDKRNKLNTWQLLVSGGLAGMPAAFLTTPFDVIKTRLQIDPKKGESVYNGIWDAARTILKEEGIKSFFKGGPARVLRSSPQFGFTLAAYEIFHNLFPAPRYDDSTTHRPTREPVGALAPINKTVSAFFPDQLEPHVGNNKWASRLYGPNIDPYSSSFLNYYYKSCQVAKAFMDLDYNFAHFDFNTYQQFHDELNAMKNKKH

SEQ ID NO: 15816 - DNA, 1355 bp, Drosophila melanogaster
  CDS (107)..(1060)
ctgtccccatcgccacttcacttcaccgctgcctgggctttccaaaattataattatttcggttttttgaattctaatctaattccccacctaacacccagtcagcatggatcgctccgccttcgcgtcccttgtcagcccgtaccgccgacgtccgtggatgacggagcacggagcggcggctgcggacagcggccaggtgggccttaagggcatcgtcgccggcggtattacgggcggcatcgagatctgcatcacctatcccaccgagtatgtgaagacacaactgcagctggacgagaagggagcggcgaagaagtacaacggcatctttgattgcgttaagaagacggtgggagaacgtggattcctgggtctctaccgaggtctcagtgtgctcgtctacggcagcattcctaagtcagcggcgagattcggtgcttttgaattcctgaaatcgaacgccgtggactcccgaggacaactgagcaactccggaaagttgctttgcggcttaggagctggcgtatgtgaggccatcgtggcagtgaccccgatggagaccatcaaggtgaagttcatcaacgatcagcgcagcggcaatcccaagttcaggggattcgcccacggcgttggccaaatcatcaagtcggagggcatctctggtatctacaagggcctaacgcccaccattctgaaacagggctccaaccaggccattcgcttcttcgtactggagtcccttaaggatttgtacaagggtgacgatcacacgaagccagtgcccaagttggtggttggagtgtttggagctatcgccggagcagcctctgtgttcggtaatacgccgctggatgtggtcaagacgaggatgcagggtctggaagcatcgaaatacaagaacactgcccactgtgcggtggagatcttgaagaacgaaggtcccgccgccttctacaagggcaccgtgccaagattaggtcgtgtgtgcctggatgtggccatcacctttatgatctacgactccttcatggatctgttcaacaaggtgtgggtgtaactcggcgattcggcttggcgacttagttacttagttcatccttctaccccaaaaaacccactcgtgcattttcctctgttcccattgttccctagtcgactgttgcaatagtttctagttttgtgacatattccaagaaagcattttatatacactctatacccgcaatgggtaagtggctatagaaattatacagcttgttttaaaaattgaattaaatctgaagagtctatttgaagttcccatataaatcatagctagactggatgaaaaaaaaaaaaaaaaaaaaaaaaaa

SEQ ID NO: 15817 - protein, 317 aa, Drosophila melanogaster
MDRSAFASLVSPYRRRPWMTEHGAAAADSGQVGLKGIVAGGITGGIEICITYPTEYVKTQLQLDEKGAAKKYNGIFDCVKKTVGERGFLGLYRGLSVLVYGSIPKSAARFGAFEFLKSNAVDSRGQLSNSGKLLCGLGAGVCEAIVAVTPMETIKVKFINDQRSGNPKFRGFAHGVGQIIKSEGISGIYKGLTPTILKQGSNQAIRFFVLESLKDLYKGDDHTKPVPKLVVGVFGAIAGAASVFGNTPLDVVKTRMQGLEASKYKNTAHCAVEILKNEGPAAFYKGTVPRLGRVCLDVAITFMIYDSFMDLFNKVWV

SEQ ID NO: 15818 - DNA, 948 bp, Plasmodium yoelii yoelii
  CDS (1)..(948)
atggagaaaaaaaatgagggggtaataaaaaacggggcatataaaaatttaataagtgggtcatttttacattgtctagaaacaggaacattaggattacctttagaagtatggaaaacacgaatgtgtatttatcgaaatgaaaatacgattaattcatttataaatatttataataaaggggttggacatttttatggagggttttatgctaaattggtagagagtagtactaaaggtgcagtattattattatcaaaagaaaagataatcaaagttttaaatgatttaaatgttaacaatactattagtggatttataggtggagcatgtggaggtatatgtcaatcgatagttatgactccatgtacattttttataactgcaagtattgataagaatattaattataaagataaattaatatctatttttaaacattctggaatttcaacattatataaaggaaattctgctatgtgtttaagacagggaacaaattgggctagtagacaaggcataaccgaatgggtgagaaatatatatattagtaaaaaacaaaaaaaaaatgaaagaaatgagataaaagagataaaagagagtgagcaaagaccaaatgacgttaaaatttgtgatatatcaaatccaaataaatttaaacaagataaaaaaaataataatgaattaaaaaccagtgaagaaattatttgtggtattataggtgggtcactatcagtatggaataacccttttgatgttattagagtttatatgcaaaataatgcaaataaaaatattaatttaagttttactcagtcatttattaatttatataaagaaggtggaatattatatttatacaaaggtgttatacctcgatgttttctttgtatttggcaaacattattcatggtgactggaattaaaataataaataactatttttag

SEQ ID NO: 15819 - protein, 315 aa, Plasmodium yoelii yoelii
MEKKNEGVIKNGAYKNLISGSFLHCLETGTLGLPLEVWKTRMCIYRNENTINSFINIYNKGVGHFYGGFYAKLVESSTKGAVLLLSKEKIIKVLNDLNVNNTISGFIGGACGGICQSIVMTPCTFFITASIDKNINYKDKLISIFKHSGISTLYKGNSAMCLRQGTNWASRQGITEWVRNIYISKKQKKNERNEIKEIKESEQRPNDVKICDISNPNKFKQDKKNNNELKTSEEIICGIIGGSLSVWNNPFDVIRVYMQNNANKNINLSFTQSFINLYKEGGILYLYKGVIPRCFLCIWQTLFMVTGIKIINNYF

SEQ ID NO: 15820 - DNA, 1155 bp, Neurospora crassa
  CDS (1)..(1155)
atggagtcactgccggccacaaggagggtacccgttccctccgaccagcattacaagggcgaccacattccgctcgtcgtatcccgcgaaacaggcgatatcgtaccagagtcacaccaagccgatccgttagtacggccagacaagatcgaagcaaccccctttgcaaaatcatgggcgcactttgttgcaggaggaatcggtggtatgacagccgcagccttaaccgccccgttagacgttctcaagacgcgactccagtccgacttctaccaagcacagctccgagcctcgcgacaatcgcacgtaggagtgcccctcaacccgattcgcgccgcctggtaccactttagcgagaccggccagattctgtcggctgtgtaccggcaagaaggcccccgcgccctgttcaagggcctcggccccaatctcgtcggcgtcgtgcccgcgcgctccatcaacttcttcacctacggcaacggcaagcggctgatcgccaagtacttcaacaacggacaggaaggcacatgggtgcacctcagcgcgggcgtgctggcgggcatcgtgaccagcaccgcgacgaacccgatatggatggtcaagacgcggctgcagctggacaaaaacgtggcggctgagagcggaggcgtgacgaggcggcagtaccagaacagctacgactgcatccggcaaatcctgcgcaacgaagggctccgaggcctgtacaagggcatgagcgcgagctacttgggcgtggccgagtcgacgctgcagtgggtgctatacgagcgcatgaagacggcgctggcgttgcgggaggagaagattgtgcagagcgggcgccaaaagacttggtgggaccacgcggtcaactggacgggcaatgcgggcgctgcgggcggcgcgaagcttgtcgcggccgtcctcacataccctcatgaggtcgcccgcacccgtctacgacaggcacccatggacggcggcaagcccaaatatacgggcctgatccagtgcttcaagctcgtgttcaaggaggagggcatggccggtctgtatggtggtatgacgccgcatatgctccggacggtgcccagcgccgccatcatgtttggcatgtacgaagccatcctcaggcttcttggtaccccgtcatga

SEQ ID NO: 15821 - protein, 384 aa, Neurospora crassa
MESLPATRRVPVPSDQHYKGDHIPLVVSRETGDIVPESHQADPLVRPDKIEATPFAKSWAHFVAGGIGGMTAAALTAPLDVLKTRLQSDFYQAQLRASRQSHVGVPLNPIRAAWYHFSETGQILSAVYRQEGPRALFKGLGPNLVGVVPARSINFFTYGNGKRLIAKYFNNGQEGTWVHLSAGVLAGIVTSTATNPIWMVKTRLQLDKNVAAESGGVTRRQYQNSYDCIRQILRNEGLRGLYKGMSASYLGVAESTLQWVLYERMKTALALREEKIVQSGRQKTWWDHAVNWTGNAGAAGGAKLVAAVLTYPHEVARTRLRQAPMDGGKPKYTGLIQCFKLVFKEEGMAGLYGGMTPHMLRTVPSAAIMFGMYEAILRLLGTPS

SEQ ID NO: 15822 - DNA, 897 bp, Mus musculus
  CDS (1)..(897)
atgtcggcctccaacgtcagcttactgcacgagacctccaggcaggtcgcggccggagggtctgcaggtcttgtagaaatttgcctgatgcatcctctcgatgtggtgaaaaccaggttccaggtgcagagaagtgtaacagacccacaaagttatagaactgtaagaggcagcttccagatgatcttccgaacagaggggttgtttggcttttacaagggaattatcccaccaattttagctgaaacaccaaaaagagcagtcaagttttctacctttgagctgtacaagaaatttctgggatatatgtcactatcaccagggctgacatttctcatcgctggcttaggatcgggactaacagaagctgtcgtggttaaccctttcgaggtggtaaaagttggcttgcaagtcaatcggaacttgttcaaagagcaaccatctacttttgcttatgcaagacaaatcattaagaaggaaggcttggggttccagggcctcgacaaaggattgacagcaactctgggacgtcacggaattttcaacatggtttattttggcttctaccacaacgtcaaaaatattattccatccagtaaggatccaaccttggagtttttgagaaaatttgggattggttttgtctcagggacaatgggctcagtgtttaacatcccctttgatgttgcaaagagtcggatccaagggccccagccagttcctggagagatcaagtaccgaagctgcttcaaaacaatggagatgatctaccgggaagaagggattttagccttatacaaaggcctggtccctaaggtgatgagacttggaccaggtggtggggtgatgttgctggtgtatgaatacacctatgcatggctgcaggaaaactggtga

SEQ ID NO: 15823 - protein, 298 aa, Mus musculus
MSASNVSLLHETSRQVAAGGSAGLVEICLMHPLDVVKTRFQVQRSVTDPQSYRTVRGSFQMIFRTEGLFGFYKGIIPPILAETPKRAVKFSTFELYKKFLGYMSLSPGLTFLIAGLGSGLTEAVVVNPFEVVKVGLQVNRNLFKEQPSTFAYARQIIKKEGLGFQGLDKGLTATLGRHGIFNMVYFGFYHNVKNIIPSSKDPTLEFLRKFGIGFVSGTMGSVFNIPFDVAKSRIQGPQPVPGEIKYRSCFKTMEMIYREEGILALYKGLVPKVMRLGPGGGVMLLVYEYTYAWLQENW

SEQ ID NO: 15824 - DNA, 927 bp, Plasmodium falciparum
  CDS (1)..(927)
atgagtaatgatttaataaatggttctattttgcattgtttagaaacagctagtttgggtatgcccctggaagtatggaaaacaagaatgtgtgtttacagaaatgaaaatacaattaaatcttttaagaatatatataataaagggctaggtcaattttatgctggtttttatgcaaaattaattgaaagtggtagtaaaggggcagttttattattatctaaagaacaaataataaaagtttgtaatgatatgaatattaacaagacaactagtggttttattggtggagcatgtggaggtatatgtcaatcattggttatgacaccttgtacatttttcataactgctagtattgataaaaaaattaattataaagaaaaattgatacatatatttaaaaatactggaattacaactttatataaagggaacactgctatgtgtttaagacaagggacaaattgggccagcaggcaaggaattactgaatggataagaaatatagttatggaaagaaaaaaaaatagaaaaaataaaaatgatgatataaataatgtaaaaggtatgattttttctggaaatgatattacaacagataaaataaaacataacaataataataataataataataatacaagccaatctaaatcacttgaattaacaacaagtgaagaacttttttgtggaattgttggaggtgctctttctgtttggaataacccttttgatgtggttcgggtttatatgcagaataatgcaaataaaaatattaagcttacattttttcagtcatttattcatttatataaagaaggtggtattctatacctctataaaggtgttatacctcgatgtttcctttgtatatggcaaacgttatttatggttactggcataaaaatattaaataaatatttttaa

SEQ ID NO: 15825 - protein, 308 aa, Plasmodium falciparum
MSNDLINGSILHCLETASLGMPLEVWKTRMCVYRNENTIKSFKNIYNKGLGQFYAGFYAKLIESGSKGAVLLLSKEQIIKVCNDMNINKTTSGFIGGACGGICQSLVMTPCTFFITASIDKKINYKEKLIHIFKNTGITTLYKGNTAMCLRQGTNWASRQGITEWIRNIVMERKKNRKNKNDDINNVKGMIFSGNDITTDKIKHNNNNNNNNNTSQSKSLELTTSEELFCGIVGGALSVWNNPFDVVRVYMQNNANKNIKLTFFQSFIHLYKEGGILYLYKGVIPRCFLCIWQTLFMVTGIKILNKYF

SEQ ID NO: 15826 - DNA, 1640 bp, Mus musculus
  CDS (101)..(1036)
ccacgcgtccgagtagcctccggctccgctgcttcccgagaaccccgcgccggaggctcggacccgaggtcgacgccgggcgcctctcctcctgcccgctatggctgcgcctcgcgggccccgcgctctgtcggccgccgcgccggggtccgggaagcccaaactgacgcaccccgggaaggcaatcctagcaggcggcctggctggaggcatcgaaatctgcatcaccttcccgaccgaatacgtgaagacgcagctgcagctagatgaacgagcgaacccaccgcggtaccggggcatcggagactgcgtgcggcaaactgtccgcagccatggcgtcctgggcctgtaccgcggcctcagctccttgctctacggctccatccccaaggcggctgtcaggtttgggatgttcgagttcctcagcaaccacatgcgggatgcccaaggtaggctcgacagcaggagaggactattgtgcggtctgggtgccggcgtggcagaagcagtggtagtcgtgtgccctatggagaccatcaaggtgaagttcatccatgaccagacttcctccaaccccaagtaccgaggatttttccacggggttagagagattattcgggaacaagggctaaagggaacataccaaggccttactgcgactgtactgaagcagggctcaaaccaagccatccgattctttgtcatgacctccctacgcaactggtaccaaggagacaaccacaacaaacctatgaacccactgatcacgggggtctttggagctactgcgggtgcagccagtgtctttggaaacacacctttggatgtgatcaagaccaggatgcagggcctggaggcacacaaataccggaacaccctggactgcggcttgaagatcctaaagaatgaggggccaaaggcattctacaagggcaccgttccccggctgggccgagtctgcctggatgtggccatcgtattcatcatctacgatgaagtggtgaagctgctcaataaagtgtggaagacagactaaccctggaggatgcagtggggtatcccagctcctccattccagaccccccgccacctactctgatgattccagtgcagtagtgccaaaaggccccttcctttgtccctcaagttctgtggcctggtgtgtcccatagttctgtatatcccatgtggtctgtgtgtgtgtaacactaccattgtatctgtgtccagcctggccatggctgggtgtctctttggcctgtgaatatgtgctcacttatccatgtgcttgcttgtgagccacatgcctgtttcgtgttctctgtcatgtgaccctgtgccccacttcctggggtgcctatgtgccctggttcatggccttggagccatggtcaggtcacagtccggtgccttccaccccctatggcaagggcgccctgccttggcctaccacagctgcctccaggcttagacctggcttcaccgcattccaggggctataggcccccctgcttttcccgccattggccttaaatggccctcgggccctccctccgcccggaacagggtggcacctgccactctcaggaccaccttgccaaggagaataaaccggatcctgttgcaaaaaaaaaaaaaaa

SEQ ID NO: 15827 - protein, 311 aa, Mus musculus
MAAPRGPRALSAAAPGSGKPKLTHPGKAILAGGLAGGIEICITFPTEYVKTQLQLDERANPPRYRGIGDCVRQTVRSHGVLGLYRGLSSLLYGSIPKAAVRFGMFEFLSNHMRDAQGRLDSRRGLLCGLGAGVAEAVVVVCPMETIKVKFIHDQTSSNPKYRGFFHGVREIIREQGLKGTYQGLTATVLKQGSNQAIRFFVMTSLRNWYQGDNHNKPMNPLITGVFGATAGAASVFGNTPLDVIKTRMQGLEAHKYRNTLDCGLKILKNEGPKAFYKGTVPRLGRVCLDVAIVFIIYDEVVKLLNKVWKTD

SEQ ID NO: 15828 - DNA, 1083 bp, Oryza sativa
  CDS (1)..(1083)
atggccgcccgctcccaatcgcagccgcacctcgacttcccctccctcttctccgacctcacctcgctcctcctccagcacccgccgcctccctcctcctcgtcgtcgcctggccccgtcttctcctcctcatctctctccatccccgcgcccgcgcctgcgtcggctgccgtcgccgccacggcgcctcccaccccgctcgcccgcgcggccatcggggcgtgcgcgggcgccgcggcgggggccttcacctacgccgctctgctccccatcgacgccgtcaagacccgcatccaggccggcgccgccgcgggggggtcgtggcaggtgttcctcgacatcctccgaaccgacgggcccctggggctctaccgcggcctctccgccgtcatcctcggctccgcgtcctcctccgccgtctacttcggcacgtgcgagctcgccaagtcgctgctccgcccccacctcccacccttcctcgtgccgccgctcgccggcgccagcggcaacgtctcctcctccgccatcatggtccccaaggagctcatcacccagcgcctccaatccggcgccgccaagggccgctcatggcaggtgctccttcagatcctccagaccgacggattcttcggcctctacgccggctacgccgccaccctcctccgcaacctccccgcgggggtcctcagctactcctccttcgagtacctcaaggcattcaccctcaagcaacgcaacaaggagagcctcacgccgggagagagtgtgctgtgcggcgctctcgcgggggccatatcggcggcgctcaccaccccgctcgacgtcgtcaagacgcgcctcatgaccagggtgggcaccgaggggagccgcaccgtggttgggacaatgcgggaggtcgtcgccgaggaggggctgatgggcttgtcccgggggattggtccgagggtgctgcacagcgcttgcttcgccgcgctgggatactgcgccttcgagacggcgaggcttgcgattctcaaatggtacattgaagactgcgagaggaaggctgcagcggagatgaaggctggagtaggcgctgcttga

SEQ ID NO: 15829 - protein, 360 aa, Oryza sativa
MAARSQSQPHLDFPSLFSDLTSLLLQHPPPPSSSSSPGPVFSSSSLSIPAPAPASAAVAATAPPTPLARAAIGACAGAAAGAFTYAALLPIDAVKTRIQAGAAAGGSWQVFLDILRTDGPLGLYRGLSAVILGSASSSAVYFGTCELAKSLLRPHLPPFLVPPLAGASGNVSSSAIMVPKELITQRLQSGAAKGRSWQVLLQILQTDGFFGLYAGYAATLLRNLPAGVLSYSSFEYLKAFTLKQRNKESLTPGESVLCGALAGAISAALTTPLDVVKTRLMTRVGTEGSRTVVGTMREVVAEEGLMGLSRGIGPRVLHSACFAALGYCAFETARLAILKWYIEDCERKAAAEMKAGVGAA

SEQ ID NO: 15830 - DNA, 972 bp, Sorghum bicolor
  CDS (1)..(972)
atggatacaacctctagggccgccaagatcccgtcgctccaccagacggagatcaactgggacaacctcgacaagaccaagctctacgtggtgggcgcaggcatgttcagcggcgtcaccgtggcgctgtatcctgtctcggtggtcaagacccggatgcaggttgcctctggggacgccatgaggaggaacgcgctggctaccttcaagaacatcctcaagatggacggcgtgccagggctgtaccgggggtttgctaccgttatcattggggctgtaccaactaggatcatcttcctcacagcgcttgagacaaccaaagcagcctcgcttaagcttgttgagcccttcaagctgtcagagccggtgcgggctgcctttgccaatggccttgctggtctgtcagcgtctacatgttcgcaggctatttttgttccaattgatgtgattagccagaaattgatggttcaaggatattctggtaatgccagatacaaaggtggattagatgttgctcgaaaggtcataaaggctgatggcattagggggctgtacagaggatttggactgtctgttatgacctatgctccatccagtgctgtgtggtgggcaagttatggttccagccagcgcataatttggagtgctcttggccatttgcatgacaaagaagaggctcctagccaattgaaactagttggtgttcaagcatcagggggggtttttgccggtgccgtgacctcttttgttacgactcccatagatacaataaagaccaggctgcaggttatggataatgaaaataagccaaaagccagggaagttgtcaaaagattgattgctgaagatggatggaaaggtttgtacagagggttgggtccaagatttttcagctcatcagcttggggaacctcaatgatagtatgctacgagtacctgaagcgcttgtgtgctaaagttgaagaggtctga

SEQ ID NO: 15831 - protein, 323 aa, Sorghum bicolor
MDTTSRAAKIPSLHQTEINWDNLDKTKLYVVGAGMFSGVTVALYPVSVVKTRMQVASGDAMRRNALATFKNILKMDGVPGLYRGFATVIIGAVPTRIIFLTALETTKAASLKLVEPFKLSEPVRAAFANGLAGLSASTCSQAIFVPIDVISQKLMVQGYSGNARYKGGLDVARKVIKADGIRGLYRGFGLSVMTYAPSSAVWWASYGSSQRIIWSALGHLHDKEEAPSQLKLVGVQASGGVFAGAVTSFVTTPIDTIKTRLQVMDNENKPKAREVVKRLIAEDGWKGLYRGLGPRFFSSSAWGTSMIVCYEYLKRLCAKVEEV

SEQ ID NO: 15832 - DNA, 957 bp, Fusarium oxysporum
  CDS (1)..(957)
atggctgctactatccgtaccgatcttccagctcccattggggacaagcagctggagaagaagcccatcaagttctccaacttgcttctcggcgctggtctcaacctcttcgaagtgaccaccctcggacagcctctcgaggtcgtcaagaccaccatggctgccaaccgaggtgacagcatggctgcggctttgggacgcgtctgggcccgcggtggtcccctgggcttctaccaaggtctcatcccctgggcttggattgaagcttccagcaagggcgccgtccttctcttcgtcgcctccgaggccgagtactacgcccgtgtcgctggtgcctctgagtttggcggcggtatccttggtggtgtcaccggtggtgttgcccaggcttacgccaccatgggtttctgcacctgcatgaagacggtcgagatcaccaagcacaagatggctgcctccggtgtcaagccccagtctaccttccagacctttggtgagatctaccgcaaggagggtattcgtggcatcaacaagggtgtcaacgctgtcgctatccgacagatgaccaactggggtagccgattcggtctcagccgtctcgctgagggttggatcaagtctctcactggcaagaaggagggcgagaagctgtccgctggtgagaaggtcatcgccagtgctcttggtggtggtctcagcgcctggaaccagcccattgaggtcatccgcgttgagatgcagagcaagaaggaggatcccaaccgtcccaagaagatgacggtcggcaacaccttcaggtacatttacgagaccaacggcgtcaggggtctttaccgtggtatcgctccccgtatttctcttggtatttggcagactgtctgcatggttgcttttggcgatatggcgaagacttatgttgagaagctgaccggcgagtcggtcaccgctaagcattag

SEQ ID NO: 15833 - protein, 318 aa, Fusarium oxysporum
MAATIRTDLPAPIGDKQLEKKPIKFSNLLLGAGLNLFEVTTLGQPLEVVKTTMAANRGDSMAAALGRVWARGGPLGFYQGLIPWAWIEASSKGAVLLFVASEAEYYARVAGASEFGGGILGGVTGGVAQAYATMGFCTCMKTVEITKHKMAASGVKPQSTFQTFGEIYRKEGIRGINKGVNAVAIRQMTNWGSRFGLSRLAEGWIKSLTGKKEGEKLSAGEKVIASALGGGLSAWNQPIEVIRVEMQSKKEDPNRPKKMTVGNTFRYIYETNGVRGLYRGIAPRISLGIWQTVCMVAFGDMAKTYVEKLTGESVTAKH

SEQ ID NO: 15834 - DNA, 951 bp, Trichomonas vaginalis
  CDS (1)..(951)
atggcacagccagcagaacagatcctcatcgctacatctccaaagccatccctctcaccagttgagcgcctttccgtcggcttcatcgctggtacactttcccgtacacttacatccccacttgatgtcgttaagatgctcatgcaagtttcctcccgcggtggttccgctaaggatacaattgctcaactctggaaggagcagggcatcgccggcttctggcgtggcaactgggctgcttgcatcagactcggcccacaatccgctatcaagttctacgcttacgaagaactcgagaagcgtatcggcaagggcaagccacttgtcggcatccagcgtacagtcttcggctccctctctggtgttatctcccaggttctcacatacccacttgatgtcatccgtacacgtatcacagtctactcaggcaagtacacaggtatcttcaactgcgcattcacaatgctcaaggaagaaggattcacatcactcttcgctggtatcgtcccaacagttatgggcgttatcccatacgaaggcgctcagttctacgcttatggtggcctcaagcaactctacacaacaaagattgccccaggcaagccaatctcaccatgggctaactgccttatcggtgccgctgctggtatgttctcacagacattctcatatccattcgatgttatcaggaaacgcatgatgctcaaggatgagaagggcaagccaatctacagcggcatgatgcaggccttctctacagtttacgccaaggaaggcgttgccggcctttaccgtggtgttggcctcaaccttatcaaggttgtcccatttgctgccctccagttcacaatcctcgaagaaacacgccgtgccttcttcaaggttcgcgctgctatcgaccagaagaaggtcgaagagatcaagggaaaggttgctccaaagaagaaataa

SEQ ID NO: 15835 - protein, 316 aa, Trichomonas vaginalis
MAQPAEQILIATSPKPSLSPVERLSVGFIAGTLSRTLTSPLDVVKMLMQVSSRGGSAKDTIAQLWKEQGIAGFWRGNWAACIRLGPQSAIKFYAYEELEKRIGKGKPLVGIQRTVFGSLSGVISQVLTYPLDVIRTRITVYSGKYTGIFNCAFTMLKEEGFTSLFAGIVPTVMGVIPYEGAQFYAYGGLKQLYTTKIAPGKPISPWANCLIGAAAGMFSQTFSYPFDVIRKRMMLKDEKGKPIYSGMMQAFSTVYAKEGVAGLYRGVGLNLIKVVPFAALQFTILEETRRAFFKVRAAIDQKKVEEIKGKVAPKKK

SEQ ID NO: 15836 - DNA, 993 bp, Drosophila melanogaster
  CDS (73)..(993)
cggtgtcggttgttgacccgtagtgttctagttggggtatttggattcagtagtagcagtagcgtcgtaaggatggccggacagcagcacgatatttcgcacgccaagcgggccgcctttcaggttttggccggcggctcggccggattcctggaggtctgcatcatgcaaccactcgatgtagtcaaaactcgcatccagatccaggccactcccgcgccgaatgccgcagctcttggtgaggtgcactacaatggcgtcttcgattgcttcgccaagatgtaccgccacgagggcatctcctcctactggaagggcatcatgccgccaatcctggccgagacgcccaagcgggccatcaagttcctggtgttcgagcagacgaagccgctctttcaattcggctcgcccactcccacgccgctgaccttttctctggctggactgacagccggcacactggaagccatagccgtgaatcccttcgaggtggtgaaggtggcccagcaggctgatcgccaaaaaaagatgctcagcacgttcgccgtggccaagggtatcatacagcaggacggattgggcttcagcggcctcaacaagggcatcaccgccaccatgggacgcaatggagtcttcaacatggtgtacttcgggttctaccacagcgtgaagaacgtggtgcccgagtacaaggagagccatttggagtttctgcgcaaggtgaccatcggcttcctggccggcactctggcctgcttcgtcaacatcccattcgacgtggccaagtcacgcatccagggaccgcaaccggtccccgggcagataaaataccgaggaaccctcagctccatgggcatcgtctaccgcgaggaaggattccgagcgctgtacaaagggctcgttcccaagattatgcgtttgggcccaggtggagctattctgctgctggtcttcgagtactcctacgattacctgctccacaactactcctag

SEQ ID NO: 15837 - protein, 306 aa, Drosophila melanogaster
MAGQQHDISHAKRAAFQVLAGGSAGFLEVCIMQPLDVVKTRIQIQATPAPNAAALGEVHYNGVFDCFAKMYRHEGISSYWKGIMPPILAETPKRAIKFLVFEQTKPLFQFGSPTPTPLTFSLAGLTAGTLEAIAVNPFEVVKVAQQADRQKKMLSTFAVAKGIIQQDGLGFSGLNKGITATMGRNGVFNMVYFGFYHSVKNVVPEYKESHLEFLRKVTIGFLAGTLACFVNIPFDVAKSRIQGPQPVPGQIKYRGTLSSMGIVYREEGFRALYKGLVPKIMRLGPGGAILLLVFEYSYDYLLHNYS

SEQ ID NO: 15838 - DNA, 958 bp, Drosophila melanogaster
  CDS (65)..(958)
acaactttagttaatactccgacgggatgacttaaagtggatgccccaacatcatttctaggacatggcagcggaattgggtctggaatcggccgcggggtccgtggcaatcaaaatgcaagagccggtcaataaattaaaatttttccatgcacttgttgcaggaggagtggctggaatggtagtggacatagcgctgtttcccatagatacagtgaagacccgactgcaaagcgagctgggcttttggcgggcaggaggattcaggggcatctacaaaggactcgctcctgcggctgcaggaagtgctcccacggcggccctgtttttctgcacctacgagtgcggaaagcagttccttagttcggtcacccaaaccaaagattcaccctatgttcacatggcagcggcttcagcagcagaagtgttggcatgcttgatccgagttcccgtggagattgccaagcaacgctcccaaacattgcagggcaacaaacagtccggcctgcaaattctactgcgtgcctatcgcactgagggattgaaacgtggtctgtacaggggatttggttccactatcatgcgggagattccatttagtctgatacagtttccgctctgggagtactttaagctgcaatggactcccctgaccggcttcgattccactcctttttcggtggctctttgtggagctgtcgctggaggcatttcagcgggattaactacgccgctcgatgtggtcaaaacccgaattatgctggctgaaagggagagtctcaaccgacgtcgcagtgcccgaagaattttgcatggcatttacctggagcgaggcttcagcggtctgtttgctggctttgtgccgcgtgtgctgtggatcacactgggcggtgcattcttctttggcttctacgacctgacgacgcgaatccttggcgccaccagtacggatcattaa

SEQ ID NO: 15839 - protein, 297 aa, Drosophila melanogaster
MAAELGLESAAGSVAIKMQEPVNKLKFFHALVAGGVAGMVVDIALFPIDTVKTRLQSELGFWRAGGFRGIYKGLAPAAAGSAPTAALFFCTYECGKQFLSSVTQTKDSPYVHMAAASAAEVLACLIRVPVEIAKQRSQTLQGNKQSGLQILLRAYRTEGLKRGLYRGFGSTIMREIPFSLIQFPLWEYFKLQWTPLTGFDSTPFSVALCGAVAGGISAGLTTPLDVVKTRIMLAERESLNRRRSARRILHGIYLERGFSGLFAGFVPRVLWITLGGAFFFGFYDLTTRILGATSTDH

SEQ ID NO: 15840 - DNA, 900 bp, Homo sapiens
  CDS (1)..(900)
atgtccgccaagcctgaagtcagcttagtgcgcgaggcttctcggcagatcgtggccggtggttctgcaggtcttgtagaaatttgcctgatgcaccccctagatgtggtgaaaaccaggtttcagattcagagatgtgcaaccgatccaaacagttataaaagcttggtagacagctttcgaatgattttccaaatggaagggttatttggtttttacaagggaattctgccacctatcttggctgaaaccccaaaaagagcagtgaagtttttcacctttgagcagtacaagaaattgctgggatatgtgtcactgtcaccagcattgacattcgccattgctggattgggatctggactaacagaagccattgtagttaacccttttgaggtagtaaaagttggcttgcaagcaaatcggaacacatttgcagagcaaccatccactgtgggttatgcaagacaaatcattaagaaggaaggctggggactccagggcctcaacaaaggattaactgcaactttgggacgacatggagttttcaacatggtttattttggcttctactacaatgtcaaaaacatgattcctgtcaataaggatccaatcttggagttttggagaaaatttgggattggtcttctctcggggacaatagcctcagtcattaacatcccttttgatgttgccaaaagtaggattcaagggcctcaaccagttcctggagagatcaagtacagaacctgttttaaaacaatggcaacagtctatcaggaagaagggattttagctttgtacaaaggcctgcttcccaagattatgagacttggaccaggtggtgcagtgatgctgctggtttatgaatacacctattcatggcttcaagagaactggtga

SEQ ID NO: 15841 - protein, 299 aa, Homo sapiens
MSAKPEVSLVREASRQIVAGGSAGLVEICLMHPLDVVKTRFQIQRCATDPNSYKSLVDSFRMIFQMEGLFGFYKGILPPILAETPKRAVKFFTFEQYKKLLGYVSLSPALTFAIAGLGSGLTEAIVVNPFEVVKVGLQANRNTFAEQPSTVGYARQIIKKEGWGLQGLNKGLTATLGRHGVFNMVYFGFYYNVKNMIPVNKDPILEFWRKFGIGLLSGTIASVINIPFDVAKSRIQGPQPVPGEIKYRTCFKTMATVYQEEGILALYKGLLPKIMRLGPGGAVMLLVYEYTYSWLQENW

SEQ ID NO: 15842 - DNA, 1456 bp, Rattus norvegicus
  CDS (100)..(996)
gacgggacccggtctccatcggcggcggccttcagcgagcggcggccttcagaggagctcgctccagcatcttggctactctgtcccctggtcacgaagatgtcggcctccaacgtcagcttgctgcacgagacctgcaggcaggtcgcggccggagggtgtgcaggtcttgtagaaatttgcctgatgcatcccctcgatgtggtgaaaaccaggttccaggttcagagaagtgtaacagacccacagagttataaaagcttaagagacagctttcaggtgatcttccgaacagaggggttgtttggcttttacaagggaattatcccaccgattttagctgaaacaccaaaaagagccgtcaagttttccacctttgagctgtacaagaaatttctgggatatatgtcactatcaccagggctgacatttcccattgctggattaggatctggactaacagaagccgtcgtggttaacccttttgaggtggtaaaagttggtctacaagtcaatcggaacatgttcacagagcaaccatctacttttgcttatgcaagacaaatcattaagaaggaaggctgggggttccagggcctcaacaaaggatttacagcaactctgggacgccacggaattttcaacatgacttactttggcttctactacaacgtcaaagataatattccatccagtaaggatccaaccttggagtttttgagaaaatttggaattggttttgtctccgggacagtgggctcagtctttaacatcccctttgatgttgcgaagagtaggatccaaggacctcagccagttcctggagagatcaagtaccgaggctgcttcaaaaccatggagacggtctacagggaagaagggattttagccttatacaaaggcctgctccccaaggtgatgcgacttggaccaggtggtggggtgatgctgctggtatatgaatacacctatgcgtggctgcaggagaactggtgaaggactgagagacgctttccccttgacacagagatgtggtctgcagccccacgcagagaagcaagtagcgatgccgttaagagggggagacagcctgctcaggagcaaagcctgttccgatgttttataatttttagacaaactgacatggtagtttgggccatatacataacactgtgagaaggaaaataacacgaagcagtggggtttgtaagttagggatcactaggatagagatcagatacagttcataaaagctatacaaagtgtctgacccccatgcttcaccacaaaaactcatttgataacttttctgagaagtctataaatccataaattcttgaaaataaattgttcctgcagctgatttcctgagaattattcaaaggaagacttaggtatgagtcagaatttaaacatgttttacaaggaattacttttccataaatcatattttaaa

SEQ ID NO: 15843 - protein, 298 aa, Rattus norvegicus
MSASNVSLLHETCRQVAAGGCAGLVEICLMHPLDVVKTRFQVQRSVTDPQSYKSLRDSFQVIFRTEGLFGFYKGIIPPILAETPKRAVKFSTFELYKKFLGYMSLSPGLTFPIAGLGSGLTEAVVVNPFEVVKVGLQVNRNMFTEQPSTFAYARQIIKKEGWGFQGLNKGFTATLGRHGIFNMTYFGFYYNVKDNIPSSKDPTLEFLRKFGIGFVSGTVGSVFNIPFDVAKSRIQGPQPVPGEIKYRGCFKTMETVYREEGILALYKGLLPKVMRLGPGGGVMLLVYEYTYAWLQENW

SEQ ID NO: 15844 - DNA, 1151 bp, Bos taurus
  CDS (8)..(943)
cgccgccatggctgcggctcgcgcaccccgcgctctgacctctgcctcgcctgggtctgggaaagccaaactgacacacccagggaaggcgatcctagcaggcggcctggctggcggcatcgaaatctgcatcactttccccaccgagtacgtgaagacgcagctgcagctggacgagcgctcgcacccgccgcgctaccggggcatcggggactgcgtgcggcagacggttcgcagccatgggctcctgggcctgtaccgcggccttagctccctgctctacggctccatccccaaggcggccgtcaggttcgggacgttcgaatttctcagcaaccacatgcgggacgcccagggacggctggacagcacgcgcgggctgctgtgcggcctgggcgccggagtgccagaggccgtggtggtcgtgtgccccatggagaccatcaaggtgaaatttatccatgaccagacctctgccagccccaaataccgaggattcttccacggggtcagggagatcgtgcgggaacaggggctgaaggggacgtatcaaggcctcacagccaccgtgctgaagcagggatccaatcagggcatccgcttcttcgtcatgacttccctgcgcaactggtaccgaggagacaaccccaacaaacccatgaacccactgatcactggtgtgttcggagccatcgcaggcgcagccagtgtcttcgggaacactccactggacgtgatcaagacccggatgcagggactggaagcacacaagtaccggaacacgttggactgcggcctgcagatcctgaggaacgagggactcaaggcgttctacaagggcactgtcccgcgcctcggccgagtctgcctggacgtggccatcgtgttcatcatctacgacgaggtggtgaagcttctcaacaaagtgtggaaggcggactgagccctggggtctgcgcgcgggccgtccccagccgccctcttacaattccagcgcagtcgtcggaaaaggcccttccctgtcccgcgtgctccgtggcctgggtgtgccgtgccgggtcctcacgtcctctgtggtcttgtatccaccaccacaatgtctgtgtccacgtgagactgtgtgtcctctcctgtgaatcttgccgcttgtc

SEQ ID NO: 15845 - protein, 311 aa, Bos taurus
MAAARAPRALTSASPGSGKAKLTHPGKAILAGGLAGGIEICITFPTEYVKTQLQLDERSHPPRYRGIGDCVRQTVRSHGLLGLYRGLSSLLYGSIPKAAVRFGTFEFLSNHMRDAQGRLDSTRGLLCGLGAGVPEAVVVVCPMETIKVKFIHDQTSASPKYRGFFHGVREIVREQGLKGTYQGLTATVLKQGSNQGIRFFVMTSLRNWYRGDNPNKPMNPLITGVFGAIAGAASVFGNTPLDVIKTRMQGLEAHKYRNTLDCGLQILRNEGLKAFYKGTVPRLGRVCLDVAIVFIIYDEVVKLLNKVWKAD

SEQ ID NO: 15846 - DNA, 24 bp, Primer
atgccatctaccactaatactgct

SEQ ID NO: 15847 - DNA, 24 bp, Primer
ctaatgtttggcaactggggtttc

SEQ ID NO: 15848 - DNA, 2995 bp, Saccharomyces cerevisiae
  CDS (328)..(2568)
ttttttggaaaataattcaatacatactcaatataaagaaatcataactctactttagcatataggaaatagactctttcgaaaaaacctctttctgtagtgttagaaagcaaccggctattatttttgtgtgtcttcgaaaaatcggaacccaaacagatcttagcggattcatggtaaaaatagccttgaagaatttaggaaaataaatagatactcaaaaaggaatagaggatcttaacaaatcattacattacttaactcacattaaaagcaaacacctttcttaagctgttggtgcaaaaaaggattacatctattgcccttatgaatttgttttggccatcggaaaccaaaaagcaaaatgaaatacctggtggcgattatacacctgggaactcaccttcagtacaaaagggttatcaattcctcaatcgagacatatttaaaagttgtccacgaattatggaaaggcagtttggtgagtgtctgcacaatagaacgcatttaatcaaggatttaatttcttctggcaatgttggactaggtcccattgagattgttcacatgtcctacttaaacaaacatgaaaaagaagagtttggtgaatatttctacgttacagggatcgaagtttccggtcctgcaatgcccgtagagtttcttgaagtgctaaaatcgagtaagcggatttccaaaaatatatcgaataatatcatattgacttattgctgttttaattttttcagcaatctagacatccgtattagatacgatgctgacgatactttccagacaacggcaattgactgtaacaaggaaaccactgacctgaccatgacagaaaaaatgtgggaagaaacgttcgcaagttctgtcatccgagcgataataacaaatactaatccagagttaaaacctcccggtttagtagagtgtccattctacgttggaaaagatactatctcctcttgcaaaaagatcatagaattactctgccgattcttaccacggtcactgaattgcgggtgggattctaccaagagtatgcaagccaccattgtcaataactatttaatgtatagtttaaaaagttttattgcaatcacgccaagcctagtggattttacaatcgactacctgaaaggacttaccaagaaagatccaatccatgacatatactacaagacggctatgatcacaattctagatcacatagaaacaaaggagttagacatgataactattttaaatgagacgctcgacccccttttatctctgctaaatgatttaccgcctcgcgatgctgattcagcacgattaatgaattgcatgagtgacttgctgaacattcaaacaaattttttgttaaacaggggtgattacgaactagcattaggcgtctctaacacatcaaccgaactagccttagactcttttgaatcttggtacaacctagcgagatgccacatcaaaaaagaggagtatgaaaaggctctcttcgcaataaattcaatgcctcgtttgcgcaaaaatgatggacacctggaaacaatgtacagtaggtttcttacctccaattattataaaaagccattgaatggtacccgcgaacactacgacttgactgcaatggaattcacgaatctctcgggaacgttgaggaattggaaagaggatgagttaaaacggcaaatttttggaagaatcgcaatgataaacgaaaaaaaaatcggttatacaaaggaaatctgggatgatattgcgataaagttgggtccgatttgtggtccacaatctgtgaatctgattaattatgtctcccctcaagaggtcaaaaacataaaaaatatcaatttaatagcaaggaatacgatcggcaaacaattgggatggtttagtggtaaaatatatgggttattaatggaaattgtgaacaaaattggttggaatggcttattaaacatccgaacagaagctttcatgatggaaactgaattctatcaagcttctaacaacattatcgatgaaaacggtcatataccgatggaatcccgaaagaaaaggttttgtgaagggtggctagatgatttatttttagatttatatcaagacttgaaattgagcaagattagcctaagcaataaagatgaaaaacacagcggattagagtgggaacttttgggtttgatcatgctgcgtacctggcattgggaagatgccgtagcttgtctaagaacaagcatagtagctcgattcgaccccgtaagttgccagcagctgctaaaaatatacctgcaacctccaaaaaatattcaagaggttacattactagacacagataccataataagtttattaattaagaaaatatcatatgattgcaggtattataattattgccagatatttaatctgcaactgctagaaaagctatgcaacgaattggggacgcatatactgcgtaataagatccttcttcaaccttccataggagacgaaatcatggtcatgatcgatgccatgcttgcgtggatagccgacctagatcacacagtacaaccttgaacaaaacggtgctcttagtattattatataaccactacggttggatggactgagggtaagggtaaccgtataccttttatttttttttttacattttgaactgggaagaaaattttttttgcgagggattgacggctaacgccaaaacactccgaagagaatgagaaaagcttgggcatcgctcgaagtcatcgaacgggactatttttgtttaaaatttcaccagatctgcttgataagggtagtttagcttgtgtatttgggaaaggtacgcaaaagatatattttactaagatctttaaatatttttagcttgaggtaatacatgctaattttagttgattagagattctgaaaaattcgttttagttagtgtttaagaatagtggcgtttatcgttttgcccatttaataattaggaaaaaat

SEQ ID NO: 15849 - protein, 746 aa, Saccharomyces cerevisiae
MNLFWPSETKKQNEIPGGDYTPGNSPSVQKGYQFLNRDIFKSCPRIMERQFGECLHNRTHLIKDLISSGNVGLGPIEIVHMSYLNKHEKEEFGEYFYVTGIEVSGPAMPVEFLEVLKSSKRISKNISNNIILTYCCFNFFSNLDIRIRYDADDTFQTTAIDCNKETTDLTMTEKMWEETFASSVIRAIITNTNPELKPPGLVECPFYVGKDTISSCKKIIELLCRFLPRSLNCGWDSTKSMQATIVNNYLMYSLKSFIAITPSLVDFTIDYLKGLTKKDPIHDIYYKTAMITILDHIETKELDMITILNETLDPLLSLLNDLPPRDADSARLMNCMSDLLNIQTNFLLNRGDYELALGVSNTSTELALDSFESWYNLARCHIKKEEYEKALFAINSMPRLRKNDGHLETMYSRFLTSNYYKKPLNGTREHYDLTAMEFTNLSGTLRNWKEDELKRQIFGRIAMINEKKIGYTKEIWDDIAIKLGPICGPQSVNLINYVSPQEVKNIKNINLIARNTIGKQLGWFSGKIYGLLMEIVNKIGWNGLLNIRTEAFMMETEFYQASNNIIDENGHIPMESRKKRFCEGWLDDLFLDLYQDLKLSKISLSNKDEKHSGLEWELLGLIMLRTWHWEDAVACLRTSIVARFDPVSCQQLLKIYLQPPKNIQEVTLLDTDTIISLLIKKISYDCRYYNYCQIFNLQLLEKLCNELGTHILRNKILLQPSIGDEIMVMIDAMLAWIADLDHTVQP

SEQ ID NO: 15850 - DNA, 2298 bp, Saccharomyces cerevisiae
  CDS (1)..(2298)
atgagttttttatgggggtctacaaagtccaagaaaggcaagaataaaaaggctgcaggttctcttccgtcaggtgttgttccacagcaacgtgtgaaaccaacacgtaaaaacgttcctatagattatccaagaactttggaaaaagtacatggtgaaagtttaatctttaggacgtcccttttaagtgaattggtgagcactggtaaatctggtattggtcctccagacttgattcattgtacagagttagataaatttcacgatgagaaaataggtgaattcttttacatcacggggatcgacgcctcgagcgtctctatgccaattgcatttttgaagctgataaaatggaatgatggtaagaaactaaaatcagcatctttgaagaacgacgacatcacaacctactgcactttcaatatctttcaaaaattggacattagattaagatatgaatctgaagatgtttatcaagttaatatcgttgactgtttaaatggcaacaatgaaataccgttgagtgatcttatttgggaagaaactttcgttagctgttgcataagaagcgtaattattaattcagattttgaaagaaaaatacctgggctagtggaattaccatttgtttttgagaacagatgcgcgagtgattataaaagggtgatagattcgttatgcaaatttttgccaagatttttagaatgtggttgggattctacaaagagcgtctatgcaacgatactgaataactacctaactgaatcattattagtatttctgtctataactccagaattcataacagactatgcgatccaggttttagacaacttgatgacgaatgacccgtcaaattctagatattacgctattgtaattatttctatcatggagcgaagtaatgaccgcgatgtagaaatgatcaaacggatacacgagatattagacctattactacccgtactgtatggattgccatccgatgaaccttacatttctgatttgatcaattgcatcaccgatgtattaagcatccaagcaaggtttctattgaacaataacgactatgaactttctttatccatttccacattggccacgaatttatcttctgataattttgaatcttggtatctgttatctaaaggctatattttttcacaacagtatgataaggcactgctctcaatcaattcgatgccctgtttagcggaatatgatatcgttaaacaagcccagattaacgcttttaagttttatatgaactactacaaggcaccactatgtcatagcagagaacactgtaccatgacatcacacgagttaaatcacctcatgaatattatgcattatgaaaatgagttggagttgaagacaataatatttggacgcactgtaatgcccaatgaatctaagtatggatgtattgaagagatatggaataaatcctgtcttgaattaggacctatttgtggaccacagagtgacaatctcataaactttgtatctcagcaggaggtaaatacagtaggagatatgctgttactaaaacgaagcaaagaaaccagacaagagagttggtttataaagcaagtacgtcttctgttgatggaattagtcgctagaatcggctggaacgccttacttcagctaagatctgacgttttcgttatggagagtaaattcaaaatgatagaatcttcggacaagctgtccacagaattacgccagaagaggctctgtcagagatggtttgatgctatgtttctggacgtttacgaagatttaagtattagcacttcatctcaagaaaataaggctacggcgaaatacagcgggttggaatgggaactacttggcttaactctgcttcgagtgagtgacttacccgatgcagtagcgtgtctacgaactagtattttggcaaggtttgaccctattagttgtcaccatctgttgaacttttatttaaccatggattttaatgatgagtttatgagaaggtttgacgtcgatatcattttagatctattagtgaaattgatctcctttcggatacgattctatgatagatttcagatattttcccttcaagtactaaggaaactagagggacagctgggctccgaaattattaagaataaaataattaattctccttacgggcaagctggcatcacttcggtgatagattatatgcttgaatgcctctctaaaaataggaatgaagcctgcctagcctatgaacgccctcttccagatcttccttccactatcaaacctctggcagactaa

SEQ ID NO: 15851 - protein, 765 aa, Saccharomyces cerevisiae
MSFLWGSTKSKKGKNKKAAGSLPSGVVPQQRVKPTRKNVPIDYPRTLEKVHGESLIFRTSLLSELVSTGKSGIGPPDLIHCTELDKFHDEKIGEFFYITGIDASSVSMPIAFLKLIKWNDGKKLKSASLKNDDITTYCTFNIFQKLDIRLRYESEDVYQVNIVDCLNGNNEIPLSDLIWEETFVSCCIRSVIINSDFERKIPGLVELPFVFENRCASDYKRVIDSLCKFLPRFLECGWDSTKSVYATILNNYLTESLLVFLSITPEFITDYAIQVLDNLMTNDPSNSRYYAIVIISIMERSNDRDVEMIKRIHEILDLLLPVLYGLPSDEPYISDLINCITDVLSIQARFLLNNNDYELSLSISTLATNLSSDNFESWYLLSKGYIFSQQYDKALLSINSMPCLAEYDIVKQAQINAFKFYMNYYKAPLCHSREHCTMTSHELNHLMNIMHYENELELKTIIFGRTVMPNESKYGCIEEIWNKSCLELGPICGPQSDNLINFVSQQEVNTVGDMLLLKRSKETRQESWFIKQVRLLLMELVARIGWNALLQLRSDVFVMESKFKMIESSDKLSTELRQKRLCQRWFDAMFLDVYEDLSISTSSQENKATAKYSGLEWELLGLTLLRVSDLPDAVACLRTSILARFDPISCHHLLNFYLTMDFNDEFMRRFDVDIILDLLVKLISFRIRFYDRFQIFSLQVLRKLEGQLGSEIIKNKIINSPYGQAGITSVIDYMLECLSKNRNEACLAYERPLPDLPSTIKPLAD

SEQ ID NO: 15852 - DNA, 2175 bp, Saccharomyces cerevisiae
  CDS (1)..(2175)
atgttgtctcaaacctccataccggaagtgaaagaagacgtgataggctatgcgctacaccagaggagagccagagtgggacaattccaagacttgggtccgcctgatttaattactttgatcaaatcgttaccttcatcctcgagcacaacaactgctactgcctccgccaacgataacggagcaacttcaaacatcaatggacaagatcctacgaccatagttacggagttacattcccatgacaaattaaaggggcagatcggcactttcttttactgtatgggtatcgatacttcggatccaacttctattacaatctttgccaaaaagataaccgatcttttcttagacacgccccaaatttggtttggtaagaagaagcactttcacgtatcgaagatttctatcagttcttggaatgcgtttaggaaatatgatgttaacattatagttcacattccaggaactgtgcaaacctacattataaatagcgacggtgaacaatcgcaacttccctccgtggcagaagcgtcatctggccgcaactcacaggatttaaacgtcaacatgatttgggcggaaacgtttatgagtggtattgtacgtgacattatgattatgaaagataatcgtgcggatggagaatcccagaatttggtagaaacactaattttcaatccatttacctcgggtgagttggaagatgttgccaataactttattaaactgttccccttggtctatgaaaaaggtgtttatttagatgcacctactcacgttttaaatccctcgttaaccaataattatttagtggaaactttagtggaaatagttaggttaactaagagtttggaagcatgtcgtaaaatgctcaagaagttaatagaaattcatccagaagcagtaataatattaattcgtgtttattttgcgtgcgatttagagatagatgcagttgacctgatcaacgagcaactaaattccccctcttcgttcttagccgacgattcaaagactagccatatccagctaatcttcaaatccgaattattaagtattcaaagtgaattcttactggatgtcaagagagattacaagcttgctaaggaagtagccatggaggctgttaactgtgcaccaaacgaatttaaaacttggtatttattgactagaatatacattaaactaaacgatatgtcaaatgccttgctatcgttaaacgcctgccccatgtcacaggttaaggaaaaatacgttcttagaagaattgcgcctattacttcagatgaaaatcttcatctgccattaccattggatgcctcaattgaggagatttcgtcattgaaccccatggatgtccagttggagcaaaagtccgcagatccaaacctagtcaatctctctgcgtcaagtttaaagtctactttccaactagcctataaattattgacagaaattgtccaaataacaggatgggagcagctgttgaaatatagatcaaaaattttcgttatggaagacgagtaccaaggctccacttcttccattgatgaagcagaagttcgcggtaatgatatatccaaaatgagatcaaagaggctatgcgaaagatggttggataatctcttcatgttactatacgaagatttgaaaacttacaccgattggcaatcagagcaattgtattttgatgctcaaaacagtaaatatcacaaattaactgttgaatgggaattattcggcctttgtgcgaaaagactgggacatcttccagaagctgcgaaggctttccaaattgggctttcccaaagattttctccagtatgcgcaaagaatctattacagttttacattgacgagcataagcgtattaggagggattcagtctcagcaaactccgagttaacctcttctcaaatattgtcaagtatcaatgacatcgacagctcaatcatcgatctagtagtcaagatttgttgctggaatcatcgttggtacatcgagttctcaataatattaatagatgctctgagtgttgcagtacaagatatgggcattactaaagtacataatgaaattgcctctagattttctgacccagtagcccaattgattgacgataacattctaaattttctgaagaatttcacgaatgacactttcgataattag

SEQ ID NO: 15853 - protein, 724 aa, Saccharomyces cerevisiae
MLSQTSIPEVKEDVIGYALHQRRARVGQFQDLGPPDLITLIKSLPSSSSTTTATASANDNGATSNINGQDPTTIVTELHSHDKLKGQIGTFFYCMGIDTSDPTSITIFAKKITDLFLDTPQIWFGKKKHFHVSKISISSWNAFRKYDVNIIVHIPGTVQTYIINSDGEQSQLPSVAEASSGRNSQDLNVNMIWAETFMSGIVRDIMIMKDNRADGESQNLVETLIFNPFTSGELEDVANNFIKLFPLVYEKGVYLDAPTHVLNPSLTNNYLVETLVEIVRLTKSLEACRKMLKKLIEIHPEAVIILIRVYFACDLEIDAVDLINEQLNSPSSFLADDSKTSHIQLIFKSELLSIQSEFLLDVKRDYKLAKEVAMEAVNCAPNEFKTWYLLTRIYIKLNDMSNALLSLNACPMSQVKEKYVLRRIAPITSDENLHLPLPLDASIEEISSLNPMDVQLEQKSADPNLVNLSASSLKSTFQLAYKLLTEIVQITGWEQLLKYRSKIFVMEDEYQGSTSSIDEAEVRGNDISKMRSKRLCERWLDNLFMLLYEDLKTYTDWQSEQLYFDAQNSKYHKLTVEWELFGLCAKRLGHLPEAAKAFQIGLSQRFSPVCAKNLLQFYIDEHKRIRRDSVSANSELTSSQILSSINDIDSSIIDLVVKICCWNHRWYIEFSIILIDALSVAVQDMGITKVHNEIASRFSDPVAQLIDDNILNFLKNFTNDTFDN

SEQ ID NO: 15854 - DNA, 3923 bp, Saccharomyces cerevisiae
  CDS (1394)..(3634)
agatcctgaatcataatatatacgtgtgtacttcactttctatagaggaaaaaaagctaaaaaaaaaaaaaaatgataaaataaacgaaaaaaaccataaaacgatcatgatagaataatgtacattattaagaatgcttcattgatgacatgcagtgcgaaaagaaaggaacaaatgaaagaagacctcttcatttcttctttggagctcccaaaggcgaaccgatgttgttacctctcaatttaacgcctaaggctctttccaacttagacaaaacttgttggtttggaatagctctagcggcttcataatcgtttaccacggttggcttttcgttaattttggttgccaaatccttctgcgacattttcttgtctgttctggcacgcgagatggccctaccgacatttggatccaatttcttgggtttgacaatatctgtctcacggtcgaccttggtcaacctctgaccctcgttgtcacccctcgtattggttgatccgtacttcttgtcaacggaaacaaccaacccctgtcttcttgcagcattaatttggccttgagatctggcaacgttggcccttggcagaaccaccagctcttgctctgctaccaataatagtatttgtatcccagtcagacatttttctttacgattttgctcgttaacttttttgttttctagcttattagcttttacagttatggaagcgtagattcaaccttccctaacacatgaaactattattggttaacgacaggcgcctttccagctacctaatatataccaccaccgtcaaggggcgcccgttcatgaaagaggcaacgatggtgatcgattatttccaggaattgttccatgacgttctacgtggttctcttggtcgggtaatacaatcagggtaacatagtcagggtaacagaatccttgcttctattaccctccaatgcaaagttgactggcgtacatttgggccaagtatcaggcctaccatcttttcatcagtgttcgataaatgagacgtagtgacccaaattcagtatgtcttgatagcttagtaagacttataagcattttcacgcatcttggaagaaagttgcgagcattgccttaagattctgtcatgcgggtgtcgatagcgtcacgtgaacacattccaagtccttttttcttcacctttttcggtacctggtacctgagccaggaatagaagaaggatctgaaaaacgtatgcaaatatagcaagagggcgtaagcttagcctcgaggcaatggcgttttaattattttaagattttttttccataaatagtgctgttattaagttgaagtgtttgagaagggagtgagcgcaaaaaaataaagaactaaggaagaagagcttccctcagatgattacgcagaattctataccagaggtaaaagaagattttattggttatgctttacatgagagaagaattcggttaccgcagtttcaagacttagggccggcagacttggtcacactaacaaagtatttgcccacttcaagtaacacaaatgccataaacagtacgagtagaaatggtgcggccattattcagtcccctgcagccgttgtagccgatgactctgccgcttccatggcaaccaatggcgatgctagtgacaccgccgttaccacaaattatacaaatgcatctatatacagtagcagcagaaatgccaatgatggagccccgatggtcgctgagctccatccacttgataaactgaaggacgaagtagggacatttttttactcaatgggtgtcgatacatccggtccaacttcaatcgcaatttttttgaaggagatttcagaggtcatcagcgagaaaccccaagtttggtttggcaggaagaaaaccttcaatgttgctcgaatttcattttccacttggaatgcgttcaggagatgcgacataaatgtcgtcgttcatattccaggatcgattcagaactttatagtggattgcaacggtgaaagtcaaaatatagagatgtgtgcggattatgacttaatttgggctgaaacgttcgtaagtggcgtagtacggtcaatcatgttaatgaaggaaaacgctgaagagggagaattacaaaatttagtggaaaccttgattttgaacccgtttactgcaggacaaatcgacgatgtaccagaaatgttcattgatctgttccctatagtttaccataagggcccattattgggagctccgtattatattaccaatgtgacgaacactaataactatttggtagaaacactcgttgagatagttaagctgactcgtaatgttagcagggcggaaataatgttgaagaatctggctaccgacaaccctgaggcgatcataatactaatcaagatctttttggtgtgtgatcaagaattagacgcaataaagctcacatacgatatgctttcgcaggataaaataataaacaacactaataaccgcatggattataaatctgaattactgtgcttacaagcgcaatttttgatagacaaaaggcaggattacagcttggcgcaaaacatagcgcaagaggcagtcaattgttctcccagtgaatttagaccttggtatcttttatccaaggtgtatgtaaagctaaatgatattgaaaatgccttactgatactgaattcatgccctatgtctccattaaaggaaaaatacgtactgaaaagagtagctccgttgccttcgaataatagtcttcatttgccattgccaattgacgttgtactggatgaagtgacgtcgttgaatccacaagacgttcagaatgaacaccgctctgcggatccaatgctggtcaatttagctgcgtcgaacttgaaatctactttccaattggcataccgattattgacagaaattgtgcagatcaccggctgggaaaatctgttaaagtacagatcaaacattttcgttatggaagaagagtaccaaaaatcatcatcttcgttaccaaaggacgttaacaaacaagaagaacagcctctgagggctaaacggctgtgtgaacgatggttagacaacctcttcatgcttttatatgaagacctgaagatgtatacattatggcaaaccgaacaactgtacatggatgcacagaataacaaccacaataagttgactttcgaatgggagttatttggcctttgtgcacgtcgactgggccatttccctgaggccgccaaggccttccagaacggtttatcgcagagattttcatcaaggtgcgcgaggaaactgctggaatattgtataaacgaacgccaacgggtcaaaaattttataaactcacctaattcgcatgacatggtccctgaaatagtaagctcacgcataagagagctagacaatagcattatcgacctttgcgtgaagatatgctgctggaaccaccgttggtatacggaattttccataagtttacttgattgtttaagtgtggttattcaagatatgagtctgaccaaagtttcgaatgaaatctcgtcaagatatccagaaactgttctcaacttggtgcaggagaatttgctcaatttcttcactacttgcaccattggatgctacgatgcataaatacgataaaaagacattaatacgtatatataatccaaaaaaaattggcgatacgcttcaacgttgtgtcaaactcttgggtcactttaaagaaaacccagcatacattaatacagagcaatgctggttatgtaacttcgccgcccgccgccattcgaggaaaaatattcgtgtttcgagaatgcgggcaaaacgaaaatatcaataaaacacatacgggaaattcattgtgcacaacgacctctaacaatttctgccaaaaagaaagttcaagagcgtcccattcatc

SEQ ID NO: 15855 - protein, 746 aa, Saccharomyces cerevisiae
MITQNSIPEVKEDFIGYALHERRIRLPQFQDLGPADLVTLTKYLPTSSNTNAINSTSRNGAAIIQSPAAVVADDSAASMATNGDASDTAVTTNYTNASIYSSSRNANDGAPMVAELHPLDKLKDEVGTFFYSMGVDTSGPTSIAIFLKEISEVISEKPQVWFGRKKTFNVARISFSTWNAFRRCDINVVVHIPGSIQNFIVDCNGESQNIEMCADYDLIWAETFVSGVVRSIMLMKENAEEGELQNLVETLILNPFTAGQIDDVPEMFIDLFPIVYHKGPLLGAPYYITNVTNTNNYLVETLVEIVKLTRNVSRAEIMLKNLATDNPEAIIILIKIFLVCDQELDAIKLTYDMLSQDKIINNTNNRMDYKSELLCLQAQFLIDKRQDYSLAQNIAQEAVNCSPSEFRPWYLLSKVYVKLNDIENALLILNSCPMSPLKEKYVLKRVAPLPSNNSLHLPLPIDVVLDEVTSLNPQDVQNEHRSADPMLVNLAASNLKSTFQLAYRLLTEIVQITGWENLLKYRSNIFVMEEEYQKSSSSLPKDVNKQEEQPLRAKRLCERWLDNLFMLLYEDLKMYTLWQTEQLYMDAQNNNHNKLTFEWELFGLCARRLGHFPEAAKAFQNGLSQRFSSRCARKLLEYCINERQRVKNFINSPNSHDMVPEIVSSRIRELDNSIIDLCVKICCWNHRWYTEFSISLLDCLSVVIQDMSLTKVSNEISSRYPETVLNLVQENLLNFFTTCTIGCYDA

SEQ ID NO: 15856 - DNA, 2040 bp, Schizosaccharomyces pombe
  CDS (1)..(2040)
atgagtgattcattctttaaggatataccagagtttttagaaactcgtgtaaacgagtcattagatgcgcgttctaaatccatcgcacaatttaaagaactcgggcctcctgatcaggtcaatactataaaagttaatgcaaaaaatccatcaaaagagtggggaaaggatcaagacaagtctctctttaccaaacttttcactcctattgaaacgttaacgttttacgtattattaacctcgtcaaaggttggaacttatcactttgtatctggagttgatgcttcttcctcagcttcactagcggcatatttaaatacgctttcctattctcttgataaaagtcaacaatggtttgggaagggaaacgcttggcgtgttagtcacggagtttactgttgctacaatgtcttctctcaagttgatgttcgtgtggaagctaaaattcctggaggtgttgacacatatgctattgatgagaatgggcaaaagcatattgtcgatgctcgtatgtggacagaagcatatatgtctgaagtccttcgttcgttactttattctgatgatacaaattctcgctttgcaggacatcgtcgttttaaccccattccaaatcctgatgcagaattaagattttttgaggctgccgaacagctttttacgttaggttatactctagggtcttcttctgaagttcgggtacctacgcatgtaaataatcatttggttcgtggaattttcgcttacttgaagcaaacctgccgctacagtgctgctctaaatctttttgaaaagctccgggtgtcaattccagaggtatcggttttgcttgctgaactatacttactaatggaccatgaagtgcatgctgttcgtatcttgcatgattcattgctaaaacaaagaatgtccgctagtttgcttattgttcaagttaagtttctgatttcaaaagagcgctatgaccttgcacttatctgtgctaagcgcgccgttcatgcttctccatcagaatttgcaacttgggcatgtttggctgatgtatacttgcatttggaggattttaaatcagcgttgttagctctaaactcctgtcccatgtatacttactatgaaagagatgcttatcctttgcctcctagtgctcgtgctcatttaccatttcctgtcaattttcctaaagaagaactggaagttgaaaataatgcgcagaacggttatacagtttctaccgaaattaccgatccttacttagctcgcctaccatctcccagtcttcgtggtacatttgcgaaggcatatgaaatgctcacccttatatgtgccaaaataggttgggatgaactattgcgggttcgttcagctgtctttgtgatggaagaagaatatagatccttaaatgatattacagaaggaaacgcttctcccgatcaaaacgaagttgcagaagaaagcgttgcagaagaagttgttggtttagacaaaccagaaacatctgttggttctcttccaaaaaatgccactgttcagagtaaacgtctctgtgagcgctggctagataatctttttatggttttatatgaggatttacgtgtatttacgatttggcgcgctgaatatactcactttaaatctcaaggtctagcttacagaaaagctcctgcagaatgggaaatactaggtgaggttgcttttcggttgcatcatcgtgttgaggctgttgaagcattctgcgcttgcttggaaagtatgttttcttttaaggcctggaaaactcttttgataatttattcagaagacaataatattgagctcgttttgaccgctatcgctaaattaacactttataactaccgatggtatcaagagtattccccctttcttctggagcaaatgaaaaatcgcattatgcaagatggcgctttgaagatgaagagtatccttgcttctactagacttgatccgtatatccttaatcttatacataagctgtattttgaatgggctatcgcctttcaaattcctggccatgaattgtaa

SEQ ID NO: 15857 - protein, 679 aa, Schizosaccharomyces pombe
MSDSFFKDIPEFLETRVNESLDARSKSIAQFKELGPPDQVNTIKVNAKNPSKEWGKDQDKSLFTKLFTPIETLTFYVLLTSSKVGTYHFVSGVDASSSASLAAYLNTLSYSLDKSQQWFGKGNAWRVSHGVYCCYNVFSQVDVRVEAKIPGGVDTYAIDENGQKHIVDARMWTEAYMSEVLRSLLYSDDTNSRFAGHRRFNPIPNPDAELRFFEAAEQLFTLGYTLGSSSEVRVPTHVNNHLVRGIFAYLKQTCRYSAALNLFEKLRVSIPEVSVLLAELYLLMDHEVHAVRILHDSLLKQRMSASLLIVQVKFLISKERYDLALICAKRAVHASPSEFATWACLADVYLHLEDFKSALLALNSCPMYTYYERDAYPLPPSARAHLPFPVNFPKEELEVENNAQNGYTVSTEITDPYLARLPSPSLRGTFAKAYEMLTLICAKIGWDELLRVRSAVFVMEEEYRSLNDITEGNASPDQNEVAEESVAEEVVGLDKPETSVGSLPKNATVQSKRLCERWLDNLFMVLYEDLRVFTIWRAEYTHFKSQGLAYRKAPAEWEILGEVAFRLHHRVEAVEAFCACLESMFSFKAWKTLLIIYSEDNNIELVLTAIAKLTLYNYRWYQEYSPFLLEQMKNRIMQDGALKMKSILASTRLDPYILNLIHKLYFEWAIAFQIPGHEL

SEQ ID NO: 15858 - DNA, 2229 bp, Candida glabrata
  CDS (1)..(2229)
atgattacacaggcgtcgattcctgaagtgagggaggatgttattgggtttgcgctaggtgagagaaaggccattcttccacaatgtcaggatctgggacctccggacttgattaccatggttaaatacgtgccaacaccaaactcaaatgctactgcaggcaccacctcaggtaatggagctggtggtgcaaataatggcactgctggagcagctaatggaaataattccttgtctactgctgatccagccgccctgttggcagagattcactcccatgacaaactaaagggggcaattggcaccttcttttacacactaggtattgatacatctgatccaacttctatttctatctctttaaaacaaattgctgacgcgattgctgagaagcctcaaaaatggtttggcaagtttaagaatttcagtatcgccaggatttccctgtcgacatacaatatcttcagaagatgtgatgttaatgtgattgtacacataccaggtgcagtacaaacctatgtactagattcaaatggtgagcatttgcctgtctcaggtaatcaaactacaccaaccgtcgcttccacggctagcgccaatccaattgatcaggcaagtgagatggatgtcatttgggcggagactttcatcagtggagtaattcgttcaattatgtttatgaaggataacgccgatgatggtgaggcccaacccttggtcgaaactttaattttgaatccattgacagcaggtaaactagacgacgttgcaaatacatttataaagctcttcccaacggtctatgaaagaggtgtgttgactgaagcaccttgtcacgttttggtgccaactagaacaaacaactacctagttgatactttggtagaactggttaggctaacgaaatcggtcgacatctgtagacctatgcttgaagagctcattaaaagttatccagatgctagcatagtccttgcgcgtgtcttgatggcttgtgattatgagattgatgctattgatatcataaacagagaattactacctcatggagaagaagatgatactatatcacctatatttagagcagaattgttatgcctacaaacacagtttttaatgaatgttaaaaatgactataagctggcgctggaagtggctctatccgcagttaaattttctcccagtgagttcattccatggtttctgctaactaagatatacatcaagctaaatgatattgaaaatgcccttttggctttgaattcatgccctatggctcaatcacacgaaagatatgtcctaaagagagcggtacctattggatcagaggataatctccacctaccattgccagaaaacataggagttgatgaaattttacaattaaatcctagcgatgttaacaaggaacaattaaattctgatccatctttaactagatccgctgctttaaatttgaagtctacatatctattggcatataggttattgacagaaattgtacaaatcacaggctgggagaccctattgaagtgtagatctaagatatttgttatggaggatgaatatcaaatatccacggatgaggtatcattgacaaaccagagtaatagaaatgaggacacaccaagtgagttaaatatgagaactaagagactttgtgataggtggttagataaccttttcatgcttctatatgaagacttgaagatatacacattatggcagacagaacagttatatttcgaagcacaaaatagtaaatacaagaagctgacatatgaatgggaagcatttgggctttgtgcacagagactaggacatcttcctgaagctgctagcgcattccaaagaggtctttcccaaagatttgctccaatgagtgcgcggatgttattgaattattatattcaggaacatcaccgcgtgagaaaccaatccttatcaccaaactctgaactcacatcatcgcaaataatatcacgtatcaatgacttagattctcgaattatagatttatgtgtcaagctatgttgctggaaccaccgttggtacattgagttttcgatacaacttatcgacgcgctgagtgtcgcagttcaagatatgggtatcatgaaggtaatcaacgaaatagcgtctcgttatccggatgccgttgtatctataatgaaagaaaacttcttagacttcttggaaaactatactaacggattctttgatgcttga

SEQ ID NO: 15859 - protein, 742 aa, Candida glabrata
MITQASIPEVREDVIGFALGERKAILPQCQDLGPPDLITMVKYVPTPNSNATAGTTSGNGAGGANNGTAGAANGNNSLSTADPAALLAEIHSHDKLKGAIGTFFYTLGIDTSDPTSISISLKQIADAIAEKPQKWFGKFKNFSIARISLSTYNIFRRCDVNVIVHIPGAVQTYVLDSNGEHLPVSGNQTTPTVASTASANPIDQASEMDVIWAETFISGVIRSIMFMKDNADDGEAQPLVETLILNPLTAGKLDDVANTFIKLFPTVYERGVLTEAPCHVLVPTRTNNYLVDTLVELVRLTKSVDICRPMLEELIKSYPDASIVLARVLMACDYEIDAIDIINRELLPHGEEDDTISPIFRAELLCLQTQFLMNVKNDYKLALEVALSAVKFSPSEFIPWFLLTKIYIKLNDIENALLALNSCPMAQSHERYVLKRAVPIGSEDNLHLPLPENIGVDEILQLNPSDVNKEQLNSDPSLTRSAALNLKSTYLLAYRLLTEIVQITGWETLLKCRSKIFVMEDEYQISTDEVSLTNQSNRNEDTPSELNMRTKRLCDRWLDNLFMLLYEDLKIYTLWQTEQLYFEAQNSKYKKLTYEWEAFGLCAQRLGHLPEAASAFQRGLSQRFAPMSARMLLNYYIQEHHRVRNQSLSPNSELTSSQIISRINDLDSRIIDLCVKLCCWNHRWYIEFSIQLIDALSVAVQDMGIMKVINEIASRYPDAVVSIMKENFLDFLENYTNGFFDA

SEQ ID NO: 15860 - DNA, 2469 bp, Candida glabrata
  CDS (1)..(2469)
atgctgtgggggaaggagaagcaggatcacaaggtgtacttgtcgccgaacaggaacgctacgggcgcacggtcgatagaggacctcgacagggaagggaacaggaacagcaacttgacgctgccgaacctggagctcgagctcgagctccagcctgtcggcagccactcgcacaggtcgcggtcgcggtccaactcgcgatcgaacttgggcgcgaaggcctcgaagtcgcacggcaagggctccacttccagcctgcccgatatacagcctggtgtgcgtgaattcccgcgcattgtggagagaaggttcggggagtcgctcggcatccggacgcagctgctgaagcggctgtcgcgcggcgggaagctcggcctgggaccgccagacctcatacacattacctcttacgacaagtaccacaaggatatagagaccggacagtacttctacatatcgggcgtcgacgtctccaacgagtccatgcccatcgctatgctgaagctgctcaaatccggcagcagcgagcaggtcatctcgacatactgcagttgcaacatattctcgcatatagacataagaatcagatacgaatcagacacagcataccagattaacgcagtcgacatcacaaacggaacttctttggtacagctcagcgaggcgctctgggaggaagcatttgtgagcgcgtgtgttcgaagcataatatcaaacatcgagtccgcaaggaagcttccgggcttggtcgagtaccctttgctcgggctcacgcagggatcaaactcagacgacatcatgaaatgcaaacggatactggaactgctctgcagatacttgcccaggttcttagaatgtggctgggactcgacaagatcagtagaacccaccattgtctccaattacttgacacagtcaatactagagttcttgtcaatagcatctccgctcctgattgagtacacaattggaattctgaaagaattgatggaagttgacaacaaaaatagcatattgtatgaggttgtcctcgctacagttttgcaccaaagtgacgaaatggaccacgaccttgtacttatactacacaagaccatcgataagttaaacaaaatgctctcagacaacaccgaacacgattttgacaacctgttcctggtcaactgtttatccgagttactaatcatacaaacacaatatctcatttacagagcagaggatctcaagctagcagaaaaagtaattacacactcaactgaattgactgtcgattccttcaaaagttggtactggctggcaaagacatatatttacttgggccaatatgacaaagcgttgctggctataaactccatgcaccctttgcattcgttagatcctgtacgagaagccctgtattcagacccatacatgttaaactactatcaaaagccattggatggtttcaaaattttgcctggtaaagtaaacaaaggtctggagccatgcgaactgacctccatcgaactcaataacttaaacagtaagtggaaataccaagatgaattccagaagttcatctttggcagaatctccatgccatattccccatcagagaaaggtttcattcgggagatatgggaagacgccgcgtataagataggtccaatatttggcactcaagttgctaatttgatcaattttgtttcccctcaagaagtagagatggttgcggattatcaattgctatcaagaaatactatcaacaagcaaaataactggtttatggcacaggtacttgatctattaattgaaataattacatatctgggttggaatggactgatggagacacgttcgaaagttttcgtcatgcaacaggagtatttggggaccatatccccagatagctcgggcaatgagaactctcaatcgacgatcataccgctacagtttcgaaagaaacgattatgtgaaagatggctggatcagttgtttcttgatatatacgaggacttaaaaatcactcgagcagcaatgaacaacaaggatgtcaaatatagtgggctagaatgggaactgttgggtttaactatgttgcgtacatggcaatggtcagatgcgattgcatgtttaagaacttcattagtggcccggtttgacatcataagtgccacaaaaatactagagttgtattttgacgaagacaagatacaaaggattcattccattgacatgaaaaatgatattctaccttatgatgttgcagttgacctcatagttaaaaagatatcatacgagtttagattttacaacgagtttcaactctacaatgtaaagatactgttcaagttggccgagagatacggtcttgatttgatccgtgcccaggtcgttggtctcccatacataaacaggagcatcctcgccgtaatggataaaatgttcaactggattgaaaaaatgaccacggactctccgcctgcttaa

SEQ ID NO: 15861 - protein, 822 aa, Candida glabrata
MLWGKEKQDHKVYLSPNRNATGARSIEDLDREGNRNSNLTLPNLELELELQPVGSHSHRSRSRSNSRSNLGAKASKSHGKGSTSSLPDIQPGVREFPRIVERRFGESLGIRTQLLKRLSRGGKLGLGPPDLIHITSYDKYHKDIETGQYFYISGVDVSNESMPIAMLKLLKSGSSEQVISTYCSCNIFSHIDIRIRYESDTAYQINAVDITNGTSLVQLSEALWEEAFVSACVRSIISNIESARKLPGLVEYPLLGLTQGSNSDDIMKCKRILELLCRYLPRFLECGWDSTRSVEPTIVSNYLTQSILEFLSIASPLLIEYTIGILKELMEVDNKNSILYEVVLATVLHQSDEMDHDLVLILHKTIDKLNKMLSDNTEHDFDNLFLVNCLSELLIIQTQYLIYRAEDLKLAEKVITHSTELTVDSFKSWYWLAKTYIYLGQYDKALLAINSMHPLHSLDPVREALYSDPYMLNYYQKPLDGFKILPGKVNKGLEPCELTSIELNNLNSKWKYQDEFQKFIFGRISMPYSPSEKGFIREIWEDAAYKIGPIFGTQVANLINFVSPQEVEMVADYQLLSRNTINKQNNWFMAQVLDLLIEIITYLGWNGLMETRSKVFVMQQEYLGTISPDSSGNENSQSTIIPLQFRKKRLCERWLDQLFLDIYEDLKITRAAMNNKDVKYSGLEWELLGLTMLRTWQWSDAIACLRTSLVARFDIISATKILELYFDEDKIQRIHSIDMKNDILPYDVAVDLIVKKISYEFRFYNEFQLYNVKILFKLAERYGLDLIRAQVVGLPYINRSILAVMDKMFNWIEKMTTDSPPA

SEQ ID NO: 15862 - DNA, 2052 bp, Ashbya gossypii
  CDS (1)..(2052)
atgttttcgcaagggtcaattccagaggtgaaagaacacagtccggggtttgtcctggagcagcggaaggccaagctggggcagtttcaggacctggggccgccagatctgattacaatctcgaagtacctgtcgacgagcggcaaaaacgggtcacacatgcggacggggtctgtggggggagacgcgggcggcgcagagccagcagagaagctgaagggcgcaatcggaacgtacctgtactgcgcgggggcggacacgtctgaccccacgtctattgcggtgttcctgaaggggattgcggacagcatttcggaggagccgcaggtgtggttcggcaagcacaagccgtacaaggtctcgaagatctcgtactcgacgtggaacgtgttccggcagtgcgacgtgaatgtgacggtgcatattccggggacagtgcagtcgtatgtgctcgacgtgcggggcgatgtggtgcacctggacgagcaggagcaggagcagctgtgggcggagacgttcatcagcggcgtgacgcggacgctgatgatgatgcaggacaacttcgaggacggcgaggtcaacaacatcgtggagacacgcattttgaacccgttcacgtcgagcgacatcggcgacgttgccacgtctttcatcaagctgtttccaacggtgtaccagcaggcgcccaagctgggcgcccctccacatatcggggcggtctcgcacacaaacaactacctggtggagacgctgctgcacctcaccaagctgaccgccaactttgatacatgtaggagcgtgctcgaggagctacgcaaagagaaccctgaggtggtggtcattctgtcgcggctattattgctggcggatctcgagctcgacgccgtaaagctgatccacgcggagctgtcgtccaacgagacgaccgactacacgtcagagctgctctgcgtcgagacagagttcctcttggagcgcaagaaggactacgagctggcgtgtgccaccgcgcaggcggcggttcactcagcgccaagcgagtttaagccatggtacttgctggtgaagagtttcacagcactaggtgacatagagaatgcattgcttactttgaacacctgtccaatgtctccactgaaagagaagtacgtgttccggcgcattgtacccgtgacgcaagagtctggcaacctccatattcccttgcctgtagatgttattctggaagaggtgaccggcctggattcccacgaggtgatcaccgaacacaaatccgtcgacccaagtctgctcaatcttcccgccgccaacttgaagagcaacttccagctggcctattctttgctggcagaaattgccaagaaaactggctgggagccgctcttgaaataccgcgccaagctttttgttatggaagaagaataccggagtgccagcacaccaagcatcgactccgaaacatcccagggcttacgttctaaacggctgtgtgagagatggttagacaacctgttcatgctaatatatgacgatctcaaaatatacacgatatggcaggccgagcagctacattttgaggcgcagaatgcacaatatgcaaaaaccactcttgaatgggagcttcttgggctgtgcgcgaataggcttcaccattaccaagaggccgcaaaagcgtttcagaatgggttgcaattgcggttctctgcctcgtcgtgcaggaaactactgcagtactacctgaaggagcgcgaattcattcgccagaagggaggggaaactgggatgacatcttcgcagattgtaaacgctgtcaacacacaggataacaagatcattgacctctgcgtgcgcctatgctgctggaaccatcgctggtatagcgagttttccctgttactgctggatgccgttgcgagaattgttgaagatattggcatcaccaagatgcaaaatgaagtggcctctcgttttccggaaagcgtcgtcaacctgttccagacaaatgtgcttgactttttcgctgaacatactcgtggtgagtacgaccaataa

SEQ ID NO: 15863 - protein, 683 aa, Ashbya gossypii
MFSQGSIPEVKEHSPGFVLEQRKAKLGQFQDLGPPDLITISKYLSTSGKNGSHMRTGSVGGDAGGAEPAEKLKGAIGTYLYCAGADTSDPTSIAVFLKGIADSISEEPQVWFGKHKPYKVSKISYSTWNVFRQCDVNVTVHIPGTVQSYVLDVRGDVVHLDEQEQEQLWAETFISGVTRTLMMMQDNFEDGEVNNIVETRILNPFTSSDIGDVATSFIKLFPTVYQQAPKLGAPPHIGAVSHTNNYLVETLLHLTKLTANFDTCRSVLEELRKENPEVVVILSRLLLLADLELDAVKLIHAELSSNETTDYTSELLCVETEFLLERKKDYELACATAQAAVHSAPSEFKPWYLLVKSFTALGDIENALLTLNTCPMSPLKEKYVFRRIVPVTQESGNLHIPLPVDVILEEVTGLDSHEVITEHKSVDPSLLNLPAANLKSNFQLAYSLLAEIAKKTGWEPLLKYRAKLFVMEEEYRSASTPSIDSETSQGLRSKRLCERWLDNLFMLIYDDLKIYTIWQAEQLHFEAQNAQYAKTTLEWELLGLCANRLHHYQEAAKAFQNGLQLRFSASSCRKLLQYYLKEREFIRQKGGETGMTSSQIVNAVNTQDNKIIDLCVRLCCWNHRWYSEFSLLLLDAVARIVEDIGITKMQNEVASRFPESVVNLFQTNVLDFFAEHTRGEYDQ

SEQ ID NO: 15864 - DNA, 2169 bp, Ashbya gossypii
  CDS (1)..(2169)
atgtcgatctggcaatggaggagtacgagtgcacactctgcgagcatgggatcgcaggtatccctgcatgatagctcagtggaccgctcgcactccgggacgccagaagcagggcggcgttataacactctggagcatccgcgaataattgagaggcatttcggagaggcggtaagggcacgatggaagctactgcggaagctctccgggagcggacagctggatgtggggcctccggatttggtgcatgtgacaggatatgacagataccaccaggtgcagattggggaacaccactacattacgggtctagacgtatccagcgaggcgatgcctatcgcgtacatgaacacgcttcggctggggcgaaaacatacagaggacgaagacgacctggtctgcacgttctgcacagtgaacctgttctcgaaggtggacgtgcggatccggtttgagtcggagcgggcgtttcaggtgtacgcggttgactgcggttccgatgagcaggttcagatgagcgacggcttgtgggaggagacttttgtgagcgggtgcattcggagtatggtgatcaacagcgaccgccggcgcaaggtccccgggctgatagagtacccaattggggcggagaacggcagaagctactccgaaaacgtggtatttttgctctgcaagtatttgccgcgcgccaaggacacgggcgtcgacctcacagtgcacacgtctgtgacgagtctgcagaactacctggccgatgcgctactgaagttcttatctatcaaccccggattgttcacatacgctattgaatgtttgcagcaattgatagaaggcgatccagcgaacgattttatttatagactgatgcaggcaaaagttgcaatatgcagcaattcaaatgaacttaaagcggtccagtttctgaacagcacggttactcgctttcttccgaacatagcggccctccacaacagagacctgcagaacgccatcgacttattgaacgtgcaggtcgggttcctactacagaaggaagactacgagtttgcccttcccttggctcagaaagcgacgtctcttgtgcatgataacttcctttcttgggagcaactagcgacatgttacatcgggcttggacagtatgatgaagccttactagcgatcaattgcatgccacgcttagctcaaggtactcctggctacgcagcatccatgatagacctaattgactccaattactacaagagaccgatgagcctagggccaacttctgatctctattccgttgagaccaattatatatctcactctgttccacattccaaccacttggctctgcagacgatgatatatggccgaacggttatgtcaagaccgtctacagctgcaggatgcatagaggaaatctggaacgggccctgcatgaagttgggcccgatatatggcccggatagcttcaacttactggcatttgtgtctccgagtgagaataacgctatcaaggaccgtggcgtcctccaacgaaattctagttcgactcgcctgtccggcggggatgagcgtgtttacagcttgctcatggatattgtcgcacgtatcggctggaaccgcttcctcgacattcgtgcacgcattttcgtcatgcgcagcgagcactccacaagtccgacagtggtgcctgaacttaagcagaaacgcctctgcgaaaaatggcttgatgagctctttctcaacttatatgaagacttacgtgtctctgccaactccccactccacacacaggatcttcagaacagtggacttgagtggcagctactcggcttgacccttctgcgcacccgctacatggacgaggctgttgcttgtttgcggactagcattctcgtgcgctttgatgttatatctgctcacaagcttctgcacctcttcctcgacggtagtcttactaccctagatactgatgttatcttgcgtcttgttgtcgccaatgcggcctacgctgcacgtttctatgactggtgtcagacactgacaatcctcgtcttacgtcgcttctgcgaagtacatccgaaggatgtcatccgcagtcgcatccacgggctctatcctccagacactggcatcctaccgctcatagacaggttcttagaccggctagacttcatatga

SEQ ID NO: 15865 - protein, 722 aa, Ashbya gossypii
MSIWQWRSTSAHSASMGSQVSLHDSSVDRSHSGTPEAGRRYNTLEHPRIIERHFGEAVRARWKLLRKLSGSGQLDVGPPDLVHVTGYDRYHQVQIGEHHYITGLDVSSEAMPIAYMNTLRLGRKHTEDEDDLVCTFCTVNLFSKVDVRIRFESERAFQVYAVDCGSDEQVQMSDGLWEETFVSGCIRSMVINSDRRRKVPGLIEYPIGAENGRSYSENVVFLLCKYLPRAKDTGVDLTVHTSVTSLQNYLADALLKFLSINPGLFTYAIECLQQLIEGDPANDFIYRLMQAKVAICSNSNELKAVQFLNSTVTRFLPNIAALHNRDLQNAIDLLNVQVGFLLQKEDYEFALPLAQKATSLVHDNFLSWEQLATCYIGLGQYDEALLAINCMPRLAQGTPGYAASMIDLIDSNYYKRPMSLGPTSDLYSVETNYISHSVPHSNHLALQTMIYGRTVMSRPSTAAGCIEEIWNGPCMKLGPIYGPDSFNLLAFVSPSENNAIKDRGVLQRNSSSTRLSGGDERVYSLLMDIVARIGWNRFLDIRARIFVMRSEHSTSPTVVPELKQKRLCEKWLDELFLNLYEDLRVSANSPLHTQDLQNSGLEWQLLGLTLLRTRYMDEAVACLRTSILVRFDVISAHKLLHLFLDGSLTTLDTDVILRLVVANAAYAARFYDWCQTLTILVLRRFCEVHPKDVIRSRIHGLYPPDTGILPLIDRFLDRLDFI

SEQ ID NO: 15866 - DNA, 2076 bp, Neurospora crassa
  CDS (1)..(2076)
atggttgcgccagctgtccccgagatcaccgaagagatactgcatgaagcggttgacactcgtaccgagtctctgagctctctcagggagcttggcccccccgatctcgtacacctggtcaagcagcccctgaagaaccccggaaagcactatggtgtctatcaccatgtcaccggcgtcgacgcgtcctcctcggccagtctggctgcttacatcaacaccctgacctacaaggagttcggcaattccgccactgccaaaaccgtcgaaggaacttattgctgttacaatgccttctcccgcgtcgacatgcgcgtacacgctcccttccccggctccgtagagagttattgcgttgacgagcggggcgaaaaacgaaaggcaaccgacgaactctggctcgaaacatacctctgcagtgttctccgcgcatactcgtatgccgacgatggaagcggcgagacaatcagaaagatcatgggcgtccggcgtttcaaccccgtttccagtaccgagaccgaacacaaattcctcagcgctgccgagcagctcttcttcaggggctggcaacttgggtccgactccgtggtgcaggtgccaaacaatgtctctaaccacttgacagccggcctcctaaagtatttctccacaacaggacgccacacttccggtatcaatctctttgagaagcttcggtcgcaaaacgttgaagtggcttcgctcttggcaaaagtgctcttcatgggaaacgaggaggtgcaaggagtccgtgttttgtacgaggccctcaaggaatcgcccatggattacgttatgcttgatacccaggccgaattccttctcaaaaaggccgaaactgccccaacgccagagctgagggaggaaagactacgcatggctctgggctgtgcagaccgaagtacgatagccgctcctagtgagttcggcacgtgggcaagactggcccaggtctatgttgcaatggaggattgggagaatgccttgaccatcctcaactcgtgtcccatgttcacataccaggacaaggatgcgcctgtcatgccagaacccaaagacgttaacctaccgaccctcccagagaccaggttggacgaaatcgacagcgagccagattcgaggttttcggagcaggtcgacccaagtttgcttggtcttcgcgccgctgcgtatcggggaacgttcaagcaggcatacagcattctcaccgagatgactgccaagattggctgggatcaacttctcaagatcagaagcaacgtttttgttatggaagacgagtatcgaaacgagaagcaggagccctcttaccctgccaagcgcaatgctagcaccgatgcgctgcgtggaagcccggatcatactacgaacggcgaaaccgctcccaaggaggctgccgaaactgacgaggttgaggacgaaaagaagaatgctactttggctgctgagcaaacggaaggcctggagagacctcctagcgctatcgacccagaggtagtccgcaaggccgaagaaaacggtgataacgaggatcacttctcgcgcctcaacaacaagcgtctatgtgaacggtggttagacagcttgttcatggttctttacgaagatcttcgcgtatataccatttggcgcacccagatggctcagtacagagcgcagagtatgcagtacaaaaagtcggcggaagagtgggagattctcggcagtctcgcagaacgcctacagcatacggacgaagcggttgaggcataccgggcgtgcttgggtcaacgcttcagccccaaggcgctcaccggtattctcaaggtgtttgagaagcaaaagagcacacgcgagagtgtcgccgctctcatcaggttggtaacttggcagtatcggtggtacagcgaattctcacccgagctactacataccatccggacactcatcgaggacgagggtgctgtgaaggtcaggagtatcatccaggcgaccaacctgccacagaacgtgctggacttgacgcatcactatgcggcgttgtgtgctactttccgcagcagcgggaccgacggctag

SEQ ID NO: 15867 - protein, 691 aa, Neurospora crassa
MVAPAVPEITEEILHEAVDTRTESLSSLRELGPPDLVHLVKQPLKNPGKHYGVYHHVTGVDASSSASLAAYINTLTYKEFGNSATAKTVEGTYCCYNAFSRVDMRVHAPFPGSVESYCVDERGEKRKATDELWLETYLCSVLRAYSYADDGSGETIRKIMGVRRFNPVSSTETEHKFLSAAEQLFFRGWQLGSDSVVQVPNNVSNHLTAGLLKYFSTTGRHTSGINLFEKLRSQNVEVASLLAKVLFMGNEEVQGVRVLYEALKESPMDYVMLDTQAEFLLKKAETAPTPELREERLRMALGCADRSTIAAPSEFGTWARLAQVYVAMEDWENALTILNSCPMFTYQDKDAPVMPEPKDVNLPTLPETRLDEIDSEPDSRFSEQVDPSLLGLRAAAYRGTFKQAYSILTEMTAKIGWDQLLKIRSNVFVMEDEYRNEKQEPSYPAKRNASTDALRGSPDHTTNGETAPKEAAETDEVEDEKKNATLAAEQTEGLERPPSAIDPEVVRKAEENGDNEDHFSRLNNKRLCERWLDSLFMVLYEDLRVYTIWRTQMAQYRAQSMQYKKSAEEWEILGSLAERLQHTDEAVEAYRACLGQRFSPKALTGILKVFEKQKSTRESVAALIRLVTWQYRWYSEFSPELLHTIRTLIEDEGAVKVRSIIQATNLPQNVLDLTHHYAALCATFRSSGTDG

SEQ ID NO: 15868 - DNA, 2286 bp, Candida albicans
  CDS (1)..(2286)
atgacaactgcattctcattttcaccttcagctgaagcaacaccaaagataagagaggataattttggggaaacattaggaatcagggctaatcttcaacatcaagatattggtcctcccgatttaatccaccgttccatttatgccggatcaaaatcagcattatataaccaaaacgattttgttaaagataagcagaaaaaggatgatgatggttatgttggatattatcattttgttaatggattgaagcctcagagtagtgaggaatatattatggaattgataaagcatggagccccgtataaacgagacgctataattacttattgtacatataacatattcagcaaaactgattttcgagtgaaatatatagtacatcataaagatttactggttgataggtcataccaaattgctggtcgaacagcgtcagaaatccacccaaattatttaaaggaacttgatgcgtcacaaatagttcgatttatatactatttggataatccggataatcaattggttggattagttaattttcctgattatgtaaaagataaagaggcgattcttggatcacttgatatattgacaaaacatcttcctaaaggatacatgacggggacatcatctgggtgtggagctcctacttcatgcggggatgacaaaaagacaaactattatcgtaatcgattggtcgatgcgataataagattggataagttgggggactatagaattagtcaactgattaaattatttcatggagacgagtttaattgtgtgattcttaaattaatcaaggatgaactcgaatatatacaattgattaatgagtctacaaagaaacagaatttgtataccacacaactggcattgatattagttgagcaagtcaaatttcttatatctaaagagcaatataaattagctttggaaattgcgaaaaaaacgatattgatattaccattagatttcgattgttggttctatttagcattgtcatatattttagttaaagacgttgaaaatgctttacttgttatcaattcattgcctatcattataaataaaaacaaaggaacacatgatctaccagatttgtttgtgtcgacatttattgaacgactcgagttggaagaagtcatttccgaaaagctgttttacgaatatttccctaatcctaaaaataccaatggcgagcttattgcttctattcggaaaatgtggaatgattcattcttatttaatcctttgtctaggcatcctattgtgggacaacatttttctcagtcgccattggtcaacagttctgctattgaaattgcatcggtggatactattcttgttaaaacatgtgcaccaaactcaactaaaaatgcctttgcatcccagtcagccggttctagtgcatcttctattttgaactttactcgaaaatcaacttggggacgaacttatgatctcttgtcgttcatggtagcacttgtcgggtgggaacacgtgatttcaattaaagagaggttgtttaagctgaatgtcgaaactaccactgctgaaaataacaattatattgtgaaccatggagctaaggaaaagttagtgacatgtgaagcttggttagaacagttgttcattacaatttacgaagatctccggacactaatgatcactattgccaacaacagcaatcaggaacggagtgcgttagaatgggaaatgataggtttgttaggatggctggtgaaacacaatttacgagactccatcagcctgttggttactagtattattggcaagaatgtccaaggtgagtttgattactttagtaccgtgcaattgttggaaatttatgatgagtttattcttgattgtccaggttacatggataattataatggcaagtttttcagcaacaaattgattttacgagtttctagtaaaaaaatgtgtgatagtttggtgaaatcattggaacaagagtatttcaagcttgattttgttcttcttgcaataattaagttgattagttggaatgtgcgatggtatcaatatgttcctgattatcttataatgagcattttacaaaaattgatagcaaaatatgatctggtttacattatgactacaatcaaaatcatatttgaacagaacaaaaggcagaaaactactaaatccttattcgggaaaaagaaaaaagaaggaccctatgaatttgttgaaagtgacactatatacgactatatggattatcttgtcaattggatcgatagtatatcctga

SEQ ID NO: 15869 - protein, 761 aa, Candida albicans
MTTAFSFSPSAEATPKIREDNFGETLGIRANLQHQDIGPPDLIHRSIYAGSKSALYNQNDFVKDKQKKDDDGYVGYYHFVNGLKPQSSEEYIMELIKHGAPYKRDAIITYCTYNIFSKTDFRVKYIVHHKDLSVDRSYQIAGRTASEIHPNYLKELDASQIVRFIYYLDNPDNQLVGLVNFPDYVKDKEAILGSLDILTKHLPKGYMTGTSSGCGAPTSCGDDKKTNYYRNRLVDAIIRLDKLGDYRISQSIKLFHGDEFNCVILKLIKDELEYIQLINESTKKQNLYTTQSALILVEQVKFLISKEQYKLALEIAKKTILILPLDFDCWFYLALSYILVKDVENALLVINSLPIIINKNKGTHDLPDLFVSTFIERLELEEVISEKSFYEYFPNPKNTNGELIASIRKMWNDSFLFNPLSRHPIVGQHFSQSPLVNSSAIEIASVDTILVKTCAPNSTKNAFASQSAGSSASSILNFTRKSTWGRTYDLLSFMVALVGWEHVISIKERLFKSNVETTTAENNNYIVNHGAKEKLVTCEAWLEQLFITIYEDLRTLMITIANNSNQERSALEWEMIGLLGWSVKHNLRDSISSLVTSIIGKNVQGEFDYFSTVQLLEIYDEFILDCPGYMDNYNGKFFSNKLILRVSSKKMCDSLVKSLEQEYFKLDFVLLAIIKLISWNVRWYQYVPDYLIMSILQKLIAKYDSVYIMTTIKIIFEQNKRQKTTKSLFGKKKKEGPYEFVESDTIYDYMDYLVNWIDSIS

SEQ ID NO: 15870 - DNA, 25 bp, Primer
atgaatttgttttggccatcggaaa

SEQ ID NO: 15871 - DNA, 24 bp, Primer
tcaaggttgtactgtgtgatctag

SEQ ID NO: 15872 - DNA, 738 bp, Saccharomyces cerevisiae
  CDS (1)..(738)
atgacaatggaaaaaaatggaggtaatagcagccgtggtggccaagtaggcggcaagtctgtgtgtgtttactgcgggtcttcatttggcgctaaggcgctatactcagaaagtgcagaagaattaggagcccttttccataagctgggatggaaattggtatacggtggaggcactactggtttgatgggcaagatagcaaggtctacgatgggacctgatttaagcggacaggttcacggtatcattccaaatgcacttgtgtctaaggaaaggacagacgaggataaagaagatgttaataaagcattgttggagtctgtagaaaatcataagggcgccactcctatttctgaagagtatggggaaacaacgattgtaccagatatgcatacgagaaaaagaatgatggcaaatttgagtgacgcgtttgttgctatgcctggtggatacgggacttttgaagaaatcatggaatgtatcacgtggtcgcaactggggattcataataaaccaattatcttgttcaatatcgatgggttctatgacaaattattggagttcctcaaacactctattcaagaacggttcatcagtgtgaagaatggtgaaatcattcaagttgcctccactccgcaggaagttgttgataaaatagagaagtacgtcgttccagagggccgtttcaatttgaattggagcgacgaaggtcacgctcacgaggattgtgctaaataa

SEQ ID NO: 15873 - protein, 245 aa, Saccharomyces cerevisiae
MTMEKNGGNSSRGGQVGGKSVCVYCGSSFGAKALYSESAEELGALFHKLGWKLVYGGGTTGLMGKIARSTMGPDLSGQVHGIIPNALVSKERTDEDKEDVNKALLESVENHKGATPISEEYGETTIVPDMHTRKRMMANLSDAFVAMPGGYGTFEEIMECITWSQLGIHNKPIILFNIDGFYDKLLEFLKHSIQERFISVKNGEIIQVASTPQEVVDKIEKYVVPEGRFNLNWSDEGHAHEDCAK

SEQ ID NO: 15874 - DNA, 588 bp, Pseudomonas aeruginosa
  CDS (1)..(588)
atgaccttgcgttccgtctgcgtattctgtggcgccagccccggcgcttccccggtctaccaggaagccgccgtggccctcggccggcacttggccgagcgcggcctgaccctggtctacggtggcggcgcggtcggtctgatgggcaccgtggcggacgccgcattggccgccggcggcgaagtgatcgggatcatcccgcagagcctgcaggaggccgagatcggccacaagggcctgacccgcctggaagtggtagacggcatgcacgcgcgcaaggcacgcatggccgaactggccgacgccttcatcgccctgcctggcgggctcggcaccctggaagagctgttcgaggtctggacctggggccaactgggctaccacgccaagccgctgggcctgctcgaagtgaacggtttctacgacccgctgctgactttcctcgaccacctggtcgacgaacgtttcgtccgcgccgaacaccgcggcatgctgcagcgcggcgccagcccggaggcgctgctcgatgccctcgccgcctggacgccgagcgtggcgccgaagtgggtcgaccgcaccccgcagtag

SEQ ID NO: 15875 - protein, 195 aa, Pseudomonas aeruginosa
MTLRSVCVFCGASPGASPVYQEAAVALGRHLAERGLTLVYGGGAVGLMGTVADAALAAGGEVIGIIPQSLQEAEIGHKGLTRLEVVDGMHARKARMAELADAFIALPGGLGTLEELFEVWTWGQLGYHAKPLGLLEVNGFYDPLLTFLDHLVDERFVRAEHRGMLQRGASPEALLDALAAWTPSVAPKWVDRTPQ

SEQ ID NO: 15876 - DNA, 600 bp, Agrobacterium tumefaciens
  CDS (1)..(600)
atgcgatccatctgcgtttattgcggctcccagcccggacgtgacccggctcatatggaagcaggccgcgcgcttgggaaatccatagccgaaaacggcattcgcctcgtctacggcggcggcaccaagggcatcatgggcgcggttgccagcggcgttctctccaatggcggcgaagtgaccggcatcataccggaatttctggtcgatatggaggcaacacgccattctctcggacaattgaacgagcttgtcatcaccaaggacatgcatgagcgcaaacatatgatgttcgagcgctcggatgccttcgtgaccctgcccggcggcgtcggcacgctggaagagatcgtcgagatcatgacctgggcgcagctcggccgccatgccaagccgatggtcttcgccaatatcaacggtttctggaaccccatgctggaactggtgcagcacatgcgcgaccagggtttcatccaccgcgcccatcttctgaacccgctcatcgtcgacgaggtgaaggacatcgtgcccgccatcatcgaccgggcgctggcgcagcagaaccccgaaggcgatccttcggtaatttcccggctctag

SEQ ID NO: 15877 - protein, 199 aa, Agrobacterium tumefaciens
MRSICVYCGSQPGRDPAHMEAGRALGKSIAENGIRLVYGGGTKGIMGAVASGVLSNGGEVTGIIPEFLVDMEATRHSLGQLNELVITKDMHERKHMMFERSDAFVTLPGGVGTLEEIVEIMTWAQLGRHAKPMVFANINGFWNPMLELVQHMRDQGFIHRAHLLNPLIVDEVKDIVPAIIDRALAQQNPEGDPSVISRL

SEQ ID NO: 15878 - DNA, 666 bp, Brucella melitensis
  CDS (1)..(666)
atgatccaccgaagccgcaagccctgcttgacgcccggtgcacaaaggctcaaaaaaagccctatgtccgagattcgatccatttgtgtttattgcggctcttccataggccagaaccctctttatcgtgaagcggggctggcgcttggccgctccattgccgaacatggcatccgcctcgtctatggtggcggcacacgcggcatcatgggcgcggtggcgcagggcgtgatggaggccggcggcgaagtcaccggcatcatcccgaccttcctgctcgacaaggaagcaagctttgagcgcgcgaaagaactgagcgaacttattatcgtcgacgatatgcatgagcgcaagcacctgatgttccagcgctctgacgctttcgtgacacttcccggcggcatcggcacggtggaagagatcgtggaaatgatgacctgggcgcaacttggcaaacaccgcaagccgatggttttcgccaatatcaacaatttctggcagccgatgctggcacttctcgaccatatgcgtgcggaaggcttcatccataccgcccatcaggttcagccgctgatcgtggacaaggcggaagatatcgtccccgccatcatcgccgccaatggccgcaggaaagcaggcgatctggagattatcgggaagatgtga

SEQ ID NO: 15879 - protein, 221 aa, Brucella melitensis
MIHRSRKPCLTPGAQRLKKSPMSEIRSICVYCGSSIGQNPLYREAGLALGRSIAEHGIRLVYGGGTRGIMGAVAQGVMEAGGEVTGIIPTFLLDKEASFERAKELSELIIVDDMHERKHLMFQRSDAFVTLPGGIGTVEEIVEMMTWAQLGKHRKPMVFANINNFWQPMLALLDHMRAEGFIHTAHQVQPLIVDKAEDIVPAIIAANGRRKAGDLEIIGKM

SEQ ID NO: 15880 - DNA, 573 bp, Bacillus halodurans
  CDS (1)..(573)
atgaaaatttgtttattttccggttcctcccttggtcaacacccgatctatgcggagcaagtccgggcgcttggtgaacagatcggtaaacaaggatgggaagtgatctacggaggaggcaatgcagggttaatgggtgtcttagctcaatcggttttagataacggcgggcgcgtcaccggaatcatcccgaaaaagattgccgaaaacgtcccatcgatcgaattaagtgaacttctaatcgtagagacaatgcatgaacgtaaacaattaatgtatgagcggagcgatgcgtttgttactcttccaggagggatcgggactttagaggagctatttgaaatttttacatggcagcaaattggctaccatgaaaagcctgttgctgtttttaacatcaataggttcttccagccattactgcaaatgttagaccatacagtaaacgaaggatttctctcatctacctgcctcgagcagcttattgttgaggaagatatgaacaccctcttcgatcgtcttcaatcatttgaatatcaaacggtcaacaagtgggcccatacaaaatcataa

SEQ ID NO: 15881 - protein, 190 aa, Bacillus halodurans
MKICLFSGSSLGQHPIYAEQVRALGEQIGKQGWEVIYGGGNAGLMGVLAQSVLDNGGRVTGIIPKKIAENVPSIELSELLIVETMHERKQLMYERSDAFVTLPGGIGTLEELFEIFTWQQIGYHEKPVAVFNINRFFQPLLQMLDHTVNEGFLSSTCLEQLIVEEDMNTLFDRLQSFEYQTVNKWAHTKS

SEQ ID NO: 15882 - DNA, 1308 bp, Caulobacter crescentus
  CDS (1)..(1308)
atgagggccgcgggacatcggatccttcatcgcgatgaagaagcggcctttgtcatcggcgcgccccccgccgctgacgacccggtcaatccggacattgaggcccgcgcccggcgcagcgactcccgacaccaccgcgccgccggccctgtcgatatcgaccgccaagatccggggcgcgctggacgcggtagcgaggcgccatgcgcccgcgccagcccgcaacaaggccacctgcccctcttccgagaccatgacgtagccttccgcctgcacggtccggccatcacgggtcatggaaaggccgaacaatcgaacgccaggctggatgggaacagccacgctccaccgcccctcggggtccgccttgcccagcacgacctcaccgtccggagagcccaaccggatatcagcctctggcagcgcagcgcccgccaaggtcacgcggccgcccgcgcgctgcacgctttccagcgctggcggcggaagatagccggcctcggcgctatcgatcttctccgtgcgcttcgcgtccccctgcccgcccgggtcgcaagccgtcagcagcgtcgccgcggcgacgacaaggatcgatggcttgaaaccccgggagcgaatcctgatcatgcggcctcaaataggaacgaaccggtggcgcgcgatccccgcgcgccattgtcttgtgtggagtggacgacgatgtccgacgagtccaggcgcctgagcgccgtgtgcgtctattgcggctcatcgaacgacgccgatcctagctacatcgcagccgccttcagtatcggcgaaagcttcgccaaggcaggcctgaagctcgtctatggcggcggcggcgtcggcctgatgggggccaccgcccgaggtgctcacacggccggcggcgcggtgctggggatcattccaagcttcctgcgcggccgcgaacagcctttcgacgacgtagagaccgtcgtcgtcgacaacatgcacgaacgcaagatgatgatgttcgagcgatctgacgccttcgtggtgctgcccggcggcatcggcaccctggaagaaatcgtcgaactgctatcttggcgccgtttagatcttcaccagaagccgattgtgttccataaccccggcggtttctgggatccgctgttcgtcctgatccgtcacacgattgatcaagggctcaccccacccgatctggcgaacgcctggcgcgcggttgagcgggccgaggacgtcacccccgcccttctggcctgggatgcagaaatctaccaatcgggcgcgccagacacgcttcggcgcttgacttag

SEQ ID NO: 15883 - protein, 435 aa, Caulobacter crescentus
MRAAGHRILHRDEEAAFVIGAPPAADDPVNPDIEARARRSDSRHHRAAGPVDIDRQDPGRAGRGSEAPCARASPQQGHLPLFRDHDVAFRLHGPAITGHGKAEQSNARLDGNSHAPPPLGVRLAQHDLTVRRAQPDISLWQRSARQGHAAARALHAFQRWRRKIAGLGAIDLLRALRVPLPARVASRQQRRRGDDKDRWLETPGANPDHAASNRNEPVARDPRAPLSCVEWTTMSDESRRLSAVCVYCGSSNDADPSYIAAAFSIGESFAKAGLKLVYGGGGVGLMGATARGAHTAGGAVLGIIPSFLRGREQPFDDVETVVVDNMHERKMMMFERSDAFVVLPGGIGTLEEIVELLSWRRLDLHQKPIVFHNPGGFWDPLFVLIRHTIDQGLTPPDLANAWRAVERAEDVTPALLAWDAEIYQSGAPDTLRRLT

SEQ ID NO: 15884 - DNA, 564 bp, Mycobacterium tuberculosis
  CDS (1)..(564)
atgtcggcgaaaatcgacattaccggtgattggactgtggccgtgtattgcgcggcctcgccaacgcacgcggagttgctagagctggccgccgaagtcggcgcggcaatcgccggacgtggctggacgctggtgtggggaggtggccatgtttcggcgatgggggctgtcgcctcggcggcgcgagcctgcggcggctggaccgtcggcgtgattcccaagatgctggtgtaccgcgaactggctgatcacgacgccgacgagctaatcgtcaccgacaccatgtgggagcgcaagcagattatggaagatcgctcagatgcgttcatcgtgttgccgggcggtgtcggcaccctagacgagctgtttgacgcatggaccgacgggtatctcggtacccatgacaaacccattgtgatggtagatccctgggggcatttcgatggactgcgggcatggctgaacggattgctcgacaccggttacgtctcacccacggcgatggaacggctggtggtagtcgataacgtcaaggacgctctgcgggcctgcgcaccttcctga

SEQ ID NO: 15885 - protein, 187 aa, Mycobacterium tuberculosis
MSAKIDITGDWTVAVYCAASPTHAELLELAAEVGAAIAGRGWTLVWGGGHVSAMGAVASAARACGGWTVGVIPKMLVYRELADHDADELIVTDTMWERKQIMEDRSDAFIVLPGGVGTLDELFDAWTDGYLGTHDKPIVMVDPWGHFDGLRAWLNGLLDTGYVSPTAMERLVVVDNVKDALRACAPS

SEQ ID NO: 15886 - DNA, 576 bp, Bacillus subtilis
  CDS (1)..(576)
atgaaaaccatttgtgtatttgcgggatcaaaccctgggggaaatgaagcgtataaaagaaaagcggcagagcttggcgtgtatatggctgagcagggaatcggccttgtctatgggggctcccgcgtaggcttgatgggcacgattgctgacgcgattatggaaaacggcggaactgcaatcggggtcatgccgagcggtttgttcagcggggaggttgtccatcagaatctgactgagctgattgaagtaaacgggatgcatgaacgaaaggctaaaatgagcgagctggcggacggctttatctcgatgccgggcggcttcggtacatatgaagaattatttgaagtgctgtgctgggcacagatcggcatccaccaaaagccaattggactgtacaatgtaaacggatattttgaaccaatgatgaaaatggtgaaatacagcattcaagaagggttttctaacgaatcgcacctaaaactgattcacagctcgtcacggccggatgagttaattgagcaaatgcaaaattattcttatccgattttagaaaaaaagtggacagaaatttaa

SEQ ID NO: 15887 - protein, 191 aa, Bacillus subtilis
MKTICVFAGSNPGGNEAYKRKAAELGVYMAEQGIGLVYGGSRVGLMGTIADAIMENGGTAIGVMPSGLFSGEVVHQNLTELIEVNGMHERKAKMSELADGFISMPGGFGTYEELFEVLCWAQIGIHQKPIGLYNVNGYFEPMMKMVKYSIQEGFSNESHLKLIHSSSRPDELIEQMQNYSYPILEKKWTEI

SEQ ID NO: 15888 - DNA, 564 bp, Bacillus halodurans
  CDS (1)..(564)
atgaaaatcgccgtcttttgcggatcaagcaatggagcttctgacgtctataaggaaggggctcgacagcttggaaaggaattagctagaagaggaattaccctagtgtatggaggagctagtgtaggaatcatgggggctgttgcagattctgtccttgaagccggtggagaagtaatcggtgtcatgccacgtttccttgaagaaccggaaatttcacatcctcatttaaccaaacttattgtagttgagacgatgcacgagcggaaagcgaaaatggcagaactagcagacggatttcttgctttgcctggtggacctgggacgttagaagagttttttgagattttcacttgggctcaaattggattgcatcaaaaaccatgtggccttttaaatatcaatcattacttcgatccacttgttactttattacatcacatgtcgaatgaacaatttttgcatgagaagtaccgttccatggcgcttgttcatacagaccctatcttgctactagatcaattttcaacttatgagccaccgacagtcaaagcgtactcataa

SEQ ID NO: 15889 - protein, 187 aa, Bacillus halodurans
MKIAVFCGSSNGASDVYKEGARQLGKELARRGITLVYGGASVGIMGAVADSVLEAGGEVIGVMPRFLEEPEISHPHLTKLIVVETMHERKAKMAELADGFLALPGGPGTLEEFFEIFTWAQIGLHQKPCGLLNINHYFDPLVTLLHHMSNEQFLHEKYRSMALVHTDPILLLDQFSTYEPPTVKAYS

SEQ ID NO: 15890 - DNA, 546 bp, Arabidopsis thaliana (mouse-ear cress)
  CDS (1)..(546)
atggaagagacaaaatcaagattcaggaggatctgtgtcttctgcggaagcagttccggcaacaaaaccacttatcacgacgctgctctccaactcgcccaccaactggtggagagaaacatcgatttggtgtatggaggaggaagcgtggggctaatgggtctcatttctcaagctgttcatgatggtggtcgagaagttataacagtatcgactatgcaccaaaggaaggctgaaatgggtcgccaagcggatgccttcatcgcacttcctggtggatatgggacatttgaagagttgttggaagtcatcacctggtctcagcttgggattcacactaaaccggtgggactattgaacgtggatggattctacgattcactattgacgtttatagataaggcagtggacgaaggcttcgtctcctccaccgctcgccgtatcattgtctcggctccaaacgctcctcaattacttcaacttcttgaggtttttttatttgcctttcattactttttgattattctatttaatactatagactaa

SEQ ID NO: 15891 - protein, 181 aa, Arabidopsis thaliana (mouse-ear cress)
MEETKSRFRRICVFCGSSSGNKTTYHDAALQLAHQLVERNIDLVYGGGSVGLMGLISQAVHDGGREVITVSTMHQRKAEMGRQADAFIALPGGYGTFEELLEVITWSQLGIHTKPVGLLNVDGFYDSLLTFIDKAVDEGFVSSTARRIIVSAPNAPQLLQLLEVFLFAFHYFLIILFNTID

SEQ ID NO: 15892 - DNA, 597 bp, Rhodococcus fascians
  CDS (1)..(597)
atgaaccttcgaccaatgcccgcgactacggtctcggcacaggcccgcccgacccccaagagcgtcacggtcttctgcggagctatgccagggcgcgggaccaaatatggacagctcgcagaggggatggggcgtgcgattgctagatcgaagctgcgcctcgtttatggtggcgcccgagtcggcctcatgggcaccctcgcgaacgcggccttggactccggcggaaccgtcgttggcgtgatccctgagagcttcactgcgatacccgaggctgcgcatcatggactgacagaactacacgtcgtccatgacatgcaccaacgcaaagctctcatggccgaactcggtgacgcattcattgccctccccggcggtgtcggaaccgcagaagagttcttcgaggtccttacgtggtcacacctggggcttcacaataaaccctgtgtactgctgaacgacaacgagtattaccgccccttgctctcctacatcgagcacgctgccgtcgaaggatttatcacccccgcaacccggtctcgcgtaatcgtctgcaaagacatcgagggggctatcgcggccattcgctcaccctaa

SEQ ID NO: 15893 - protein, 198 aa, Rhodococcus fascians
MNLRPMPATTVSAQARPTPKSVTVFCGAMPGRGTKYGQLAEGMGRAIARSKLRLVYGGARVGLMGTLANAALDSGGTVVGVIPESFTAIPEAAHHGLTELHVVHDMHQRKALMAELGDAFIALPGGVGTAEEFFEVLTWSHLGLHNKPCVLLNDNEYYRPLLSYIEHAAVEGFITPATRSRVIVCKDIEGAIAAIRSP

SEQ ID NO: 15894 - DNA, 609 bp, Arabidopsis thaliana (mouse-ear cress)
  CDS (1)..(609)
atggaaatcaaaggtgaatcgatgcaaaagtcaaagttcagaagaatctgtgtcttctgtggaagcagccaaggcaagaagagcagttaccaagatgctgctgttgacctcggcaacgaactggtttcaaggaatattgatctagtctatggaggtgggagcataggattgatgggtttggtttcacaagctgttcatgatggtggtcgtcatttgactggtgaaacagtaggagaagtaagagcagttgcagatatgcaccaaaggaaagctgagatggctaagcactctgatgcttttattgccttaccaggtggttatggaacacttgaagaattgcttgaagtcataacttgggctcagcttggtatacatgacaagccggtgggtttgctcaatgttgatggatactacaactctctgctctcattcattgacaaagcagtcgaagaaggatttattagcccgactgctcgtgagatcatcgtctccgcacctactgctaaagagctggtgaaaaagctagaggaatatgcaccttgccatgaaagggttgcaacgaagctttgttgggagatggaacggattggttactcctctgaagagtag

SEQ ID NO: 15895 - protein, 202 aa, Arabidopsis thaliana (mouse-ear cress)
MEIKGESMQKSKFRRICVFCGSSQGKKSSYQDAAVDLGNELVSRNIDLVYGGGSIGLMGLVSQAVHDGGRHLTGETVGEVRAVADMHQRKAEMAKHSDAFIALPGGYGTLEELLEVITWAQLGIHDKPVGLLNVDGYYNSLLSFIDKAVEEGFISPTAREIIVSAPTAKELVKKLEEYAPCHERVATKLCWEMERIGYSSEE

SEQ ID NO: 15896 - DNA, 807 bp, Arabidopsis thaliana (mouse-ear cress)
  CDS (1)..(807)
atggaaatagtgaagtcgaggttcaagagggtttgtgtgttctgtggtagcagcagcggaaagagagagtgctacagtgatgccgccactgatctagctcaagagctggttcggttatgcttaaatcttaatgagagtcttgaaaacctgaaatgggtgacgaggagattgaatcttgtgtatggaggaggaagcattggtctcatgggtttggtctcacaagctgttcatgaagctggaggacatgtactagggtatgctcaaatctatgacctcttcactttaataaccggagaaacatatggtgaggtaatagctgtggcggatatgcatgaaagaaaagccgaaatggcacgccactcggattgtttcattgctttaccaggtgggtatggaacactggaggagttattggaagtaatagcatgggcacaacttggaattcacgacaagcctgtgggtttgttaaatgtggatggttattacaattacctcctcactttcattgataaagccgttgatgatggctttatcaaaccatctcagcgtcacatctttgtctcagcccccaatgccaaagagcttgtccaaaaacttgagattctgatgaagataaacaaagacaaaaagtttgattcggcaattgatcttttgttttttgatattcctcaggcatacaagccagtgaatgatggagtcatagctaaatctaggtgggaggttgagaagaaagtgcaacagccgcaacaacagcaacaagtagtgttctgttctaacacaagcatgcagactgagattgccctttag

SEQ ID NO: 15897 - protein, 268 aa, Arabidopsis thaliana (mouse-ear cress)
MEIVKSRFKRVCVFCGSSSGKRECYSDAATDLAQELVRLCLNLNESLENLKWVTRRLNLVYGGGSIGLMGLVSQAVHEAGGHVLGYAQIYDLFTLITGETYGEVIAVADMHERKAEMARHSDCFIALPGGYGTLEELLEVIAWAQLGIHDKPVGLLNVDGYYNYLLTFIDKAVDDGFIKPSQRHIFVSAPNAKELVQKLEILMKINKDKKFDSAIDLLFFDIPQAYKPVNDGVIAKSRWEVEKKVQQPQQQQQVVFCSNTSMQTEIAL

SEQ ID NO: 15898 - DNA, 549 bp, Streptomyces coelicolor
  CDS (1)..(549)
atggacgccatgaacatctgcgtcttcctctccgccgccgacctcgacgagcactacacgcgccccgccaaggagttcgccgaactgctcggcaagggcgggcacaccctcgtctggggcggctccgacgtcggtctgatgaaggtggtcgccgacggcgtgcaggagtccggcggaaagctgctcggggtctcggtggacttcctggccgccaaggcgcgcgagggcgccgacgagatggtgatcgcgaaggacctggccgagcgcaagcggctgctgctggagaaggccgacgccgtggtcatcatggtgggcggcaccggcacgctcgacgaggccaccgagatcctggagctgaagaagcacgggcacaccgacaagccggtcgtcctgctgaacaccgcgggcttctacgacggcctcaaggagcagttccgccgcatggaggacgagggcttcctgccccgccccctcaccgagctggtcttcttcgccgaggagccggtgggcgcgctcgcctacctggaggagagccagggcatcgagtag

SEQ ID NO: 15899 - protein, 182 aa, Streptomyces coelicolor
MDAMNICVFLSAADLDEHYTRPAKEFAELLGKGGHTLVWGGSDVGLMKVVADGVQESGGKLLGVSVDFLAAKAREGADEMVIAKDLAERKRLLLEKADAVVIMVGGTGTLDEATEILELKKHGHTDKPVVLLNTAGFYDGLKEQFRRMEDEGFLPRPLTELVFFAEEPVGALAYLEESQGIE

SEQ ID NO: 15900 - DNA, 564 bp, Mycobacterium leprae
  CDS (1)..(564)
atgcgttcggatcgcggtaaacccaatgcgtgggcgatttgtgtcttttgcgcggctggaccgatgcacccggagctgctcgaactggccgccgaacttggtgaggcgattgctgagcgcggctggaccctggtctggggcggtggccgcgtttcagcgatgggtgcggtggcgtccgcggcgtggacacgcggcggtcggatagtcggcgtgatcccggaaatgttgcaacgccgcgagattgccgacacctatgtcggtgagctgatcgtcaccgaaacgatggccgaacgtaaacaggtcttggacgatcacgctgatgcgttcatcgtgttgccgggtggtctggggaccctcgatgagctattcgaagcatggaccgcgggctatttgggtatgcaccgtaaacccatcgtaatgctggacccctgggggcactacgaaggcctttgggcttggctgcacggattgatcgatagtggctatgtttcgccggtagcgatggagcggctggtggtggttgaccaggtggatgccgcgcttgaggcttgtatgtccgtctga

SEQ ID NO: 15901 - protein, 187 aa, Mycobacterium leprae
MRSDRGKPNAWAICVFCAAGPMHPELLELAAELGEAIAERGWTLVWGGGRVSAMGAVASAAWTRGGRIVGVIPEMLQRREIADTYVGELIVTETMAERKQVLDDHADAFIVLPGGLGTLDELFEAWTAGYLGMHRKPIVMLDPWGHYEGLWAWLHGLIDSGYVSPVAMERLVVVDQVDAALEACMSV

SEQ ID NO: 15902 - DNA, 648 bp, Arabidopsis thaliana (mouse-ear cress)
  CDS (1)..(648)
atggaggtcaacaatgaaaccatgcaaaagtcaaagtttggaagaatctgtgtgttttgtggaagcagccaaggcaagaagagtagttaccaagatgctgctgtggatctaggcaacgaattggttttaaggaacattgatctagtctatggaggtggaagcataggtttgatgggtttggtttcgcaagctgttcatgatggtggtcgccatgttattggagttattcccaagacactcatgcctagagagttgaccggtgaaacagtaggagaagtaagagcagttgcagatatgcatcaaagaaaagcagagatggctagacactctgatgcttttattgctttaccaggtggatatggaacacttgaagagcttttggaggtcataacatgggctcagcttggaatacatgataaaccggtgggtttgctcaatgttgatggatactacaactctttgctctctttcattgataaagccgttgaagaaggcttcatcagtacaaacgcacgccagatcataatttctgcacctactgccaaggagcttgtaaagaagctggaggaatattcgccttgccatgaaagtgttgcgactaagctttgttgggagatagagcggattgactactcttctgaagactga

SEQ ID NO: 15903 - protein, 215 aa, Arabidopsis thaliana (mouse-ear cress)
MEVNNETMQKSKFGRICVFCGSSQGKKSSYQDAAVDLGNELVLRNIDLVYGGGSIGLMGLVSQAVHDGGRHVIGVIPKTLMPRELTGETVGEVRAVADMHQRKAEMARHSDAFIALPGGYGTLEELLEVITWAQLGIHDKPVGLLNVDGYYNSLLSFIDKAVEEGFISTNARQIIISAPTAKELVKKLEEYSPCHESVATKLCWEIERIDYSSED

SEQ ID NO: 15904 - DNA, 690 bp, Arabidopsis thaliana (mouse-ear cress)
  CDS (1)..(690)
atggagaatgaagagggaaaaagagagatgacgaagaaacaaagttcaaggtttaagagcatttgcgtcttttgtgggagtagcaatgggaacaaagctagttatcaagatgcagccattgatttggccaaggaactggtgatgaggaagattgatcttgtttatggtggaggaagcataggtttaatgggtttggtgtctcaagctgttcatgatggtggtcgtcataataataacaataatggtaatgatgatgctcttttttgtcactctgtcaatgtctcgcaaacaaactcaaagttaactggagaaacagtaggagaagtgaaggaagttgcagacatgcatcagagaaaagctgtgatggctaagcattctgatgctttcattactttgcctggtggctatggtacactagaggagctacttgaagtgataacttgggcacaacttggtatccatgataaaccggtcggtttattaaacgttgatggatattacgatgcattgctgttattcatcgacaaagccgtcgaagagggatttattcttccaaccgctcgacatattatcgtatctgcaccaaccgcaagagagttgtttataaaattggagttgaatatggtatcactagatcgaatatctaaacatgcattatctttgtttcaagttatgtctaaagctggttag

SEQ ID NO: 15905 - protein, 229 aa, Arabidopsis thaliana (mouse-ear cress)
MENEEGKREMTKKQSSRFKSICVFCGSSNGNKASYQDAAIDLAKELVMRKIDLVYGGGSIGLMGLVSQAVHDGGRHNNNNNGNDDALFCHSVNVSQTNSKLTGETVGEVKEVADMHQRKAVMAKHSDAFITLPGGYGTLEELLEVITWAQLGIHDKPVGLLNVDGYYDALLLFIDKAVEEGFILPTARHIIVSAPTARELFIKLELNMVSLDRISKHALSLFQVMSKAG

SEQ ID NO: 15906 - DNA, 600 bp, Acinetobacter sp
  CDS (1)..(600)
atggtaaaaaaatttatgaattctgtttgtattttctgtggttctgctgttggtacagatccggtctttattcaggctgctcaaagtactggaaaacgcattgccgaacaaggtaaaacactggtgtatggtggtgggcgttctggcttgatgggtgttgttgcagacagtgctttgcaggcaggtgggcatgtgattggtgtgataccaacagcgctggttgatcgtgagttggctcatccacatctgaccgaattgcatgtcgtaaaaaatatgcacgaacgtaaaaccaaaatggcagaactctcggacgggtttattgctttacctggtggcgctgggactttggaagaaatttttgagcagtggacatgggcacagctgggtattcaccaaaaaccatgtggatttttgaatatcaaagggttctacgatgatttactgaaaatgattcaagggactgtcgactacggttttacccaatcacgttttgcagaaaagctgatcgcctctgatgatattgaaattattctgaatcagtttgagcattatctggcgcctacaccaaaatggggggatcatgccaaagttcatccttga

SEQ ID NO: 15907 - protein, 199 aa, Acinetobacter sp
MVKKFMNSVCIFCGSAVGTDPVFIQAAQSTGKRIAEQGKTLVYGGGRSGLMGVVADSALQAGGHVIGVIPTALVDRELAHPHLTELHVVKNMHERKTKMAELSDGFIALPGGAGTLEEIFEQWTWAQLGIHQKPCGFLNIKGFYDDLLKMIQGTVDYGFTQSRFAEKLIASDDIEIILNQFEHYLAPTPKWGDHAKVHP

SEQ ID NO: 15908 - DNA, 618 bp, Acinetobacter sp
  CDS (1)..(618)
atgaatagcgtagttaaaatgaccttagagttgaatagtaaagacaaaacaacccaacctttgattgccttatattgtggatcacgcgccggaaataaacctatttatcgagaaaaagccattgaactggcacaaggtattgccgaacagggctttggtatcgtctacggtggagccagtattggcctgatgggacaagtggcagatacagtcctcgaaaacgctggtgaagtagttggtgtcattcccgagttcatgctcgattatgaagtcgctcactccaaactgacagaattacacgtcgtacaaaccatgcatgaacgtaaagccatgatggcagatcgcgccaatgcatttattgcattacctggtggcctgggcacctttgaggaaatcttggaaattgccacttgggggcaattaaatcagcatcaaaaacccatgattttatataatgttaatggattttatgaagcgctgattgctcagcttgaccatgccgttgaggaaggattcttgccaccccaacatcgcgccaagctgatcgtttgtcaaagtcttgaagagatctataccgctattaagaatctcaatgttccgagtggctttatggcctaa

SEQ ID NO: 15909 - protein, 205 aa, Acinetobacter sp
MNSVVKMTLELNSKDKTTQPLIALYCGSRAGNKPIYREKAIELAQGIAEQGFGIVYGGASIGLMGQVADTVLENAGEVVGVIPEFMLDYEVAHSKLTELHVVQTMHERKAMMADRANAFIALPGGLGTFEEILEIATWGQLNQHQKPMILYNVNGFYEALIAQLDHAVEEGFLPPQHRAKLIVCQSLEEIYTAIKNLNVPSGFMA

SEQ ID NO: 15910 - DNA, 669 bp, Candida glabrata
  CDS (1)..(669)
atgaagagcgtttgtgtttattgcggttcggctagcggggacaagagcttcgtagctgctgcggaggagctgggcgcgctgatccacgcgagacggtggtcgctggtgtacggcgggggcaccactgggctgatgggcggggtggcccgcggtgccatgggccccagcaaggacggctcggtgcatgggatcatcccggatgcgctggtggccaaggaacgtagcgatggtggtggcgctgggcaagagcaggagcaggagcaggaggagtacagcgagcctgtcaatggtaccacggtggtgtcgagcgactacggtgagaccacggtggtgccggacatgcacaccaggaagcggctgatggcgtctatgagcgatgcgttcgtggcgctgcccggcgggttcggcacgctggaggagctgctggagtgcgtcacttggtcgcagctggggatccacaacaagccggtggtggtgctgaacaccaacggctacttcgacgcgctgctgcggttcttccgggacgccatcgcggcggggttcatcagcgaggccaacggcagcatcttgcaagtggcctccacgccgcaggaggctatcgacctcatcgtcaactacaaagtcccagaagggcggttcaacttgaagtggtccgacgaagggttgtaa

SEQ ID NO: 15911 - protein, 222 aa, Candida glabrata
MKSVCVYCGSASGDKSFVAAAEELGALIHARRWSLVYGGGTTGLMGGVARGAMGPSKDGSVHGIIPDALVAKERSDGGGAGQEQEQEQEEYSEPVNGTTVVSSDYGETTVVPDMHTRKRLMASMSDAFVALPGGFGTLEELLECVTWSQLGIHNKPVVVLNTNGYFDALLRFFRDAIAAGFISEANGSILQVASTPQEAIDLIVNYKVPEGRFNLKWSDEGL

SEQ ID NO: 15912 - DNA, 567 bp, Staphylococcus aureus subsp
  CDS (1)..(567)
atgaagcgaatcgcagtttattgtggtgcaagcaaaggtcatgacccttcatatgtacaaaaagcatacgatttaggtaaatattttgctgaacaaggttatgaattagtatttggtgcagggtcaattggtattatgggtgccattcaagatggtgtattagatcatggtggcaaagctattggcgtcatgcctaaaatgttagatgaacatgaaatcacaagccaacgtttaactgaattaattttagttgattctatgcatgaacgtaaaaataaaatggcagaacttgcagatgcatttgtcatggctcctggtggcgcaggttcactagaagaatttttcgaaatgtatagttgggctcaaataggtatccatgaaaagcctattgccatttataatattaatggctttttcaatccactacaaacaatgattgaccatatgattgaggaaggttttattgatcctaagtatcgtgcacttgcaccgttatgcgacactaaggaatcattaatagaatcaatattaaatttcaaacctctaggtactcgttcatacgattaa

SEQ ID NO: 15913 - protein, 188 aa, Staphylococcus aureus subsp
MKRIAVYCGASKGHDPSYVQKAYDLGKYFAEQGYELVFGAGSIGIMGAIQDGVLDHGGKAIGVMPKMLDEHEITSQRLTELILVDSMHERKNKMAELADAFVMAPGGAGSLEEFFEMYSWAQIGIHEKPIAIYNINGFFNPLQTMIDHMIEEGFIDPKYRALAPLCDTKESLIESILNFKPLGTRSYD

SEQ ID NO: 15914 - DNA, 867 bp, Oryza sativa
  CDS (1)..(867)
atgaccctagcggccgcggcggaggcgccggcgccgacccatgcgttcgcgatcgcggcagaggaggtggcaatggagccgctgtcgacggcgacggctccggcggccatggaggaggagtccagtagtagtggcggcggcggcggggtaggggagcgacggtcgcggttccgccggatctgcgtctactgcggcagcgccaaggggaagaagcccagctaccaggacgccgccgtcgacctcggcaaggagctggtggagaggggcatagacctggtctacgggggtggatccatcggactcatgggcctggtctcgcatgcagttcatgctggaggtcgccatgtcattgggatcattccaaaatctctgatgcccagagaggtaactggagaacctgtaggggaagttagagccgtttctggtatgcacgagaggaaggccgagatggctcggtttgctgatgcttttattgctctaccaggtggctatggaaccttggaggagttgcttgaggtcattacttgggcacaacttggaatccataagaagccgatatggttcacactttttgaatattctcaaacagctaatggaatggcgattggaggatcttatactgttggtcttttgaatgttgacggattctacaaccctcttctatcgtttatcgacttggctgttaatgaaggcttcatcaccgaggaggctaggcgcatcatcatctccgctccaacagccaaggagctagttatgaaattggaggactatgtccccgagtatagcattggcttggtttgggaggaccagaaccagaagcaaaataacttggtccctgagctggactccgggatcacatcatcctga

SEQ ID NO: 15915 - protein, 288 aa, Oryza sativa
MTLAAAAEAPAPTHAFAIAAEEVAMEPLSTATAPAAMEEESSSSGGGGGVGERRSRFRRICVYCGSAKGKKPSYQDAAVDLGKELVERGIDLVYGGGSIGLMGLVSHAVHAGGRHVIGIIPKSLMPREVTGEPVGEVRAVSGMHERKAEMARFADAFIALPGGYGTLEELLEVITWAQLGIHKKPIWFTLFEYSQTANGMAIGGSYTVGLLNVDGFYNPLLSFIDLAVNEGFITEEARRIIISAPTAKELVMKLEDYVPEYSIGLVWEDQNQKQNNLVPELDSGITSS

SEQ ID NO: 15916 - DNA, 588 bp, Corynebacterium glutamicum
  CDS (1)..(588)
atgacttcgcttttcgacgccccaaccctccaacgcgtcaccgttttcacgggctcggcgctcggcagttcctcgctgtacacgcaagcggctcaaaccttggcgaaaaccgcggtagaccgcggcatcgacttggtttacggtggcggaaaagtggggctcatgggtatcgtcgcggatgcgttcctggaatcaggtggcgaagcctttggcgtcatcacggaatcacttatgaagggtgagcttgggcatgaaaagctcaccgaacttgaaatcgttcctgatatgcacatccgcaagcgtcgcatggcagaacttggcgatggttttatcgccatgcccggtggcgccggcaccttggaagaacttttcgaggtctggacctggcaacagctgggcattcatcaaaagcccgtcgcactttatgatgtcgatggtttttggcagcccctgctggaaatgcttgagcagatgacccagcgtggatttatcaagcgagacttctttgagtgcctcatcgtggaatccgacccgcatgccctgctaaaggcaatgcagacctggactccaccagcaccaaaatggtaa

SEQ ID NO: 15917 - protein, 195 aa, Corynebacterium glutamicum
MTSLFDAPTLQRVTVFTGSALGSSSLYTQAAQTLAKTAVDRGIDLVYGGGKVGLMGIVADAFLESGGEAFGVITESLMKGELGHEKLTELEIVPDMHIRKRRMAELGDGFIAMPGGAGTLEELFEVWTWQQLGIHQKPVALYDVDGFWQPLLEMLEQMTQRGFIKRDFFECLIVESDPHALLKAMQTWTPPAPKW

SEQ ID NO: 15918 - DNA, 636 bp, Rhodopseudomonas palustris
  CDS (1)..(636)
atgacgctgtcatcccgcggtgccacatccgccaccatgagcaagatcaagaccgtctgcgtctattgcggctccggccccggcagcaatccccgatttctcgaagcagcgacagccttcggcaaggaactcgccgagcacggcgtcgggctggtgtacggcggcggcgcgatcgggctgatgggtgcggtcgctaacgcagtgctcgatcacggcggcgcggttaccggcatcattccaggctttctcagcgccaaggagattgcgctcggtcgcgtcagtgagctgatcgtcactgaagacatgcacgagcggaagcggctgatgttcgagcgatccgacgccttcgtagctttaccaggcggcatcggcacgctcgaagaactcgtcgagcagatgacctggcagcagcttggccgtcacaccaagccgatcctgatcgccgacatcgacggtttctggcagccgctactcgaactcttggcacacatgcgcagcaccgccttcatccgtcccaacctcgcggtcgaggttctgaaagcggacaaggtcgaagacatcctgccgaagctgcaagctgccgcagcgccgcagccgacgcgtgagatgccgccggggattgcggaacggctatag

SEQ ID NO: 15919 - protein, 211 aa, Rhodopseudomonas palustris
MTLSSRGATSATMSKIKTVCVYCGSGPGSNPRFLEAATAFGKELAEHGVGLVYGGGAIGLMGAVANAVLDHGGAVTGIIPGFLSAKEIALGRVSELIVTEDMHERKRLMFERSDAFVALPGGIGTLEELVEQMTWQQLGRHTKPILIADIDGFWQPLLELLAHMRSTAFIRPNLAVEVLKADKVEDILPKLQAAAAPQPTREMPPGIAERL

SEQ ID NO: 15920 - DNA, 1086 bp, Corynebacterium diphtheriae
  CDS (1)..(1086)
atgagcttttccccagaactgcctgactttatgcagggcctcggcgtgtccgtccatgccatgaccaacgccgatgtccccgcgcacacggactccgttttacgtaacctgaatcgttttgagcagcactttaccgccgacgatcttgctgtagtgccgttgtcggagtacaccttttttaacgaggggcgtggcgatattggcatcgtggtacaagatgcctctggtgccgtcgtgggtaccatgtgcgtgcagtttattaaaggactggcctacctcaaccccgctgtgcctgagatgacgcttcgtttggatgaagcgtggcgcgggaaggggatcggtggctggttgattgagcaggcaaccgagtatggtcgtttgaacggttggcctggtattgcggtgaatgtggaaaagcagtcgccagctcgtcgcctttatgcgcgccatgatttcgctgctcaggaccgtgaggttgaatatggtgctatcatgctgaagaccttgagtccgaagattcgtagtgttgctgtgtattgtggctctgctgtgggggagcgacctgagtatgcgcaggcggcgcgtgagttgggtactgcgttggcgcagcgcggtatcaccatggtttatggtggcggcaggccaggtctgatgggtattgctgccgacgctgccatcgctgcgggtggcaaggtgcatggtgtgatgccgcatgcgcttgttgatctagagcaggcgcatcctggtttgagtgcgcttgatattactgacacgatggcgcagcgtaagacgcgcatggaagagcttgccgacgcctttgtggttctgccaggtggtatgggcactatggaggagatgttccaggtgttggtgcgtcagcagctagggccgtatgcggggccggtggcgttgatgaatattgaggagttctgggatccgtttattgctgcattgcgcacaatgagtgaagagggctttatttcagagcgttatattgatgcgctggtgatggcgaaagattctgaggagcttttccaaggcttcagctcgtgggtgaaccctggtctgaagtggctgtccgactag

SEQ ID NO: 15921 - protein, 361 aa, Corynebacterium diphtheriae
MSFSPELPDFMQGLGVSVHAMTNADVPAHTDSVLRNLNRFEQHFTADDLAVVPLSEYTFFNEGRGDIGIVVQDASGAVVGTMCVQFIKGLAYLNPAVPEMTLRLDEAWRGKGIGGWLIEQATEYGRLNGWPGIAVNVEKQSPARRLYARHDFAAQDREVEYGAIMLKTLSPKIRSVAVYCGSAVGERPEYAQAARELGTALAQRGITMVYGGGRPGLMGIAADAAIAAGGKVHGVMPHALVDLEQAHPGLSALDITDTMAQRKTRMEELADAFVVLPGGMGTMEEMFQVLVRQQLGPYAGPVALMNIEEFWDPFIAALRTMSEEGFISERYIDALVMAKDSEELFQGFSSWVNPGLKWLSD

SEQ ID NO: 15922 - DNA, 564 bp, Mycobacterium paratuberculosis
  CDS (1)..(564)
atgcccgcagaacgcgattcgtcggccgcgtgggcggtgtgtgtgtactgcgcgtccggcccgcagcatcccgaattgctcggtgtcgctgcggaactgggcgaggcgatcgccgagcggggctggacgctggtgtggggcggcggccgggtgtcggcgatgggcgcggtggccagcgcggcccgggcccgcggcgggcggaccgtcggtgttatccccacggtgctgatgcgccgcgagatcgccgacgccgacgccgacgagctgatcgtcagcgacaccctgcacgagcgcaaacagatcatggaggaccgcgccgacgcgttcatcgcgttgcccggcggcatcggcaccctcgacgaggtgttggacgcgtggacgacggggtttctcgggctgcacgccaaacccatcgtgctgctggacccgatcggccactacgaggggctgtggctgtggctgtccggattgctggacagcggctacatcacccaggcggcgatggaccgggtggtcctggtcgacaaggtgggtgccgcgttggaggcgtgcgcgcccggctga

SEQ ID NO: 15923 - protein, 187 aa, Mycobacterium paratuberculosis
MPAERDSSAAWAVCVYCASGPQHPELLGVAAELGEAIAERGWTLVWGGGRVSAMGAVASAARARGGRTVGVIPTVLMRREIADADADELIVSDTLHERKQIMEDRADAFIALPGGIGTLDEVLDAWTTGFLGLHAKPIVLLDPIGHYEGLWLWLSGLLDSGYITQAAMDRVVLVDKVGAALEACAPG

SEQ ID NO: 15924 - DNA, 591 bp, Geobacter sulfurreducens
  CDS (1)..(591)
atgaaacgcatctgcgtgttttgcggttccagccccggcgcgcggccggcttatgccggggcggcgcgggagctcgggcggctgctggcggcaacgggaatcgatctggtctacggcggggcgagcgtcggcctgatggggattctggcccggaccgtgctcgatggcggcggccgggtgaccggcgtcatcccccggatgctggaggagaaggagatcgccctgaccaggctgagcgatctccgggtggtggagtccatgcatgagcgcaaggccctcatggcggagctgtcggacggattcatcgccctgcccggcgggatcggcactatcgaggagttcgttgaggtgctcacgtggctgcagttgggcatccacggcaagccgtgcggcctgctgaacagcgacggctattacgaccgcctgctggactttttcgaccacatggccgcggaagggttcatccggccggaatgccgcgaagccgtgctggtggaccgggacccggcggcgttgctgaagaagatgagtctctaccgcgcgcccgtcccggacaaggtggagtgggcgctgaagatggataacgcgtga

SEQ ID NO: 15925 - protein, 196 aa, Geobacter sulfurreducens
MKRICVFCGSSPGARPAYAGAARELGRLLAATGIDLVYGGASVGLMGILARTVLDGGGRVTGVIPRMLEEKEIALTRLSDLRVVESMHERKALMAELSDGFIALPGGIGTIEEFVEVLTWLQLGIHGKPCGLLNSDGYYDRLLDFFDHMAAEGFIRPECREAVLVDRDPAALLKKMSLYRAPVPDKVEWALKMDNA

SEQ ID NO: 15926 - DNA, 567 bp, Lactobacillus johnsonii
  CDS (1)..(567)
atgattaaaaaacttgcagtatactgtggtgccagggctggtaatcgtcctgaatacattaaggctgcctataattttggtaagaaaatggccgaccaccaaattgaattagtttatggtggcggaaagttcggcttaatgcgggcagttgcagacggtgttttagaaaatggtggtatcgtccacggcattattactgaagaattaaaagatcgcggagcttcttatgataaagtacaggatttccgtgtggttcccaatatggataagcgaaaagataccatgatgaatctagcagatggaatggtagctttacctggaagtattggaactttagaagaaataagtcaggctatttcttggactgcaattggtgacaatgctaagcccgtagctttttataattatgaaggtttctatgattatttagataaactccttaagcggatgaatcaagatgattttttagagaatatctatttagacgcaatttattttggaactgattttgataaaattctacagtttatggaagactatcaagcacctgcttatcggaagtattaa

SEQ ID NO: 15927 - protein, 188 aa, Lactobacillus johnsonii
MIKKLAVYCGARAGNRPEYIKAAYNFGKKMADHQIELVYGGGKFGLMRAVADGVLENGGIVHGIITEELKDRGASYDKVQDFRVVPNMDKRKDTMMNLADGMVALPGSIGTLEEISQAISWTAIGDNAKPVAFYNYEGFYDYLDKLLKRMNQDDFLENIYLDAIYFGTDFDKILQFMEDYQAPAYRKY

SEQ ID NO: 15928 - DNA, 708 bp, Ashbya gossypii
  CDS (1)..(708)
atgagcagtgaattggagggcacgacgcccaaggatgcgcgcgccgatggcttcaagctcgccgtctgcgtgtactgcggctcctcgttcggcaacagcgccaagtacgccgacgcggcccgcagcctcggcgagctcttccaccagctgcagtggaagctcgtctacggcggcggcaccaccggcctcatgggcacggtcgcgcgcgccaccatgggccccgactgcgacggctacgtgcacggcatcatccccaacgcgctcgtcgctaaggaacgcgacgacaaggccgaccacaacgcgctcctccacgcctccgtcgacaaccacaccggcgtgacccccatcagcgaggagtacggcgccacaaccatcgtccccgacatgcacacgcgcaaggccatgatggcccgcgagagcgacgctttcgtcgcactccccggcggctacggtaccctcgaggaggtcatggagtgcatcacctggtcccagctcggcatccaccagaagcccatcatcctcttcaacatcgacggcttctacgacagcctgctcgcctttgtcgaccgcgccatcgccgacggcttcatctcccgcaagaacggcgacattctcgaggtcgccacttcgcccgaggaggtcgtccgcaagatcgagaactaccacgtcccggacggccgcttcaacctgcgctgggccgacatgtag

SEQ ID NO: 15929 - protein, 235 aa, Ashbya gossypii
MSSELEGTTPKDARADGFKLAVCVYCGSSFGNSAKYADAARSLGELFHQLQWKLVYGGGTTGLMGTVARATMGPDCDGYVHGIIPNALVAKERDDKADHNALLHASVDNHTGVTPISEEYGATTIVPDMHTRKAMMARESDAFVALPGGYGTLEEVMECITWSQLGIHQKPIILFNIDGFYDSLLAFVDRAIADGFISRKNGDILEVATSPEEVVRKIENYHVPDGRFNLRWADM

SEQ ID NO: 15930 - DNA, 774 bp, Oryza sativa
  CDS (1)..(774)
atgggagacggagcggaggcggcgggggcgaccgcggcgagcaggttcgggacgatctgcgtcttctgcggcagcaacgcggggcgccgcagggtgttcggcgacgcggcgctcgacctcggccacgagctggtgaggcggggcgtcgatctggtctacggcggcggcagcatcgggctgatgggcttgatcgcgcgtacggttctcgacggcggccgccgtgtcgtcggggtgattcctagagctctcatggctgtcgagggtgatgtttatcttgaatatgtcagggtgaagttacctgatcctaacataattgataataagatgttttactttgacttggaaggactgtacagctttgtgaagaattttgtaaagggagtgatatcaggtgagagtgtgggagaagtaatagttgtacaggacatgcatgagcggaaagcggagatggctcggcgatccaaagcgttcattgctcttcctgggggctatggaacaatggaggagctgttagagatgataacatggtgccaacttggaattcatgacaagccagttggattgctaaatgttgacggttactacgatccactgctcgcgttgttcgacaaaggcgaggcggagggcttcatcaactctgattgtagacaaatatttgtatctgcaccaactgcaagtgaattgctgacaaagatggaggaggtggcccctgcaacaagctgggagatctcagagcttggctatggaagaacaccgggcgctgatcaatcctag

SEQ ID NO: 15931 - protein, 257 aa, Oryza sativa
MGDGAEAAGATAASRFGTICVFCGSNAGRRRVFGDAALDLGHELVRRGVDLVYGGGSIGLMGLIARTVLDGGRRVVGVIPRALMAVEGDVYLEYVRVKLPDPNIIDNKMFYFDLEGLYSFVKNFVKGVISGESVGEVIVVQDMHERKAEMARRSKAFIALPGGYGTMEELLEMITWCQLGIHDKPVGLLNVDGYYDPLLALFDKGEAEGFINSDCRQIFVSAPTASELLTKMEEVAPATSWEISELGYGRTPGADQS

SEQ ID NO: 15932 - DNA, 564 bp, Photorhabdus luminescens subsp
  CDS (1)..(564)
atgaaaagtattgctgtttattgtggttcaagtctgggtatatctgaaatctataaagaaaatgtcattatcttcgcaaaggaattggttaaacgtaatcttacgctcatttatggtggcgcaagtgtgggcattatgggaactgttgctaatacggttttggcagagggtgggaaagtcattggtgttattccaacattattggagtcgcgggaaatatcacataaaaatctgacagaattatacgttgttgaaactatgcatcagcgtaaaaacaaaatgattgagttagctgatggttttgttgctttgcctgggggttttggcacattggaagagttcagtgaggtatttacctggagtcagattgggttacatacgaaaccttgcggtattcttaatattaataacttttatgatccgttaattgcgatgattaataaaatggctgatgaacaattcttacatgaaaaatatcgtcatatggcaataattgagcaagatcctgctatcttactcgatcgttttaatacttatcggtcgccatctataaaaacatattaa

SEQ ID NO: 15933 - protein, 187 aa, Photorhabdus luminescens subsp
MKSIAVYCGSSLGISEIYKENVIIFAKELVKRNLTLIYGGASVGIMGTVANTVLAEGGKVIGVIPTLLESREISHKNLTELYVVETMHQRKNKMIELADGFVALPGGFGTLEEFSEVFTWSQIGLHTKPCGILNINNFYDPLIAMINKMADEQFLHEKYRHMAIIEQDPAILLDRFNTYRSPSIKTY

SEQ ID NO: 15934 - DNA, 639 bp, Chromobacterium violaceum
  CDS (1)..(639)
atgacccggggccggaagattccggcccttgtttttttgagagaaacggaaaagaaaatgaaatcgatttgcctgttttgcggttccaacaaaggcggcaagccggagtacgaggaagctgcccgggtattcggccgcaccttggccgagcaaggcatcaccctggtgtacggcgcgggcaaggtgggcctgatgggcttggccgccgacgccgcgctggaagccgggggcaaggtgatcggcgtgatcccggaattcctcaaggccaaggaagtggcgcacctgggcctgaccgagctgcacatcaccgaaaccatgcatcagcgcaaggccatgatggcgcagctgtccgacggcttcatcgccttgccgggcggtttcggcactttcgacgagctgttcgagatcctgacctgggcgcagctgtcggtgcacaacaagccggtgggcgtgctggatgccggcggattctatcagcccttgcgggcgctggtggaacacgcggtcagcgaaggcttcgtccccaagggcaatcaggacctgttccgcatcgagcgcgatctgccggcgctgttgagctggatgcggcaataccagcccagccacgtcgccaagtggctggatctggcgcgtacttga

SEQ ID NO: 15935 - protein, 212 aa, Chromobacterium violaceum
MTRGRKIPALVFLRETEKKMKSICLFCGSNKGGKPEYEEAARVFGRTLAEQGITLVYGAGKVGLMGLAADAALEAGGKVIGVIPEFLKAKEVAHLGLTELHITETMHQRKAMMAQLSDGFIALPGGFGTFDELFEILTWAQLSVHNKPVGVLDAGGFYQPLRALVEHAVSEGFVPKGNQDLFRIERDLPALLSWMRQYQPSHVAKWLDLART

SEQ ID NO: 15936 - DNA, 570 bp, Synechococcus sp
  CDS (1)..(570)
atgaaaggcttctggcacgggcaagcgatgcgacgcctcgcggtctactgcggatccagatctggccacgcgccggagcatggtcaggtcgccacggcattgggccgcgccatggcccgtcgcggtgtggggttggtgtatggcgccgcccagattggtctgatgggcacgatcgccgatgcagtgctggctgctgatggggaggtgatcggcgtgatccccgaagcgttgatggatgccgaggttgctcaccatcagctcacgcgcctggaggtcgttgccgacatgcatgtccgcaaggcgcgcatgatcgaattggcagatgccacggtcgcgctgccgggggggcttggaaccctggaggagttgtttgaagcactcacctggttgcagctgcgctttcacggcaaaccctgtgccttgctcaatgtgtccggctactacgaccatcttctccagttcctggatggagcggtggccgatggtttcgtggctgaggagcaccgcgggctgctgaaggtgcatcaggacccggagcggctcctggatgagctgttgcaacacccctga

SEQ ID NO: 15937 - protein, 189 aa, Synechococcus sp
MKGFWHGQAMRRLAVYCGSRSGHAPEHGQVATALGRAMARRGVGLVYGAAQIGLMGTIADAVLAADGEVIGVIPEALMDAEVAHHQLTRLEVVADMHVRKARMIELADATVALPGGLGTLEELFEALTWLQLRFHGKPCALLNVSGYYDHLLQFLDGAVADGFVAEEHRGLLKVHQDPERLLDELLQHP

SEQ ID NO: 15938 - DNA, 588 bp, Bordetella pertussis
  CDS (1)..(588)
atgaaaattcagaacatctgtgtgtactgcggctcgaacagcggccgccaacccgagtacatcgagcacgcgcaaggcttcgcacgcgagctggtcaagcgcggcctgggactggtgtacggcggcgccagcgtcggcatcatgggcgcggtggccgataccgtgatggccgaaggcggccgggtcatcggcatcattcccgaggcgctgatgaagaaggagctggcgcaccgcggcctgaccgaactgcatgtggtgcagtcgatgcacgagcgcaagacgctgatggcgcagaaggccgacggtttcgtcgccctgcccggcggcgcgggcacgctggaagagatcttcgaaatctggacctgggcgcaattgggcatgcaccagaagccatgcggcctgctcaatatcgccggctattacgacctgctgggtcagttcctgaatcacacggtggatgaagccttcatgcgcccgcaacatcgcgccatgctcgccatcgaccacgacccggcagccctgttggaccacttcgccagctacgtcgcgcccacggtttccaagtggatcgcgccgggcgaacactga

SEQ ID NO: 15939 - protein, 195 aa, Bordetella pertussis
MKIQNICVYCGSNSGRQPEYIEHAQGFARELVKRGLGLVYGGASVGIMGAVADTVMAEGGRVIGIIPEALMKKELAHRGLTELHVVQSMHERKTLMAQKADGFVALPGGAGTLEEIFEIWTWAQLGMHQKPCGLLNIAGYYDLLGQFLNHTVDEAFMRPQHRAMLAIDHDPAALLDHFASYVAPTVSKWIAPGEH

SEQ ID NO: 15940 - DNA, 630 bp, Bordetella pertussis
  CDS (1)..(630)
atgtcagagataaagaccgcggccgagaaattggccgacatcggtcccgcggtcagcatgttcggcagcgcccgcatcagccgcgaatcgccctattatgaaacctgtgcggcgatctcggcagccctggccggcgccggtttcgcgatcatcgcggggggcggccccggcatcatggaagcggccaacaagggcgccttcgaggccggcggcaccagcgtcggcctgaacatcagcctgccccacgaagcgcacaacaacgaataccagaccatcagcctgtcgttcgagtacttctactcccgcaaggccaccttcttcatgcacagcatggcctatgtcgccatgcccggcgggttcggcaccctggacgagctgttcgaggcgctgaccctgatccagaccggcaaggtcccgcccgcccccatcgtgctggtgggcagcgaattctggcacggcctggtcgactggctgggcgagcaattgctggccaacggcatgatcgcggcccacgacctgaatctcttcatcatcgaggacgaccccgccaaagtcgtgcgcaaggtggtcgaattccacgacaagcaaggcaggacggacagccagtacgcgccttccctcccggcataa

SEQ ID NO: 15941 - protein, 209 aa, Bordetella pertussis
MSEIKTAAEKLADIGPAVSMFGSARISRESPYYETCAAISAALAGAGFAIIAGGGPGIMEAANKGAFEAGGTSVGLNISLPHEAHNNEYQTISLSFEYFYSRKATFFMHSMAYVAMPGGFGTLDELFEALTLIQTGKVPPAPIVLVGSEFWHGLVDWLGEQLLANGMIAAHDLNLFIIEDDPAKVVRKVVEFHDKQGRTDSQYAPSLPA

SEQ ID NO: 15942 - DNA, 765 bp, uncultured Acidobacteria bacterium
  CDS (1)..(765)
atggccgattcaaacgaacctgaagagcaccggcccggcacaacccaggacgagcaattgctcgagagccctcgcgccgacgagttcacccatacagacacgtggcgagtgtttagaatcatgggtgagtttgtcgctggcttcgacgacctggcgacactcagtcgcggcgtttccattttcggctcggcacgaaccagtagagacgatccttattacaaggaagcgcaggaaacagctgcgctcctgagccaggccggcttcgcggtgatcactgggggtgggccgggaataatggaggctgccaatcgcggggctcttgaagcaggtggacagtcgatagggtgcaacatcgaattgccgtttgagcaaaagtcaaacgactatctgacgctcgggttaaagttcaaatacttcttcgtacgcaagatgatgtttgttaagtacagcctgggattcataatttttccaggaggcttcggcacgcttgatgagcttttcgaagcgctgaccctgattcagaccggcaagatccgtaattttcccgttgtgctttacggctcggactattggaaagggatgctcgactggattcgtgattgggcaatgaaggaaggtaaagtaaccgaagccgatctgaaactgctgcatctgactgattcgcctgcagaagtagttaagatcatttccgacagccaaagttctttgcgagaccttgagaacgatctgatctcgacccagccttctgctgcgaatgaccgctag

SEQ ID NO: 15943 - protein, 254 aa, uncultured Acidobacteria bacterium
MADSNEPEEHRPGTTQDEQLLESPRADEFTHTDTWRVFRIMGEFVAGFDDLATLSRGVSIFGSARTSRDDPYYKEAQETAALLSQAGFAVITGGGPGIMEAANRGALEAGGQSIGCNIELPFEQKSNDYLTLGLKFKYFFVRKMMFVKYSLGFIIFPGGFGTLDELFEALTLIQTGKIRNFPVVLYGSDYWKGMLDWIRDWAMKEGKVTEADLKLLHLTDSPAEVVKIISDSQSSLRDLENDLISTQPSAANDR

SEQ ID NO: 15944 - DNA, 696 bp, Oryza sativa
  CDS (1)..(696)
atggctctactccagtctcggttcaggaggatatgcgtcttctgcgggagcagccagggcaagaagaagagctaccaggacgcagccgttgagcttggcaaggagctggtagcaaggaacattgatctagtgtatggtggaggaagtgtggggctcatgggcctggtctctcaagctgtctacaatggagggaggcatgttattggggtgattcccaagactcttatgcctagagagattacgggtgagacagtaggggaggtgaaagcagtggcagatatgcatcagaggaaggctgagatggccaggcaatctgatgcgttcatagcactgcctggtgggtatggaacacttgaagagctcctggaagtaattgcctgggctcagctcggcattcacgacaagccggttggcctgctaaatgtggacggctactacaactctctgctgtcgttcatcgataaagctgtggaggaagagttcatcagcccctctgcgcgccatatcatcgtgttagctccaacaccaaaagaacttctcgagaagctagaggcgtactcccctcggcatgacaaggtcgtgccgaagatgcagtgggagatggagaagatgagctactgcaagagctgcgagatccctggcctgaaagaaggcaacaaggcgaccatccaagcacagcgaggaagcatgctctga

SEQ ID NO: 15945 - protein, 231 aa, Oryza sativa
MALLQSRFRRICVFCGSSQGKKKSYQDAAVELGKELVARNIDLVYGGGSVGLMGLVSQAVYNGGRHVIGVIPKTLMPREITGETVGEVKAVADMHQRKAEMARQSDAFIALPGGYGTLEELLEVIAWAQLGIHDKPVGLLNVDGYYNSLLSFIDKAVEEEFISPSARHIIVLAPTPKELLEKLEAYSPRHDKVVPKMQWEMEKMSYCKSCEIPGLKEGNKATIQAQRGSML

SEQ ID NO: 15946 - DNA, 579 bp, Bacillus cereus
  CDS (1)..(579)
atgagaaagatttgtgtgtttgcaggttctaatttaggggagagaccagaattcaaagagcaggcaattcagttaggtaaaatgtttgttgagaacgagtatgagcttgtatacggtggttcatgtgttggattaatgggagaagtagcaaacgaagttcttcgtttaggtggacgtgtaacaggtgttatgccgcgcggtctattccgaggagaaattgtgcatacaggattaacagaattaattgaagtagagacgatgcatgaacgtaaagcgaaaatggcagagcttgcggatgcttttattgcgcttccaggcggatacggaacgtttgaagaactatttgaagttgtatgttggtcacaaattggtatacataataagccggttggtttattaaacataaaaggtttttacggaccaattttgcaaatggttgaacgtgcagcagaagaaggatttatgaattcatcaaataaagaattgatcgtttcagctgagacagcagataaactaattcatgcaatccaaaattatgagcgtcctgttttgggaacgaagtggaagcaactatcatag

SEQ ID NO: 15947 - protein, 192 aa, Bacillus cereus
MRKICVFAGSNLGERPEFKEQAIQLGKMFVENEYELVYGGSCVGLMGEVANEVLRLGGRVTGVMPRGLFRGEIVHTGLTELIEVETMHERKAKMAELADAFIALPGGYGTFEELFEVVCWSQIGIHNKPVGLLNIKGFYGPILQMVERAAEEGFMNSSNKELIVSAETADKLIHAIQNYERPVLGTKWKQLS

SEQ ID NO: 15948 - DNA, 540 bp, Streptomyces avermitilis
  CDS (1)..(540)
atgaaaatctgcgtcttcctctccgccgccgacctcgacgaccgctacacgcgccccgcgcgggagttcgcggaactgctcggcaagggcgggcacacactggtgtggggcggctccgacgtcggtctcatgaaggtggtcgccgacggtgtgcaggaggcgggcggccggctcctcggggtctccgtggacttcctcgccgccaaggcccgcgcaggcgccgacgagatggtcatcgcccgtgacctcgcggagcgcaaggcgctgctcctggaacgggccgacgccgttgtgatcatggtcggcgggaccgggacgctggacgaggcgacggagatcctggagctgaagaagcacggtcacaccgacaagcccgtggtgctgctgaacaccgcgggcttctacgacggcctgaaggagcagttccggcgcatggaggacgaggggttcctgccctgccccctcacggacctggtgttcttcgccgaggagccggtgggcgcgctggcctacctcgaggagtcgttcggcaccgtctga

SEQ ID NO: 15949 - protein, 179 aa, Streptomyces avermitilis
MKICVFLSAADLDDRYTRPAREFAELLGKGGHTLVWGGSDVGLMKVVADGVQEAGGRLLGVSVDFLAAKARAGADEMVIARDLAERKALLLERADAVVIMVGGTGTLDEATEILELKKHGHTDKPVVLLNTAGFYDGLKEQFRRMEDEGFLPCPLTDLVFFAEEPVGALAYLEESFGTV

SEQ ID NO: 15950 - DNA, 576 bp, Enterococcus faecalis V583
  CDS (1)..(576)
atgtttgtgaaaaaaatggcagtatattgtggcgccagtctggggaatgagccaatctatcagcaagctgcagtagcgttagccgcttggatgaaagaaaatcactatgatctagtttatggcggtggcaatgttggtctaatgggtacggtggctgacacgcttttagcagaaggtggagaggtaattggtgtcatgcccacttttttaatggaacgagagattgcacataatggcattacaaagatgcatacagtcagtgatatgcatgcgcgtaagaaaaagatgattgaattggcagatgtgtatttagctttacccggtggtcccggcacgctagaagaaattagcgaggtgatctcttggggccgagtcggtgaacatatgaatccttgtattttatacaacgtgaatggttactatgatttactagctgctttttttgataaaatggtagaaactaatttcttaacagaagcggatcgagctaaaattttcatttcagattccttagaagaaattggtgcatttattgattcctatgaaccgccaatgattcgtcaatacaaaaaataa

SEQ ID NO: 15951 - protein, 191 aa, Enterococcus faecalis V583
MFVKKMAVYCGASLGNEPIYQQAAVALAAWMKENHYDLVYGGGNVGLMGTVADTLLAEGGEVIGVMPTFLMEREIAHNGITKMHTVSDMHARKKKMIELADVYLALPGGPGTLEEISEVISWGRVGEHMNPCILYNVNGYYDLLAAFFDKMVETNFLTEADRAKIFISDSLEEIGAFIDSYEPPMIRQYKK

SEQ ID NO: 15952 - DNA, 1191 bp, Oryza sativa
  CDS (149)..(889)
gattcagaaaaaaacactattagtaagtgggaaactagaggccgaccggaggtttctttctatcgttgggagcctctctgccttccgacctccatcgaattgggtgcagaccagcagcagccaataattaaggtcgtcggccgtatatatgatgatggagaatagcagggagcagcagccggagtcgtcgccggcgaacaacaatagcaagaagaagaagaagaagaagacggcgtcgcggttccggcgtgtgtgcgtgttctgcggcagcagccccgggaagaaggcgtcgtaccaggtggccgccgtgcagctggggcagcagctggtggagcgcggcatcgacctggtgtacggcggcggcagcgttgggctgatggggctggtgtcccgcgccgtccacggaggcggcgggcacgtggtgggcgtggtgcccaatggcgtgctgccacgcgagctgatcggcgagacgctgggggaggtgagggcggtgggaagcatgcaccagcggaaggcggagatggcgcgggagtcggacgccttcatcgccctccccggcggctacggcacgctggaggagctcctcgaggtcatcacctgggctcagctccgcatccaccacaagcccgtcggcctcctcaacgtcgacggctactacgactccctgctcgccttcatcgacaaggccgtccacgaaggcttcgtctcgccgcccgcccgccgcatcatcgtcgccgcacccaccgcctccgacctgctctgcaagctcgaggaatacgtgccgccgccgcacgacgccaccgccctgaagctcacctgggagatgtccaccgtatcggagcagcacgccggaagcatctactcccccaagcccgacatggcacgctagctagctagctagctactcgatccacttcattattacttatcttgtttcttctcatataatcttgctgctaattatttcttccatatattaattccctatatatatgtatatatactcgatcgtactatattgtatacatcatcaattacttgtaacttcaattaatcctagctacatcgaagaggcaggcggccctagttagttttcctgtactagaagctagttaattttcctctatggagtgttattatgagttgattgagttgggagtattaatttgttctctcatcatttactagtac

SEQ ID NO: 15953 - protein, 246 aa, Oryza sativa
MMMENSREQQPESSPANNNSKKKKKKKTASRFRRVCVFCGSSPGKKASYQVAAVQLGQQLVERGIDLVYGGGSVGLMGLVSRAVHGGGGHVVGVVPNGVLPRELIGETLGEVRAVGSMHQRKAEMARESDAFIALPGGYGTLEELLEVITWAQLRIHHKPVGLLNVDGYYDSLLAFIDKAVHEGFVSPPARRIIVAAPTASDLLCKLEEYVPPPHDATALKLTWEMSTVSEQHAGSIYSPKPDMAR

SEQ ID NO: 15954 - DNA, 651 bp, Arabidopsis thaliana
  CDS (1)..(651)
atggaagataatcagcgaagcagattcagaaaaatctgtgtcttttgcggaagccactctggtcacagagaagttttcagtgatgctgccatcgaactcggcaatgaactcgtgaagaggaagatagatttggtttatggaggaggaagtgttggattgatgggtttgatatccaggagagtctatgaaggtggtttacatgtacttggaatcattcccaaagctttgatgccaattgagatatctggtgagactgtgggagatgtaagagttgttgcagacatgcatgagcgaaaggctgcaatggcacaggaagctgaggccttcattgcactccctggaggttatggaacaatggaggagctgttggagatgataacatggtcacaacttggtatccataagaagacggttggtctattgaatgttgatgggtactataacaatttgcttgctttatttgataccggtgtcgaagaaggttttatcaagccaggtgcacgtaacattgtggtttctgctccaacagccaaagagcttatggagaagatggaggaatatactccttcacacatgcatgttgcatcgcacgaaagctggaaagttgaagaactcggagattacccgggacaagaaaacaagccgcaataa

SEQ ID NO: 15955 - protein, 216 aa, Arabidopsis thaliana
MEDNQRSRFRKICVFCGSHSGHREVFSDAAIELGNELVKRKIDLVYGGGSVGLMGLISRRVYEGGLHVLGIIPKALMPIEISGETVGDVRVVADMHERKAAMAQEAEAFIALPGGYGTMEELLEMITWSQLGIHKKTVGLLNVDGYYNNLLALFDTGVEEGFIKPGARNIVVSAPTAKELMEKMEEYTPSHMHVASHESWKVEELGDYPGQENKPQ

SEQ ID NO: 15956 - DNA, 693 bp, Oryza sativa
  CDS (1)..(693)
atggatgctaaccacgacaaggttgtggagagcggcagccgcgggggccggggaccggtgcggacgatctgcgtcttctgcggcagcaggcggggaaaccggccgtccttcagcgctgccgctctcgacctcggaaagcagctggtcgagagggagctcgatctggtctacggcggcggcagcggcggcctgatgggcctcgtctccaagaccgtccacgacggcggccgccacgtcctcggggtcatccctagtgctctcctacctgaagaggtgtcaggggagacgttgggagaggcgaaagtggtcagggacatgcatgagcgcaagtcagaaatggcgaaacacgccgacgctttcatcgccctgccaggtggttacgggacaatcgaagaactgttggagatcatagcgtgggcgcagctggggatccacaacaaaccggtggggctgctcaatgtggacggctactacaacaacttactctcgctgttcgacaagggcgtcgaggaagggttcatcgacgccgcggcgcggaacatcttcgtcctcgccgacaacgccggcgaactactgaccaagctgacggaggcggcggcagcggcagcggcggcggttgagggcggcgacggggatcaggtcgacggcgaggccacggccgcggcggctggcttgaagaggaaaagaagctag

SEQ ID NO: 15957 - protein, 230 aa, Oryza sativa
MDANHDKVVESGSRGGRGPVRTICVFCGSRRGNRPSFSAAALDLGKQLVERELDLVYGGGSGGLMGLVSKTVHDGGRHVLGVIPSALLPEEVSGETLGEAKVVRDMHERKSEMAKHADAFIALPGGYGTIEELLEIIAWAQLGIHNKPVGLLNVDGYYNNLLSLFDKGVEEGFIDAAARNIFVLADNAGELLTKLTEAAAAAAAAVEGGDGDQVDGEATAAAAGLKRKRS

SEQ ID NO: 15958 - DNA, 729 bp, Neurospora crassa
  CDS (1)..(729)
atgtcgaccaacggtgttacctccagccccaagcggaccaagatctgcgtctactgcggcgcatccgccggcaacaaccccatctacctcgaagccgcgcgccagctcgcccgtagcatggccgccaacaacattgacctcgtctacggtggtggcacagtcggtctcatgggcgaaatcgccaagacccttgtttccctgtccggccctgactccgtccacggcatcatccccgaggctctggtccggtacgagcgcgaccctcactacacgtccacccaggtgagcggcggccagaaggattccgctgccgacgaggaggcaaaggccaagaagcttcccgtccctgatgagaacgtctttggccgaacgaccatcgtcaaggacatgcacacgcgcaagatgatgatggcgcaggaggtgttagcgggcggccccggatcgggcttcatcgccctgagtggcggctacggcaccatggaggagctgttcgagacggtgacgtggaaccagctgggcatccacgacaagggcatcgtcctgctcaacatcaacggcttttatgacggtattctgcactggatccagaacagcatccaagagggatttgtgaaccaggcgaatggaaagatcatggtggaggcgaagaacccggaggatgcaatcaaggcgctgagggagtataaggtgtccgaggcggttttcaagctgaactggagtgatgagtag

SEQ ID NO: 15959 - protein, 242 aa, Neurospora crassa
MSTNGVTSSPKRTKICVYCGASAGNNPIYLEAARQLARSMAANNIDLVYGGGTVGLMGEIAKTLVSLSGPDSVHGIIPEALVRYERDPHYTSTQVSGGQKDSAADEEAKAKKLPVPDENVFGRTTIVKDMHTRKMMMAQEVLAGGPGSGFIALSGGYGTMEELFETVTWNQLGIHDKGIVLLNINGFYDGILHWIQNSIQEGFVNQANGKIMVEAKNPEDAIKALREYKVSEAVFKLNWSDE

SEQ ID NO: 15960 - DNA, 588 bp, Pseudomonas putida
  CDS (1)..(588)
atgcccgtacgttccgtttgtgtgttctgcggcgccagcatgggcgccaaccctgcctaccgtgaagcagccgtcgcgctgggccaggccattgcccgccgcggcttgaccctggtgtatggcggtggcgcggtcggcttgatgggtgtggtggccgacgcggccatggcggccggtggcgaagtggtcgggatcatcccgcagagcctgctggacgctgaagtcggccacaagggcctgacccgcctggaagtggtggatggcatgcatgcgcgcaaggcccgcatggccgagctgagcgatgcattcattgccttgccgggtgggctgggtacgctggaggaactgttcgaagtgtggacctgggggcagctgggctatcacgccaagccgctcgggctactggatgtgaacggtttctacgacaagctgggcgggttcctcgaccatatcgtcgaagaaggtttcgtgcgcccgcaacaccgggcgatgttgctgctggggcagcagccggacgagctgctggaagggatggacagctttgtggcgccggtcgcgcctaagtgggtcgacaagcagcctgactga

SEQ ID NO: 15961 - protein, 195 aa, Pseudomonas putida
MPVRSVCVFCGASMGANPAYREAAVALGQAIARRGLTLVYGGGAVGLMGVVADAAMAAGGEVVGIIPQSLLDAEVGHKGLTRLEVVDGMHARKARMAELSDAFIALPGGLGTLEELFEVWTWGQLGYHAKPLGLLDVNGFYDKLGGFLDHIVEEGFVRPQHRAMLLLGQQPDELLEGMDSFVAPVAPKWVDKQPD

SEQ ID NO: 15962 - DNA, 576 bp, Lactobacillus plantarum WCFS1
  CDS (1)..(576)
atggcaattcataatatctgtgttttttgtgggtctaattctggtttagatcccgcatttagtgagaaaacggtggcactcggtcaatacttggccgctaatgattaccaactcgtctatggcggtggcgaccatggtttaatggggaaagtcgccaaagcaactatggatgctggtggccgcgttatcgggatcatcccgcattttctggtcgcaagagaacttgcatttaaggacgtcacgacttttatcgaaacgcgcacgatgaccgaacgcaaggaaaagatgcttcacctcgctgacgcctttatcgttttacctggcgggtttggcacctttgaagaattcttacaaatgttatcttggagtcaaatggatattcaccaaaagccgattgcgctctacaacatcgacggcttctacgacgatctagtcgccatgctacaaaagaccgccgacttagggtttgcccccgaggctaacctcgacctattcattaatgggcatgatcttgatgaaattttcgctggtttccatgatttcaaacatgtattaccgcctaagtatacgaactaa

SEQ ID NO: 15963 - protein, 191 aa, Lactobacillus plantarum WCFS1
MAIHNICVFCGSNSGLDPAFSEKTVALGQYLAANDYQLVYGGGDHGLMGKVAKATMDAGGRVIGIIPHFLVARELAFKDVTTFIETRTMTERKEKMLHLADAFIVLPGGFGTFEEFLQMLSWSQMDIHQKPIALYNIDGFYDDLVAMLQKTADLGFAPEANLDLFINGHDLDEIFAGFHDFKHVLPPKYTN

SEQ ID NO: 15964 - DNA, 615 bp, Bradyrhizobium japonicum USDA 110
  CDS (1)..(615)
atggcaccaatgagcacgatcaaaaccgtctgtgtctattgcggctccggccccggaaccaatccccgcttcaccgaaggcgccaaggcgttcggcaaggcgctcgccgagaacaacatccgcctggtctatggcggcggctcgctcggcctgatgggctcggtcgcaacctccgtcctcgataatggcggcaccgtcaccggcatcattcccgaattcctccggatgcgcgagaacgcgctgacgcgggtgcaggagatgatcgtcacccccgacatgcatgagcgcaagcggctgatgttcgagcgctccgacgccttcgtggcgctgccgggcggcgtcggcacgctggaggagctggtcgagcagttgacctggaagcaactcggccgtcacgccaagcccgtgctgctcgccaatatcgacaatttctgggagccgctgttctcgctgctgtcgcacatgcgccagaccgagttcatccgtgccggcctctcggtcgacatcctcaaggccgatcgggtcgaggagatcctgccgaagctgaaggccgccgtggcacagctcgccgaggcggaaaaagagctcgctccggaagtcgcgcgcaagctgtaa

SEQ ID NO: 15965 - protein, 204 aa, Bradyrhizobium japonicum USDA 110
MAPMSTIKTVCVYCGSGPGTNPRFTEGAKAFGKALAENNIRLVYGGGSLGLMGSVATSVLDNGGTVTGIIPEFLRMRENALTRVQEMIVTPDMHERKRLMFERSDAFVALPGGVGTLEELVEQLTWKQLGRHAKPVLLANIDNFWEPLFSLLSHMRQTEFIRAGLSVDILKADRVEEILPKLKAAVAQLAEAEKELAPEVARKL

SEQ ID NO: 15966 - DNA, 486 bp, Bacteroides thetaiotaomicron VPI
  CDS (1)..(486)
atgtactttgacagtgcccgtcaaatcggagaatggatgggaaaagcaggcaaaacgttgatttatggaggagccaatctcggactgatggaatgcgtagcccgcgccgtgaaagagaatggcggtacggtcatcggagtagttcctgccaaactggaagaaaaaggtagtgtgagcacattactggacgaggtgattcatacccgtaacctgagcgaccggaaagatgtgataacagagaagtcggagatattggtcgcattgcctggtggtgtaggtacactcgacgagattttccacgtcatagccgccgcctctatcggatatcatcagaaaaaggtgatcttctataacgaatacggtttttataatgaacttctggctgcacttaagacgttagaggataagggcttcgcccgacaatctttctctacctattatgaaacagcaaacaatctggatgaattaaaagaaaaaataaactga

SEQ ID NO: 15967 - protein, 161 aa, Bacteroides thetaiotaomicron VPI
MYFDSARQIGEWMGKAGKTLIYGGANLGLMECVARAVKENGGTVIGVVPAKLEEKGSVSTLLDEVIHTRNLSDRKDVITEKSEILVALPGGVGTLDEIFHVIAAASIGYHQKKVIFYNEYGFYNELLAALKTLEDKGFARQSFSTYYETANNLDELKEKIN

SEQ ID NO: 15968 - DNA, 588 bp, Bacteroides thetaiotaomicron
  CDS (1)..(588)
atgaatcagatacattccgtatgcgtatacagcgcatccagcactaagatagcccccgtatattttgaagcagccgaaaaactcggccgcctgcttgccaaacaacatatccgtctgataaacggtgccggaagcatcggactgatgcgctccgtagccgacgcagttctgaagaatggcggtgaggtgacaggtgttatcccccacttcatggtcgaacagaactggcatcacacagggttgacggaattgatcgaagtcacttccatgcacgaacgcaagcagaagatggcgaatctgagcgacggcatcattgccttgccgggcggatgcggcactctggaagaattgcttgaaatcatcacatggaaacagctcggactgtatctgaatccgattatcattctgaatataaacggcttttttgatccgctgttccaaatgctcgaacgggcaatagaggaaaacttcatgcgccagcaacacggtgatatatggaaagtggcacaaacaccggaagaagcggtggagttacttcagacaactcccgtatgggacgcttctatccgtaaatttgcagccatatga

SEQ ID NO: 15969 - protein, 195 aa, Bacteroides thetaiotaomicron
MNQIHSVCVYSASSTKIAPVYFEAAEKLGRLLAKQHIRLINGAGSIGLMRSVADAVLKNGGEVTGVIPHFMVEQNWHHTGLTELIEVTSMHERKQKMANLSDGIIALPGGCGTLEELLEIITWKQLGLYLNPIIILNINGFFDPLFQMLERAIEENFMRQQHGDIWKVAQTPEEAVELLQTTPVWDASIRKFAAI

SEQ ID NO: 15970 - DNA, 567 bp, Staphylococcus epidermidis ATCC 12228
  CDS (1)..(567)
atgaaaagaattgctgtttattgtggtgcaagtaaagggaaaaacccatcttatgttaaagaggcatacgaattaggaaaatatatggctgaacaaggatacgagcttgtattcggagcaggatcagtcggcattatgggagctattcaagatggcatacttgagcatggcggtaaagctatcggtgtcatgcctaaaatgttagatgaacgagaaataacaagccaaaaagtaagtgagcttatattagtagattctatgcatgaacgaaaaaataaaatgactgaacttgccgatgcttttattatggctccaggcggtgctggttcattagaagaattttttgaaatgtatagttgggctcaaattggtatacaccaaaagcctataggtgtatttaatttaaatggattctttgagccactacaacacttaatcgaccatatgattaaagaaggatttattgatgagaaatatcaaaagcttgcacctttatatgatactaaagaatcactcatcgaaggacttaaacattacaaaccacttggtgtacgtacatacgattaa

SEQ ID NO: 15971 - protein, 188 aa, Staphylococcus epidermidis ATCC 12228
MKRIAVYCGASKGKNPSYVKEAYELGKYMAEQGYELVFGAGSVGIMGAIQDGILEHGGKAIGVMPKMLDEREITSQKVSELILVDSMHERKNKMTELADAFIMAPGGAGSLEEFFEMYSWAQIGIHQKPIGVFNLNGFFEPLQHLIDHMIKEGFIDEKYQKLAPLYDTKESLIEGLKHYKPLGVRTYD

SEQ ID NO: 15972 - DNA, 561 bp, Streptococcus agalactiae
  CDS (1)..(561)
atgagaataactattttttgtggagcaagtactggggaaaatcctgtttatagtgaaaaaacagttgccttagcacaatggatggcacaaaacaaacattctctggtgtatggtggaggaaaagttggcttaatgggagtcatggctgatactgtgattgcaaatggtggctacactactggtgttattccgacatttttaagagatcgtgaaattgcacatgaaaatttatcagagcttatcatagtaaataatatgcctgaacgtaaggcaaaaatgatgctacttggagatgcctttatcgctctacctggtggacctggtacccttgaagaaatttccgaagttatctcttggtctcgcatcggtcaaaatgataatccttgcattttatataatgttaatggctactttaatgatttaaaaaatatgtttgatcatatggttggtgagggttttcttagtctggaagatagagaaaatgtcctattctcagatgatattactgaaatcgaagattttataacgaattataaagtccctagcacgcgccaatactag

SEQ ID NO: 15973 - protein, 186 aa, Streptococcus agalactiae
MRITIFCGASTGENPVYSEKTVALAQWMAQNKHSLVYGGGKVGLMGVMADTVIANGGYTTGVIPTFLRDREIAHENLSELIIVNNMPERKAKMMLLGDAFIALPGGPGTLEEISEVISWSRIGQNDNPCILYNVNGYFNDLKNMFDHMVGEGFLSLEDRENVLFSDDITEIEDFITNYKVPSTRQY

SEQ ID NO: 15974 - DNA, 567 bp, Streptococcus agalactiae
  CDS (1)..(567)
atgaaaataactgtcttttgcggtgcaagcaacgggaataacccaatctacagtcagaaaatagtagaacttggtgaatggatgattaaaaataatcatgatttagtttatggtggcggaaaagttggcttaatgggagtaattgctgatactgttattaataatggtggccaagcaattggcgttatacctacatttttaaaagatagagagatcgcccacactaatttatcaaagcttattgttgtcgaaaatatgccacaacgaaaagggaaaatgatgtctcttggagaagcatatattgcattacctggtggaccaggaactttagaggaaatttcagaggtaatctcttggtctcgaattggtcaaaatgatagtccatgcattctttataatatcaatggttatttcaatcacctagaaagtatgtttgatcatatggtctctgaaggcttcctgagtcaaaatgatagaaataacgtactattctcagacgatatcattgaaattgaaaagtttattaaagattatcaatcacctacaattcgtaagtatagcaattaa

SEQ ID NO: 15975 - protein, 188 aa, Streptococcus agalactiae
MKITVFCGASNGNNPIYSQKIVELGEWMIKNNHDLVYGGGKVGLMGVIADTVINNGGQAIGVIPTFLKDREIAHTNLSKLIVVENMPQRKGKMMSLGEAYIALPGGPGTLEEISEVISWSRIGQNDSPCILYNINGYFNHLESMFDHMVSEGFLSQNDRNNVLFSDDIIEIEKFIKDYQSPTIRKYSN

SEQ ID NO: 15976 - DNA, 570 bp, Oceanobacillus iheyensis
  CDS (1)..(570)
atgaatttaaataatattgctatcttttgtgggtcaagtaatggaaccaatgagcggtatttaaaagcagccaatgacatgggaaaatacttggcagcaacgaatcgaaaactaatttatggcggtgcaaaagtaggatgcatgggggaattagcgaatgcgtctcttagtcatcacggatacgtcattggcgtgattcctcaaaaacttgttgatgttgaaattgctcatgaggatataactgaattacatactgttgctgatatgcatgaacgaaaagcaaaaatggcagaactcgcagatggttttattgcattacccggaggagccggaactctcgaggaatggtttgaagtctttacttggctacaattaggctaccacaaaaagccttgtggatttctaaatgtaaatgggttttatgatcctttaataagcatgttgaaaaacacggtcaaagaaggatttatgaaagaatcatacttagaattaattattagcgaccaagaccctaaaactttaattgaaaaaatggaagcttttgaaatgagttctacttcaaaatggtag

SEQ ID NO: 15977 - protein, 189 aa, Oceanobacillus iheyensis
MNLNNIAIFCGSSNGTNERYLKAANDMGKYLAATNRKLIYGGAKVGCMGELANASLSHHGYVIGVIPQKLVDVEIAHEDITELHTVADMHERKAKMAELADGFIALPGGAGTLEEWFEVFTWLQLGYHKKPCGFLNVNGFYDPLISMLKNTVKEGFMKESYLELIISDQDPKTLIEKMEAFEMSSTSKW

SEQ ID NO: 15978 - DNA, 558 bp, Leptospira interrogans
  CDS (1)..(558)
atggatttaaccaaattggcggtttgtgttttttgtggttcgcgttccgggaacaatccggtttatgtggaagcggctcggaatttgggtcgattgctcgttgaaaaaaatttagatttggtttttggaggggcttcgtgcggtatcatgggaacgattgctgatgctgtaatggacaaaggaggaggtgtatctggaatcattccggattttctttctatcaaagaagttaaacacgatcgtgttaaggatttgatgatcgtttcttccatgcatgaaagaaaatttagaatgtatgaaaggtcctcaggttttatcgccttgcctggtggaattggaactttggacgagctcgtagaaatcactacttggaatcaactcaaacttatttcaaaacctttgggtttactcaatgtaaacggttattttgaatatttgcttaaacaattaggtagaatggtggacgatggttttttagattcggaaactaaagaaggtctaatcgtttcggaagatccggaagaattactcgacttattgagtagacgttttgtttaa

SEQ ID NO: 15979 - protein, 185 aa, Leptospira interrogans
MDLTKLAVCVFCGSRSGNNPVYVEAARNLGRLLVEKNLDLVFGGASCGIMGTIADAVMDKGGGVSGIIPDFLSIKEVKHDRVKDLMIVSSMHERKFRMYERSSGFIALPGGIGTLDELVEITTWNQLKLISKPLGLLNVNGYFEYLLKQLGRMVDDGFLDSETKEGLIVSEDPEELLDLLSRRFV

SEQ ID NO: 15980 - DNA, 636 bp, Oryza sativa
  CDS (1)..(636)
atgaggcagcagcagcagcagcagcaggagagcaggttcaagaggacctgcgtgttctgcggcagtagccagggcaacaagaccacctaccgcgatgccgccgtcgacctcgccaaagagctggtcgcgaggggcattgaccttgtgtacggcggcggcagcattggcctcatgggcctcgtctcccaggccgtctacgacggtggcagacatgtcattggggtcatccccaagactctcatgacccccgagataatcggagagacagtaggggaggtgaggccagtgtccgacatgcaccagaggaaggctgagatggcgaggcagtctgatgcattcatagccctgcccggaggatacggaacactggaagagctgcttgaagtcatcacatgggcgcaattaggcatccatcataaaccggttgggctgctgaacgttgatgggtactacaactccctgctcacattcatcgaccaagccgtggaagaaggcttcatcagccccagtgctcgccgcatcatcgtgtcggctccaacggcacaagaactcatggacaagcttgaggaatacgtcccttaccatgatagggttgcgtctgggctgaactgggagactggtcatctagggttctaa

SEQ ID NO: 15981 - protein, 211 aa, Oryza sativa
MRQQQQQQQESRFKRTCVFCGSSQGNKTTYRDAAVDLAKELVARGIDLVYGGGSIGLMGLVSQAVYDGGRHVIGVIPKTLMTPEIIGETVGEVRPVSDMHQRKAEMARQSDAFIALPGGYGTLEELLEVITWAQLGIHHKPVGLLNVDGYYNSLLTFIDQAVEEGFISPSARRIIVSAPTAQELMDKLEEYVPYHDRVASGLNWETGHLGF

SEQ ID NO: 15982 - DNA, 645 bp, Chlorobium tepidum
  CDS (1)..(645)
atggccgatggctggcgcgtattcaagatcatggcggagtttgtcaacggcttcgagaccatgtcgcgcatcggcccggcggtcacggtgttcggctcgacgcgggtcaaagagggagacgccgagtaccagcttggcgaaacgatgggcaagctgctcgccgaaaccggattcgccgttatcaccggcggcggccccggcgcaatggaggcggccaacaaaggggcgcagagcaaaggcggcgcgtcggtcggcttcaacatcaaactgcccaaccagcagcgcccgaaccgctacatcgattacgacaaactcgtcaccttcgagtactttttcatccgcaaggtgatgttcctcaaatactcgcaggcattcatcgtgctgccgggcggctttggcacgctcgacgagctgtccgaagcgatcactctcatccagaccggcaagagccagaaatttccggtgatcatgatggtggctgactactggggcgacttctacggctggatcaaaaaacggatgctcgacgagcacggcttcatcagagagtcagacctcgacttcatcttcatcgaggacgatcctgccaaggttatcgaaatcatcctcagcttctatcccgaagggtacaggatcaatttttag

SEQ ID NO: 15983 - protein, 214 aa, Chlorobium tepidum
MADGWRVFKIMAEFVNGFETMSRIGPAVTVFGSTRVKEGDAEYQLGETMGKLLAETGFAVITGGGPGAMEAANKGAQSKGGASVGFNIKLPNQQRPNRYIDYDKLVTFEYFFIRKVMFLKYSQAFIVLPGGFGTLDELSEAITLIQTGKSQKFPVIMMVADYWGDFYGWIKKRMLDEHGFIRESDLDFIFIEDDPAKVIEIILSFYPEGYRINF

SEQ ID NO: 15984 - DNA, 555 bp, Chlorobium tepidum
  CDS (1)..(555)
atgatccgctcagtcaccgtctattgcagctccagcaaccttgctccggaaccctatttcagcgaagccgaatcgcttggccgcggccttgccgaacgcggaattgatctggtcttcggtggtgggcacgtcgggctgatgggacgcaccgccgacgcagctctgaaggctggcggcacggtgaagggcatcatcccgcgcttcctcgaagagcgcgaggtagctcaccccggactgaccgagctgcacgtggttgaaaccatgcaccagcgcaaaatgctgctcaccgactgggcggacgccttcgtgattttgccgggcggactcggcacactcgatgagttgatggaaatcctcacctggaagcacctcggccagcaccgaaaaccgatcatcctgctcaacacggagggcttttggaatcagctcctacagttcttcgaacgcatcgccgccgaaaagatggtcaagcctggttacgaaagctactacgacatctgcaactccgccagcgacgtgcttgcgatgatcgaccgccaaaacaccagcgtctga

SEQ ID NO: 15985 - protein, 184 aa, Chlorobium tepidum
MIRSVTVYCSSSNLAPEPYFSEAESLGRGLAERGIDLVFGGGHVGLMGRTADAALKAGGTVKGIIPRFLEEREVAHPGLTELHVVETMHQRKMLLTDWADAFVILPGGLGTLDELMEILTWKHLGQHRKPIILLNTEGFWNQLLQFFERIAAEKMVKPGYESYYDICNSASDVLAMIDRQNTSV

SEQ ID NO: 15986 - DNA, 983 bp, Arabidopsis thaliana
  CDS (126)..(812)
atcacaaagtgaaacaagaatgagttagcttgaaccacacgttcaccttccgagaaagaaacctactttctcccaaatccacaaaagagagaaaaaaaagaaagtaaactgatttggctaagaaaatggaaatagtgaagtcgaggttcaagagggtttgtgtgttctgtggtagcagcagcggaaagagagagtgctacagtgatgccgccactgatctagctcaagagctggtgacgaggagattgaatcttgtgtatggaggaggaagcattggtctcatgggtttggtctcacaagctgttcatgaagctggaggacatgtactagggatcataccaaggactcttatggacaaagagataaccggagaaacatatggtgaggtaatagctgtggcggatatgcatgaaagaaaagccgaaatggcacgccactcggattgtttcattgctttaccaggtgggtatggaacactggaggagttattggaagtaatagcatgggcacaacttggaatccacgacaagcctgtgggtttgttaaatgtggatggttattacaattacctcctcactttcattgataaagccgttgatgatggctttatcaagccatctcagcgtcacatctttgtctcagcccctaatgccaaagagcttgtccaaaaacttgaggcatacaagccagtgaatgatggagtcatagctaaatctaggtgggaggttgagaagaaagtgcaacagccgcaacaacagcaacaagtagtgttctgttctaacacaagcatgcagactgagattgccctttagacttttagagggtcttatggttaagaattgatcaatgtttagggatataattatgagaaatattaaagtttgttgttttctggggtttcttttgtccctcttgaagaaaccacctgtatcaaactttcaacaaactgattccaccaaaatgcacaacctgaaaatatcagc

SEQ ID NO: 15987 - protein, 228 aa, Arabidopsis thaliana
MEIVKSRFKRVCVFCGSSSGKRECYSDAATDLAQELVTRRLNLVYGGGSIGLMGLVSQAVHEAGGHVLGIIPRTLMDKEITGETYGEVIAVADMHERKAEMARHSDCFIALPGGYGTLEELLEVIAWAQLGIHDKPVGLLNVDGYYNYLLTFIDKAVDDGFIKPSQRHIFVSAPNAKELVQKLEAYKPVNDGVIAKSRWEVEKKVQQPQQQQQVVFCSNTSMQTEIAL

SEQ ID NO: 15988 - DNA, 926 bp, Oryza sativa
  CDS (31)..(702)
ggtcggcgaggccaaggcaggcaggaagccatgggcgacaacagcgccgccgcggcggccgtggccgcgccgcgcggcaggttcggcaggatctgcgtcttctgcggcagcaacgccggcaaccgcgcggtgttcggcgacgcggcgctccagctcgggcaggagctggtgtcgagagggatcgagttggtctacggtggcggcagcgtcgggttgatgggcttgatcgcgcagacggttcttgatggcggctgcggtgttctcggggtgattccaaaagcactcatgcccaccgagatatcaggtgcaagtgttggagaagtgaaaattgtgtctgacatgcatgagaggaaagctgagatggcacgccaatccgatgccttcatcgctcttcctggagggtatggaacaatggaggagttgttagagatgataacttggtcacaacttggaattcatgacaaaccagttgggttgctgaatgtggacggttactatgatccgttgcttgcgctatttgataagggtgcggcagaaggatttattaaggccgattgcagacaaataattgtttcggcaccgactgcgcatgagctgctgagaaagatggagcaatacactcgttcacaccaggaggtagcgccacgtacaagctgggagatgtcagagcttggttatggaaagacaccagaggaatcgtagcataatctgctaatgtgacattgttcctgaaggagaattgcagctgctccttttatctcccattttggttaccttatcgtgttacctgtccagtcaacttcatccggtgaagaagatgcataagaaaatatgtacctaccctcggttttcctgtgggggaatgaacgcatggttatagtccgtataatatttcctgccttacataaattaagaggcatttgagc

SEQ ID NO: 15989 - protein, 223 aa, Oryza sativa
MGDNSAAAAAVAAPRGRFGRICVFCGSNAGNRAVFGDAALQLGQELVSRGIELVYGGGSVGLMGLIAQTVLDGGCGVLGVIPKALMPTEISGASVGEVKIVSDMHERKAEMARQSDAFIALPGGYGTMEELLEMITWSQLGIHDKPVGLLNVDGYYDPLLALFDKGAAEGFIKADCRQIIVSAPTAHELLRKMEQYTRSHQEVAPRTSWEMSELGYGKTPEES

SEQ ID NO: 15990 - DNA, 594 bp, Xanthomonas axonopodis
  CDS (1)..(594)
atgaaaagcatctgcgtctactgcggctccaatgccggcaacaaacccgcctatgtcgagcgcgcgattgcgttgggcgatcgcatcgccaagcagggcctgcgcctggtgtacggcggcggcaacgttggcttgatgggcaccgtggccaatgcagtgctggcggccggcggtgaagtgaccggggtgatcccgcagcaactggccgattgggaagtggcgcaccgcgggttgaccacgctggaaatcgtcggctccatgcatgagcgcaagatgcgcatgttcgagctgtccgatgcgttcgtggccctgcccggcggcttcggtaccatggaagagatcttcgagatgctgacctggcgccagctcggcatcggcaacaagccgtgcgcctttctggacatcgaaggtttctacgcaccgctgattggcatgatcgaccgcatggtcgaagagcgcttcctgcatccagaccagcgcgccgacctgtggtacggcgccgatatcgagcagatgctcgaatggatgcagcactacactccggcgcaggcgtcgaagtggatcgacgagaagcgtcgctccaccctggtgtaa

SEQ ID NO: 15991 - protein, 197 aa, Xanthomonas axonopodis
MKSICVYCGSNAGNKPAYVERAIALGDRIAKQGLRLVYGGGNVGLMGTVANAVLAAGGEVTGVIPQQLADWEVAHRGLTTLEIVGSMHERKMRMFELSDAFVALPGGFGTMEEIFEMLTWRQLGIGNKPCAFLDIEGFYAPLIGMIDRMVEERFLHPDQRADLWYGADIEQMLEWMQHYTPAQASKWIDEKRRSTLV

SEQ ID NO: 15992 - DNA, 579 bp, Fusobacterium nucleatum subsp
  CDS (1)..(579)
atgagaaaaaaaaatgttacagtttattgtggagcttcatttggagttgatgaaaaataccaagaagtaactagaaaacttggagaatggataggaaaaaataattacaatcttgtatatggtggaggaagatcgggtttaatgggactgattgctgattctgttcttgaaaatggaggaaaagttacaggaattataactcatttcctttcagaaagagaaatagcccatgaaggaataacaaaacttataaaagttgatactatgtctgaaagaaaaaagaagatggcagacttagctgatatttttatagccttaccaggaggacctggaactttggaagaaataacagaagttgtttcttgggcagttcttgctttacacccttgtccttgtatattttttaactttgataattattataaccatattagagatttctatgatttaatggtagcgaaaggctatatgaaaaaagaggcaagagataaaattttatttacaagttcatttaaagaaataggaaattttattattaaatatgaacctccaaaagcaagagaataccatggagaataa

SEQ ID NO: 15993 - protein, 192 aa, Fusobacterium nucleatum subsp
MRKKNVTVYCGASFGVDEKYQEVTRKLGEWIGKNNYNLVYGGGRSGLMGLIADSVLENGGKVTGIITHFLSEREIAHEGITKLIKVDTMSERKKKMADLADIFIALPGGPGTLEEITEVVSWAVLALHPCPCIFFNFDNYYNHIRDFYDLMVAKGYMKKEARDKILFTSSFKEIGNFIIKYEPPKAREYHGE

SEQ ID NO: 15994 - DNA, 996 bp, Arabidopsis thaliana
  CDS (74)..(715)
atcacaacgagaaagatagattcatctttcaatctttttttatcttaaaacaaaactttgtgtgaagagaaagatggagatagaatcaaagttcaagagaatatgtgtgttttgtggaagtagtgctggtaataaagtcagttacaaagatgcagctatcgaactcggaaccgaactggtatcgagaaatatcgatcttgtctatggtggagggagcattggtttaatgggtttgatttctcaagctgttttcaatggaggtcgccatgtcattggggttatccccaagacactaatgccaagagagataacaggagagacagtgggagaagtgaaggcagtagcagacatgcaccaaaggaaagctgaaatggctaagcactctgatgcttttatcgctttacctggtgggtatgggacacttgaagagcttcttgaagttatcacttgggcacagctaggcatccatgataaaccagtgggactgttgaatgtggaaggatactacaattcattgttatcattcatagacaaagcagtggaagaaggtttcatttcaccaactgctcgtcatatcattgtatctgctccttctgctaaagaacttgtcaagaaacttgaggattatgtaccaaggcatgagaaggtagcctcaaagaaaagctgggagatggagcaaatagggctaagtcccacttgtgaaatctcaagatgaaaaaggactaattaatttccttaattaggacaacccaattgaattatctctccaaattgggaccctctttattgattgtaaaacttagtccaagcaaaccggggaaaaaacagattgactttcttctttttgtgtagttgattctgttgtttaatgtattttttttagatttttattcgggaaaaaaaaagaaaagacagaaaatatgttggtttttttagtttggattttgtaatatgtcccccaacaaacaactcaattttatagtttttctttcttcc

SEQ ID NO: 15995 - protein, 213 aa, Arabidopsis thaliana
MEIESKFKRICVFCGSSAGNKVSYKDAAIELGTELVSRNIDLVYGGGSIGLMGLISQAVFNGGRHVIGVIPKTLMPREITGETVGEVKAVADMHQRKAEMAKHSDAFIALPGGYGTLEELLEVITWAQLGIHDKPVGLLNVEGYYNSLLSFIDKAVEEGFISPTARHIIVSAPSAKELVKKLEDYVPRHEKVASKKSWEMEQIGLSPTCEISR

SEQ ID NO: 15996 - DNA, 585 bp, Oryza sativa
  CDS (1)..(585)
atggcaatggaggctgcggcggagaggagcgccggagcaggggcggcggcgacggcggcgccggagagcggtggcggtggtgcaggggagaggcggtcgcggttcaggcggatctgcgtgtactgcggcagcgccaaggggaggaaggccagctaccaggacgccgccgtcgagctcggcaaggaactggtcgagaggggcatagacctggtctacggcggtggctccatcggcctcatgggcctcgtctcccacgctgttcacgacggtggtcgccatgtcattggggtcatcccgaaatccttgatgcccagagaggtcactggtgagcctgttggtgaagttagagcggtctctggcatgcacgagaggaaggctgaaatggcccggtttgctgatgcgttcattgcactgcctggcggctacgggactcttgaggagttgcttgaggtcatcacctgggcccaactaggaatccacaagaagccggagtatgttcccgagtacgaggtcggcttggtttgggacgatcagatgccgcacagcttcgcgcctgacctcgagaccaggatcacctcatcctga

SEQ ID NO: 15997 - protein, 194 aa, Oryza sativa
MAMEAAAERSAGAGAAATAAPESGGGGAGERRSRFRRICVYCGSAKGRKASYQDAAVELGKELVERGIDLVYGGGSIGLMGLVSHAVHDGGRHVIGVIPKSLMPREVTGEPVGEVRAVSGMHERKAEMARFADAFIALPGGYGTLEELLEVITWAQLGIHKKPEYVPEYEVGLVWDDQMPHSFAPDLETRITSS

SEQ ID NO: 15998 - DNA, 954 bp, Ralstonia solanacearum
  CDS (1)..(954)
atggactctaatgtgactggaacgcccgacggcgtttccgacaatggcgcttccgctgaaggcggcgtggcgaagcaggttgccggcgtgtccgcggccgagttgatcggcatgcagccggcccatcaggccacgacggccgacatggacgtcaacgtgacggtcggcgccgagcatcgggcagcggatgcggctgccaaatccgacgccgcgcacggccgcgccgaacgcaagatgatccccagcctgcgggcactcgccgacgaggaacgcgccaccgcgaagaaagcgcgcgcctcctggcagatgttcacgattatggcagagttcatcgaggcgaccgagtacctctcggagatccgcccggcggtctcgatctacggcagcgcgcgcctgcgcgaggattcgccgtactaccagcgcaccatcgacattgcccgactgttctcggatgcgggcttcgccgtcatctccggcggcggccccggcatcatggaggcggccaacaagggcgcgcacggcggcaagtcggccagcgtcggcctgaacatcgagctgccgcacgagcagcagggcaatccgtaccaggacatctcgatgcgcttccgccatttcttcacgcgcaaggtcaccttcgtgaagaactcggatgccttcatcgtgatgcccggcggcttcggcacgctcgatgagctggccgaggtgctcacgctggtccagactggcaagtcacgcagcgtgccggtggtgatgttcggcagccatttctggaagggcctgctcgactggttccgcttcacgctgctgccgatgggcctgatcgccgagcacgacctcgacatcatgcgcatcgtcgacgaaccgaaggacgcgctcgacgcggtctacgagttctacgaaaagcgcgaaggcgtctcgccgatcccgccgaaggaagagatgttctacctgtag

SEQ ID NO: 15999 - protein, 317 aa, Ralstonia solanacearum
MDSNVTGTPDGVSDNGASAEGGVAKQVAGVSAAELIGMQPAHQATTADMDVNVTVGAEHRAADAAAKSDAAHGRAERKMIPSLRALADEERATAKKARASWQMFTIMAEFIEATEYLSEIRPAVSIYGSARLREDSPYYQRTIDIARLFSDAGFAVISGGGPGIMEAANKGAHGGKSASVGLNIELPHEQQGNPYQDISMRFRHFFTRKVTFVKNSDAFIVMPGGFGTLDELAEVLTLVQTGKSRSVPVVMFGSHFWKGLLDWFRFTLLPMGLIAEHDLDIMRIVDEPKDALDAVYEFYEKREGVSPIPPKEEMFYL

SEQ ID NO: 16000 - DNA, 585 bp, Ralstonia solanacearum
  CDS (1)..(585)
atgaaatcgatctgcgtctattgcggctccagcccgggcgagcgcccggaatacaaggccggcgccatcgcgctgggcaacgagatggtcgggcgcgggctcacgctggtctacggcggcggcaacatcggcctgatgggcatcgtggccgatgccgtgctgcggggcggcaacccggtcatcggcatcatccccaagtcgctggtgcgcaaggaggtcggccacaaagacgtgaccgagctgcacatcgtcgacagcatgcaccagcgcaagcagatgatggcggaccgcgccgacgccttcatcgccatgccgggcggcatcggcacctatgaagagctgttcgagaccttcacctggctgcagctcggctatcacggcaagccgatcggcctgctcaacgtggcgggcttctacgacaagctgctcgccttcatcgaccacgcggtggaggaaggcttcctcaagcggcaccatgccgacctgctgcacgtcagcgccgatcccgccgagctgatcgaccggctcgagcgcgcgccgcgccatccggtcgacaaatgggcggaacggcgcgagcgcacgtaa

SEQ ID NO: 16001 - protein, 194 aa, Ralstonia solanacearum
MKSICVYCGSSPGERPEYKAGAIALGNEMVGRGLTLVYGGGNIGLMGIVADAVLRGGNPVIGIIPKSLVRKEVGHKDVTELHIVDSMHQRKQMMADRADAFIAMPGGIGTYEELFETFTWLQLGYHGKPIGLLNVAGFYDKLLAFIDHAVEEGFLKRHHADLLHVSADPAELIDRLERAPRHPVDKWAERRERT

SEQ ID NO: 16002 - DNA, 618 bp, Rhizobium meliloti
  CDS (1)..(618)
atgaacaaggaaaccacgccgattctatccgtttgcgtttattgcggttctcagcccgggcgtgacgacgcccacatccaggccggccgcaccctcggcaaatcgatcgccgatcatggcctgcgcctcgtctatggcggcggcacgcgcgggatcatgggcgccgtggcaagcggcgtgctttcatccggcggacacgtcaccggcatcattccggaattcctgatggacaaggaagcgacgcgtcactcgctgggccagctgaacgaactgatcgttaccgccgacatgcatgagcgcaagcacaagatgttcgagcgcgccgacgccttcgtcgcccttccgggcgggatcggcacgctcgaggagatcgtcgaaatcatgacctgggcgcagctcggccgccacaggaagccgatggtcttcggcaatgtcaacggcttctgggatccgatgctggagctgatcgaccacatgcgcgaccagggattcgtccacacggcgcatctcgtgcagccgctggtgatcgaccgggcggaagacatcgtccccggcatccttgcctcggttcgcgccaacgggcgcgagggcgaagccgagatcatctccaggctctga

SEQ ID NO: 16003 - protein, 205 aa, Rhizobium meliloti
MNKETTPILSVCVYCGSQPGRDDAHIQAGRTLGKSIADHGLRLVYGGGTRGIMGAVASGVLSSGGHVTGIIPEFLMDKEATRHSLGQLNELIVTADMHERKHKMFERADAFVALPGGIGTLEEIVEIMTWAQLGRHRKPMVFGNVNGFWDPMLELIDHMRDQGFVHTAHLVQPLVIDRAEDIVPGILASVRANGREGEAEIISRL

SEQ ID NO: 16004 - DNA, 612 bp, Rhizobium loti
  CDS (1)..(612)
atgaacacgattcgatccgtctgcgtttattgcggctcgtctccgggccgcaatgaaatctatgcgaaggccgggcacctgcttggacgctcgattgccaaagcgggcctgcggctggtctatggcggcggcaccaaaggcattatgggcgccgtcgcagaaggcgcgctcaaggccggcggcaaggtgaccggcatcattccccgcttcctgatcaacagggaagcaaccgaaaccgcgctcgaccggctcgacgagttgctgatcaccgacaacatgcacgagcgcaagcacaagatgttcgagaaatccgacgcctttgtggcgctgcctggcggcatcggcacagtcgaggaaatcgtcgagatcatgacctgggcgcaactcggccatcaccgcaagccgatcgtcttcgccaatatcaacggattctgggatccgatgacggcgttgcttgatcatatgacggcggagggcttcatccacaccgcgcagcgggtcaagccgctggtcgtcaacgatccggaggccatcgtcgccgccatcatggtggcaggctcttccgtcgacgccccgaccgagggcgtgcagtcggtgatcgacaagatgtag

SEQ ID NO: 16005 - protein, 203 aa, Rhizobium loti
MNTIRSVCVYCGSSPGRNEIYAKAGHLLGRSIAKAGLRLVYGGGTKGIMGAVAEGALKAGGKVTGIIPRFLINREATETALDRLDELLITDNMHERKHKMFEKSDAFVALPGGIGTVEEIVEIMTWAQLGHHRKPIVFANINGFWDPMTALLDHMTAEGFIHTAQRVKPLVVNDPEAIVAAIMVAGSSVDAPTEGVQSVIDKM

SEQ ID NO: 16006 - DNA, 1179 bp, Arabidopsis thaliana
  CDS (93)..(746)
atcataataatcatagaattttcaactttttaagctctagatagagagagagagagagagagacaaagtaacaaagagaaagagagagaaatatggaagagacaaaatcgagattcaagaggatctgtgtcttctgtggaagcagttccggcaaaaaaccttcataccaagaagctgccattcaattgggtaacgagttggtggagagaaggattgatttggtatacggaggtggtagcgtggggcttatgggtctcgtctctcaagctgttcatcatggtggtcgccatgttctaggggtcattccaaaaaccttgatgccaagagagataactggtgagaccatcggagaagttaaagccgtggccgatatgcatcaaaggaaagctgaaatggctcgccaagccgacgcattcattgcccttcctggtgggtatggtacgttagaagaattgctggaagtcattacatgggctcaactcggtatccaccgtaagccggtgggtcttcttaacgtggatggttactacaactcgctgttaacgtttattgataaggctgtggacgaaggatttatatccccaatggctcgtcgaatcatcgtctcagctccaaacgctaaagagttggttcgacaactcgaggaatatgaaccggagtttgatgagataacatcaaaattggtttgggatgaagtggaccggataagttatgtaccgggttcggaggtagctaccgctacgtaaggatgtattatggggagtttattttttggtaaaagcagtgtacagcggaaattaagttgtttaacatcagaaggtaagggcggaaagaagacaaaagaaagtattggggtcgttttgataaacattattttgtaggggtggtttaaatgtgtgaagtggataaaccatgtgggtaactgctaaccgcgtatataccaaaccctatcactccccacttgtctttgtacattttggtttaatggaaaaaaaggatagggctattttcaagaaatgacaaaacgatccttttcttttggttattttctgattttatccataacttctagtttttaacttttttctcgtgtcaaaggtatcagatttttatttaaccagaaaattatcatgtacgatattttttaattaatccgagtggagaatattccgagtaata

SEQ ID NO: 16007 - protein, 217 aa, Arabidopsis thaliana
MEETKSRFKRICVFCGSSSGKKPSYQEAAIQLGNELVERRIDLVYGGGSVGLMGLVSQAVHHGGRHVLGVIPKTLMPREITGETIGEVKAVADMHQRKAEMARQADAFIALPGGYGTLEELLEVITWAQLGIHRKPVGLLNVDGYYNSLLTFIDKAVDEGFISPMARRIIVSAPNAKELVRQLEEYEPEFDEITSKLVWDEVDRISYVPGSEVATAT

SEQ ID NO: 16008 - DNA, 615 bp, Oryza sativa
  CDS (1)..(615)
atgaggcagtcgaggttcaagaggatctgcgtcttctgcggcagcagccaggggaagaagaggagctaccatgacgccgccattgagctcggcaacgagctggtggcgaggagcatagacctggtgtacggcggcggcagcatcggcctcatggggctcgtctctcaggcggtcttcgacggcggccgccacgtcatcggggtcattcccaagactctcatgacgccagagataagtggtgagacagtgggggaggtgaggccagttgctgatatgcaccaaaggaaggcagagatggcaaggcagtctgatgccttcatagccctacctggagggtacgggactctggaggagctgctcgaggtgattacatgggcacagcttggcatccatcataagccggttgggctgctcaacgtcgacgggtactacaactcgctgctgacgttcatcgacaaggcggtggaggaagggttcatcaacaccagcgcgcggcggatcatcgtcatggcgccgacggcggaggagctgatggacaagctagaggagtacgtgccttaccacgacagggtggcatcgaagctgaactgggagatgggccacctaggttactga

SEQ ID NO: 16009 - protein, 204 aa, Oryza sativa
MRQSRFKRICVFCGSSQGKKRSYHDAAIELGNELVARSIDLVYGGGSIGLMGLVSQAVFDGGRHVIGVIPKTLMTPEISGETVGEVRPVADMHQRKAEMARQSDAFIALPGGYGTLEELLEVITWAQLGIHHKPVGLLNVDGYYNSLLTFIDKAVEEGFINTSARRIIVMAPTAEELMDKLEEYVPYHDRVASKLNWEMGHLGY

SEQ ID NO: 16010 - DNA, 510 bp, Agrobacterium rhizogenes
  CDS (1)..(510)
atggcgagatcgggcatcggattggtgtacggcggcgcttcgattggtttaatgggtgctatcgcggacgcggcccgaagcgatggcggagaggttatcggcgtcattccccgcgcgctggccgagaaggagatcgcccacaccgatcttgctgatctacgcgttgtcgagaccatgcacgagcgcaaagcgctgatggcggcgctgtcggatggttttatcgctttaccaggaggattgggaaccctcgaagagctgttcgaagtatggacatgggctcagttgggttaccacaataaaccatgtgcactgctggacatagcgggcttttacaaaaggctagattcctttcttgatcatgttgttggcgaagcattcttgacagcaagtcatcgcaacatcctcctcgtcgaagaggacgccgaggtgctcatttctgccatggcaaatgatagtgccactttaaagtcacgttcagaagagagcgattttaggcgactccgacgctaa

SEQ ID NO: 16011 - protein, 169 aa, Agrobacterium rhizogenes
MARSGIGLVYGGASIGLMGAIADAARSDGGEVIGVIPRALAEKEIAHTDLADLRVVETMHERKALMAALSDGFIALPGGLGTLEELFEVWTWAQLGYHNKPCALLDIAGFYKRLDSFLDHVVGEAFLTASHRNILLVEEDAEVLISAMANDSATLKSRSEESDFRRLRR

SEQ ID NO: 16012 - DNA, 26 bp, Primer
atgacaatggaaaaaaatggaggtaa

SEQ ID NO: 16013 - DNA, 24 bp, Primer
ttatttagcacaatcctcgtgagc

SEQ ID NO: 16014 - DNA, 972 bp, Saccharomyces cerevisiae
  CDS (1)..(972)
atgacggtaaacttagatccggataaagtttggatagacggctgctttgatttcacacatcatgggcatgcgggagccattttgcaggctcgtcgaacagtttcaaaagaaaatggtaaactattctgtggtgtgcataccgatgaagatattcagcataacaaaggaacaccagtaatgaactcttcagaaagatatgagcatactagatcaaataggtggtgttcggaagtggttgaagcggcgccatatgttacagatcccaattggatggataaatatcagtgccaatatgttgttcatggtgatgatatcaccatagatgctaatggagaagactgctataagttggtgaaagagatggggcgcttcaaggtagttaaaagaacatatggcgtaagtactaccgagattatacatagaatattgacgaaaaaatctttgccaccgactcatcctgattattatcccaccacccaggaattgagtttctattctgtcgcccaagatgccgtttcaaaacattgttatgtctttcagagggatttggacaatgtcttggtcaatggtggatacaaattcgatgcagaagattgtgtttatgttgacggggattttgacttattccatatgggggatattgatcagttaagaaagctgaaaatggatcttcaccccgataagaaattgattgttggtattaccacaagcgattactcgagtaccattatgacgatgaaggaacgcgtcttgagcgttttaagttgtaaatatgttgatgccgttattatcgatgctgacgccacctcaatgtctcagtataactgcgagaagtatcatattggcacggctgtcctcactgctgccggaaaattcagtgaatacttgactaaagagcttattgtgaagagggtggaatcgcaaagggaggtttacattgcgaggaaccaaaaaaagggaatgtccatataa

SEQ ID NO: 16015 - protein, 323 aa, Saccharomyces cerevisiae
MTVNLDPDKVWIDGCFDFTHHGHAGAILQARRTVSKENGKLFCGVHTDEDIQHNKGTPVMNSSERYEHTRSNRWCSEVVEAAPYVTDPNWMDKYQCQYVVHGDDITIDANGEDCYKLVKEMGRFKVVKRTYGVSTTEIIHRILTKKSLPPTHPDYYPTTQELSFYSVAQDAVSKHCYVFQRDLDNVLVNGGYKFDAEDCVYVDGDFDLFHMGDIDQLRKLKMDLHPDKKLIVGITTSDYSSTIMTMKERVLSVLSCKYVDAVIIDADATSMSQYNCEKYHIGTAVLTAAGKFSEYLTKELIVKRVESQREVYIARNQKKGMSI

SEQ ID NO: 16016 - DNA, 1281 bp, Arabidopsis thaliana (mouse-ear cress)
  CDS (128)..(1027)
gaaaaaaaaaatccaatttagaaaaccgcgcgttggagggaaagccatagaaaactaaaagataacaaacattttaacaaacccaaacccaaaaattctcaaggaggccgaagaagaagaagaagaaatgagcgttaatggtgagaacaaggtctcaggaggagatagttcatcttcagatcgacctgttagagtctacgccgatgggatcttcgatttgttccatttcggccacgctcgtgccatcgaacaagccaaaaaatcgttcccgaatacgtatctgcttgttggatgttgcaatgacgaaattacgaacaaattcaaggggaaaactgtgatgactgaatctgagcgatacgaatctcttcgacattgcaagtgggttgatgaagtgattccagatgcaccatgggttcttacaacagagtttcttgataagcataagatagattacgtagctcacgatgctcttccctatgcggatactagtggagctggaaatgatgtttatgagtttgtaaagtcgattgggaagtttaaggagactaaacgaacagaggggatatcgacatctgatataatcatgagaatagtgaaagattataaccagtatgtgttgcgtaatcctggaccgaggtattcaagagaagaactctcgtgtcagctcgaggagaagaggcttagagtgaatatgagattgaagaaactacaagagaaagttaaagaacaacaagaaaagatacaaaccgtagcaaaaactgctgggatgcaccatgatgagtggcttgaaaatgctgatcgttgggtggctggatttcttgaaatgtttgaggaaggttgtcataaaatgggaacagccatcagagatgggattcagcaacggctaatgaggcaagaatcggaagagaaccggcgattgcttcaaaatggactgacgatttccaaagacaatgacgatgaacaaatgtctgatgacaacgagtttgcagaagaaagactgcgtcaatgtgagcaacaaagggattgaaacagtaaagaaatgagagattttgggtcatggttgaagtatttccagatacagaaccaaaatctactagatttcaccagtaatggtattaggcttgtttattcaactgtacatcaaactctgtttcaaaatctctacttgtgtctaaaactcaaatgcatcagaaatcaaaagcagtcatggatatatctatgatcaaacactccaaatgattacatgatgaccataatagaaacagctcaacttcacaattc

SEQ ID NO: 16017 - protein, 299 aa, Arabidopsis thaliana (mouse-ear cress)
MSVNGENKVSGGDSSSSDRPVRVYADGIFDLFHFGHARAIEQAKKSFPNTYLLVGCCNDEITNKFKGKTVMTESERYESLRHCKWVDEVIPDAPWVLTTEFLDKHKIDYVAHDALPYADTSGAGNDVYEFVKSIGKFKETKRTEGISTSDIIMRIVKDYNQYVLRNPGPRYSREELSCQLEEKRLRVNMRLKKLQEKVKEQQEKIQTVAKTAGMHHDEWLENADRWVAGFLEMFEEGCHKMGTAIRDGIQQRLMRQESEENRRLLQNGLTISKDNDDEQMSDDNEFAEERLRQCEQQRD

SEQ ID NO: 16018 - DNA, 1314 bp, Arabidopsis thaliana (mouse-ear cress)
  CDS (1)..(999)
atgagcaacgttatcggcgatcgcactgaagacggcctttccaccgccgctgcggcctctggctctacggctgtccagagttctcctcccactgatcgtcctgtccgcgtctacgccgatgggatctacgatcttttccactttggtcatgctcgatctctcgaacaagccaaattagcgtttccaaacaacacttaccttcttgttggatgttgcaatgatgagactacccataagtacaagggaaggactgtaatgactgcagaagagcgatatgaatcacttcgacattgcaagtgggtggatgaagtcatccctgatgcaccatgggtggtcaaccaggagtttcttgacaagcaccagattgactatgttgcccacgattctcttccctatgctgattcaagcggagctggaaaggatgtctatgaatttgttaagaaagttgggaggtttaaggaaacacagcgaactgaaggaatatcgacctcggatataataatgagaatagtgaaagattacaatcagtatgtcatgcgtaacttggatagaggatactcaagggaagatcttggagttagctttgtcaaggaaaagagacttagagttaatatgaggctaaagaaactccaggagagggtcaaagaacaacaagaaagagtgggagaaaagatccaaactgtaaaaatgctgcgcaacgagtgggtagagaatgcagatcgatgggtcgctggatttcttgaaatatttgaagaaggttgccataagatgggaactgcaatcgtagacagtatccaagaaaggttaatgagacaaaagtcggcagagaggctggagaacggtcaggatgatgacacagacgaccagttctatgaagaatacttcgatcatgacatgggtagtgacgatgatgaagatgaaaaattctacgacgaggaagaagtaaaggaagaagagacagagaaaactgttatgacggatgctaaagacaacaagtaagaacaaatttggcttgcagaaacctcagattagctctacttatggccacttctactaaactcccttaagcctcgcactctctctcgaaattcatctacttaacatataataccaatgtttagaaagagagagtgtgtgatgtgtttgtttgtgtgtgttgaacaaacgaacgtgcgtggttgtctttggtgagttggtctcatctttgttgatttttgaatgcgcatgtatttttttcttctttttcatgacgggcaaagtgttatgaagtacaatgcaattgtctaaaacaggataagtcaatggttcgtgtgt

SEQ ID NO: 16019 - protein, 332 aa, Arabidopsis thaliana (mouse-ear cress)
MSNVIGDRTEDGLSTAAAASGSTAVQSSPPTDRPVRVYADGIYDLFHFGHARSLEQAKLAFPNNTYLLVGCCNDETTHKYKGRTVMTAEERYESLRHCKWVDEVIPDAPWVVNQEFLDKHQIDYVAHDSLPYADSSGAGKDVYEFVKKVGRFKETQRTEGISTSDIIMRIVKDYNQYVMRNLDRGYSREDLGVSFVKEKRLRVNMRLKKLQERVKEQQERVGEKIQTVKMLRNEWVENADRWVAGFLEIFEEGCHKMGTAIVDSIQERLMRQKSAERLENGQDDDTDDQFYEEYFDHDMGSDDDEDEKFYDEEEVKEEETEKTVMTDAKDNK

SEQ ID NO: 16020 - DNA, 1345 bp, Arabidopsis thaliana (mouse-ear cress)
  CDS (1)..(1266)
atggtttgggagaaagagaagatcgtcggaagttgtatagtcggaggagctgcgttcgccgtcggagcttctttccttcatcttttccttaaaggtgagcttccgttaggattaggtttaggtttgtcttgtccatggcgcattttgagaaaacgaaaacctgttcgcgtttacatggatggttgcttcgatatgatgcactatggccactgcaacgctcttcgtcaagctcgtgctctcggtgaccaattggtcgtcggtgttgtttccgacgaagaaattatagccaacaaaggacctcctgttactcctcttcatgaaagaatgacaatggtgaaagctgtgaagtgggtggatgaagttatatctgatgctccttacgctattacggaagatttcatgaagaaattgttcgatgagtatcagatcgattacattatccatggtgatgatccttgtgttcttcctgatggtactgatgcttatgcacttgctaagaaggctggtcgttacaagcagattaagcgcactgaaggagtttctagcactgatatcgttggtcgtatgcttctttgtgtaagagaaagatccattagtgacactcatagtcgttcctctctgcaaaggcaatttagtcatgggcatagtagcccaaagtttgaggatggagcttcttctgctggtactcgtgtctcgcattttcttcctacttcccgcaggattgttcagttctccaatggaaaggggccaggacctgatgcacgcattatctacatagatggtgcttttgatcttttccatgctggccatgttgagattcttagacgtgctcgagagcttggagactttcttcttgttggtatacataatgaccagactgtcagtgctaaacgaggagcgcatcgccctattatgaatctccatgaaaggagcttaagcgttctggcgtgccgctacgtggatgaggtgataattggtgctccatgggaagtgtcgagagatacgatcacgacatttgacatctcgttggtggtacatgggacagtagccgagagcgatgattttcgaaaggaggaagataatccgtattctgtaccaattagcatgggcatattccaagttctagatagccctcttgatatcacaacgtccaccataatcaggaggattgtagcaaaccatgaagcttatcagaaacgtaatgcgaagaaggaagctagcgagaaaaagtattacgagcagaagtcgtttgtgtccggagactgatagagctatatgcttagctttttaaatctatctacatcttgtactttgactatagtaggatgtttttggttgagactcc

SEQ ID NO: 16021 - protein, 421 aa, Arabidopsis thaliana (mouse-ear cress)
MVWEKEKIVGSCIVGGAAFAVGASFLHLFLKGELPLGLGLGLSCPWRILRKRKPVRVYMDGCFDMMHYGHCNALRQARALGDQLVVGVVSDEEIIANKGPPVTPLHERMTMVKAVKWVDEVISDAPYAITEDFMKKLFDEYQIDYIIHGDDPCVLPDGTDAYALAKKAGRYKQIKRTEGVSSTDIVGRMLLCVRERSISDTHSRSSLQRQFSHGHSSPKFEDGASSAGTRVSHFLPTSRRIVQFSNGKGPGPDARIIYIDGAFDLFHAGHVEILRRARELGDFLLVGIHNDQTVSAKRGAHRPIMNLHERSLSVLACRYVDEVIIGAPWEVSRDTITTFDISLVVHGTVAESDDFRKEEDNPYSVPISMGIFQVLDSPLDITTSTIIRRIVANHEAYQKRNAKKEASEKKYYEQKSFVSGD

SEQ ID NO: 16022 - DNA, 1636 bp, Mus musculus (house mouse)
  CDS (5)..(1108)
gaagatggatgcacagagttcagctaaagtcaattcgaggaagaggaggaaagaggcacctggccctaatggagcaacagaggaagatggaattccttccaaagtgcagcgttgcgcagttggtttacggcagccagctcctttttctgatgaaattgaagttgactttagtaagccctatgtcagggtgactatggaagaagcctgcaggggaactccgtgtgagcggcctgtgagagtttatgcggatggaatatttgacttgtttcactctggtcatgcccgggctctgatgcaagcaaagaaccttttccctaatacgtatctaattgtgggagtctgcagtgatgagctaacgcacaacttcaagggcttcactgtgatgaacgagaatgagcgctatgacgccgtgcagcactgccgctacgtggacgaggtggtgcggaacgccccctggactctgacgcctgagttcctggcagagcaccggattgattttgtcgcccatgacgacatcccctattcttctgcagggagcgatgatgtgtataagcacatcaaggacgcaggcatgtttgctcccacacagaggacagaaggtatctccacatcagacatcatcacccgcattgtccgtgactatgatgtgtatgcaagacggaacctacagaggggctacactgccaaggagctcaatgtcagctttatcaacgagaagaaataccacttgcaagaacgagttgataaagtaaagaagaaagtgaaagatgtggaggaaaagtcaaaagagtttgtgcagaaggtggaagagaagagcatcgacctcatccagaagtgggaggagaagtcccgagagttcattggaagtttcctggaaatgtttggtccagaaggagcactgaagcacatgctgaaggagggaaaaggtcggatgctgcaggccatcagtcccaagcagagccccagcagcagccctactcatgagcgctccccctccccctcctttcggtggcccttctctggcaagacttccccatcttcctccccagcaagtctttctaggtgcagggctgtgacctgtgacatcagcgaggatgaagaggactaacttttcatccctgttccctctctcccccactgcccatcacctccagaagctctctgtcgaattccattttgtgatcccaacactaaacctaaggacatctacaaagaaaagacaaccggggcaagaggacctgggaatggggaaccaaaacagcccatgccctgagacattctcagccacaccaaggaggctgcccataccttagaagcctgctctgcatccatcttccctccccagaactttgctttactgtttatgctcatgtaatcttgacagggaaattgtcatttttatcaattttttttaaaaagtagtctttcaaatatagtaagtagaactaattttttgcccctgaggagtgggcagaagaaggaagcgtggaatgcccagaggccttttttcctgaacactagtgcttgccttctgttctgaagcaaagtggcttgccagatccttcaaacagggagccatgctaatggccaatttggggactatcataattttaacttccctaaaaaaaaaaaaaaa

SEQ ID NO: 16023 - protein, 367 aa, Mus musculus (house mouse)
MDAQSSAKVNSRKRRKEAPGPNGATEEDGIPSKVQRCAVGLRQPAPFSDEIEVDFSKPYVRVTMEEACRGTPCERPVRVYADGIFDLFHSGHARALMQAKNLFPNTYLIVGVCSDELTHNFKGFTVMNENERYDAVQHCRYVDEVVRNAPWTLTPEFLAEHRIDFVAHDDIPYSSAGSDDVYKHIKDAGMFAPTQRTEGISTSDIITRIVRDYDVYARRNLQRGYTAKELNVSFINEKKYHLQERVDKVKKKVKDVEEKSKEFVQKVEEKSIDLIQKWEEKSREFIGSFLEMFGPEGALKHMLKEGKGRMLQAISPKQSPSSSPTHERSPSPSFRWPFSGKTSPSSSPASLSRCRAVTCDISEDEED

SEQ ID NO: 16024 - DNA, 1240 bp, Pisum sativum (garden pea)
  CDS (106)..(963)
taaaatagaaaaaacaaaaacaggaaagaaaatcgtgtgactgggttttgaatgccgttttgactctctgcacattgcaacagcacaaacacaagcagagtgatcatgaacgatcaccaggagtgtgaagttcgccaaaacgataaacctgttcgagtttatgccgatggaatttacgatctcttccacttcggtcatgcacgttctcttgaacaagccaagaaatcgtttccaaacacttatctccttgttggatgctgcaatgatgagaccactcataagtacaagggtaaaactgttatgactgaggccgaacgctatgagtctcttcgccactgcaagtgggttgatgaagttattccagatgtgccatgggtaatcaatcaggagttcattgacaagcatcaaattgactatgtggctcatgattctcttccttatgctgatacaagtggagctggaaaggatgtctatgaatttgttaaggctattggaaaatttaaggaaacacagcgaacggaaggaatttctacttctgatatcataatgagaatcatcaaagattataaccagtatgtaatgcgtaatttggatcgtggttattcaagaaaagacctaggagttagctatgtcaaggagaaaagattgagaatgaacatgggacttaaaaagttgcaggagagagtgaagaaacagcaagagactgtgggaaagaagataggaacagtgaaaaaaattgctggcatgaaccgtactgagtgggtcgaaaatgctgatcgattagttgctggattcctcgagatgtttgaagaaggatgccacaaaatgggaacggcgatcagagacagaattcaagaacaactgaaggcacagcagctaagatctcttctatacgacgagtgggatgatgacgttgacgatgaattctatgaaaatgaatctgtggaatactacagcgactaaagggacgaatatgcttgtttatttacagattgtgaaccgtttgacaaaattatgtgtcctttgtgtaaaatatttgatatatgtcatatacatgcaagatggtttggacattatttgtctttcttcatagtttgttatctattatctgtgcggttgtgtagcatttgagttcaatatgacctagtcttgtgtcatggaagatcatgactagatttcttatgtggttctttcttacaataaagcatctttgagttatttcttaaaaaaaaaaaaaaaa

SEQ ID NO: 16025 - protein, 285 aa, Pisum sativum (garden pea)
MNDHQECEVRQNDKPVRVYADGIYDLFHFGHARSLEQAKKSFPNTYLLVGCCNDETTHKYKGKTVMTEAERYESLRHCKWVDEVIPDVPWVINQEFIDKHQIDYVAHDSLPYADTSGAGKDVYEFVKAIGKFKETQRTEGISTSDIIMRIIKDYNQYVMRNLDRGYSRKDLGVSYVKEKRLRMNMGLKKLQERVKKQQETVGKKIGTVKKIAGMNRTEWVENADRLVAGFLEMFEEGCHKMGTAIRDRIQEQLKAQQLRSLLYDEWDDDVDDEFYENESVEYYSD

SEQ ID NO: 16026 - DNA, 1321 bp, Brassica napus (rape)
  CDS (31)..(1026)
gtgatttctaccccttcgatcagagagaatatgagcaacgttaccgccgatccaactgccgacggtccttccaccgccgtcgcagtctccaactctacagcaatccagacttcgcctcctaccgatcgtcccgtccgcgtctacgccgacgggatctacgatctcttccactttggccacgctcgatctctcgaacaggccaagaaatcgtttccaaacacttaccttcttgtgggatgttgcaacgatgagactactcataagtacaagggaaggactgtgatgactgctgaagagcgttatgaatcacttcgtcattgcaagtgggtggatgaagtcattcccgatgcaccgtgggtgatcaaccaagagtttcttgataaccaccggattgactacgttgcccatgattcccttccgtatgcagacaccagcggagctggaaaggatgtctatgaatttgttaagaaagttgggaggtttaaggaaacaatgcgaactgaggggatatcaacctcggacattatcatgagaatagtgaaagattataaccagtatgttatgcgtaatttggatagaggatattcaagggaagatcttggagttagctttgtcaaggaaaagagacttagagttaatatgaggctaaagaaactccaggagagagtcaaagaacagcaagaaaaagtgggagaaaagattcaaactgtaaaaatgctgcgcaacgagtgggtagagaatgcagatcgatgggtcgctggatttcttgaaatatttgaagaaggttgccataagatgggtactgcaatcagagacagaatccaagagaggttaataagacagattcccagaaacaggctggagaacggtcaggatgatgacacagacgatcaattctatgaagaatatttcgaccatgacatgggcagtgacgaggatgaagaggaacgatactatgacgaggaggaagatgttgaagaagagaaatataaaaccgttaagccagatgcaaaagacgacaagtaagaacaaatttgtgtctcagaaacctaagtttagcctctcactctatctccctcgcaataatatgcatctacttaacatatagtatcaaatgtttagaaagggagcgtgtgtgagtgtgatgtgtgtatgtgtcttttaaaaaacgtcgaacgtgcgtgcttgtctttgataagttgtctcatcgttgtttattttcgtataagcaatgtttttcgatacttggttttgggatcttgtgtatctaatgtttcatcattgttctttcttctttgtataatgggcaaagtgttatgaa

SEQ ID NO: 16027 - protein, 331 aa, Brassica napus (rape)
MSNVTADPTADGPSTAVAVSNSTAIQTSPPTDRPVRVYADGIYDLFHFGHARSLEQAKKSFPNTYLLVGCCNDETTHKYKGRTVMTAEERYESLRHCKWVDEVIPDAPWVINQEFLDNHRIDYVAHDSLPYADTSGAGKDVYEFVKKVGRFKETMRTEGISTSDIIMRIVKDYNQYVMRNLDRGYSREDLGVSFVKEKRLRVNMRLKKLQERVKEQQEKVGEKIQTVKMLRNEWVENADRWVAGFLEIFEEGCHKMGTAIRDRIQERLIRQIPRNRLENGQDDDTDDQFYEEYFDHDMGSDEDEEERYYDEEEDVEEEKYKTVKPDAKDDK

SEQ ID NO: 16028 - DNA, 1099 bp, Brassica napus (rape)
  CDS (9)..(983)
tctaaagtatgactaacgtcaccggagatcgcaacggagacggacgttcaaccgccgtcacggagagttcgcctccgtctgatcctccaatccgtgtctacgctgatgggatctacgatctgttccatttcggccacgctcgatctctcgaacaggctaagaaatcgtttccaaacacttaccttcttgtgggatgctgcaacgacgatactactcataagtacaagggaaagactgtgatgaatgatcaagaacgatatgaatctcttcgacattgcaaatgggtggatgaagttatccctgatgcaccgtgggtgatcaaccaagagtttcttgacaaacaccgtattgcctatgtggcccatgatgctcttccgtatgctgatgctagtggagctggaaaagatgtctatgagttcgtcaaaaaagtagggaggttcaaggagactaagcgaactgaagggatatctacttcggatataataatgaggatagtgaaagattataatcagtatgtcatgcgtaaccttgacaggggatattcaagggaggatcttggagttagctttgtcaaaagacttagagttaatatgaggttgaagaaacttcaggagaaggtcaaagaacaacaagaaaaagttggggaaaagatccaaactgtgaaaatggtacgtaatgagtgggtggagaatgcagatcgttgggtagctggattccttgaaatgtttgaagaaggctgccataagatgggaactgccatcagagaccgaatccaagagaagttaatgagacaggagtccaaagagttgctcgagaagggtcaaaacggtcagcgtgaagacacggaggaacagttctacgaagaatatttcgagcatgacattgttgacagctgtgaagacaatgaagacgatgaagaagagtactatgacgagattgaagagcaatgtagtagtgcctcaaaagctttaaaaagtaactagatcgaggaacaaaaaatttatgttgttttagtgccctattgttcactgcttttgcagtaaaaatgcttatcaacatgacttattagttagctataagagtttagtaaacgtttgtg

SEQ ID NO: 16029 - protein, 324 aa, Brassica napus (rape)
MTNVTGDRNGDGRSTAVTESSPPSDPPIRVYADGIYDLFHFGHARSLEQAKKSFPNTYLLVGCCNDDTTHKYKGKTVMNDQERYESLRHCKWVDEVIPDAPWVINQEFLDKHRIAYVAHDALPYADASGAGKDVYEFVKKVGRFKETKRTEGISTSDIIMRIVKDYNQYVMRNLDRGYSREDLGVSFVKRLRVNMRLKKLQEKVKEQQEKVGEKIQTVKMVRNEWVENADRWVAGFLEMFEEGCHKMGTAIRDRIQEKLMRQESKELLEKGQNGQREDTEEQFYEEYFEHDIVDSCEDNEDDEEEYYDEIEEQCSSASKALKSN

SEQ ID NO: 16030 - DNA, 1098 bp, Schizosaccharomyces pombe
  CDS (1)..(1098)
atggcatcttcttccaatataaaacatcgtctttggttagacgggtgcatggatttcttccattatggtcatagtaatgccattcttcaagctaagcagttgggcgaaacgcttgttattggtatacattcggatgaagaaattaccctaaacaagggaccgcctgttatgactcttgaggagcgttgtttatctgctaacacttgtaaatgggtcgatgaagtggtaccctctgcaccatatgtgtttgatttggaatggatgagaagatatgggtgtcagtatgttgtacatggtgacgatatatctacagacgccaatggagacgattgttatagatttgctaaagcagcagaccaatacttagaagttaaaaggacggagggagtgagcactaccgagctcctagatcgattacttagttcggttcctttagagatttattctacacctgtatcggtactttcttcccaaattgatctcctcagaagatttgcaactgattccgacgggctaactccttttactgatgtttttatatataacactgagaagccagaaacccttatttcgggcacaaccttgctaaggttgaatcccgaaaagaacataatatacattgatggtgattgggatttgtttacagagaagcatatttctgctttagaactctgtactcgaatgtttccgggtattccaattatggcaggtattttcgcggatgagaaatgtttcgaaaagcctatgcttaatctgttagagcgtatcttgaatttactacaatgcaaatatatatcttcaatcctcgttggtcctccaccagcatctttgtttgcatcttctaaatacataaagttatgttttgatgagcagatctcgaaagtatattacccaatattttccactgacgtgagcataccagcgcttgacattagcctttccaataccccaaataatagtttttataaatttgataagctgggttctgatttgattaagcagcgggttatgttacgtcggcagcattatgaagaacggcagcgtcgaaaaatgggtaaaaatgctacagaacaaacgaccattaaaacttacgcataa

SEQ ID NO: 16031 - protein, 365 aa, Schizosaccharomyces pombe
MASSSNIKHRLWLDGCMDFFHYGHSNAILQAKQLGETLVIGIHSDEEITLNKGPPVMTLEERCLSANTCKWVDEVVPSAPYVFDLEWMRRYGCQYVVHGDDISTDANGDDCYRFAKAADQYLEVKRTEGVSTTELLDRLLSSVPLEIYSTPVSVLSSQIDLLRRFATDSDGLTPFTDVFIYNTEKPETLISGTTLLRLNPEKNIIYIDGDWDLFTEKHISALELCTRMFPGIPIMAGIFADEKCFEKPMLNLLERILNLLQCKYISSILVGPPPASLFASSKYIKLCFDEQISKVYYPIFSTDVSIPALDISLSNTPNNSFYKFDKLGSDLIKQRVMLRRQHYEERQRRKMGKNATEQTTIKTYA

SEQ ID NO: 16032 - DNA, 1275 bp, Saccharomyces cerevisiae
  CDS (1)..(1275)
atggcaaacccaacaacagggaagtcctcgattagggctaagctttctaactcatcgctatcaaacctatttaaaaaaaataaaaataaaagacagcgtgaggaaacggaagagcaggacaatgaggataaggatgagagtaagaaccaggatgaaaataaggacacacagctcactccccgcaagcgtcgccggttgacgaaggagtttgaagagaaggaggctcgttacaccaacgagttgcccaaggaactgcgcaagtatcgtcctaaaggtttcagattcaatttgcctccaacggatagacccatcaggatatatgcagatggtgtttttgatcttttccatcttggccacatgaagcaactggaacagtgtaagaaggctttccccaatgtaacactgatagttggtgtgcctagcgacaaaatcactcacaaactaaaaggtttgactgtgctgaccgataagcagcgttgtgaaactttaacgcactgcagatgggttgacgaagtcgtgcccaacgctccctggtgtgtcaccccagaatttctactagaacacaagattgactacgtggcacatgacgatattccttacgttagcgccgacagcgacgatatctacaagccaataaaggagatgggaaaattcttgactacccaaagaaccaatggtgtctctacaagtgatattatcacaaagatcatcagagattatgacaaatatttgatgagaaactttgcaaggggtgctaccagacaggagctgaacgtttcttggttgaagaaaaacgaactggagttcaaaaaacacatcaatgaattcaggtcatatttcaagaaaaaccagacaaatttgaataacgcctccagagacttgtacttcgaagtccgtgaaatcttgctaaagaaaacgttgggcaaaaaactctactccaagttaataggcaatgaattaaagaaacaaaatcaacgacaaagaaaacagaattttttggatgatccgtttactaggaagctaatcagggaggcctctccggctacagagtttgccaacgaatttacgggcgaaaactctaccgctaaatcaccggatgacaatggaaatcttttcagtcaggaagatgatgaagacacaaattctaacaacacgaatacaaattcagattcagattcaaacactaactcaacgcctcccagtgaagatgacgacgacaacgacaggttaactttggaaaacctaacacagaagaagaaacaatcagcgaactga

SEQ ID NO: 16033 - protein, 424 aa, Saccharomyces cerevisiae
MANPTTGKSSIRAKLSNSSLSNLFKKNKNKRQREETEEQDNEDKDESKNQDENKDTQLTPRKRRRLTKEFEEKEARYTNELPKELRKYRPKGFRFNLPPTDRPIRIYADGVFDLFHLGHMKQLEQCKKAFPNVTLIVGVPSDKITHKLKGLTVLTDKQRCETLTHCRWVDEVVPNAPWCVTPEFLLEHKIDYVAHDDIPYVSADSDDIYKPIKEMGKFLTTQRTNGVSTSDIITKIIRDYDKYLMRNFARGATRQELNVSWLKKNELEFKKHINEFRSYFKKNQTNLNNASRDLYFEVREILLKKTLGKKLYSKLIGNELKKQNQRQRKQNFLDDPFTRKLIREASPATEFANEFTGENSTAKSPDDNGNLFSQEDDEDTNSNNTNTNSDSDSNTNSTPPSEDDDDNDRLTLENLTQKKKQSAN

SEQ ID NO: 16034 - DNA, 1065 bp, Schizosaccharomyces pombe
  CDS (1)..(1065)
atgtattgtaatttagctaaaatgtatgaagtggaaccatctgaaaaagaagataatgtagaaagacagacgaagaagtataatttcgagattgatgaacctgaagaacaagaaaagaaagatgagaaggaagatgataaagaggaaagcccttctaaatctttggaagagatatctcaatcagtttcacctgtagaggaggagcctcgtgatgttcggtttaaagagctgtccactccttttagttaccctatcaatgatcctcctgagggtcgtcctgttcgagtttacgccgatggagtttttgacttgtttcatattgggcatatgagacaactagaacaggccaaaaaagtatttcctaatgtgcatcttattgttggtcttcccaacgatcaattgactcatcgccttaaaggattaacagtgatgaatgacaaggaacgagctgaagcccttcgacattgtaagtgggttgacgaggtcttagaaaatgcaccttgggtaattaccccagaatttttggaagaacacaagattgattttgtcgcccacgacgacattccatatgctagcgatgattccggagatatctatcttccggttaagaaggttggtaaatttattcctacaaagcgtacagagggtgtttctacatccgatctcattactcgaattattcgggactatgatcaatatgtgatgcgaaaccttgctcgcggtgtaaaccgaaaggaattaaacgtttcgttgtttaagaagaatgaacttgatcttagacaccacattaaggttcttcgtgatacattgagaaatcactgggtttctacaactcgtgatctgaaggctgatatcaaatcatttttgtcaatggcgactaccgattatcaattgcagaagaatcctctgcacggctctagtgaaccttcaagtcctggtcccacaggatttttaggtggtatcaatcgttggatgcaacgtaggtctagcagtcattatgacttacctcgtgtcggcaatgagatagctgcttcaagctcttcagcgactgaagaaaatcattaa

SEQ ID NO: 16035 - protein, 354 aa, Schizosaccharomyces pombe
MYCNLAKMYEVEPSEKEDNVERQTKKYNFEIDEPEEQEKKDEKEDDKEESPSKSLEEISQSVSPVEEEPRDVRFKELSTPFSYPINDPPEGRPVRVYADGVFDLFHIGHMRQLEQAKKVFPNVHLIVGLPNDQLTHRLKGLTVMNDKERAEALRHCKWVDEVLENAPWVITPEFLEEHKIDFVAHDDIPYASDDSGDIYLPVKKVGKFIPTKRTEGVSTSDLITRIIRDYDQYVMRNLARGVNRKELNVSLFKKNELDLRHHIKVLRDTLRNHWVSTTRDLKADIKSFLSMATTDYQLQKNPLHGSSEPSSPGPTGFLGGINRWMQRRSSSHYDLPRVGNEIAASSSSATEENH

SEQ ID NO: 16036 - DNA, 993 bp, Caenorhabditis elegans
  CDS (1)..(993)
atgcccaaggctattgtacaaggactgactccagatggagaaaaaaagaaagctcgagtgtatacagatggatgctttgactttgtacattttgcaaatgccagattattatggccagcaaaacaatacggaaaaaagctgattgttggtattcattcagatgacgagcttgacaataatggaattttaccaattttcaccgatgaggaaagatacagacttatttcggcaattcgatgggtcgatgaagcatttgaagacgcgccatttcaacccgagatgtcaacgctaaaccagctagattgtgatattattgcaataccaggcaagttggaaatcgctggtcgtctcatgcttgtcacaaaaaagcatcacatggaaaccgattcaatcttggatttcaaaagcgctattcttccgtttgccctggatccgttgagcaacgagcctgtcatatcggtgtcccttttcaaacaaaactatacgtttgcacctgtcgtcatcggaaggaaaccgaaagtaacagacaaggttgtttatgttagcggagcgttcgatttatttcatgcggggcacctgtcttttttggaagcagcgaaagatcttggagactatctgattgttggaattgtgggagatgatgacgtaaatgaagaaaaaggaacaattttcccggttatgaaccttctcgaaagaacactgaacatatcatcactgaaaattgttgatgaagtatttgttggtgttccggcagtgacaaattccaagtttgtgaatttgattcgagcatcgaaaatcgcagtgtactctgaaacccacccacggcggtttgcagactgcacgtatcatagaattatagaagaagtaacaccagattatgatgcaacatgtgaagaaatactggagcgaatcacgtccagaaagattgcatcatcggatgacgacgaaatcgcaatgttcaacgcagttccattgaataacaaccaacattga

SEQ ID NO: 16037 - protein, 330 aa, Caenorhabditis elegans
MPKAIVQGLTPDGEKKKARVYTDGCFDFVHFANARLLWPAKQYGKKLIVGIHSDDELDNNGILPIFTDEERYRLISAIRWVDEAFEDAPFQPEMSTLNQLDCDIIAIPGKLEIAGRLMLVTKKHHMETDSILDFKSAILPFALDPLSNEPVISVSLFKQNYTFAPVVIGRKPKVTDKVVYVSGAFDLFHAGHLSFLEAAKDLGDYLIVGIVGDDDVNEEKGTIFPVMNLLERTLNISSLKIVDEVFVGVPAVTNSKFVNLIRASKIAVYSETHPRRFADCTYHRIIEEVTPDYDATCEEILERITSRKIASSDDDEIAMFNAVPLNNNQH

SEQ ID NO: 16038 - DNA, 1447 bp, Arabidopsis thaliana
  CDS (111)..(1106)
aaaattaaaaaaaaaaagagtaggagaagagggaagcgactagcaccttttgtagttttccgtttattttctgtataaggcgggtgatctcggctccttcatcggaaattatgagcaacgttatcggcgatcgaactgaagacggcctttccaccgccgctgcctctggctctacggctgtccagagttctcctcccactgatcgtcctgtccgcgtctacgccgatgggatctacgatcttttccactttggtcatgctcgatctctcgaacaagccaaattagcgtttccaaacaacacttaccttcttgttggatgttgcaatgatgagactacccataagtacaagggaaggactgtaatgactgcagaagagcgatatgaatcacttcgacattgcaagtgggtggatgaagtcatccctgatgcaccatgggtggtcaaccaggagtttcttgacaagcaccagattgactatgttgcccacgattctcttccctatgctcattcaagcggacgtggaaaggatgtctatgaatttgttaagaaagttgggaggtttaaggaaacacagcgaactgaaggaatatcgacctcggatataataatgagaatagtgaaagattacaatcagtatgtcatgcgtaacttggatagaggatactcaagggaagatcttggagttagctttgtcaaggaaaagagacttagagttaatatgaggctaaagaaactccaggagagggtcaaagaacaacaagaaagagtgggagaaaagatccaaactgtaaaaatgctgcgcaacgagtgggtagagaatgcagatcgatgggtccctggatttcttgaaatatttgaagaaggttcccataagatgggaactgcaatcgtagatcagtatccaagaaaggttaatgaggcaaagtcggcagagaggctggagaacggtcaggatgatgacacagacgaccagttctatgaagaatacttcgatcatgacatgggtagtgacgatgatgaaggggaaaaattctacgacgaggaagaagtaaaggaagaagagacagagaaaaccgttatgacggatgctaaagacaacaagtaagaacaaatttggcttgcagaaacctcagattagctctacttatggccacttctactaaactcccttaagcctcgcactctctctcgaaattcatctacttaacatataataccaatgtttagaaagagagagtgtgtgatgtgtttgtttgtgtgtgttgaacaaacgaacgtgtgtggttgtctttggtgagttggtctcatctttgttgatttttgaatgcgcatgtatttttttcttctttttctagacgggcaaagtgttatacaagaacaatgcaattgtctaaaacaggataagtcaatggttcgtgtgtgccataaagtaaaaaaaaaaaaaaa

SEQ ID NO: 16039 - protein, 331 aa, Arabidopsis thaliana
MSNVIGDRTEDGLSTAAASGSTAVQSSPPTDRPVRVYADGIYDLFHFGHARSLEQAKLAFPNNTYLLVGCCNDETTHKYKGRTVMTAEERYESLRHCKWVDEVIPDAPWVVNQEFLDKHQIDYVAHDSLPYAHSSGRGKDVYEFVKKVGRFKETQRTEGISTSDIIMRIVKDYNQYVMRNLDRGYSREDLGVSFVKEKRLRVNMRLKKLQERVKEQQERVGEKIQTVKMLRNEWVENADRWVPGFLEIFEEGSHKMGTAIVDQYPRKVNEAKSAERLENGQDDDTDDQFYEEYFDHDMGSDDDEGEKFYDEEEVKEEETEKTVMTDAKDNK

SEQ ID NO: 16040 - DNA, 951 bp, Candida glabrata
  CDS (1)..(951)
atgactgtgcatttgtgggaagagaaagtttggatagacgggtgctttgatttcacgcatcacggacacgctggtgtgttcttgcaagctcggcaaaccatcgaccctgaggttagcggtggcaacgacgcgctgatctgcggtatccacagcgatgaggacatacgcgtcaacaagggttgtttgccggtgatgcaggagcgggagcggtacgagcatgcgcgggcgaacaggtggtgcgaccaggtcatagaaggtgctccctacgtgacgcatccagacgtgatgaacaagtacggatgcatgtatgtggtgcatggggatgacattactttggacaaagacggcaacgactgctaccaggagatgaaggactgcggcaggtacaagtgtgtgaagcgtaccgctggtgtgagcacgagtgacataatccagcggatccttactgggtcgcgtgaccaccactcgcgtcccgatgaagttgtgactctggaggagctgaccaagtacagttacgaccgtgacgggtacggcccaggctgcactgtgtatagagaaaccctggacaatatagtggtacggggcaagaccgtacccgagcgtctagtgatagtggagggcaattttgacctattccacattggccacatcagtaagttcaagaagatcagagctgatcatccggataggcatgttattgtgagtgtgcgtacgaacgaagacgatatcatgacgctaaaggagaaagcactcagtatcctgagctgcaagtacatcgacggcgtggtgcttgatttagacatgggcactcttgccaccgacatcgtcaccatccagatcgacgatatagatggcggtgaattcgactacttaaccaaggaaaccatagtgaacaggataatatcgcaaagagatgagtatgtatcgcggaataaacgcaagggtttctaa

SEQ ID NO: 16041 - protein, 316 aa, Candida glabrata
MTVHLWEEKVWIDGCFDFTHHGHAGVFLQARQTIDPEVSGGNDALICGIHSDEDIRVNKGCLPVMQERERYEHARANRWCDQVIEGAPYVTHPDVMNKYGCMYVVHGDDITLDKDGNDCYQEMKDCGRYKCVKRTAGVSTSDIIQRILTGSRDHHSRPDEVVTLEELTKYSYDRDGYGPGCTVYRETLDNIVVRGKTVPERLVIVEGNFDLFHIGHISKFKKIRADHPDRHVIVSVRTNEDDIMTLKEKALSILSCKYIDGVVLDLDMGTLATDIVTIQIDDIDGGEFDYLTKETIVNRIISQRDEYVSRNKRKGF

SEQ ID NO: 16042 - DNA, 1209 bp, Candida glabrata
  CDS (1)..(1209)
atggccaaactatctagaactacatctttgaagaaaaggctctcaaactcttcctttacaaaattgttcaaagctaagcgtaagagagaggacgatgaggatagtactactgacagtgctgatcatgaagagacccctgggaaggagaacagggaaatagctactccttctgctaagcgtcatcgtccaattagtaaagaacaacaggagttcgagaaaaaggaggcattgctggatgctgagcttcctgaagagctaagaaaatacagacctaaaggttttaggcttaacatacctcctaaggatagacctattcgtatatatgcggatggtatctttgatctgttccatttgggacacatgaaacagttggaacaatgtaagaaggcgttccctaatgttgaattggtgtgtggtattccaagtgatgaggttactcacaaattgaagggtcttactgtcctaactgacaagcaacgttgtgagacactaatgcattgtaaatgggtggacgaagttgttccaaatgcaccatggtgtgtaacaccagagttccttgccgaacataagatcgactatgtagctcacgatgacattccatatgttagtagcgatagtgacgatatctataaaccaatcaaagagcttggtaagtttttaactacccagcgtacagacggtatatctacaagtgatattattaccaagattattagagactatgacaagtacttgatgagaaattttgctcgtggtgctacaagacaggaactgaacgtgtcatggttgaagaaaaatgagctggagtttaagaaacacatcagtgattttagatcgtacttcaagaagaaccaaggtaacttgaataatgcgtcaagagatctgtatttcgaagtcagggagatcctattgagaaagacgttgggaaggaagctatactcaaagctgctgggagacaagcacattccaagaagtattgcattgggatccctttcggcaacctcagatgaagaagagcagagtgatgatttgcctgagccaaagagaaagaagatgctattgatcagagaaccatccccagcaaccgagttcgctagcaaatacacaggtgctaaggtaaccaaacaagaatcggaggaggacgctgaatcagaagatataaatgatgaagatgatgaagaagaagcggatgaagaagacagccattga

SEQ ID NO: 16043 - protein, 402 aa, Candida glabrata
MAKLSRTTSLKKRLSNSSFTKLFKAKRKREDDEDSTTDSADHEETPGKENREIATPSAKRHRPISKEQQEFEKKEALLDAELPEELRKYRPKGFRLNIPPKDRPIRIYADGIFDLFHLGHMKQLEQCKKAFPNVELVCGIPSDEVTHKLKGLTVLTDKQRCETLMHCKWVDEVVPNAPWCVTPEFLAEHKIDYVAHDDIPYVSSDSDDIYKPIKELGKFLTTQRTDGISTSDIITKIIRDYDKYLMRNFARGATRQELNVSWLKKNELEFKKHISDFRSYFKKNQGNLNNASRDLYFEVREILLRKTLGRKLYSKLLGDKHIPRSIALGSLSATSDEEEQSDDLPEPKRKKMLLIREPSPATEFASKYTGAKVTKQESEEDAESEDINDEDDEEEADEEDSH

SEQ ID NO: 16044 - DNA, 1370 bp, Oryza sativa
  CDS (107)..(1054)
gatgtgaaatctcgccgtctcctctcggagcctttcctcctcgccttctcccttctctctctctctctctctctctctctctctctctctcccgaaccttctcgccatggccgaccacgctgcggcggaggcggcgccgcagtcgtcgcaggaggaggaggaggactggaaggaggccgaggggggagacggggacgtcgaggtggcggacaggggcggcggaggcggcgccgccaatgggggaatcccggaggggaggccgatccgggtctacgcggacggaatctacgatctcttccacttcggccacgccaagtcgctcgagcaggccaagaggctgtttcctaacacatatctccttgtcggatgctgcaatgatgagttgacacataagtacaaagggagaactgttatgacagaggatgagcgatatgaatcacttcgtcactgcaagtgggtggatgaagtcattcctgatgctccatgggtggtaacggaagaattcttgaataaacataacattgattttgttgcacatgattctctgccgtatgctgatgctagtggagctggtaacgatgtctatgaatttgtcaaaaaacttggtaaatttaaggaaacccagcgcacagatgggatatcgacgtcagatattataatgcggattgttaaggattataatgagtatgttatgcggaacctggccagggggtacaccagaaaggatcttggtgtcagttacgttaaggaaaaaagactgagagttaacatgggattaaaaaacctgcgtgacaaagtgaagcagcaccaagaaaaagtaggggagaagtggaatacaatggcgaaactccaggaagagtgggtggaaaatgcagatcgatgggttgctggttttctggagaagtttgaagaaggctgccactcaatgggaactgccatcaaagagcggatccaagagaggctcaaggcgcaatccagggatttcagccttctacagtatgatggcgaggatgttgacgaggatgaggacgacgacgaatatgtcagagaataatgccaccactgtgaatatacgtcaagtataatatatgtacatgcgctgcatgtagcagatcttcaatccttgggcatgtcatgcacccctctctcttcaggaatggtgaacttgtgccccccaggttagattttggtgctgtgttgtagcaatagcaggtgttttgtttaggctaagacgcaaagtaagcctgtaaaatcccctagtcgatggcctgaatggttatctggaagatacagatatgttcaattatatttttgtttagcacacaagaacactatatttcaattgactatctactatatttcaattgact

SEQ ID NO: 16045 - protein, 315 aa, Oryza sativa
MADHAAAEAAPQSSQEEEEDWKEAEGGDGDVEVADRGGGGGAANGGIPEGRPIRVYADGIYDLFHFGHAKSLEQAKRLFPNTYLLVGCCNDELTHKYKGRTVMTEDERYESLRHCKWVDEVIPDAPWVVTEEFLNKHNIDFVAHDSLPYADASGAGNDVYEFVKKLGKFKETQRTDGISTSDIIMRIVKDYNEYVMRNLARGYTRKDLGVSYVKEKRLRVNMGLKNLRDKVKQHQEKVGEKWNTMAKLQEEWVENADRWVAGFLEKFEEGCHSMGTAIKERIQERLKAQSRDFSLLQYDGEDVDEDEDDDEYVRE

SEQ ID NO: 16046 - DNA, 1287 bp, Oryza sativa
  CDS (1)..(1287)
atgggtttgctagcgtttgagagcaaccaagggctctggaatagtggatattattcccagctgtttgggattggaggagttatggtcactgttgccattctttggttatcgacaggctactttggaggaattggtgctccttttgccccatatttttggccatatctagcacaacttccaaagaagaaggaacggaaaaggcctgtgagagtgtacatggatggatgctttgacctcatgcattatggccatgcaaatgcattacggcaggccaagttgttgggagatcaacttgtagtgggagttgttagtgatgaggagattgtggcgaacaagggtccacctgtgctttcaatggaagagaggttgacacttgttagtggattgaagtgggtggatgaggtcattcccaacgcgccctatgagatcacggaagaatttatgaataccctcttcaataaatataacattgattacattatacatggagatgatccttgtcttctacctgatggaacggatgcttatgcgttggcaaagaaggttggacgctacaagcaaatcaaacgcactgaaggtgtctcaagcactgatatagtcgggaggatactactgacattcaagcagaaagaagctggcagtatggaagctaccacagatgcaaatgttgctgtcaatcagaacactggagctgatacatatgataaagtgaaaagtcagctatccaattttcttccaacatctcgccggataatgcagttttcaaatggacaggctcctttgccaggtgctcgcgttgtgtatatagatggtgcttttgacctttttcatgccggccatgttgagatcctcagaagtgctaggcaacttggtgacttccttcttgttggtgtccatgatgaccaggcaatcagggatagaagagggtatcgtcctatcatgcacctccacgagcgtactcttagtgtacttgcatgtcgctatgttgatgaagttataataggcgccccatgggaggtttcaagggatatgatcactacatttaacatttcattggttgtgcatgggacagtaaccgagggtagttctgtggtcggtattgatccatacgccgttccaaagagcatgggtatcttccaaacaatcacaagccccaaacctataacaacagtttcagttgctaccagaataattgataaccatgaagcttacaagaaaaggaacttgaaaaagaaggcaagcgaagatagatactacacacaaaagaaatttgtctctggagattaa

SEQ ID NO: 16047 - protein, 428 aa, Oryza sativa
MGLLAFESNQGLWNSGYYSQLFGIGGVMVTVAILWLSTGYFGGIGAPFAPYFWPYLAQLPKKKERKRPVRVYMDGCFDLMHYGHANALRQAKLLGDQLVVGVVSDEEIVANKGPPVLSMEERLTLVSGLKWVDEVIPNAPYEITEEFMNTLFNKYNIDYIIHGDDPCLLPDGTDAYALAKKVGRYKQIKRTEGVSSTDIVGRILLTFKQKEAGSMEATTDANVAVNQNTGADTYDKVKSQLSNFLPTSRRIMQFSNGQAPLPGARVVYIDGAFDLFHAGHVEILRSARQLGDFLLVGVHDDQAIRDRRGYRPIMHLHERTLSVLACRYVDEVIIGAPWEVSRDMITTFNISLVVHGTVTEGSSVVGIDPYAVPKSMGIFQTITSPKPITTVSVATRIIDNHEAYKKRNLKKKASEDRYYTQKKFVSGD

SEQ ID NO: 16048 - DNA, 942 bp, Ashbya gossypii
  CDS (1)..(942)
atgctagatccaaggtacgtttggattgacggctgcttcgacttcacgcattacggccatgcggctgccatgctacaggcgcggcagaccattgcgccgggcgatttgccctcacgcctgtttgcaggtgtccatagtgacgcagagatcgcgcaccacaagggcgccccgccagtgatggaggaggaagagcgctatatgcacgtgcagcacatccgctgggttgatgagatcgtgaaagacgcgccatacgttacggaacccgccgtcctggactactatgcatgccaatacgtggtccatggcgatgacatcacccttgacgcagaaggccacgactgctaccaagaggtgaaggatttgggtcgcttccaggtggtgaaacggacctgcggcgttagcaccactgagcttatccagcgcatgctggacggcccgcgaccacaagcgcccatggagcccgttgatgcctcaacattgcgactgttcgcgacagcacgtgacggattcagcccttggtgctgggtcttcgacggcacgctcgaccgctgcctcgttgagggcggctttgtgtgggaaccgcaaacggcggtatacgtggaggacaactttgatttgttccacgctggccacatcgagcggctcgcccgtgtacgtgatatcgcaggtgcggagcgcctagttgttggggtgcaagccgcgcccaacgcttacatgaccctgcgcgagcgcgtactcggggtactgagctgcgacgcggtcgatgcagtcgtcgtggcgcccgcggccgacgtgactgctgagttgcgctccttctgtctgcacgaccccgcgctgaacggcgtcttcgcggggcttaccagcagcgcaattgccgcgcgcgtgaccgcgcagcgcaaccgctacgcagcgcgcaacagggcaaagggcatagtatcgtaa

SEQ ID NO: 16049 - protein, 313 aa, Ashbya gossypii
MLDPRYVWIDGCFDFTHYGHAAAMLQARQTIAPGDLPSRLFAGVHSDAEIAHHKGAPPVMEEEERYMHVQHIRWVDEIVKDAPYVTEPAVLDYYACQYVVHGDDITLDAEGHDCYQEVKDLGRFQVVKRTCGVSTTELIQRMLDGPRPQAPMEPVDASTLRLFATARDGFSPWCWVFDGTLDRCLVEGGFVWEPQTAVYVEDNFDLFHAGHIERLARVRDIAGAERLVVGVQAAPNAYMTLRERVLGVLSCDAVDAVVVAPAADVTAELRSFCLHDPALNGVFAGLTSSAIAARVTAQRNRYAARNRAKGIVS

SEQ ID NO: 16050 - DNA, 1206 bp, Ashbya gossypii
  CDS (1)..(1206)
atggggcctgtgacgcgccagggctcgttgaaacagcggctagccaactcgtcgctcacaaatttgttcaacctgaaccgcaagcggcggcatggggagctggaagacggggaggacggcgttgtcggggtgcggcggtcgcggcgggccagcgtgcgcagctgcaacggggagctggcggaggggtcggagtcggacgaggagcgccggcacagccgtaagcggcggcacacagagcgagaggagcaggagcggcggtacgatgaggcgatcccggaggaattccggaagttccggccgcgcgggtttccgttcaacctcccgccgcaggaccgcgcggtgcgggtgtatgcagacggggtgtttgaccttttccacctcgggcacatgaagcagttggagcagtgcaagaagtcctttgagaacgtaacgctcatctgcggcgtgcccagcgaccgcatcacgcacaagctcaagggcttgaccgtgctcacggacaagcagcgctgcgagtccttgcgccactgccggtgggtcgacgaggtcgttgaggacgccccgtggtgtgtgactcccgagttcctcgaactgcacaaaatcgactatgtagcacacgatgacatcccctacacgagcggcgatagcgatgacatctaccgccccatcaagcagatgggcaagttcttggccacccagcgcaccaacggcatttcgacgagcgacatcataaccaagatcatccgcgactatgacaagtacttgatgcgcaacttcgcgcgcggtgcgtcgcgccaggagttaaacgtctcctggctcaagaagaacgagttggagtttaagaaacacatacaggatttccgctcttacttccgcaaaaaccaggagaagctcaatgacgcgtccaaggacctttacttcgaggtgcgcgaaatgcttttgaagaagacgctagggcgcaacctgtactccaagcttgttggccccgcgggcccgcccgaaaagcgcggcaagctgcaggaggcttctcccgcaactcaattcgcacacatatacacgggcgaggcccctgcgattgccggccaggcgatgctaccctccagcgagagtgacgatgaaaatatcaaccgcgcgggctcggtgctgtcccacctgaaccggtggctctcgcaggagacaccccactatacgacagaggagagcgaataa

SEQ ID NO: 16051 - protein, 401 aa, Ashbya gossypii
MGPVTRQGSLKQRLANSSLTNLFNLNRKRRHGELEDGEDGVVGVRRSRRASVRSCNGELAEGSESDEERRHSRKRRHTEREEQERRYDEAIPEEFRKFRPRGFPFNLPPQDRAVRVYADGVFDLFHLGHMKQLEQCKKSFENVTLICGVPSDRITHKLKGLTVLTDKQRCESLRHCRWVDEVVEDAPWCVTPEFLELHKIDYVAHDDIPYTSGDSDDIYRPIKQMGKFLATQRTNGISTSDIITKIIRDYDKYLMRNFARGASRQELNVSWLKKNELEFKKHIQDFRSYFRKNQEKLNDASKDLYFEVREMLLKKTLGRNLYSKLVGPAGPPEKRGKLQEASPATQFAHIYTGEAPAIAGQAMLPSSESDDENINRAGSVLSHLNRWLSQETPHYTTEESE

SEQ ID NO: 16052 - DNA, 1076 bp, Oryza sativa
  CDS (43)..(888)
aaaaaaaaaaaaaagtaggctttgggatcgccgccggtgacgatgaagccactgaaggacgcggacgcgcaggagaaggcggcgccgccgccgacggagtggtacgacccgctgtcgtcgccggggcggccggtcagggtgtacgccgatggcatctacgacctcttccacttcggccatgcccgcgccctcgagcaggccaagaaatcattccccaacacatatttgctcgtgggctgctgcagcgacgagatcaccaacctttacaaaggcaagaccgtcatgactgaagacgagcgctacgaatcgcttcgccattgcaagtgggtggatgaggtgataccagatgctccatgggttatcaatcaggagttcctagacaagcaccgcatcgactacgtcgctcatgatgctcttccgtatgcggacaccagtggagctgccaatgatgtctatgaatttgtgaaggccgttgggaagttcaaggagacgaagcgcaccgagggcgtctcgacgtctgacatcatcatgaggatcttgaaggactacaaccagtacatcatgcgaaatctgacccggggatactcccgcaaagacctcggtgtgagctatgtcaaggagaagcaacttagagtaaacatggggatcagcaagctaagggagaaggtgaaggagcatcaagagaagtttcacagcgcggcaaagatagctggaagcaatcctgtggagtggatggagaatgccgaccgttggatcgttgggtttcttgaaaagtttgaggaaggttgccacatgatggaaaccgcgattaaagatcggattcaggaggggctgaagaggcaaagcaggtcggaccccaacctttctggggaggattccgactcataatggatcctgtaatatccagatcaaactgggaagagaaaaaattgtggagatcatttctagccttgtgtgagattagcctcatgttgtaggacaattaaagtgaccgtgcatggtttgtttgtaccaaaaggttttgtacttctgagaacaataataatagttcgtgcaattactgctcaaggttatcc

SEQ ID NO: 16053 - protein, 281 aa, Oryza sativa
MKPLKDADAQEKAAPPPTEWYDPLSSPGRPVRVYADGIYDLFHFGHARALEQAKKSFPNTYLLVGCCSDEITNLYKGKTVMTEDERYESLRHCKWVDEVIPDAPWVINQEFLDKHRIDYVAHDALPYADTSGAANDVYEFVKAVGKFKETKRTEGVSTSDIIMRILKDYNQYIMRNLTRGYSRKDLGVSYVKEKQLRVNMGISKLREKVKEHQEKFHSAAKIAGSNPVEWMENADRWIVGFLEKFEEGCHMMETAIKDRIQEGLKRQSRSDPNLSGEDSDS

SEQ ID NO: 16054 - DNA, 1743 bp, Plasmodium yoelii yoelii
  CDS (1)..(1743)
atgtcgagtgaatttttagttgatacaatttataatcatgaatatttgaaaaaggttttaggcttaataaaaagtataaagaaaaataataagtttgattatattgaaaaaatatatgagcaatttaatatagaggaggacgaagaaatatataataaatttttcaatgaattggaaaacataaataataatggaactataaatagtaataatagacgacgtaacggaaattatataaataaatatgcctctgattataataataatgtaaattgttgtaacaataataatcatcattgttctggaaatcctccgattattcctgaagatgataaggatgctaatagctatttatcaaataattctgaggaaattaatgaatttgatatagactcatatgattcatcatttgaaaaaaaagccaaggaaaaaagaatatatgtggatggtatttttgacctatcgcattcaggtcatttcaatgctatgcgacaagccaaaaaattaggagatgttgttgtcgttggaattaattcagatgaagatgctttaaattcaaaaggcgttactccaatatatacacaagaagaaagaggagcattaatagcgggttgtaaatgggttgatgaggttattataggaacaaaatataatgtagatatggaattattaaaaaaatataattgtgattatgcagctcatggtagtgatattgcgtatgatcgcaatggagtatgctgctatgaagatgtgcaaaaaaataatcgattaaaagtatttgaaaggagttatggaatatcaactacaactattgtaaatcatttgttacaaatcgttagcaatgcaaatagaattggttcacctcatatacataatctaaaaaataataacctattagatgtaaaggatgaagaaaaaaataaaaattgtgatgcaaatagtatgggtagtgttgaaaatatcgcggataatataaattctacagaagataaaacaaatttaaaaaatggcaaaaatgattcaaacgacatagataacaataatatcaaaatggtaaaaggcgacaaaaaaaaaaacagtgatgttatgccatcaaatataaaaggtttaatgaataaaaataaaggctatatagcagcttcacaaatatatttatttatggaaaaacatgaaaaaaaaaagcatcataaagttgtatatgtagatggatcatttgatatgttccatttaggacatttaaaaattatagaaaatgctaaaaaattaggggactatttattagtaggaatatattcagatgaaactgttaggaaactcaaaggaaatcattttccaattacatcagtattagaaaggaccttaacggttttagctatgaaaggtgtcgacgatgtagttatttgcgcaccatgggtcataacagaaagttttattaaacgctttcaaattgacacagttgttagaggttctatatcagattataattattcgagttttggtcctgatccatatactatacccaagaaattaaatatatttaaggaaattccatcagaatcggatatgactacctttgaaataattagtagaattgaaaaaaacaaacaatatttgttgagtatcatctcagcaagaaaaaagaaagaagaaaacatttggaaaaataacaattcaaaaaaggagccctcatgttttttttttgctctatattattatatttgttttaatatttttaagagttaa

SEQ ID NO: 16055 - protein, 580 aa, Plasmodium yoelii yoelii
MSSEFLVDTIYNHEYLKKVLGLIKSIKKNNKFDYIEKIYEQFNIEEDEEIYNKFFNELENINNNGTINSNNRRRNGNYINKYASDYNNNVNCCNNNNHHCSGNPPIIPEDDKDANSYLSNNSEEINEFDIDSYDSSFEKKAKEKRIYVDGIFDLSHSGHFNAMRQAKKLGDVVVVGINSDEDALNSKGVTPIYTQEERGALIAGCKWVDEVIIGTKYNVDMELLKKYNCDYAAHGSDIAYDRNGVCCYEDVQKNNRLKVFERSYGISTTTIVNHLLQIVSNANRIGSPHIHNLKNNNLLDVKDEEKNKNCDANSMGSVENIADNINSTEDKTNLKNGKNDSNDIDNNNIKMVKGDKKKNSDVMPSNIKGLMNKNKGYIAASQIYLFMEKHEKKKHHKVVYVDGSFDMFHLGHLKIIENAKKLGDYLLVGIYSDETVRKLKGNHFPITSVLERTLTVLAMKGVDDVVICAPWVITESFIKRFQIDTVVRGSISDYNYSSFGPDPYTIPKKLNIFKEIPSESDMTTFEIISRIEKNKQYLLSIISARKKKEENIWKNNNSKKEPSCFFFALYYYICFNIFKS

SEQ ID NO: 16056 - DNA, 1605 bp, Neurospora crassa
  CDS (1)..(1605)
atgtcaccttctctgaactcgtcaacgcctcaggcttctgggaaacgcaagcgtagctctgctgccgcggacagcatcgcaaattccaacatcaacaccacacatcttgaccccgtcgacgccgccatcatgaaccaggaccagatcatccagaccgagtcccgcgacgcctcggctgaagagggcgacaccaccgcacccgagtcttcacgcactgccgctggccacagaaagaccgactcggccactagcagccatccgcctagcaagcgccagcgtcccaacaacgaccagctctcagaaggccccgccaccactgatgcgatagagcaggcccaggctatcgatcccggcgagcctagtgataccaccgaagccagtgatcacatcgccgaaagagtcacccgcaagagcagccgcaaggccacggtcggccagaacaatggcagtgaagacggagagacgggtggttacccaataatatccaagggcccggccatggcaccaccgcccattggaaagcttacccatcccgtgggatacaagacgaaccctcctcccgtgggtaggccagtcagagtatatgcggatggtgtcttcgatctgttccatctcggacacatgcgccagcttgagcaagcaaagaaggccttccccgaagtctacctccttgtgggcgtgacgggcgatgaggatacacacaagcgcaagggtttgaccgttttgtcaggcaaggagcgtgccgagaccgtccggcattgcaagtgggtggatgaagttatcgaggactgcccctggattgtcacacccgagttcctcgaggaacacaaaattgactatgtggcccatgacgacatcccctacggcgctgatgagggcgacgatatctatgcgcctatcaaggcggctggcaagttcctggtcacgcaacggacagagggtgtgagcaccactggcatcatcaccaagatcgtccgcgattatgaaaagtatattgctcgtcaattcaagcgcggcgcgtcgcgtcaagagctcaacgtcagctggctaaagaagaatgagcttgacctgaagaggcacatccaggatctgcgtgacaatatccgcagcaactgggctacgaccggacaggagctcagcaaggagctgcgccagttttggccgtctagtcgaccccaaagcccaagcccttcgggattcccccgactgcctccgcagctgttggctatggcgcagaacggcggtagcagcgccgatgtgtcgaatgctaccagtcccagtccccttggtccagcttcaggatcggcgcaagcaggtccctctaacttggcgcccaagagcccgacacaggcagctgcgcaggcagcaggaaacgtgaacgatttcatcacgggttatactcttggattggttgggggtgtacgatcttggatgagcaggacccgcgggccgagccaggaagacggtagtcgggcacccagcgatgatgactcggaagagggtgacaaaaagaaaagtaacgagaagcggaggtccaatgtcccggctggctccggtgcggcttcggcctcggcttctaccagccttgctcagaggcgtgtctga

SEQ ID NO: 16057 - protein, 534 aa, Neurospora crassa
MSPSLNSSTPQASGKRKRSSAAADSIANSNINTTHLDPVDAAIMNQDQIIQTESRDASAEEGDTTAPESSRTAAGHRKTDSATSSHPPSKRQRPNNDQLSEGPATTDAIEQAQAIDPGEPSDTTEASDHIAERVTRKSSRKATVGQNNGSEDGETGGYPIISKGPAMAPPPIGKLTHPVGYKTNPPPVGRPVRVYADGVFDLFHLGHMRQLEQAKKAFPEVYLLVGVTGDEDTHKRKGLTVLSGKERAETVRHCKWVDEVIEDCPWIVTPEFLEEHKIDYVAHDDIPYGADEGDDIYAPIKAAGKFLVTQRTEGVSTTGIITKIVRDYEKYIARQFKRGASRQELNVSWLKKNELDLKRHIQDLRDNIRSNWATTGQELSKELRQFWPSSRPQSPSPSGFPRLPPQLLAMAQNGGSSADVSNATSPSPLGPASGSAQAGPSNLAPKSPTQAAAQAAGNVNDFITGYTLGLVGGVRSWMSRTRGPSQEDGSRAPSDDDSEEGDKKKSNEKRRSNVPAGSGAASASASTSLAQRRV

SEQ ID NO: 16058 - DNA, 2550 bp, Aedes aegypti
  CDS (581)..(2074)
gctcggcgcgagtgtttttcgtttgtctttagcagctggtttgtcgacgagaggcgcattgatcatcaacagaagaaaagacgactttcttccggaagaaattccgagataaatcgtgacaccacggtaaataatcgaaaccgaactttgttcgtataggcaagtgcatttttgttgagtgacacacggaaggcggtcgaatattcggaacactggttgtggaatttgtgcgtggcttttgagctagaagaagagtgaagaaaattgatacagagcagtgacggagtgaaaatagtcgggagttcccttcggaaggtttttgaaactacagctgtgtggacaactggcgaatctcggcttgttatcatcgtaggcgccataaaggtcaccgctgaagccacaacgtgagccagtaaacgaacaagcaaaattgtggtgcaaccaaaatattgcgtcgtagttttgcgttcgttatcacacattctccctcgtgttatcatattatccagagcggggagaccagcctcctgaccaagtagactccacatcagcaaaactggcgtccacggcagcagtatcgatgcaagaggagcagcagcaggagcaacaaccggcagtaacaaacggcggtagaatgtctcgaaagcgaccacgcgacgcgacagtccccctgctgggacgatcagaagaatccatctcgattgaaattccgtcggatgaaccacaatcagagcaacaacaacaacccacaacaaatggcactaataataatggcactactccaagcaacggcgcgacacagaaacgtttcagcagcatccgcatcgacgacgatggaatggagacgggcagcagtgacaatttctggccccccaatgtggacagcattcggaatggacacgtgagcttcgacactccatcgtcttcgtcatcgaaaccgatgacagggcccacagtatcactttccagctattccaaacagttgggaagtggagttgaacacagcccaccagttacaatctgcaaaccggcaccgttctccgacgagctggatgccgttgccgagcgggaccgatgcgactacacagagaaaatcacctaccaaatggccagatccggtacggccccgcgaaggattcgcgtctacgccgacggaatctacgatctgttccaccagggccacgcccggcagctgatgcaggccaagaatgtgtttcgtaatgtgtatctgattgttggcgtgtgcagcgatgagctcacgcacagcaggaagggccgcaccgtcatgaacgacgacgaacgatacgaggcggtccggcactgtcgctacgtggacgagatcgttcgcgatgcgccctgggagctggacgacgagttcctcgagaagcacaagatcgacttcgtggcccacgacgagatcccgtacagctcggacgactgcaacgacatttacgccaacatcaaggcgcgcggcatgttcgtggcgaccgagcgaaccgaaggcgtcagcacatcggacatcgtggcccggatcgtcaaggactacgacatctacgtgcggcgaaatctggcccgcggctacacagccaaggagctgaacgtgtcgttcctgtcggagaagaagttccgcttccagaacaaaatggacgaactgaaggacaaggtgaagaagggcaagggagacatcatcagcaagtgggaggaaaagtccagcgacttcatccggacgttcctgctcatgttcggcaaggacagtcgaatctcaaacttctggtccgattcgaagaaaaggatcacatcggccttgagcccgcccggaagtcccaacgggggcagcaacagcagtttgcacgaatacggcgatgaggacgatgcggacagtcccgattcggtgctagattcgccaccgatgaagcgctcgaatctgatcagatctggactcatctctgggaggaatcacctctcggaaaccgaagacgacgaggaagaggaagaggaggaagaatttgtcgattcacgttcgcgacctgcttccaactacagtctggcagcgatagccaacggtcagcactaaggtgcacaattgcacgtgtgtatgagattgagatgagattttgtgttgtttgggcgtttgtttttggtctccgcgcaaatcgagttgattgcgccccgcttttttgcaagaaggaacagactggatctttaaccgacatggcaaagaatgtagatttaaaagcgaaagcaggaacgactgagactgagaatgcttgagttttgagtaaggatgcgtagctaaattttcctgcatattattacatatttatttaattataatcgcaaatctagagaaggttttgtttcttcctttcgatagcaatgtgtagatttcttttgtgttgcaaacatttatcgttatgattagctcttcatttcccttcaaaaaatatctaggctttagtgtttagcgttcccttaaagtacatcatattggttttctcattcaaaaaaaaaaaaaaaaaaaaaaaaaaaaaaaaaaaaaaaaaaaaaaaa

SEQ ID NO: 16059 - protein, 497 aa, Aedes aegypti
MQEEQQQEQQPAVTNGGRMSRKRPRDATVPLLGRSEESISIEIPSDEPQSEQQQQPTTNGTNNNGTTPSNGATQKRFSSIRIDDDGMETGSSDNFWPPNVDSIRNGHVSFDTPSSSSSKPMTGPTVSLSSYSKQLGSGVEHSPPVTICKPAPFSDELDAVAERDRCDYTEKITYQMARSGTAPRRIRVYADGIYDLFHQGHARQLMQAKNVFRNVYLIVGVCSDELTHSRKGRTVMNDDERYEAVRHCRYVDEIVRDAPWELDDEFLEKHKIDFVAHDEIPYSSDDCNDIYANIKARGMFVATERTEGVSTSDIVARIVKDYDIYVRRNLARGYTAKELNVSFLSEKKFRFQNKMDELKDKVKKGKGDIISKWEEKSSDFIRTFLLMFGKDSRISNFWSDSKKRITSALSPPGSPNGGSNSSLHEYGDEDDADSPDSVLDSPPMKRSNLIRSGLISGRNHLSETEDDEEEEEEEEFVDSRSRPASNYSLAAIANGQH

SEQ ID NO: 16060 - DNA, 2019 bp, Chlamydomonas reinhardtii
  CDS (193)..(1524)
agtgcgaacagttctaacacccactccgacatcagtgtctaacttgcttttgttggcagcgggaaagcaccttagattgacacatcaagcaggcgatactttcttcatagtgaaggggttcagctccgcggagacagtccacgttcacgttcgagtccggcgcccctgcgctgaactcagatcggcagccaaatggtcttactcgattcggtcaagcaaaatccattgctgtggacttgcgctgctggagtcgtcggcctgggcgtcagcctgctgtcatggaaagctgccaaggcagcggagctgtatgttccgattcagtaccaataccggccggggaccatcagcgggtggcttgcgaacgctctagccaaccactccaagagccggcgaaagcgccgccccgtccgcgtgtaccttgacggctgcttcgacatgatgcactacggccacgcgaatgcactacgccaggctaaggcggtgggcgatgagctggtggtggggctgatcaacgacgcggagattatgcgctgcaagggcccgcccgtcatgaacgaggaggagcggcacacgctggtggaggctgtcaagtgggtggacgagatcctcactggcgttccctacgatctgaacccggaatttgtgaacgagctgttcaccaagcaccggatagattacatcatccacggtgacgacccctgcttgctgccggatggctcggacgcgtacgcacacgcgaagaagctggggcgcttcaagatggtcaagcggacggagggcgtcagcaccactgacatcgtgggccgcatgctcacctgcagccgcgtcaaccacttcatcaacgcagatgagccgcacccgctggccaagtcgttcagcatgggcacgccgcgcgaggagtccaacgctgaggcctccaccagcgacgcctccacgcgcaccacgctgtccaagttcctgcccaccagccggcgcctggtgcagttctccaacggccgcgtggcaccggagggggcgcgcatcgtgtatatcgacggcgccttcgactgctttcaccctgggcacgtcaagatcctgcaggccgccaaggcccagggtgacttcctgctggtggggctgcacacggacgaggacgtgcaggcgcgccgcgggccgcacctgcccatcatgaacctgcacgagcgcagcctgtcggtgctgtcctgcaagtatgtggacgaggtggtgatcggcagcccgtgcgtaatcacggaggacctgatgacgaccttcaacatcagcgtggtggtgcgcggctccatgtcggagaccagtatgctggggccagtggaggaggagcggtacgaggtgcctcgccgcatgggcctgttcacggagctgcccagccccagcgacgtgtcggcgcgcaacattatccaccgcatcgtggacaagcgcgcggctttcgaggcgcgcaacgccaaaaaggtcaagggcgaggaggcctactacaccggggccaagcagtacgtgcaggagttgtgaacggcgcccagcttggttaccgcggttcaggttgaaggcgctgcctggtgcacgtgtgagggttactgatgctcgaatagtgcgttttgtgtgtacgttgtatcgtatgtggctatggcgtcctgaggcggtttggtacggccgtcggaggaaaggcgtgaggcacaatgcgttggcgatgttttgatgtgggcgggaggtttgcgggatgcttgctgtgcgattgtgcgcgactgtggaccagggggcttctagctgacgagtatatgctgctttcaacgaaatgctgtggggcggatagccgccgccgctagtgacgtggacaagctcaggagcatggctgcaatgtgccgagtaggctctggtattgcgttgacgtgtattggacggacagacgaatggcgtaccgtaccgtttagacgacacaaacggatttacggacactgtatgtggctcatttcatcacactctgtaagatgataatgcaccaaaaaa

SEQ ID NO: 16061 - protein, 443 aa, Chlamydomonas reinhardtii
MVLLDSVKQNPLLWTCAAGVVGLGVSLLSWKAAKAAELYVPIQYQYRPGTISGWLANALANHSKSRRKRRPVRVYLDGCFDMMHYGHANALRQAKAVGDELVVGLINDAEIMRCKGPPVMNEEERHTLVEAVKWVDEILTGVPYDLNPEFVNELFTKHRIDYIIHGDDPCLLPDGSDAYAHAKKLGRFKMVKRTEGVSTTDIVGRMLTCSRVNHFINADEPHPLAKSFSMGTPREESNAEASTSDASTRTTLSKFLPTSRRLVQFSNGRVAPEGARIVYIDGAFDCFHPGHVKILQAAKAQGDFLLVGLHTDEDVQARRGPHLPIMNLHERSLSVLSCKYVDEVVIGSPCVITEDLMTTFNISVVVRGSMSETSMLGPVEEERYEVPRRMGLFTELPSPSDVSARNIIHRIVDKRAAFEARNAKKVKGEEAYYTGAKQYVQEL

SEQ ID NO: 16062 - DNA, 1783 bp, Hordeum vulgare var
  CDS (193)..(1458)
acagctccgtccgtctccgagacctcccacccatctcccatggcgaaggcccctccagccgcccgcccgcatccctaaccctaggctagatcccgccgcacctcgcgcgctcgcgagaccaaacacacgcctctgaccactcccccccagccccgctgactcctctgggaccgtgagtccattgctttacccatggattcggctagtaacaacgcgcggacggtggcggcgtgcgtgatcggcgggatcgtgctgggcgcctcggttgtcgcgctgcacctcggcgctggccccgcggccccgagtctgccaccggtcgaggccctccggcggcgcttccgccgccgctgccgccccgtgcgggtctacatggacggctgcttcgacatgatgcactacggtcactgcaacgcgctgcgccaggcacgggcgctcggggacgagctcgtcgtcggcgtcgtcagcgacgacgagatcaccgccaacaagggaccccccgtcacgccgctccacgagagaatgaaaatggtccgtgctgtcaaatgggttgacgatgtcattccagatgcaccatatgccataaccgaagatttcatgaacaagctattcaatgagtacaatattgattacattattcatggtgatgatccttgcctgctcccagatggtactgatgcatatgcccttgccaaaaaggctggccgatataagcagattaaaaggactgaaggagtgtcaacaacagatattgttggaagaatgctcctttgtgttagagagagaccagtttctgataataacagccactcttcactacaaagacagttcagtcatgggcatggtcagaatattgatgatagtggatttggaagtggaacaaaaatatctcattttcttcccacatctcggcggatagtacagttctcaaatggcaggggtccaggaccaaattcccgggtagtgtacatagatggtgcatttgatctgttccatgctggtcatgtcgagatactgcgacttgctcgagggcttggagatttcttgcttgtgggcattcacacagatcagaccataagttcaactcgaggaccacatcgcccaatcatgaatctccatgagcgcagtttgagtgttttggcttgccgttatgttgacgaagtgatcattggtgctccctggcacatttcgaaagacatggttaccacttttaatatttcattggttgttcatgggactatagctgagaacatggactatacagaggatgattcaaatccatatgctgttccagttgctatgggcatttatcataagctggagagccctttggacatcaccactagtactattataaggaggatagtttctaaccatgaagcctatcagaagcggaacgagaagaaggaagccagtgagaagaagtactacgacagtaaaagctttgtcaatggagagtagttacctatggatagatcttctcagaagactggtcctaaatcttcgaggctctaacacaggtcacaaatgaagccattaggtgatctacagttttacccgctccattggcatttttgctatatagcttagtagccttcaaatgcaatcttgatgcatgataggcaatggcgctgagttgggtgcggaacctggatgaatttccaatgcccacttccagtgctagtacctaccctattcccaccctgtataccggcttccagagctgccgttaccggctgagttctttttgagatctatagttgttcgagaaaaaaaaaaaaaaaaa

SEQ ID NO: 16063 - protein, 421 aa, Hordeum vulgare var
MDSASNNARTVAACVIGGIVLGASVVALHLGAGPAAPSLPPVEALRRRFRRRCRPVRVYMDGCFDMMHYGHCNALRQARALGDELVVGVVSDDEITANKGPPVTPLHERMKMVRAVKWVDDVIPDAPYAITEDFMNKLFNEYNIDYIIHGDDPCLLPDGTDAYALAKKAGRYKQIKRTEGVSTTDIVGRMLLCVRERPVSDNNSHSSLQRQFSHGHGQNIDDSGFGSGTKISHFLPTSRRIVQFSNGRGPGPNSRVVYIDGAFDLFHAGHVEILRLARGLGDFLLVGIHTDQTISSTRGPHRPIMNLHERSLSVLACRYVDEVIIGAPWHISKDMVTTFNISLVVHGTIAENMDYTEDDSNPYAVPVAMGIYHKLESPLDITTSTIIRRIVSNHEAYQKRNEKKEASEKKYYDSKSFVNGE

SEQ ID NO: 16064 - DNA, 1032 bp, Homo sapiens
  CDS (1)..(1032)
atggaagaggacaatcgcgctccccaattgtggcgcaagaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagattgactttgtggctcatgatgacattccgtattcctctgctggctctgatgatgtttacaagcacataaaggaagcagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggaagcagatgttccaggagaggagcagccggatgctgcaggccttatccccgaagcagagccctgtgagcagcccaacccggagccggtccccttcccgctccccatcgcccaccttctcatggcttccactcaaaacctcacccccttcctcacccaaagcagcctcagcctctatcagcagcatgagcgagggggatgaggatgaaaagtag

SEQ ID NO: 16065 - protein, 343 aa, Homo sapiens
MEEDNRAPQLWRKTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWKQMFQERSSRMLQALSPKQSPVSSPTRSRSPSRSPSPTFSWLPLKTSPPSSPKAASASISSMSEGDEDEK

SEQ ID NO: 16066 - DNA, 2184 bp, Drosophila melanogaster
  CDS (423)..(1568)
ctgctctcacggtactcgaaattgtgagaaaagaaatgaaagaatctaaaaaaaaacccaagctaaacacaccgcacttacgccccaaagaagttcccatgcgcccgcgcgctgataacgcaagtctgagaatctgagaccaattccgctccgagtctgaacgtgaatccgagtccgaaaccgataacgaaaactgaactgagtagctcggtcgtgaaatgggaattgatatatagcgggcgtcgtcgtagctcagaacaaataacttacagctctcgaagcgtgaacgtcgctgtcgtcgagtttccgccttcaaaacgagcactgaaaacagaaacatactctccggaatctaatgttcgcccgttagccggattctaaattaaaattaaattaaattgtgaaaattcaataagtcaacgatggaggcaaatggcgataccagcgcctgcaatgggtattcggacaagcagcggaaggatgtgcgcgtctggtgcgatggatgctatgatatggtacacttcggacatgccaattctctgcgacaagccaaggctcttggcgataaggtaattgtgggcattcacaccgacgaggagatcaccaagcacaagggaccaccggtcttcaccgaggaggagcgcgtcaagatggtcaagggcatcaaatgggtggatgaggtggtgctcggtgctccgtatgtgaccacactggatgtgctcgaccagaacaactgtgatttctgtgtgcatggagatgacattacaatgacagccgaaggagtggacacatatcatttggtcaaatcagccaatcgctacaaggaagtgaaacgcacagctggagtctcgaccactgaccttgtgggccgcatgttgctcctgacacgcaaccacttccgtcaaggatccgcggaatatgatatcgagaaagaaggttcttcgaacatgggtcaagattcggcagccaaaagtccgtggaccggttgtagtcagttcttgccgactacccaaaagatcatacagttcagtgatggaaagtcaccgaatcccggcgataagattgtttatgtggctggcgccttcgatctcttccatgtgggtcacctggactttctggaaaaggctaagaaactgggtgactatctgattgttggcctgcacacagatcccgtggtgaactcctacaagggcagcaactatcccattatgaatctgcacgagcgcgtgctcagtgttttggcctgcaagtttgtcaatgaggtagtaatcggagctccctactgtgtcactgaagagctgcttgagcacttcaaaatcgatgttgtctgtcatggacgcacacccattgcgcttgagaatggcaagatcgatccatatgccgttcccaagacgcgagccatctttgagctgatcgattccggcaacgagatgaccacggagcgcatcgtggagcgcatcatctcgcaccgactggaatatgagcgtcgcaatcaggccaaagaaaagaaggaaatcgaagcctttgaggcacttcaacgccaaaaacagacccaaaaggccggctagccggaaccagattccgacctctcacactagacggatgttttttattttctagttgcgttcttttagtttgttttatttagtttgtcttgtttagtatgtcgtcccctgatgatggcgctttaattttttgttgcgtaaaaagcgaagcgacgctgcctgaggattcagcgcaccgctctctcgatttctagtacaattttagaatatctgcacatgcgccttaatgatataaggttatacacataattatatatttctaacacattaacgtagaatatttaaaatctaaattttatgtatgtaagctcaaaatttgtaaattccctttaaagtacgatgtaagtgtgaggaacaacaaaattgtacgaatagcatgttatccaaactgttgccgaattgaaaagccttgtacgacttgtatgtatatatattcagcaacggaagtaggatgcctggatcaggaagtagctgcttttatcaaatgtaatctctgatactttgtcctaatttattaatgcatatagtaagtgcgagttcaagttttatgtttccttgtttaatcttagacttaaatacatggccaaaaatattgcgaattccaaaaaaaaaaaaaaaa

SEQ ID NO: 16067 - protein, 381 aa, Drosophila melanogaster
MEANGDTSACNGYSDKQRKDVRVWCDGCYDMVHFGHANSLRQAKALGDKVIVGIHTDEEITKHKGPPVFTEEERVKMVKGIKWVDEVVLGAPYVTTLDVLDQNNCDFCVHGDDITMTAEGVDTYHLVKSANRYKEVKRTAGVSTTDLVGRMLLLTRNHFRQGSAEYDIEKEGSSNMGQDSAAKSPWTGCSQFLPTTQKIIQFSDGKSPNPGDKIVYVAGAFDLFHVGHLDFLEKAKKLGDYLIVGLHTDPVVNSYKGSNYPIMNLHERVLSVLACKFVNEVVIGAPYCVTEELLEHFKIDVVCHGRTPIALENGKIDPYAVPKTRAIFELIDSGNEMTTERIVERIISHRLEYERRNQAKEKKEIEAFEALQRQKQTQKAG

SEQ ID NO: 16068 - DNA, 1238 bp, Arabidopsis thaliana
  CDS (128)..(1045)
gaaaaaaaaaatccaatttagaaaaccgcgcgttggagggaaagccatagaaaactaaaagataacaaacattttaacaaacccaaacccaaaaattctcaaggaggccgaagaagaagaagaagaaatgagcgttaatggtgagaacaaggtctcaggaggagatagttcatcttcagatcgacctgttagagtctacgccgatgggatcttcgatttgttccatttcggccacgctcgtgccatcgaacaagccaaaaaatcgtttccgaatacgtatctgcttgttggatgttgcaatgacgaaattacgaacaaattcaaggggaaaactgtgatgactgaatctgagcgatacgaatctcttcgacattgcaagtgggttgatgaagtgattccagatgcaccatgggttcttacaacagagtttcttgataagcataagatagattacgtagctcacgatgctcttccctatgcggatactagtggagctggaaatgatgtttatgagtttgtaaagtcgattgggaagtttaaggagactaaacgaacagaggggatatcgacatctgatataatcatgagaatagtgaaagattataaccagtatgtgttgcgtaatctggaccgaggttattcaagagaagaactcggtgtcagcttcgttaaggagaagaggcttagagtgaatatgagattgaagaaactacaagagaaagttaaagaacaacaagaaaagatacaaaccgtagcaaaaactgctgggatgcaccatgatgagtggcttgaaaatgctgatcgttgggtggctggatttcttgaaatgtttgaggaaggttgtcataaaatgggaacagccatcagagatgggattcagcaacggctaatgaggcaagaatcggaagagaaccggcgattgcttcaaaatggactgacgatttccaaagacaatgacgatgaacaaatgtctgatgacaacgagtttgcagaagaagactgcgtcaatgtgagcaacaaagggattgaaacagtaaagaaatgagagattttgggtcatggttgaagtatttccagatacagaaccaaaatctactagatttcaccagtaatggtattaggcttgtttattcaactgtacatcaaactctgtttcaaaatctctacttgtgtctaaaactcaaatgcatcagaaatcaaaagcagtcatggatatatctatgatcaaacactccaaa

SEQ ID NO: 16069 - protein, 305 aa, Arabidopsis thaliana
MSVNGENKVSGGDSSSSDRPVRVYADGIFDLFHFGHARAIEQAKKSFPNTYLLVGCCNDEITNKFKGKTVMTESERYESLRHCKWVDEVIPDAPWVLTTEFLDKHKIDYVAHDALPYADTSGAGNDVYEFVKSIGKFKETKRTEGISTSDIIMRIVKDYNQYVLRNLDRGYSREELGVSFVKEKRLRVNMRLKKLQEKVKEQQEKIQTVAKTAGMHHDEWLENADRWVAGFLEMFEEGCHKMGTAIRDGIQQRLMRQESEENRRLLQNGLTISKDNDDEQMSDDNEFAEEDCVNVSNKGIETVKK

SEQ ID NO: 16070 - DNA, 969 bp, Encephalitozoon cuniculi
  CDS (1)..(969)
atggcatcccacgagatccagaaggtatgggccgatggatgctttgatatgttccattatgggcatgcaaacgccctgaggcaatcgaaggcgctcggagattacctgatagctggcgtccactcgtcactcagcataaaccaagaaaagggactgccggtgatggaggatgaggagaggtacgaggttgtggagggatgtaggtatgtggacgaggtggttagggacgctccgtttgtcacacagacaagcatgattaaggagtatggagtaagcatagtggcgcatgggaatgatatagtactcgactcaagcggacaggactcatattgccaggtcaggagaatggggatcttcagagaagttgaaaggaccttcgggatatcgacgacggagatagttggcaggatgatgctgaagaacagaggaagctggctggatggggaaaatggagagtccagcaaggattccgggtaccatgataggctgcttagtctatttatgagctccatgggcagggagaagagggggaaggttgtttttatggacggaaactttgacctgttccatgcagggcatgttgcgtcgctgaggatagcaagaggaatgggagactatttgattgttgggatacacgacgacgagaccacaaaggagtacactaggagctatcctgtgctaagcacgaaagaaaggatgctcacactgatggcgtgtagatacgttgatgagattgttgtatcgccatatctggttgggagcgagtttattaagaggcatggaatcgatgttgtggcgccttctttcgattcaaaggatctatcgaggtatgacgggattaaggacgtagtggagcacagctacgccgaaaataggttcaactacctctctgcagagcacatagtcaacaggataatatctaattaccaagactatgcaaacaggcagaagaagagaacaggaaaataa

SEQ ID NO: 16071 - protein, 322 aa, Encephalitozoon cuniculi
MASHEIQKVWADGCFDMFHYGHANALRQSKALGDYLIAGVHSSLSINQEKGLPVMEDEERYEVVEGCRYVDEVVRDAPFVTQTSMIKEYGVSIVAHGNDIVLDSSGQDSYCQVRRMGIFREVERTFGISTTEIVGRMMLKNRGSWLDGENGESSKDSGYHDRLLSLFMSSMGREKRGKVVFMDGNFDLFHAGHVASLRIARGMGDYLIVGIHDDETTKEYTRSYPVLSTKERMLTLMACRYVDEIVVSPYLVGSEFIKRHGIDVVAPSFDSKDLSRYDGIKDVVEHSYAENRFNYLSAEHIVNRIISNYQDYANRQKKRTGK

SEQ ID NO: 16072 - DNA, 837 bp, Encephalitozoon cuniculi
  CDS (1)..(837)
atgaagaaggatgacgcctcagaggagtacaggatgatgatgccctcgtatcctgataggaacgcctttgagtacgaggatatgaccaccgatgtcgggatgtacagggtgcctgtgaatagacctgtcaggatatactgtgatggggtgtacgacctatttcattatgggcatgcgaggagtttgaagcaagctaagaatctttttccaaatgtctatctactagttggggttactgatgacgacataacggtgaggctcaagggaaaccttgttatggatgagaacgaaagggcagaggggctgatccactgcaggtatgtcgacgaggttataacaagcgcgccatgggaactgaccctggaatttctgcagaagcacaagatagactttgttgcgcatgacgacatcccctataaaggagaggacaaggacgatatctacaagtttgtgaaggacatggggatgtttataccgatcagaagaacaaaggggatcagtacaagtgggataataacaagtattgtgaagaactatgacatgtatgtcaggagaaatcttgaaagaggagtttctgcaaaggacctgaacatatcatttctccagatgaaaagaataaagatgagcaagaaaatgaatgaaatgatcaagaatgttgacattcagagggaaatagacgacataaggagggagatacgaattgcaatgagatactgggaaagggtgtcgaacgagattatctctgggtttatagaaaacttctatcatggaaaaagctccaacagattcattgaccgattggtggggcttgtgaagcttaagaaagagaatgcatag

SEQ ID NO: 16073 - protein, 278 aa, Encephalitozoon cuniculi
MKKDDASEEYRMMMPSYPDRNAFEYEDMTTDVGMYRVPVNRPVRIYCDGVYDLFHYGHARSLKQAKNLFPNVYLLVGVTDDDITVRLKGNLVMDENERAEGLIHCRYVDEVITSAPWELTLEFLQKHKIDFVAHDDIPYKGEDKDDIYKFVKDMGMFIPIRRTKGISTSGIITSIVKNYDMYVRRNLERGVSAKDLNISFLQMKRIKMSKKMNEMIKNVDIQREIDDIRREIRIAMRYWERVSNEIISGFIENFYHGKSSNRFIDRLVGLVKLKKENA

SEQ ID NO: 16074 - DNA, 552 bp, Caenorhabditis elegans
  CDS (1)..(552)
atgccgttcctccagcctgctccgttgactgatgattctactgttattgcaaaacgaaacttgattgattattccgagaaaatctccatggaaaatgccagaaatggattgtcaagtcgcccgatccgtgtctacgctgatggaatctatgatatgttccactacggtcatgccaagcagctcttgcaaatcaagcaaatgtttccgatggtttatctgattgttggcgtgtgctccgacgaaaacactttgaaattcaaaggtccgactgtgcaatcggaaaacgaaagatacgaatctgtgagacaatgtagatatgtggatgaggtgctcaaagatgctccttgggaagtcagcgtggactttttggaagagatgaagatgtatgcggagcacaaagctgctggaagatttttggagactacgagaaccgagggagtgtccacaagtgattcgatttgcaaaatcattcgagatcgtgatgagctcgcaagaaattataatctggaagctggagtttttgcggtaggaaaaactatatattttaattga

SEQ ID NO: 16075 - protein, 183 aa, Caenorhabditis elegans
MPFLQPAPLTDDSTVIAKRNLIDYSEKISMENARNGLSSRPIRVYADGIYDMFHYGHAKQLLQIKQMFPMVYLIVGVCSDENTLKFKGPTVQSENERYESVRQCRYVDEVLKDAPWEVSVDFLEEMKMYAEHKAAGRFLETTRTEGVSTSDSICKIIRDRDELARNYNLEAGVFAVGKTIYFN

SEQ ID NO: 16076 - DNA, 2229 bp, Oryza sativa
  CDS (1)..(2229)
atggattcgagggccgggggcgacgtctcgcccgggcccgcgctaggagacaactggcggcagagggggccggtgacgctggcgagcatagcagtgtattgcagcttccaccaccaccctccccctccactccggtcaccggcgccgcgccgacctcgtcgtcctcggcgtcctccccagcagcgcaccaacatcgccacgtccgccatcaccgatcttcttcgtccccgtcgtcctcctcggcaactagcacaacttcctcgccaccttcgttcccatcttcctcctcggccgccttcaccgaccccttcatcccgtcaatggcaagctatgggaaccacgtcgttcgtgttcttcaccatcatcctcgtcgttcgtgttcttcaccatcatcctcctctccaccggcttgttcttcgcagcggatgcatacccaccgggaggcccagttccaggaacaacaagtttggaccttttggcttcggcttcatccaacgtcaaaagctcggaacatggaactcgccattccagggtgccgtcggtgataccatgaagaagttaagtcagaattatgcagttggggaaccgctagatctagcaaggagtccggatttagcgtctccgctcttcatcgggtcaactcttgtctccctgagtccctgcaagcccgacactagcgacctcaatggcatctataacaatagtgtgcatgacgagaggggaggagaaaaaaaagggtggctcatggagggtaacaagagtgtggttgcgcatgcaaaggcggagagggggaacgatggtggctcatggagaagagcagtggtggtggtgcgtagagtgatggttagtggttgttggtgtaggagtagtacttatattatatctccgactccgagtatcttccccttcccttcccttggcggcgtaaatgaaagaagggaaatctcccgtctctttgtctcctgccaagacgagtcgcggctgaacaggggaggggccgcgatctccatctggcgggcagagcaggggacgggaggggatcctgcgtttgagagcaaccaagggctctggaatagtggatattattcccagctgtttgggattggaggagttatggtcactgtcgccattctttggttatcgacaggctactttggaggaattggtgctccttttgccccatatttttggccatatctaggacaacttccaaagaagaaggaacggaaaaggcctgtgagagtgtacatggatggatgctttgacctcatgcactatggccatgcaaatgcattacggcaggccaagttgttgggagatcaacttgtagtgggagttgttagtgatgaggagattgtggcgaacaagggtccacctgtgctttcaatggaagagaggttgacacttgttagtggattgaagtgggtggacgaggtcattcccaacgcgccctatgagatcacggaagaatttatgaataccctcttcaataaatataacattgattacattatacatggagatgatccttgtcttctacctgatggaacggatgcttatgcgttggcaaagaaggttggacgctacaagcaaatcaaacgcactgaaggtgtctcaagcactgatatagtcgtctattgtgatcttaatgtgggaactgtattctttttccacccagggaggatactactgacattcaagcagaaagaggctggcagtatggaaactaccacagatgcaaatcagaacactggagcaacatgtgataaagtgaaaagtcagctatccaattttcttccaacatctcgccggataatgcagttttcaaatggacaggctccttcgccaggtgctcgcgttgtgtatatagatggtgcttttgacctttttcatgccggccatgttgagatcctcagaagtgctaggcaacttggtgacttccttcttgttggtgtccatgatgaccaggcaatcagggatagaagagggtatcgtcctatcatgcacctccatgagcgtactctcagtgtacttgcatgtcgctatgttgatgaagttataataggtgccccatgggaggtttcaagggatatggtcggtattgattcatacgctgttccaaagagcatgggtatcttccaaacaatcacaagcaccaaacctataacaacagtttcagtggctaccagaataatcgataaccatgaagcttacaagtgtgtggagtga

SEQ ID NO: 16077 - protein, 742 aa, Oryza sativa
MDSRAGGDVSPGPALGDNWRQRGPVTLASIAVYCSFHHHPPPPLRSPAPRRPRRPRRPPQQRTNIATSAITDLLRPRRPPRQLAQLPRHLRSHLPPRPPSPTPSSRQWQAMGTTSFVFFTIILVVRVLHHHPPLHRLVLRSGCIPTGRPSSRNNKFGPFGFGFIQRQKLGTWNSPFQGAVGDTMKKLSQNYAVGEPLDLARSPDLASPLFIGSTLVSLSPCKPDTSDLNGIYNNSVHDERGGEKKGWLMEGNKSVVAHAKAERGNDGGSWRRAVVVVRRVMVSGCWCRSSTYIISPTPSIFPFPSLGGVNERREISRLFVSCQDESRLNRGGAAISIWRAEQGTGGDPAFESNQGLWNSGYYSQLFGIGGVMVTVAILWLSTGYFGGIGAPFAPYFWPYLGQLPKKKERKRPVRVYMDGCFDLMHYGHANALRQAKLLGDQLVVGVVSDEEIVANKGPPVLSMEERLTLVSGLKWVDEVIPNAPYEITEEFMNTLFNKYNIDYIIHGDDPCLLPDGTDAYALAKKVGRYKQIKRTEGVSSTDIVVYCDLNVGTVFFFHPGRILLTFKQKEAGSMETTTDANQNTGATCDKVKSQLSNFLPTSRRIMQFSNGQAPSPGARVVYIDGAFDLFHAGHVEILRSARQLGDFLLVGVHDDQAIRDRRGYRPIMHLHERTLSVLACRYVDEVIIGAPWEVSRDMVGIDSYAVPKSMGIFQTITSTKPITTVSVATRIIDNHEAYKCVE

SEQ ID NO: 16078 - DNA, 1113 bp, Caenorhabditis elegans
  CDS (1)..(1113)
atgagcggattagcaccagatggactgcccaaaggaaatcgagtttgggctgatggatgttatgacatggtgcatttcggccatgcaaatcaattacggcaggctaagcagtttggacagaagttaattgttggagtacataatgatgaagagattcgactacataaaggacctccagtattcaatgaacaagagcgatatcgaatggttgccggcattaaatgggtcgatgaagttgtggaaaatgcgccatacgccacaacagtcgaaactctggacaagtatgattgtgatttttgtgttcacggagacgacataactctaaccgccgacggaaaagacacgtatcaagaggtgaaggatcaccaacgatacagagaatgtaagcgaacgtgtggtgtctctacaactgatttagttggccgaatgcttctgctcaccaagaaccatcacacacaggatgagcacatcgagcaacacgtcgaacgagctcgttcgctgagcacggacaacgttgcaatgtccccctggacacgtgtctcgcgcttcatcccaacaacgacaacgattctcgagtttgccgaaggaagaccgccaaaaccgacggacaaggttgtctacgtgaccggatcgtttgatttgttccatattggacatctggcgttcctggaaaaagccaaagagtttggagattacctgattgtgggaattttatcggatcagactgtcaatcaatacaagggaagcaatcaccccataatgtcgattcacgagcgtgtactatccgttctggcctataagccagtgaatgaagttgtgttcggtgctccatatgagattacttctgacattttggatcagtttaatgttcaggcagttatcaacggattccgtgacaacaactcctcagtcgtcaactcatcgcttgcatcgatcgacccgttcgcagaagccaaacgtcgtggaatctaccatgaagtggactcgggaagtgatatgaccaccgatttgattatcgatcgaatcatccatcaccgtctcgagtatgagacacgaaataagaagaaggagaagaaagaagctgatgtggcaaaagccatgaacttgatttaa

SEQ ID NO: 16079 - protein, 370 aa, Caenorhabditis elegans
MSGLAPDGLPKGNRVWADGCYDMVHFGHANQLRQAKQFGQKLIVGVHNDEEIRLHKGPPVFNEQERYRMVAGIKWVDEVVENAPYATTVETLDKYDCDFCVHGDDITLTADGKDTYQEVKDHQRYRECKRTCGVSTTDLVGRMLLLTKNHHTQDEHIEQHVERARSLSTDNVAMSPWTRVSRFIPTTTTILEFAEGRPPKPTDKVVYVTGSFDLFHIGHLAFLEKAKEFGDYLIVGILSDQTVNQYKGSNHPIMSIHERVLSVLAYKPVNEVVFGAPYEITSDILDQFNVQAVINGFRDNNSSVVNSSLASIDPFAEAKRRGIYHEVDSGSDMTTDLIIDRIIHHRLEYETRNKKKEKKEADVAKAMNLI

SEQ ID NO: 16080 - DNA, 1436 bp, Oryza sativa
  CDS (159)..(1028)
gggagtcttgttccctttttattgagaggatcccctccctcgtgtcgacacgatcgtccaaaatagggaagagggagggggttcttcttctcctcgatccggttgaggactttgaggtagagagaggcagaggcgacgaggaaggatctgatctatcgatggcgcgcgtttcgcattccagaaagcggactagggctccctccaactccaactccaagcccacttcacaaacccaaccgccgccgccggagctcaccgaccgccctgtccgcgtctacgccgacggcatcttcgatctcttccacttcggccatgcccgcgccctcgagcaggccaagttgctgttccccaacacgtacctgctagtgggctgctgcaacgacgagctcaccaaccgctacaagggcaagaccgtcatgacccaggatgagcgatacgagtcccttcgccactgcaaatgggttgatgaggtcattcctgatgctccatgggtcctcacgcaagagttcattgacaaacatcagattgactatgttgctcatgatgcactgccttatgccgatactagtggagctgctaatgatgtctatgaatttgttaaaaagattggcaaattcaaggaaacgaaacggacagacggtgtatccacatcagacctcataatgaggatattgaaggactacaatcagtatgtcatgaggaatttagcacgtggatacacaaggaaagatttaggcgtaagctatgttaaggaaaagcaactccaggtcaacatgaagataaataaactgcgagagactgtaaaggcgcatcaagaaaagttgcaaacggtggcgaagacagctggaataaatcatgaagaatggttggccaatgcagatcgctgggttgctggtttcttggagaagtttgaggaacactgccacaacatggaaactgccatcaaggggcgtatccaggagaaattgaggaggcaaacaagcagagggataattgggggtctaatgcagcaaccggtggcagcgtaataagttgtagaggagagatgacgttgagttggagtaagctgccctggggtcaccacggacgagaaatgtagtgaagatgccttcttggttggcggttatagtgtgagtgtgtgcttgtgtcatggaatgtgatgcttgtacgagttgttacagcttaattacatgggagaggctttgtttcttgtttatttttttgcggggggtgggggtgttggtttccttgtatacaaatgtctatagcagaggcgtttggtgcataatccagagtgtgtagtaggtgttggacagatgaagttgagtggtactgtagtgttgttgttctcttcccttgggttttgtctgtaacgtcgagagggagagatgttgacgctggctgaaagcacaacacaagcagagtgatattatact

SEQ ID NO: 16081 - protein, 289 aa, Oryza sativa
MARVSHSRKRTRAPSNSNSKPTSQTQPPPPELTDRPVRVYADGIFDLFHFGHARALEQAKLLFPNTYLLVGCCNDELTNRYKGKTVMTQDERYESLRHCKWVDEVIPDAPWVLTQEFIDKHQIDYVAHDALPYADTSGAANDVYEFVKKIGKFKETKRTDGVSTSDLIMRILKDYNQYVMRNLARGYTRKDLGVSYVKEKQLQVNMKINKLRETVKAHQEKLQTVAKTAGINHEEWLANADRWVAGFLEKFEEHCHNMETAIKGRIQEKLRRQTSRGIIGGLMQQPVAA

SEQ ID NO: 16082 - DNA, 1359 bp, Neurospora crassa
  CDS (1)..(1359)
atggccccctccgaccccgttaatcccccgggtacccccgccccctccctcctcgaaggccgtctctgggtcgacggctgcttcgacttcttccaccacggccacgccggcgccgtcgtgcaggcccgccaactcggcaccgagctgtacgtcggcgtgcactcggacgaagccatcctcgagaacaaggggcccaccgtcatgacgctgcgcgagcgtctgctcgccaccgacgcctgccggtgggtgaccaagtcggtcgcctacgcgccctacgtcacgcagctggactggatcagccatttcgggtgcaagtacgtggtgcacggggacgacatcacgtccgacagctcgggcgaggattgctaccggtttgtgaaggcggcgaatcggttcaaggtggtgaagcgcacgccgagtatcagcaccacggatctggtgggcaggatgctgttgtgcacgcggacgcatttcatcaaggatttggaaaagatgttggagggggaggaagggaatgggacggcggaggagaagaagaaggtcggggaggagatgaaggagaggatcaggctgtacgcgacggatgagacggccaaaaaccctggtgcgaatgtgtggttttggaagggggatgagaagaagaagaagaaggaggatgagggcaaggaggaggagaagggggtgttcagggagttgtttggagggattggacccaagccggggcagagggttgtttatgtggatggaggctttgatttgttctcgagcggacatattgagttcctgcggctggtgacgcagaaggaggaggagctggcgcgtcaggaggggtggtattcgcagcaggcaattgacgagaggaagggcaagggcgcggattacggtccagcgtttgtggtggctggtgttcatgatgacgaggtcatcaaccgcgaaaagggcgtgaactatcccatcatgaacgtctttgagcgtggtctctgcgtcttgcagtgcaagtacatcaacgccgtcgttttcggcgctcccttcaagccaaccaagggctatctcacctctctcccctggggcactcctgatgcggtctaccacggtccgacctcgttcatgccgcacaccgaagacgtgtacgcggttcccaaggagatgggcatctacaaggagattggccaacacgagtacaaggacgtgaatgccggcaccatcgtccaaagaatcatgaagagcagggatctctatgaggctcgccagaaggccaagggcatgaaggccgacatcgaggccgcccaccgggagcgcgagttgctggaggaacagcagaggcagaaggaggaggccatcgccgcgcaaaaggagtag

SEQ ID NO: 16083 - protein, 452 aa, Neurospora crassa
MAPSDPVNPPGTPAPSLLEGRLWVDGCFDFFHHGHAGAVVQARQLGTELYVGVHSDEAILENKGPTVMTLRERLLATDACRWVTKSVAYAPYVTQLDWISHFGCKYVVHGDDITSDSSGEDCYRFVKAANRFKVVKRTPSISTTDLVGRMLLCTRTHFIKDLEKMLEGEEGNGTAEEKKKVGEEMKERIRLYATDETAKNPGANVWFWKGDEKKKKKEDEGKEEEKGVFRELFGGIGPKPGQRVVYVDGGFDLFSSGHIEFLRLVTQKEEELARQEGWYSQQAIDERKGKGADYGPAFVVAGVHDDEVINREKGVNYPIMNVFERGLCVLQCKYINAVVFGAPFKPTKGYLTSLPWGTPDAVYHGPTSFMPHTEDVYAVPKEMGIYKEIGQHEYKDVNAGTIVQRIMKSRDLYEARQKAKGMKADIEAAHRERELLEEQQRQKEEAIAAQKE

SEQ ID NO: 16084 - DNA, 2224 bp, Drosophila melanogaster
  CDS (423)..(1604)
ctgctctcacggtactcgaaattgtgagaaaagaaatgaaagaatctaaaaaaaaacccaagctaaacacaccgcacttacgccccaaagaagttcccatgcgcccgcgcgctgataacgcaagtctgagaatctgagaccaattccgctccgagtctgaacgtgaatccgagtccgaaaccgataacgaaaactgaactgagtagctcggtcgtgaaatgggaattgatatatagcgggcgtcgtcgtagctcagaacaaataacttacagctctcgaagcgtgaacgtcgctgtcgtcgagtttccgccttcaaaacgagcactgaaaacagaaacatactctccggaatctaatgttcgcccgttagccggattctaaattaaaattaaattaaattgtgaaaattcaataagtcaacgatggaggcaaatggcgataccagcgcctgcaatgggtattcggacaagcagcggaaggatgtgcgcgtctggtgcgatggatgctatgatatggtacacttcggacatgccaattctctgcgacaagccaaggctcttggcgataaggtaattgtgggcattcacaccgacgaggagatcaccaagcacaagggaccaccggtcttcaccgaggaggagcgcgtcaagatggtcaagggcatcaaatgggtggatgaggtggtgctcggtgctccgtatgtgaccacactggatgtgctcgaccagaacaactgtgatttctgtgtgcatggagatgacattacaatgacagccgaaggagtggacacatatcatttggtcaaatcagccaatcgctacaaggaagtgaaacgcacagctggagtctcgaccactgaccttgtgggccgcatgttgctcctgacacgcaaccacttccgtcaaggatccgcggaatatgatatcgagaaagaagtgtcaattttaaaacgacaaataaaatcccatccaggttcttcgaacatgggtcaagattcggcagccaaaagtccgtggaccggttgtagtcagttcttgccgactacccaaaagatcatacagttcagtgatggaaagtcaccgaatcccggcgataagattgtttatgtggctggcgccttcgatctcttccatgtgggtcacctggactttctggaaaaggctaagaaactgggtgactatctgattgttggcctgcacacagatcccgtggtgaactcctacaagggcagcaactatcccattatgaatctgcacgagcgcgtgctcagtgttttggcctgcaagtttgtcaatgaggtagtaatcggagctccctactgtgtcactgaagagctgcttgagcacttcaaaatcgatgttgtctgtcatggacgcacacccattgcgcttgagaatggcaagatcgatccatatgccgttcccaagacgcgagccatctttgagctgatcgattccggcaacgagatgaccacggagcgcatcgtggagcgcatcatctcgcaccgactggaatatgagcgtcgcaatcaggccaaagaaaagaaggaaatcgaagcctttgaggcacttcaacgccaaaaacagacccaaaaggccggctagccggaaccagattccgacctctcacactagacggatgttttttattttctagttgcgttcttttagtttgttttatttagtttgtcttgtttagtatgtcgtcccctgatgatggcgctttaattttttgttgcgtaaaaagcgaagcgacgctgcctgaggattcagcgcaccgctctctcgatttctagtacaattttagaatatctgcacatgcgccttaatgatataaggttatacacataattatatatttctaacacattaacgtagaatatttaaaatctaaattttatgtatgtaagctcaaaatttgtaaattccctttaaagtacgatgtaagtgtgaggaacaacaaaattgtacgaatagcatgttatccaaactgttgccgaattgaaaagccttgtacgacttgtatgtatatatattcagcaacggaagtaggatgcctggatcaggaagtagctgcttttatcaaatgtaatctctgatactttgtcctaatttattaatgcatatagtaagtgcgagttcaagttttatgtttccttgtttaatcttagacttaaatacatggccaaaaatattgcgaattccaaaaaaaaaaaaaaccggaa

SEQ ID NO: 16085 - protein, 393 aa, Drosophila melanogaster
MEANGDTSACNGYSDKQRKDVRVWCDGCYDMVHFGHANSLRQAKALGDKVIVGIHTDEEITKHKGPPVFTEEERVKMVKGIKWVDEVVLGAPYVTTLDVLDQNNCDFCVHGDDITMTAEGVDTYHLVKSANRYKEVKRTAGVSTTDLVGRMLLLTRNHFRQGSAEYDIEKEVSILKRQIKSHPGSSNMGQDSAAKSPWTGCSQFLPTTQKIIQFSDGKSPNPGDKIVYVAGAFDLFHVGHLDFLEKAKKLGDYLIVGLHTDPVVNSYKGSNYPIMNLHERVLSVLACKFVNEVVIGAPYCVTEELLEHFKIDVVCHGRTPIALENGKIDPYAVPKTRAIFELIDSGNEMTTERIVERIISHRLEYERRNQAKEKKEIEAFEALQRQKQTQKAG

SEQ ID NO: 16086 - DNA, 1714 bp, Drosophila melanogaster
  CDS (405)..(1550)
cctgatcgaatcggcggacccgtgccaagtcaggcgaccgacccgttgcttcctatttgcttgcgccgcaatttgcggcaattgaagatgagcgatgaatccgagccagagacttgggcctgagactgctagagccgcctccaagtcgtgtgcctcgccagccgctggactcaattgtattgattcgccaccagttgccgccaatttattctgatcgcagctagtgcgcagttggggacatctctcgctcaaagtctcggactcaatcctcgacagagtagacctagagggttatgccggttccgtctcaatttatgtaatcagtcgtccggatgaaatccccttgagcggaccactagtgctgtacttagttgtgtatactcgtacatatatttttataagcaatggacagaatgccgaaagaggacgacgaatctccagtgtcgacggctcctgccacaccgacatcgccgatggagtttaagatgctaccgctctttatggactttgaggattttagcatttgccagcctgctcctttctcgtacgatgacaaggccatgctggagctcgagagatgcgactacacacagaggatcacctatcatatggccagagctgggaagacgacgcgcagggtgcgggtctatgcagatggcatatatgatctgttccaccaaggccatgcccgccaactcatgcaggccaagaatgtgtttcccaacgtctatctcatcgtcggcgtgtgcaatgatgagctgaccctcaggatgaagggacgcacggttatgaatggattcgagcgctacgaggcggtgcgccactgccgctacgtggatgagatcgttccgaatgctccgtggacgctaaatgaggagtttatcgaggagcacaaaatcgactttgtggcccacgatgacataccctatggagctggcggagtcaacgacatatatgctccactcaaagcgaagggaatgtttgtggccacggaacgcactgagggcgtgtccacgtcggacattgtggcccgaatcgtgaaggactacgatgtatatgtgcgcaggaacctggccagaggctactcagccaaggagctcaacgtctcctttctctccgagaagaaattccgtctgcagaacaagatggacgagctgaagacacgaggcaagcgggagctgaccaaagtcaaggttgacatcatcaccaagtgggaggagaagtcgcgcgagttcatcgatgccttcctgctcctgttcggccgggagcggcttaacaccttctggaacgagtccaagggccgaatcattcaggcactcagcccaccaggcagtccgaatggctccgtaaacggtgacgatccagacgcaacagacgacttagactctgaggatgagtacatggagctgccaccagactacgggtctggtagttgcgtatcccttagtcgaaaacaaaagcgccctgataaggtgaatgcctcagcaaacctcaattactcggagcaaccagagcataaggatgtcgtagacgagcgacgcagcgactaaagacgaatttggcctcttcctatcaattaaaacataaataaatatgtttgaagtttaatggaacagcgcagtaggcacttttatacatatttaaaagagctaccagaaaaagtatgcgcttaaaatacattccgataaatttcagttaaaaaaaaaaaaaaaaa

SEQ ID NO: 16087 - protein, 381 aa, Drosophila melanogaster
MDRMPKEDDESPVSTAPATPTSPMEFKMLPLFMDFEDFSICQPAPFSYDDKAMLELERCDYTQRITYHMARAGKTTRRVRVYADGIYDLFHQGHARQLMQAKNVFPNVYLIVGVCNDELTLRMKGRTVMNGFERYEAVRHCRYVDEIVPNAPWTLNEEFIEEHKIDFVAHDDIPYGAGGVNDIYAPLKAKGMFVATERTEGVSTSDIVARIVKDYDVYVRRNLARGYSAKELNVSFLSEKKFRLQNKMDELKTRGKRELTKVKVDIITKWEEKSREFIDAFLLLFGRERLNTFWNESKGRIIQALSPPGSPNGSVNGDDPDATDDLDSEDEYMELPPDYGSGSCVSLSRKQKRPDKVNASANLNYSEQPEHKDVVDERRSD

SEQ ID NO: 16088 - DNA, 2518 bp, Drosophila melanogaster
  CDS (307)..(1887)
tccacctctaacaacttttgttcactagggttattcgaagttgtgtttgtgtccgacgaacaacaaacgaattgttaacagaccgagtggggtgacttgtggtccgcgtttcgtgtgtgtgtcattccagacgaaaacgaagatttgcttcgacaagcagagaaaagaagggaccagctccaatcgataatcgaaagaaccgttccgagttggaagaaagtggaaactgaaagtcaattgaatctctgttcctccgtcaccgcgtcgcgaagccgttaaaactgccgctcccaaacattcgctgcgatggccacctcatcgatactcgccaaaagcacaattaatagcacatcgccaccggccacgcccagcagcagcgcgtcccccggctccacactgaccacccggaagcggacctacgagatagccattgccatgccctcgtccaccgcctccagcagcgccacaaaggtatcggaagttcaggatcagcgcacaaacagccccggcaagtccaagagcaggcccggccagctggagagtgtcttggtggtcggcgagggagccagcgagcccaccacctcggccaccacactgcgggacagcacacgcaccatctcacaaagcgacgccgacgatggcggcgaagcggcagccgccgaggacctgctgcccccacagtcggattacctcaacggcgtcaagcggaagtacgtcccgcagcagcaggcgtcgccgaatcaccgggtggtgcccgcatccacctcgcagcaattcttcagcggggcctccgattttgcgacaatttgcaagccggcgccctactctcacgacgaggaggccatgctggagcgggatagatgtgactacactcaaaggatcacctaccagatggcccgctccggacagacgacccgcagggtgagggtctacgccgatggcatctacgatcttttccaccagggccacgcccgccaactaatgcaggccaagaacatctttcccaacgtgtacttaattgtgggcgtgtgcaacgacgagctcacccaccgcatgaagggacgcaccgtgatgaacggcttcgagcgatacgagggagtgcgtcactgccgctatgtggacgagatcgtccagaatgcgccatggactctgtccgatgaattcatcgccgacaacaaaatcgactttgtggcccacgacgacattccgtatgtaaccgatggcatggacgacatctatgctcctctcaaggcgcgcggcatgtttgtggccacggagcgcactgagggtgtgtccacctcggacatcgtagcccggatcgtcaaggattacgatctgtatgtgcgtcgtaatctggccagaggctattcggccaaggaactcaatgtgtcgttcctgtccgagaagaagttccggctgcagaacaagatggacgagctgaagtcgcgcggcaagcgcgagctgagcaaggtgaaggtggacatcatcaccaagtgggaggagaagtcgcgcgaattcatcgacaccttcctgctgctgttcggacgtgagaacctgaatcatttgtggaacgagtcgaagggcaagctgctgcaggcactcagtccgccgggcagcccgtcgggatcagtgaacggtgatgacacggagggcggcgaggactacagcgaaactattgacgagtacttggagatggccgagaagttgagcgggggcagcggcagcggcagcagtggatcgctgaacggcaaacagaggccgaagcagaagcgctcctcgctggcccgccgcagttaccagagtctgcagagccaatcacccgacttggaagcggatggggacgaggatgcggatgcggatgcggagtacgagcgtcgaagcaattgattctattgcggggcagcccgatcttttcttcttctcttaatgtctttaatgctattgtaaatggacttgcttgcaactagttcgacggcacactatagatgccccaggatcgccacgcaggctccacgaacacacacttatatttactctagccctaagtggtattgtaatcccaatgttttagttggcactcgttctcctcctgcctcaactccacctgcccatctccatctgtgagaatcgagggaatcctgtagctaatttagctgtgtgtgtgtgtgtgtgggacaagcaaccaccaacgcggaaaagactcatttttgtattaggcactcgacggactgtgcacgaaatcaatcggcagtggcggcagattcaggtgccgaaaatatctagaaatatttatattaaattatttcgcataacattaaactaagttaacaacaccgcaaccagaacaccaaccaatatagagaaatccaaacaaacaaattacgaaatacattcggaaaatgcaaaaaacaaaaacaagtaattagtaacagttggcaatagcggaactattgcaaatgctttgttaaatattttttgaaaaataaacattgaatcgaaaaaaaaaaaaaaaaaaaaa

SEQ ID NO: 16089 - protein, 526 aa, Drosophila melanogaster
MATSSILAKSTINSTSPPATPSSSASPGSTLTTRKRTYEIAIAMPSSTASSSATKVSEVQDQRTNSPGKSKSRPGQLESVLVVGEGASEPTTSATTLRDSTRTISQSDADDGGEAAAAEDLLPPQSDYLNGVKRKYVPQQQASPNHRVVPASTSQQFFSGASDFATICKPAPYSHDEEAMLERDRCDYTQRITYQMARSGQTTRRVRVYADGIYDLFHQGHARQLMQAKNIFPNVYLIVGVCNDELTHRMKGRTVMNGFERYEGVRHCRYVDEIVQNAPWTLSDEFIADNKIDFVAHDDIPYVTDGMDDIYAPLKARGMFVATERTEGVSTSDIVARIVKDYDLYVRRNLARGYSAKELNVSFLSEKKFRLQNKMDELKSRGKRELSKVKVDIITKWEEKSREFIDTFLLLFGRENLNHLWNESKGKLLQALSPPGSPSGSVNGDDTEGGEDYSETIDEYLEMAEKLSGGSGSGSSGSLNGKQRPKQKRSSLARRSYQSLQSQSPDLEADGDEDADADAEYERRSN

SEQ ID NO: 16090 - DNA, 1089 bp, Caenorhabditis elegans
  CDS (1)..(1089)
atgtttattcacaaacaagaaaagatgccacaacgaaagagaacaatggactcaccacaagaagaagatgtggaggtgaagaagaaggcgacggaagtggagtacgttgtcaggtcgttggcatcagatgagccagctccattttccgacgaggcgttggcgattacgacaagagaagcggtggattattcaaagaaaataactttggcaatggcagaagctaatgaggctggccgacctgtgcgaatttatgctgatggaatttatgatctgttccatcatgggcatgcgaatcaacttcgccaagtgaagaaaatgttcccaaatgtctaccttattgttggagtttgtggtgatcgcgacactcacaagtacaaaggaagaacagtcacttcagaagaagaacgttacgatggtgttcggcactgtcggtacgttgatgaagtctacagagaggctccatggttttgtactgtcgagtttttgaaaaaccttaaagttgatttcattgctcatgacgctattccatatgttgcaccaggagaggaggacttgtatgagaagtttcgtagagaaggaatgttcttggaaacggaacgaactgaaggtgtctctacaagtgacgtcgtctgcagaatcatccgtgattacgataagtacgtgcgtcgtaatttgcaaagaggatattcaccgaaagagctcaacgtcggatttttggcggcaagtaagtatcaaattcaaaacaaagtcgactcgttgaaaagcaagggaatcgagcttctgtccacctggaaaagcaaatcagacgatatcatccgggactttatagatacattccataaggacggaggtttgaacgcattcggtggacgtctgaagggaataatgtcaatgtctcgttcaccatcaccatctcctcacgaaggatctccaaccggtatcgagcatcacctcgaaactcaggacgaagaagaagaagaggaggcactggaagaggaaaaagtcgtcgaacagaaaattgtagaaaagaaagaagtcgtgaagaaaaggtcctctagaaataaggcaaagactcctttggagtattaa

SEQ ID NO: 16091 - protein, 362 aa, Caenorhabditis elegans
MFIHKQEKMPQRKRTMDSPQEEDVEVKKKATEVEYVVRSLASDEPAPFSDEALAITTREAVDYSKKITLAMAEANEAGRPVRIYADGIYDLFHHGHANQLRQVKKMFPNVYLIVGVCGDRDTHKYKGRTVTSEEERYDGVRHCRYVDEVYREAPWFCTVEFLKNLKVDFIAHDAIPYVAPGEEDLYEKFRREGMFLETERTEGVSTSDVVCRIIRDYDKYVRRNLQRGYSPKELNVGFLAASKYQIQNKVDSLKSKGIELLSTWKSKSDDIIRDFIDTFHKDGGLNAFGGRLKGIMSMSRSPSPSPHEGSPTGIEHHLETQDEEEEEEALEEEKVVEQKIVEKKEVVKKRSSRNKAKTPLEY

SEQ ID NO: 16092 - DNA, 1566 bp, Homo sapiens
  CDS (5)..(1114)
ggccatgccagtagttaccactgatgctgagtcagaaacaggtatcccaaaatccctttccaatgagcctccctcagaaaccatggaggaaatagagcacacatgcccacagcctcgactgaccctgactgcacctgccccatttgctgatgaaaccaactgccagtgtcaagcaccccatgaaaaactgaccattgctcaggcccgcttaggaacaccagctgacaggcctgtcagagtatacgccgatggaatatttgacctcttccactcaggtcatgcaagagcccttatgcaagcaaaaacactgtttcccaacagctacttgttggtaggagtttgcagtgatgatctcacccacaaattcaaaggtttcaccgtgatgaatgaagccgagagatacgaagctctcagacactgtcgctacgtagacgaagttatcagagatgctccctggacactcacgccagagtttctggaaaaacacaagattgactttgtggctcatgatgacattccgtattcctctgctggctctgatgatgtttacaagcacataaaggaagcagggatgttcgttccaacgcagagaacagaaggcatctcaacatcggacatcattaccagaattgttcgtgactatgatgtttatgcccgacgtaacctccagagagggtatacagccaaggaactgaatgtcagctttataaatgagaagaggtaccgtttccagaaccaagtggacaaaatgaaggaaaaagtcaagaatgtggaggaaagatcaaaggaatttgtgaacagagtggaagaaaagagccatgatctaattcaaaagtgggaagagaagtcaagggaattcattggcaacttcctagaactgtttggacctgatggagcatggaagcagatgttccaggagaggagcagccggatgctgcaggccttatccccgaagcagagccctgtgagcagcccaacccggagccggtccccttcccgctccccatcgcccaccttctcatggcttccactcaaaacctcacccccttcctcacccaaagcagcctcagcctctatcagcagcatgagcgagggggatgaggatgaaaagtagaggctgctgggaggcaagagccgcaccatgcaggatggggaggagggcgagagtcacagggttgcctgggtggtgtttgaagggtaatagtcacaggagctgcagtcagcagagagaccctgaactctgctaagggaaggtcttgggaccagttctctctcactctccgtacagctgaagagttgggcgaggtgcagagacttctagctggacaacctacacaaaccttagcgtctagagtcactctaaccttgctaaggaaggatgcagagttccctagagagacttgcactgatggggtgacttctgctttggtccttccaccacccccaccaagtaaaccacctgtggcagcggctgttccctcaacctgctacttctgcgtccataagggtcctgcacgttgcctcccaccaccccagctctgccagaataaaattgtttccaataaa

SEQ ID NO: 16093 - protein, 369 aa, Homo sapiens
MPVVTTDAESETGIPKSLSNEPPSETMEEIEHTCPQPRLTLTAPAPFADETNCQCQAPHEKLTIAQARLGTPADRPVRVYADGIFDLFHSGHARALMQAKTLFPNSYLLVGVCSDDLTHKFKGFTVMNEAERYEALRHCRYVDEVIRDAPWTLTPEFLEKHKIDFVAHDDIPYSSAGSDDVYKHIKEAGMFVPTQRTEGISTSDIITRIVRDYDVYARRNLQRGYTAKELNVSFINEKRYRFQNQVDKMKEKVKNVEERSKEFVNRVEEKSHDLIQKWEEKSREFIGNFLELFGPDGAWKQMFQERSSRMLQALSPKQSPVSSPTRSRSPSRSPSPTFSWLPLKTSPPSSPKAASASISSMSEGDEDEK

SEQ ID NO: 16094 - DNA, 1856 bp, Homo sapiens
  CDS (67)..(1236)
attgcgggcggcggcgttcggagtcgccgggagctgccaggctgtccgcgccgccgctgcggggccatgatccggaacgggcgcggggctgcaggcggcgcagagcagccgggcccggggggcaggcgcgccgtgagggtgtggtgcgatggctgctatgacatggtgcattacggccactccaaccagctgcgccaggcacgggccatgggtgactacctcatcgtaggcgtgcacaccgatgaggagatcgccaagcacaaggggcccccggtgttcactcaggaggagagatacaagatggtgcaggccatcaaatgggtggacgaggtggtgccagcggctccctacgtcactacactagagaccctggacaaatacaactgtgacttctgtgttcacggcaatgacatcaccctgactgtagatggccgggacacctatgaggaagtaaagcaggctgggaggtacagagaatgcaagcgcacgcaaggggtgtccaccacagacctcgtgggccgcatgctgctggtaaccaaagcccatcacagcagccaggagatgtcctctgagtaccgggagtatgcagacagttttggcaagtgccctggtgggcggaacccctggaccggggtatcccagttcctgcagacatctcagaagatcatccagtttgcttctgggaaggagccccagccaggggagacagtcatctatgtggctggtgccttcgacctgttccacatcgggcatgtggacttcctggagaaggtgcacaggctggcagagaggccctacatcatcgcgggcttacactttgaccaggaggtcaatcactacaaggggaagaactaccccatcatgaatctgcatgaacggactctgagcgtgctggcctgccggtacgtgtcagaagtggtgattggagccccgtacgcggtcacagcagagctcctaagtcacttcaaggtggacctggtgtgtcacggcaagacagaaattatccctgacagggatggctccgacccataccaggagcccaagagaaggggcatcttccgtcagattgacagtggcagcaacctcaccacagacctcatcgtccagcggatcatcaccaacaggttggagtatgaggcgcgaaaccagaagaaggaagccaaggagctggccttcctggaggctgccaggcagcaggcggcacagcccctgggggagcgcgatggtgacttctaacctggcagaggccctggccggccctccccctgctctgcttctgcgccttctgcgtttggacataggactctgcagggccgccctctctaactggcctggctctggaagggctggtgaggactctgcctccttgcctgcctacaaggtgcctggtttgcagcaggctctccgctctttccagcaaagctgctcagagagggtgtccagcacagtggagaggccggaagtgagacgggcagacggcacctgcagcctgaaacgcaccgctcctgcgtgcgcccccacctggtccccggatgcccccaccacctggacagaggccacactgactgcccacccagctgtggcgggaggtgcagagcagggggctttagggagcagtgactgcggtcacccctttagttctctgggtgtagaccacaccacctcccactgggcaccccccaacacggtgtcctgccacccagcgcctggctccaggaaaacacgcttgccttccttcccggcagcttcgccactctccttatggactctgttctgtttgtacatggctgacggaaatctctttggtacaaccgaataaagcctggtggcagtgctgcgcggggctcccagccaat

SEQ ID NO: 16095 - protein, 389 aa, Homo sapiens
MIRNGRGAAGGAEQPGPGGRRAVRVWCDGCYDMVHYGHSNQLRQARAMGDYLIVGVHTDEEIAKHKGPPVFTQEERYKMVQAIKWVDEVVPAAPYVTTLETLDKYNCDFCVHGNDITLTVDGRDTYEEVKQAGRYRECKRTQGVSTTDLVGRMLLVTKAHHSSQEMSSEYREYADSFGKCPGGRNPWTGVSQFLQTSQKIIQFASGKEPQPGETVIYVAGAFDLFHIGHVDFLEKVHRLAERPYIIAGLHFDQEVNHYKGKNYPIMNLHERTLSVLACRYVSEVVIGAPYAVTAELLSHFKVDLVCHGKTEIIPDRDGSDPYQEPKRRGIFRQIDSGSNLTTDLIVQRIITNRLEYEARNQKKEAKELAFLEAARQQAAQPLGERDGDF

SEQ ID NO: 16096 - DNA, 1855 bp, Mus musculus
  CDS (45)..(1259)
cccacgcgtccggccgccaggatttgcggggggcctccggtgccatgatccggaacgggcacggggctgccagcgctgctgggctgaagggtccgggagatcagcgcatcgtgcgggtgtggtgcgatggctgctatgacatggtgcattatggccactccaaccagctacggcaggcacgggccatgggggactacctcatcgtgggtgtgcatacggatgaggagattgccaagcataaggggcccccggtgtttacccaggaggagaggtacaagatggtacaggccatcaagtgggtggatgaggtggtgcccgctgctccctacgtcaccaccctggagacactggacaagcacaactgtgacttctctgttcacggcaatgacatcacgctgacagtagacggccgagacacctatgaggaagtgaagcaggctgggaggtacagagagtgcaaacgcacccagggtgtgtccaccacagacctcgtgggtcgcatgctgctggtgaccaaggcccatcacagcagccaggagatgtcctctgagtaccgggaatatgctgacagttttggaaagccccctcacccgacacctgccggggacacactttcctcagaagtctcctcccagtgccctggggggcagagcccctggacaggggtgtcccagtttctacagacatcccagaagatcatccagtttgcttctgggaaggagccccagcccggggagacggtcatctatgtggctggtgcctttgacctgttccacatcgggcacgtggacttcctacaggaggtgcacaagctagccaagaggccctacgtcatcgccggcctacactttgaccaggaagtaaaccggtacaagggcaagaactaccccatcatgaacctgcacgagcggactctcagtgtgctggcctgccggtatgtttcagaagtggtgattggggcaccatactccgtgacagcggagctcctgaatcacttcaaggtggacctggtgtgtcacgggaagacagagattgtacccgacagggatgggtctgacccctaccaggagcccaagagaagaggcatcttctatcagattgacagtggcagtgacctcactacagacctgattgtgcagaggatcatcaagaacaggctggagtatgaagcacggaatcagaagaaagaagccaaggaattagcctttctggaggccacgaagcagcaggaggcgccgcctggaggggagattgactagcttcagacccggagatgttgttcacgcccttgccctgtgcccacctcttctcttcctgcccggctctgcttctgtgtcttgatgtcagctcacacaattccaaaggaaactggccttgctgagggtgctgcctgcctgcgaggcacctgccttgcagcaggctctcagcccttccctctgagctgctcagagagggtagctagcccaatgatgtggcccgtggacaggataagcagatgcacctgtgactgactggaggcgtgttgctgtgtatcccgggcatccatgggttccaactgccactgccccagtcttggccagagatacccctcctgcctgactggaagctgcacatctgcccactgagctttggtgaaaggtccagaggctttggggacctctgttcctgggccaccctgcccgtgggcaccctctaccttggggcacgttctagcaccccattcctgactcctggaagatgcacttgccccgacagctgggcagcacggctgtcctctgcagagactgcctggtcctcattgtactttggtggctcaactgaataaagccttgtgggaagcaaaaaaaaaaaaaaa

SEQ ID NO: 16097 - protein, 404 aa, Mus musculus
MIRNGHGAASAAGLKGPGDQRIVRVWCDGCYDMVHYGHSNQLRQARAMGDYLIVGVHTDEEIAKHKGPPVFTQEERYKMVQAIKWVDEVVPAAPYVTTLETLDKHNCDFSVHGNDITLTVDGRDTYEEVKQAGRYRECKRTQGVSTTDLVGRMLLVTKAHHSSQEMSSEYREYADSFGKPPHPTPAGDTLSSEVSSQCPGGQSPWTGVSQFLQTSQKIIQFASGKEPQPGETVIYVAGAFDLFHIGHVDFLQEVHKLAKRPYVIAGLHFDQEVNRYKGKNYPIMNLHERTLSVLACRYVSEVVIGAPYSVTAELLNHFKVDLVCHGKTEIVPDRDGSDPYQEPKRRGIFYQIDSGSDLTTDLIVQRIIKNRLEYEARNQKKEAKELAFLEATKQQEAPPGGEID

SEQ ID NO: 16098 - DNA, 25 bp, Primer
atgacggtaaacttagatccggata

SEQ ID NO: 16099 - DNA, 26 bp, Primer
ttatatggacattccctttttttggt

SEQ ID NO: 16100 - DNA, 777 bp, Saccharomyces cerevisiae
  CDS (1)..(777)
atggatgacgatcacgaacagttggtcgaagaactggaggccgtcgaggccatctatccggatcttctctccaagaagcaggaagacggaagcatcatcgttgtgaaagtgccgcagcatgaatacatgacactgcagatctccttcccgacacactacccctccgaggaggctcctaatgtcatcgaagttggtgtctgcacttctttggctaagcgcgatctctacgataccaagtaccttcagcatttgttccaggaagtgatggactctgttttccaccgcggatctgtctgtctatttgacttcctcacagaactcgacggtgtcttgtacgttgaaccagaggaggagacagaaccggtccagcagagtgacattcccacagaccccttcgagggctggaccgcgtcggaccccattactgatagaggctcgactttcatggcctttgcagcacatgttacctccgaggaacaagcgtttgccatgctagacctactgaagaccgactccaagatgcgtaaggcaaaccatgtcatgagtgcatggcgaatcaagcaggatggctctgcggcaacatatcaagattccgatgatgacggtgaaacggccgccggctccagaatgctgcacctcatcaccatcatggatgtgtggaacgtcatcgttgtggtggcccgttggttcggcggtgcccacataggtcccgaccggtttaaacacatcaattctacggcaagagaagctgttgtcagggccggcttcgactcgtaa

SEQ ID NO: 16101 - protein, 258 aa, Saccharomyces cerevisiae
MDDDHEQLVEELEAVEAIYPDLLSKKQEDGSIIVVKVPQHEYMTLQISFPTHYPSEEAPNVIEVGVCTSLAKRDLYDTKYLQHLFQEVMDSVFHRGSVCLFDFLTELDGVLYVEPEEETEPVQQSDIPTDPFEGWTASDPITDRGSTFMAFAAHVTSEEQAFAMLDLLKTDSKMRKANHVMSAWRIKQDGSAATYQDSDDDGETAAGSRMLHLITIMDVWNVIVVVARWFGGAHIGPDRFKHINSTAREAVVRAGFDS

SEQ ID NO: 16102 - DNA, 774 bp, Caenorhabditis elegans
  CDS (1)..(774)
atgagcgacgaggagcaaagaatagcagaaattgagtcattggcatcgatttttccggatttattagaagaaacaactgataaacagctggtttttaaattcgatagggatattggaatgacaattaatctgccagaggattatccttcgatatctccgccaattttcgaactaagtggtccatatctccgtcgggagcagaaagaggtgcttcacaacagtctaaatgacgtttatatcgaaaatatcggatttccagtgattttcaattggatatcccttgttcaagactttattcgggatcttcccgaagaagtagcggagcccagccatgtggccgatgacgtggtgacaccgatggccgaggaaatcgatgatatgaatattcgacacggagaagtgcttacagaccggaaaagtgcatttcaggctcatttggccgaggttcggagtaaggaagatgtggatcgagtgatgcgaatccttaaatcgaatacaaaaatctgccgggcaacacataatattacagcatatcgatatatgactgaaatcaatggaaaaccaattcatcatcatgattgtgtggatgatggggaatttggagcaagttcgaaaatgttagagctcatggatcgaatgaaagcggataatgtgatggtcgtcgtttcacgttggtacggtggaattcatcttggacccgatcgttttcgacatattaataatttaactcggcaaattttaagtgataataattatggaccgaagaagtcttaa

SEQ ID NO: 16103 - protein, 257 aa, Caenorhabditis elegans
MSDEEQRIAEIESLASIFPDLLEETTDKQLVFKFDRDIGMTINLPEDYPSISPPIFELSGPYLRREQKEVLHNSLNDVYIENIGFPVIFNWISLVQDFIRDLPEEVAEPSHVADDVVTPMAEEIDDMNIRHGEVLTDRKSAFQAHLAEVRSKEDVDRVMRILKSNTKICRATHNITAYRYMTEINGKPIHHHDCVDDGEFGASSKMLELMDRMKADNVMVVVSRWYGGIHLGPDRFRHINNLTRQILSDNNYGPKKS

SEQ ID NO: 16104 - DNA, 843 bp, Schizosaccharomyces pombe
  CDS (1)..(843)
atggaaaataatgaagaatttcaagacgagctcttagctctagagagtatatatccttcttgtttactacctatatctgaacaaagcttcacttatactctgagtatcccagattcatctgtacgacttaacatccaattcccactcgactacccaaattcggctcctactgtcttagatgcttacgggatcgataaaacactggcagaggacgtcctcttgtctgttgcaacaggcgatgtatgtatattctcatatatggatttgctgaaagaattagtggatatagatgccgaacaagcagccgcagagagagaatccaaattgcaagaagaatcagacaaagaaacaccagtaatgctcaataaatctcattatgtagctaaaactccagaaattcaagacgaaccatggaaaccaaaattcgattggaaagagtcagaaccgatcacagatcgaaaaagcacctttatggctcatgcaacgcgtgtttattctacagaagaagttcgcgaagctctcgaagatttgtatatggataaaaaagttgcaaaggcgaatcataatatggtagcatatcggattatttccccaaacgggaacgttattcaggataatgatgatgacggagaatcagctgctggttctcgtatgagtcatttgctaactatgatgtctgccgaaaatgtttttgtttgcgtttcacgttggtttgggggcgttcacatcggaccagacagattcaaacatataaactcatcggctcgtgaagcagtattactcaccgacgctgctcctagtcagaaaaagggtacagaacatggcaaaaagaagaaaaaatag

SEQ ID NO: 16105 - protein, 280 aa, Schizosaccharomyces pombe
MENNEEFQDELLALESIYPSCLLPISEQSFTYTLSIPDSSVRLNIQFPLDYPNSAPTVLDAYGIDKTLAEDVLLSVATGDVCIFSYMDLLKELVDIDAEQAAAERESKLQEESDKETPVMLNKSHYVAKTPEIQDEPWKPKFDWKESEPITDRKSTFMAHATRVYSTEEVREALEDLYMDKKVAKANHNMVAYRIISPNGNVIQDNDDDGESAAGSRMSHLLTMMSAENVFVCVSRWFGGVHIGPDRFKHINSSAREAVLLTDAAPSQKKGTEHGKKKKK

SEQ ID NO: 16106 - DNA, 957 bp, Mus musculus
  CDS (1)..(957)
atggctgaagaggaagtagggaacagccagaggcagagtgaagaaatcgaagcaatggcagccatttatggcgaggagtggtgtgtcattgatgaaaatgccaaaatattttgtattagagtcactgacttcatggatgaccccaaatggacactttgtttacaggtgatgttgccaagtgagtacccgggtacagcaccgccttcttatcagctgaacgctccctggctgaaagggcaagaacgcgcagacttatcgaacagccttgaggagatatatgtccacaacatgggtgaatctattctttaccagtgggtggagaaaataagagatgctctgatacagaaatctcagataaccgagccagacccagatgtcaagaagaaaactgaagaggttgaggttgagtccgaagaagaccctattctagagcacccgccggaaaatccagttaaaacattggacctcaaaatcagtgaagaaactcaaccagaaactgaagaattgcctccagttgctcatggcgttcctattactgaccgaaggagcacttttcaggctcatgtggcccctgtcgtctgtcctgagcaggtgaaactggttcttgccaagctgtacgagaataagaagattgccagcgccacccacaacatctatgcctacaggatattctgtgaggataaacagaccttcttgcaggactgtgaagatgatggagaaacagctgctgggggccgccttcttcacctcatggagattttgaatgtgaagaatgtcatggtggtggtgtcccgctggtatggagggattctgctgggacctgaccgtttcaaacacatcaacaactgtgccaggaacattctggtggagaagaacttcacgaacactcctgacgagtcaactaagaatttggggaaaaagaaggtgaagaaagacaagaagaagaatgatcattaa

SEQ ID NO: 16107 - protein, 318 aa, Mus musculus
MAEEEVGNSQRQSEEIEAMAAIYGEEWCVIDENAKIFCIRVTDFMDDPKWTLCLQVMLPSEYPGTAPPSYQLNAPWLKGQERADLSNSLEEIYVHNMGESILYQWVEKIRDALIQKSQITEPDPDVKKKTEEVEVESEEDPILEHPPENPVKTLDLKISEETQPETEELPPVAHGVPITDRRSTFQAHVAPVVCPEQVKLVLAKLYENKKIASATHNIYAYRIFCEDKQTFLQDCEDDGETAAGGRLLHLMEILNVKNVMVVVSRWYGGILLGPDRFKHINNCARNILVEKNFTNTPDESTKNLGKKKVKKDKKKNDH

SEQ ID NO: 16108 - DNA, 780 bp, Candida glabrata
  CDS (1)..(780)
atggatgaactagttgtagaagaattggagtctctggaagctatctaccctgacttactgaagagagatgatgcagagaatatatttgccatgaaggtacctcaacatgagaagttcacggtcaagatctctttgcctgataagtatccagcaactgaaccgccccatgtcctcgaagtttctgtggctcaaggagattacgactcaaagtatctcacgacactgtttcaagaagtcatggattccatgtttcaccagggttctgtttgcctgttcgatttcttcactgaattggatggtgtgctatatgatgatgaagaggaatcgtctatggatgccgctgaagtagtagataattctgctttagttcccgtggatccatttgaaggctggactgcgtcggatcctatcagtgaccgtgggtcaacatttatggcgtttgcagctcatgtaaattccgaggaggaggcattccaaatgcttgatcatttgaagaccgattctaagatgaggagggctaaccatgccatgtgtgcctggagaattaagaaacaaacagatagtaacgatatcatctaccaggattgtgacgacgacggagaaaccgcagcaggatcccgaatgctacatttagtgactatcatggatgtgtggaatgttatcgttgtagtagctcgttggtttggtggtgtacatattggtccagataggttcaaacacatcaactcaacggcaagagaggcaatcctgcgggcaggctttacaccagccaaaaaataa

SEQ ID NO: 16109 - protein, 259 aa, Candida glabrata
MDELVVEELESLEAIYPDLLKRDDAENIFAMKVPQHEKFTVKISLPDKYPATEPPHVLEVSVAQGDYDSKYLTTLFQEVMDSMFHQGSVCLFDFFTELDGVLYDDEEESSMDAAEVVDNSALVPVDPFEGWTASDPISDRGSTFMAFAAHVNSEEEAFQMLDHLKTDSKMRRANHAMCAWRIKKQTDSNDIIYQDCDDDGETAAGSRMLHLVTIMDVWNVIVVVARWFGGVHIGPDRFKHINSTAREAILRAGFTPAKK

SEQ ID NO: 16110 - DNA, 819 bp, Ashbya gossypii
  CDS (1)..(819)
atggcactaaatgaggaggtagcagaggagatttctgccgtagatgccatctaccctgggaatctcagcaggttaagcgagaatagagtacttattaggattcctaactatgaagagatcgccatacaaatatcatttccctctaactatcctgcggaagagccgccccacatcctggagatatcgatcagccacgagaaagttcaaagatacgagcggagtgatttgcagccagtttgcgaggagctgatggcatccgtttactccaaaggctttgtatgccttttcgattttatcagcgagctgagcaatgtgctgtacgagagatttggcgcgcaggacgacgacacagaagacgatgaactggcggagaggatgggacacctgaacttggatccctttgacggatggatcgctagcgatccaattacggatcggagctccacctttatcgcatacgcggcgcacgtgaactccgaagaagacgcctgtctcaggatagatcaactgaagaccgacaacaagatctcaaaatgcgcgcatttaatgacagcatggcgtatacacggggagaacggagtagcgtacaaagactgcgatgatgatggcgaggcagcagccggcagcagaatgctacacctactgaataccatggacgcatgggatgtcgtcgtggcagtagcgcgatggtttggcggcgtacatattggcccggaccgcttcaagcacattaactcatgcacgcgtgacgcattgatcaagggggattttgtgtcccaagcgaaggcagggtcggcttcgaagaagaccaagaaataa

SEQ ID NO: 16111 - protein, 272 aa, Ashbya gossypii
MALNEEVAEEISAVDAIYPGNLSRLSENRVLIRIPNYEEIAIQISFPSNYPAEEPPHILEISISHEKVQRYERSDLQPVCEELMASVYSKGFVCLFDFISELSNVLYERFGAQDDDTEDDELAERMGHLNLDPFDGWIASDPITDRSSTFIAYAAHVNSEEDACLRIDQLKTDNKISKCAHLMTAWRIHGENGVAYKDCDDDGEAAAGSRMLHLLNTMDAWDVVVAVARWFGGVHIGPDRFKHINSCTRDALIKGDFVSQAKAGSASKKTKK

SEQ ID NO: 16112 - DNA, 900 bp, Neurospora crassa
  CDS (1)..(900)
atgtccgaacaactagccgacgagctcgaggccatcaactccatctacggcgacggcactctctccccatccgacgacgactcacccgccacttacatcctgactctccccggcgacatcacctcatccaccctgcgtctgcagttccccccagcctaccccgatgaaccacccgtcgttctcggcacccactcctccggcgagcatgctaagcgcggcgccgctgctcgagacctggctctcttccgcgacgcagtcggcgaggtgtacgagccgggccaagtctgtctgtttgatgccattgagcaagtgaaggaactcatagccgcagtcaccacggcggagaaggaggatgaggaggaggaggaggacgtggaggaaggaaatggaaagagggtatcctcatatgacgcaacagcagcaactcatgatacacagacaggaggaggggggggaggagatctccttggccccgaacctccctggacgctctcccttcccatgatcgaactcaaatcgaccttcatcgcccgctgcgcgccagttacctctccgcaacaggcggcgcagtacctgcaacacctgctggcgtcggacaagcgggtccgggcggctacgcacaacatcacggcgtggcggatccgcgggccaaacggcacgtcgttccaggactgcgacgacgacggggagacggcggcgggcggcaggctgctacatttgatgcagctgatggacctgtgggacaccatggtcgtggtgacgcggtggtatggaggccaaaagttggggccgaggaggttcgcgctgattaacggcgcggcgagggatgcgtttgttagggcggggttggtggacgaggagaacaagcaggaagggaagaagaagaagggtgggaaatga

SEQ ID NO: 16113 - protein, 299 aa, Neurospora crassa
MSEQLADELEAINSIYGDGTLSPSDDDSPATYILTLPGDITSSTLRLQFPPAYPDEPPVVLGTHSSGEHAKRGAAARDLALFRDAVGEVYEPGQVCLFDAIEQVKELIAAVTTAEKEDEEEEEDVEEGNGKRVSSYDATAATHDTQTGGGGGGDLLGPEPPWTLSLPMIELKSTFIARCAPVTSPQQAAQYLQHLLASDKRVRAATHNITAWRIRGPNGTSFQDCDDDGETAAGGRLLHLMQLMDLWDTMVVVTRWYGGQKLGPRRFALINGAARDAFVRAGLVDEENKQEGKKKKGGK

SEQ ID NO: 16114 - DNA, 963 bp, Homo sapiens
  CDS (1)..(963)
atggctgagggggacgcagggagcgaccagaggcagaatgaggaaattgaagcaatggcagccatttatggcgaggagtggtgtgtcattgatgactgtgccaaaatattttgtattagaattagcgacgatatagatgaccccaaatggacactttgcttgcaggtgatgctgccgaatgaatacccaggtacagctccacctatctaccagttgaatgctccttggcttaaagggcaagaacgtgcggatttatcaaatagccttgaggaaatatatattcagaatatcggtgaaagtattctttacctgtgggtggagaaaataagagatgttcttatacaaaaatctcagatgacagaaccaggcccagatgtaaagaagaaaactgaagaggaagatgttgaatgtgaagatgatctcattttagcatgtcagccggaaagttcggttaaagcattggattttgatatcagtgaaactcggacagaagtagaagtagaagaattacctccgattgatcatggcattcctattacagaccgaagaagtacttttcaggcacacttggctccagtggtttgtcccaaacaggtgaaaatggttctttccaaattgtatgagaataagaaaatagctagtgccacccacaacatctatgcctacagaatatattgtgaggataaacagaccttcttacaggattgtgaggatgatggggaaacagcagctggtgggcgtcttcttcatctcatggagattttgaatgtgaagaatgtcatggtggtagtatcacgctggtatggagggattctgctaggaccagatcgctttaaacatatcaacaactgtgccagaaacatactagtggaaaagaactacacaaattcacctgaggagtcatctaaggctttgggaaagaacaaaaaagtaagaaaagacaagaagaggaatgaacattaa

SEQ ID NO: 16115 - protein, 320 aa, Homo sapiens
MAEGDAGSDQRQNEEIEAMAAIYGEEWCVIDDCAKIFCIRISDDIDDPKWTLCLQVMLPNEYPGTAPPIYQLNAPWLKGQERADLSNSLEEIYIQNIGESILYLWVEKIRDVLIQKSQMTEPGPDVKKKTEEEDVECEDDLILACQPESSVKALDFDISETRTEVEVEELPPIDHGIPITDRRSTFQAHLAPVVCPKQVKMVLSKLYENKKIASATHNIYAYRIYCEDKQTFLQDCEDDGETAAGGRLLHLMEILNVKNVMVVVSRWYGGILLGPDRFKHINNCARNILVEKNYTNSPEESSKALGKNKKVRKDKKRNEH

SEQ ID NO: 16116 - DNA, 24 bp, Primer
atggatgacgatcacgaacagttg

SEQ ID NO: 16117 - DNA, 21 bp, Primer
ttacgagtcgaagccggccct

SEQ ID NO: 16118 - DNA, 1110 bp, Saccharomyces cerevisiae
  CDS (42)..(1082)
tcgaaaagacagaggtcgtactagcagagatagcaaatcagatggaggacggtaaacaggccatcaatgagggatcaaacgatgcttcgccggatctggacgtgaatggcacaatattgatgaataatgaagacttttcccagtggtcggttgatgatgtgataacttggtgtatatccacgctggaggtggaagaaaccgatccattatgtcagagactgcgagaaaatgatattgtaggagatcttttgccggaattgtgcttgcaagattgccaggacttgtgtgacggtgatttgaataaggccataaaattcaagatactgatcaataagatgagagacagcaagttggagtggaaggacgacaagactcaagaggacatgataacggtactgaaaaacttgtacactactacatctgcgaaattgcaagaatttcaatcgcagtacacaaggctgaggatggatgtcttggacgtaatgaagaccagctcaagctcttctccgattaacacacatggagtgtccactacggtaccttcttcaaacaacacaattatacccagtagtgacggtgtgtctctttcacaaacagactatttcgacacagttcataaccgacaatcaccgtcaaggagagaatccccggtaacggtatttaggcaacccagtctttcccactcaaaatctttgcacaaggatagcaaaaacaaagtaccccaaatatctacaaaccaatctcacccatctgccgtttcaacagcgaacacaccggggccatcacctaacgaggcgttaaaacagttgcgtgcatctaaagaagactcctgcgaacggatcttgaaaaacgcaatgaaaagacataacttagcagatcaggattggagacaatatgtcttggtcatttgctatggggatcaagagaggctgttagaattgaacgaaaagcctgtgatcatattcaagaacttaaagcaacagggtttgcaccccgccattatgttaagaagaagaggtgatttcgaagaagtagcaatgatgaacggaagtgacaatgtcacccccggtggaagactctaatgtgcagttgtcatgcacatcatcatac

SEQ ID NO: 16119 - protein, 346 aa, Saccharomyces cerevisiae
MEDGKQAINEGSNDASPDLDVNGTILMNNEDFSQWSVDDVITWCISTLEVEETDPLCQRLRENDIVGDLLPELCLQDCQDLCDGDLNKAIKFKILINKMRDSKLEWKDDKTQEDMITVLKNLYTTTSAKLQEFQSQYTRLRMDVLDVMKTSSSSSPINTHGVSTTVPSSNNTIIPSSDGVSLSQTDYFDTVHNRQSPSRRESPVTVFRQPSLSHSKSLHKDSKNKVPQISTNQSHPSAVSTANTPGPSPNEALKQLRASKEDSCERILKNAMKRHNLADQDWRQYVLVICYGDQERLLELNEKPVIIFKNLKQQGLHPAIMLRRRGDFEEVAMMNGSDNVTPGGRL

SEQ ID NO: 16120 - DNA, 969 bp, Candida glabrata
  CDS (1)..(969)
atggacgacagtcagaagaccttgaggcaaggcacgctgctcaaggataactttgataagtggaccacagacgaagtggtgcaatggtgtgggactgtgcttggaaaggacgagcaggagccgctattcactcgtatcagagacaataatatagacggcagtgtgttgcaggagctcacgcttcaagactgcaaagagcttaccgataatgacttgaaagaggctatcaagctgaaattgtggctaaacaagcttatcgattcacaattaggtgaggatgacgtgcctacagaagacatagttgtagtattgaagaatttgcatactacagtgtcacagaaattgctggatttccaaagtcagtactccggtttgcgagcagatgtggtggaaatcatgaagagatcgaagactgctgaacatggtatgtcctcgcctcaactaacaccatcaactgcttcatcaaagccttctggtgcgagaacagactacttcgatcatggccagctgcggcaatcgcctagagcgaaagaagtacgccccactttgctatacaataaatctacacctaatagtaatagcaatagcaatagcaagtatcatgatcaaattatacatgccaattcatcattaactatacccaatattaagagtaatctctccccaatagagccacttaaacaattgaaagcctcgaaagaggattcctgtgagaagatactgaagaatgcaatggtaaggcataatttagctgatcaagattggaaacaatatgtattagtaatatcttatggtgatcaagaacgtattctagacttagctgaaaaaccagtagtgatatttaagaatttgaaaaggcaaggacttcatccttctatcatgctgagaagacggggtgattttgaggaagtggacatgtccatgaatggattgagctctgctgatgttacacctggtggacgattataa

SEQ ID NO: 16121 - protein, 322 aa, Candida glabrata
MDDSQKTLRQGTLLKDNFDKWTTDEVVQWCGTVLGKDEQEPLFTRIRDNNIDGSVLQELTLQDCKELTDNDLKEAIKLKLWLNKLIDSQLGEDDVPTEDIVVVLKNLHTTVSQKLLDFQSQYSGLRADVVEIMKRSKTAEHGMSSPQLTPSTASSKPSGARTDYFDHGQLRQSPRAKEVRPTLLYNKSTPNSNSNSNSKYHDQIIHANSSLTIPNIKSNLSPIEPLKQLKASKEDSCEKILKNAMVRHNLADQDWKQYVLVISYGDQERILDLAEKPVVIFKNLKRQGLHPSIMLRRRGDFEEVDMSMNGLSSADVTPGGRL

SEQ ID NO: 16122 - DNA, 1083 bp, Ashbya gossypii
  CDS (1)..(1083)
atgtctgcaacaccggataccgggagctgtttgatagcgaaccatttgagctggacagtcgatgaggttatagagtgggcatttggggaactgcagctgacaggaggtgcgaaaatggcagagacagcaggtcctgaagctgcaggcggatgcgaaaaggacggtgtgactggcgcgcagcctgaggggcttggcggcttaaccgaggcgggcggcgcgggtactgcgccgacgttggattcctgtagacgtaactttcggcagcacaagatcacaggcgatgtgctgccctttctaacgctggatgactgcaagcagttgttcgacggcgatgcgcgactgggtgtgaagttcaagatagccatcaacggactcaagagattcgaaagcggcactacggccatcaacaaggagctcgtggcaacattgaacaatctgcataatacgatcgccgataagctgcaggaataccaatcgcaatacgcccgtctgcgtgtggatattctagaggtaatgaaacggagcattacgccgtcgtccggtatcgccccgggcgcgcatacgcaccactctacacagatgcaggattattttgaaaggccacagcagcacggtcactcgggacatccgtcgcccatctcaccgcgtaatcacccggcggcgcccgctgcccagcggagaaccagttccaataaccctccgggtattggcgtggcgggtcctccgcctccagttgttccttcgaacgcagggatagccacctcaggaaacaacagttccgggcaggtatcgacaactgctagccccaacgagccgctgaagcagctgcgggcatccaaagaggactctacagaaaagattctgaaaaatgctatgaagaaacataacctgaacgaggcggactggcggcagtacgtgcttgttatatgctatggcgacaaggagagaatcctagaaatggacgagcagcccgtagtaatattcaaaagcttaaagcaacagggcctccatcccgcaattatgctgcggcagaagggtgacttcgaggaagttggcgatctgacaccaggaggtagattgtag

SEQ ID NO: 16123 - protein, 360 aa, Ashbya gossypii
MSATPDTGSCLIANHLSWTVDEVIEWAFGELQLTGGAKMAETAGPEAAGGCEKDGVTGAQPEGLGGLTEAGGAGTAPTLDSCRRNFRQHKITGDVLPFLTLDDCKQLFDGDARLGVKFKIAINGLKRFESGTTAINKELVATLNNLHNTIADKLQEYQSQYARLRVDILEVMKRSITPSSGIAPGAHTHHSTQMQDYFERPQQHGHSGHPSPISPRNHPAAPAAQRRTSSNNPPGIGVAGPPPPVVPSNAGIATSGNNSSGQVSTTASPNEPLKQLRASKEDSTEKILKNAMKKHNLNEADWRQYVLVICYGDKERILEMDEQPVVIFKSLKQQGLHPAIMLRQKGDFEEVGDLTPGGRL

SEQ ID NO: 16124 - DNA, 1464 bp, Aspergillus fumigatus
  CDS (1)..(1464)
atgtctctgcatacatcctaccatgcggactccgacgcggatgatgagtacgaacggagtgtgattacctcccctcatctagcgaccgattctgaggcttctccctccgactccgaattcccttcagccgaacacactcctaggacatttgcaaatcccgaggaagatcctcgatcgccgaagactatcattacagagtggaccgctgaggagtgcgcaaactggcttgctgcccttggtctccgtcagtactgcgcaacttttcttgagaacgaaatcgtcggcgaagcattgattgcgctcaaacacgaggaattgaaagagatgggcatcaccagtgttgggcaccgattgaccattttgaagagtgtatacgagactaaagtcaagcaagacattcccctcgaccctgaccactacatacctctttcggcggaccaaagcatgaacgaaacggccacacaagaggacattgctcgtttgatacaatcgatccggttacgagatgaaaaaatcgtcagtgtcgagtcggagttgcggcgcgttgcagaggagtatcgccggcttcgcgaagagcttcttcctgtcttcaaaatggccaaggatcgatcacagccactcccacctccatcatcagcaggcccgggagcggatggccaccacgaaggccaaacccttgtgtcgccctctggaaacaccttgattgagcgcgcagcgtccggaatctcgcggactttctccaagcgtgtctacacgggggggtccacaccgaaaaataactcgcctacgcatatccctccatcaatacacgaaggacgaccgtacaacgacaacggtggactggacccttctgctgccgcgaattcgtcccatcttagcgccttgaacggcaagccacagttgtcaccgggcatgccatcgccaacgtctcctggcgctcactacggtgctcatcagacgcttgcatcacgttcttacacacaaccgaattcgggtcgcacaggctatgatcatcccgaagatactccgacagcacaatcacgtcccgatcggttgaatccaacccccacacaagcgtcacgccctgatgttcccacacggtctgattcccgagcgggtgcggatccacctagcgtcgagatcttcaagtcattccgtgtttccatggatgacccttgtcataaagttcttcccgccgcactcaaaaagtacaatatcaacgccgattggaagcagtatgcattgtacattgtgtacggtgatcaagagcgatgcctaggactggaggagcggccgcttattcttttcaagcagctcgagaaggaggggagaaaaccgatgttcatgctacgaaaacagctgcatcccattgacaacgcttacaccagcgggggctctgcccccaatagtgcaggtttcgagggcagacaaggccagatcaacctacctggcggcgttttgtga

SEQ ID NO: 16125 - protein, 487 aa, Aspergillus fumigatus
MSLHTSYHADSDADDEYERSVITSPHLATDSEASPSDSEFPSAEHTPRTFANPEEDPRSPKTIITEWTAEECANWLAALGLRQYCATFLENEIVGEALIALKHEELKEMGITSVGHRLTILKSVYETKVKQDIPLDPDHYIPLSADQSMNETATQEDIARLIQSIRLRDEKIVSVESELRRVAEEYRRLREELLPVFKMAKDRSQPLPPPSSAGPGADGHHEGQTLVSPSGNTLIERAASGISRTFSKRVYTGGSTPKNNSPTHIPPSIHEGRPYNDNGGLDPSAAANSSHLSALNGKPQLSPGMPSPTSPGAHYGAHQTLASRSYTQPNSGRTGYDHPEDTPTAQSRPDRLNPTPTQASRPDVPTRSDSRAGADPPSVEIFKSFRVSMDDPCHKVLPAALKKYNINADWKQYALYIVYGDQERCLGLEERPLILFKQLEKEGRKPMFMLRKQLHPIDNAYTSGGSAPNSAGFEGRQGQINLPGGVL

SEQ ID NO: 16126 - DNA, 23 bp, Primer
atggaggacggtaaacaggccat

SEQ ID NO: 16127 - DNA, 22 bp, Primer
ttagagtcttccaccgggggtg

SEQ ID NO: 16128 - DNA, 2063 bp, Saccharomyces cerevisiae
  CDS (301)..(1872)
taataattatagcataatatatattcataatgtataggcatatttattttttattttttttatttcatgttctatttaatgacgaatcacgaagaaaatatatctaagaaaagatcttttgaatccttgatttgcgaatagtttaaatgacccagcttattgctctggtgaaaaaaaactttgtgcggtctcaaagccgtcggcggcaaaataacgtgaattgatgaaagtaaataaacaaaacaaaatctctaattgttgtaacacaaatactaagaaatttgttagctaattcgggacatgtaccaaaataatgtattgaatgctattttggcttctgaaaaatcaaactttcaatacgatagtggaacaatattaagaaaccacaaaagaccaataataacatttaataacaacatagagcacacagtatccgaacctaataattttacaggctatgaggaaaaggaagatttggatataatggatatttgtccttattacccaaaagcaagaatgctggcggatgccattcaacatgccaaaacgagcgcaagtgaaaacaaaatggaactatcaatgaaaactatcccatgtctcaagaaggaaaacgtccatgttgagaaagggcacgattggtctcaactcagtacgagcagaatttgtaaaattttagaagacatagcagataaaaaaaataaaactagaaggcaatctgccccattacaaaagacgaagtatttcccaacaaatgagaatcaaaataccgatatagaaaatcagaattggtcccaaatccccaatgaagacatatgtgcacttatagagaagattgctagcagacgcaataaaaatcgcaaacggaaaaatctttcatgttctaaagtccaagaaattcagggaaatattgatttacccaaaaaagacgtacaagagggagatatttcagattcgtctctatttgcagcagtaagaggaaccaaaaaagtttccggatatgattacaattcagaagataagatacctaatgcgatacgtcttccttactgtaagcaaatattacgattattctcacttttacaaatgaagagaaatgacttaatagtcacctctgaaaattgtaatagcggagttttcttcagcaattttaattatcaacttcaagttaaatcgaattgtattgcaaatatttcttctacactcagttttctaccccatcatgaaataaccgtatacacatcctttattctctatccaaacgttgtcgataatatttgggaatgcacacgatacgctattcaacttttgaagtccgaagcagcacagtttacgctactgcgtgatatatatagtggcttcacaattatactttcaaatcatcgatatcatcctaagggttttagcgctgattactgttacagtgcaaatgaattgacattatttctttttgttattcgaacagggcaaaaaaaagtactttatcgatctattcctcacaacacagcagcaattgaaaaagacagttcttttgatacagaaaatagaaagagaaggtccgaggaagaggttgttcttaaatgtaggaagtgttctaataattcattggcattaaaagaaatcagcacctatcgtttggatagcgcagaaggttttgagaagtctcagcctctaaaagatgaagcaaagctcagtgatatgaattatgtacaaggtagtatcagctataacaggactattcttaccggcttatggaaattatttcacagattgtgctgcaaagatcgttataggaaaaccaatctgtcagaaacattgttctatgacgattcaacggaaagatgggttagaatgggagagttaatgcactattgaaagggagatgcttcaataacttttttcatgaaaaactatttaataaatttaatatatatacttcagaatgaaaaacaaatgaatagtttttactgaatatgtaagtggtatgtggaataagaaactcaaatgaagcaatggctatttacagatgttccaaaacttttcgcatttatatacatattgcctta

SEQ ID NO: 16129 - protein, 523 aa, Saccharomyces cerevisiae
MYQNNVLNAILASEKSNFQYDSGTILRNHKRPIITFNNNIEHTVSEPNNFTGYEEKEDLDIMDICPYYPKARMLADAIQHAKTSASENKMELSMKTIPCLKKENVHVEKGHDWSQLSTSRICKILEDIADKKNKTRRQSAPLQKTKYFPTNENQNTDIENQNWSQIPNEDICALIEKIASRRNKNRKRKNLSCSKVQEIQGNIDLPKKDVQEGDISDSSLFAAVRGTKKVSGYDYNSEDKIPNAIRLPYCKQILRLFSLLQMKRNDLIVTSENCNSGVFFSNFNYQLQVKSNCIANISSTLSFLPHHEITVYTSFILYPNVVDNIWECTRYAIQLLKSEAAQFTLLRDIYSGFTIILSNHRYHPKGFSADYCYSANELTLFLFVIRTGQKKVLYRSIPHNTAAIEKDSSFDTENRKRRSEEEVVLKCRKCSNNSLALKEISTYRLDSAEGFEKSQPLKDEAKLSDMNYVQGSISYNRTILTGLWKLFHRLCCKDRYRKTNLSETLFYDDSTERWVRMGELMHY

SEQ ID NO: 16130 - DNA, 27 bp, Primer
atgtaccaaaataatgtattgaatgct

SEQ ID NO: 16131 - DNA, 25 bp, Primer
tcaatagtgcattaactctcccatt

SEQ ID NO: 16132 - DNA, 5356 bp, Saccharomyces cerevisiae
  CDS (428)..(3355)
taaatgtctacatacatacatacatctcgtacataaatacgcatacgtatcttcgtagtaagaaccgtcacagatatgattgagcacggtacaattatgtattagtcaaacattaccagttctcgaacaaaaccaaagctactcctgcaacactcttctatcgcacatgtatggttcttattgtttcccgagttcttttttactgacgcgccagaacgagtaagaaagttctctagcgccatgctgaaatttttttcacttcaacggacagcgattttttttctttttcctccgaaataatgttgcagcggttctcgatgcctcaagaattgcagaagtaaaccagccaatacacatcaaaaaacaactttcattactgtgattctctcagtctgttcatttgtcagatatttaaggctaaaaggaaatgttgtcgagactatctttattgagtaactcgagggcgttccaacaggccagatggcgcatttaccgcttaaaagtttcgccaactgtgcatgcttctcaataccatattctttctggtaggaaacttgctcaatctattcgagaaaaagccaatgatgagatacaagccattaagcttaagcatcctaatttcaagcctaccttgaaaatcattcaagtcggggccagaccagactcatctacgtacgtgaggatgaaattgaaagcttcaaaggacagcaatgtagactgtatcatagagaagttaccagcagaaatcactgaagttgagcttttgaagaaaattagtgacatcaatgatgatgactctatccatgggttgctaattcaactacctctaccgcgtcacttggatgaaaccacgattacaaacgctgtggactttaaaaaggacgttgatgggttccacagatataatgctggtgaattggctaaaaaaggagggaaaccatacttcataccatgtactccttatggttgcatgaaattacttgaagaagctcatgttaagttagatggtaagaacgccgtcgtgttaggcagatcaagtatcgtcggaaatccaattgcttcgttgttgaaaaatgcgaatgccactgttactgtctgtcatagtcatacaaggaacattgcagaagtggtctcccaagctgatatagttatcgcagcttgcggtattcctcaatacgttaaatcagactggattaaagaaggcgccgtggttattgatgtaggtatcaactacgtacctgatatcagtaagaaaagtgggcaaaaattagttggtgatgttgattttgattctgtaaaggaaaagacatcttatattacccctgttcctggtggagtgggtccaatgactgtcgctatgcttgtttccaatgtactattagctgctaaaaggcaattcgtggaatctgaaaagcttccagttatcaaacctcttccattacacttagaaagtccagtgccttcagatattgatatatcaagagctcagagtcctaagcatatcaagcaagttgccgaggagttgggaatccactctcacgaattagaattatacggccactataaggcaaaaatttctccaaatatttttaaaagattagaatctagagaaaacggtaagtacgtccttgttgcaggtattactccgactccattgggtgaaggtaaatccactacgactatggggttggtgcaggctttatccgctcatttagggaaaccatccatcgcgaacgttagacaaccatctcttggcccaaccctgggtgtcaaaggtggtgctgctggtggtggttatgcccaagttattcctatggacgagttcaatttacatttgaccggggatattcatgctatcagcgctgcgaacaatcttcttgcagcagctatcgacactagaatgttccatgaagccactcagaagaatgatagtacattttacaagagactagttccaagaaaaaaaggcatcagaaagtttaccccatccatgcagagaaggcttaaaagattggatattgaaaaagaagaccctgatgctttaacacctgaagaagtcaaaagatttgctagattgaacataaatcccgatactatcactatcagaagagttgtcgacatcaatgacaggatgttaagacaaattaccattggcgaagccgctacggagaagggttttacaaggaccactggattcgatatcactgttgcctctgaattaatggccattttagctctatctaaaagcttacacgagatgaaggaacgtattggacgcatggttattggtgctgattatgataacaaaccagtaacagtagaagatattggctgtaccggtgctctgactgcattattacgtgacgctataaagcctaacttaatgcaaactttggaagggacccccgtaatggttcacgctggtcctttcgccaacatctccatcggcgcatcatcagtaattgcagacttaatggcattgaagcttgttggttcagaaaagaacccgttaaatgacaagaacatccatgaacctggttatgtagttactgaagcaggattcgattttgccatgggtggtgaaagattctttgatatcaaatgtcgttcctctggattggtgccagatgcagttgtcttagtcgcaaccgtaagagctttgaaatctcatggaggtgctccaaatgttaagcccggacaatcattaccaaaagaatacacagaggaaaacatcgattttgttgccaagggtgttagtaatttggttaagcagattgaaaacatcaaaacgtttggaataccagtcgttgtagcaatcaacagatttgaaacagactcacaggcagagattgaggtaatcaagaaagcagccttgaatgctggcgcatctcatgccgttacttctaatcactggatggaaggtggtaaaggtgcagtagaattagcacatgctgtggtagatgcaacgaaagaaccaaagaactttaactttttgtacgacgtcaatagctccatcgaggacaagcttaccagcatcgtccaaaaaatgtatggtggggcaaaaatcgaagtatcaccagaagcccaaaaaaagatagacacctacaaaaaacaaggcttcggtaatcttcccatctgtattgctaagacacaatattcattatcccatgatccatcattaaagggtgttcctagaggttttacgttccccatcagggatgtgagagcttcaataggtgcaggttatttatacgctttggctgcagaaattcaaaccataccgggtctatcgacatatgctggttacatggcagtagaagtcgacgacgacggtgaaattgaaggtctattttaaatagtttggcagactcctaatggcatcaattcgacctcgatgtccgtctgcacgagtaccctttatataaacaattgagatgagaatattagaaaaatgggttttagttatgtaggtatatgtgcatacatacgtattatcgaagtttttgctacctgtttattaactgagtatgtatattaagataaattaattaaagaaaatttaagcgtcttccttcaataaagcatctctcttttcagcaactctttgagctcttctgtcacgagcagctctgttcttcaatcttctagcttcagcttcttcgttcaaagccttttcacgttgagcatcagccttagcttggatgatgtgttcaaccaaggctctcttgtgtttgaaagcgttacccttagattccttgtacaaaacatggtacaagtgcttgtcaatcttaccagcatcacggtacttagccaataatcttctcaagacacgtaatcttctgatccagacaacttgggatggtaaacgggcttctctggtaccctttctcttaccgtaaccactgtgacgaccttctctcttagattgagcatgggctctggttctggatttagagtggacggtaacggccttctttacgatggtaccgttcttaaccaattttctaatggcgtttctggagttggcttgagcaatttcagaggtttcatttggatctaaccaaacctttctcttaccgacaccgacgacagaagcggcaagtctcttttgagtacgtaaattagccctgttaaagtcatgttagttattatcgttctgtaagaaggaaaaagtctattcgcgtcgaaagatagaaattgcggtggtagacactttaaaactcgctatagaaaaatgacatggttattatgtatgctggatactgcagcagctcgagtaacttttatcacgtaactggttctcgtattgaatactcatattaatggtctcacttatcgctataaatatcttaatggtaaactgcacagaaaaaaaattcttccacaagtttcctcttttgccttttagtgctaaaactccgattatagaaacatctggcttcactagcatattcatgatgcaaatggaacacagtatcgttcttggcatatattacccatatcacttttcaataacgctggtgtttcaggtgataactcatcaaactcgcattcctcaagagggagttattataacaattctatcttattcctgataaactttcatagattcattattcactgcatcacatacatttttgctttggagttcttaatcaactttctatgtgaagcgtaaaatcaatagttaccttgtattctctgttgatcactgtccaaacctatatttttgtttccccctcagagaagttaggtcgatgcctatcgtagtttgcaaggaagacggcttccaactgagaccgccctagtctggcaggattcgtgaaaggagtccatgccagctgctacccagggattgccacggccccggccagcgtatagtacactgtcaggagcaattcgaagaggcaaccaaaattatgctaagcatcgcactctctctcagtctggtgctaagcggaagacatgcttccaatggcctcctcaccgagaacggatattaaacgaaacgaagaaaaaaaatcttcacggaaaatgcgtaatgtctggatgacaaaatgcatgggtgtaaaaaaggaaatgagacgaacttgtaataaaccttagtgggttgacgaattttgaaataaagtttttcctttttttttttttttttctttttcattgtttggttgccttcaaattacatataagatttctcgagaagggttttccattgtccttttcattaggcgttgaagtgaatctaaagtgcgcttgaatgatttcagatagaaagactaaagaagtggtgtgagtataattaactcaattgaagacggtttacctgaagtgatatactgtgccttgagaaaca

SEQ ID NO: 16133 - protein, 975 aa, Saccharomyces cerevisiae
MLSRLSLLSNSRAFQQARWRIYRLKVSPTVHASQYHILSGRKLAQSIREKANDEIQAIKLKHPNFKPTLKIIQVGARPDSSTYVRMKLKASKDSNVDCIIEKLPAEITEVELLKKISDINDDDSIHGLLIQLPLPRHLDETTITNAVDFKKDVDGFHRYNAGELAKKGGKPYFIPCTPYGCMKLLEEAHVKLDGKNAVVLGRSSIVGNPIASLLKNANATVTVCHSHTRNIAEVVSQADIVIAACGIPQYVKSDWIKEGAVVIDVGINYVPDISKKSGQKLVGDVDFDSVKEKTSYITPVPGGVGPMTVAMLVSNVLLAAKRQFVESEKLPVIKPLPLHLESPVPSDIDISRAQSPKHIKQVAEELGIHSHELELYGHYKAKISPNIFKRLESRENGKYVLVAGITPTPLGEGKSTTTMGLVQALSAHLGKPSIANVRQPSLGPTLGVKGGAAGGGYAQVIPMDEFNLHLTGDIHAISAANNLLAAAIDTRMFHEATQKNDSTFYKRLVPRKKGIRKFTPSMQRRLKRLDIEKEDPDALTPEEVKRFARLNINPDTITIRRVVDINDRMLRQITIGEAATEKGFTRTTGFDITVASELMAILALSKSLHEMKERIGRMVIGADYDNKPVTVEDIGCTGALTALLRDAIKPNLMQTLEGTPVMVHAGPFANISIGASSVIADLMALKLVGSEKNPLNDKNIHEPGYVVTEAGFDFAMGGERFFDIKCRSSGLVPDAVVLVATVRALKSHGGAPNVKPGQSLPKEYTEENIDFVAKGVSNLVKQIENIKTFGIPVVVAINRFETDSQAEIEVIKKAALNAGASHAVTSNHWMEGGKGAVELAHAVVDATKEPKNFNFLYDVNSSIEDKLTSIVQKMYGGAKIEVSPEAQKKIDTYKKQGFGNLPICIAKTQYSLSHDPSLKGVPRGFTFPIRDVRASIGAGYLYALAAEIQTIPGLSTYAGYMAVEVDDDGEIEGLF

SEQ ID NO: 16134 - DNA, 1053 bp, Arabidopsis thaliana
  CDS (1)..(1053)
atgatcgcgaggaaagctttggcctcggcgcatactaaggcgtttcgtttggcaacaagggatgtacattgctttagttccatcttagtgtctcctcctctcgtgtcacttgacttgcctgaaaattggattccttactctgatcctccacctcctgtttcctttgagactgaacagaagactgtggtgatagatggtaatgttatcgctgaggaaatcagaacaaagattattagtgaagtggggaagatgaaaaaggctgttggaaaagtccctggtcttgctgttgttttggttggtgaacaaagagactcgcaaacttatgttcgcaacaaaattaaagcttgtgaagaaactggcattaaatctgttttggctgaattaccagaggattgtactgaaggacagattatcagtgtattgagaaaattcaatgaagacacgtctattcacggaattcttgtgcaacttcctttaccccaacatcttaatgaatcaaaaatcttgaatatggtgagattggagaaagatgttgatgggtttcatccattaaacgtggggaatcttgcaatgagagggagggaaccgctgtttgtatcttgcactcctaagggctgtgtggagttgttgataagaacgggtgttgaaatagcaggaaaaaatgctgtggtcataggcagaagcaacatcgttggactaccaatgtctttattattgcagaggcatgacgcgacagtaagcacggtgcatgcgtttacaaaggatccagagcacattactaggaaggcggatatcgttatagcagcagcgggtatacctaatttagttcgtggaagttggcttaagcctggagcagttgtcattgatgttggaacaactccagtcgaggatagtagctgtgagtttggttaccgtcttgtcggggatgtatgttacgaggaagcgttaggtgttgcctcggctatcactcccgtaccgggaggagttggacctatgacgatcaccatgctactatgcaatactttggaggctgctaagcggatcttcctctga

SEQ ID NO: 16135 - protein, 350 aa, Arabidopsis thaliana
MIARKALASAHTKAFRLATRDVHCFSSILVSPPLVSLDLPENWIPYSDPPPPVSFETEQKTVVIDGNVIAEEIRTKIISEVGKMKKAVGKVPGLAVVLVGEQRDSQTYVRNKIKACEETGIKSVLAELPEDCTEGQIISVLRKFNEDTSIHGILVQLPLPQHLNESKILNMVRLEKDVDGFHPLNVGNLAMRGREPLFVSCTPKGCVELLIRTGVEIAGKNAVVIGRSNIVGLPMSLLLQRHDATVSTVHAFTKDPEHITRKADIVIAAAGIPNLVRGSWLKPGAVVIDVGTTPVEDSSCEFGYRLVGDVCYEEALGVASAITPVPGGVGPMTITMLLCNTLEAAKRIFL

SEQ ID NO: 16136 - DNA, 1935 bp, Arabidopsis thaliana
  CDS (1)..(1905)
atgagttcatcaacaagaaagcttgaggttgtttcaccagttcccgccgatatcgacatagctaattccgtcgagcctttacacatctctgagattgccaaagatcttaatatcaaccctcttcactacgatctctatggcaagtataaagctaaggttttgttgtctgcgtttgatgagcttcaaggacaagaagatggatactatgttgttgttggagggattactcctactcctcttggagaaggcaagagtactaccactgttggactttgccaagccttaggcgcttacctcgataagaaggttgttacttgtcttcgccaaccgtcacaaggacccacctttggaatcaaaggaggtgcagctggtggtgggtatagtcaggtgattcctatggatgagttcaatcttcatctcactggagatattcacgcgattaccgcttccaacaacctcttagctgctgcaatcgacactcggattttccatgagacgtctcaatccgacaaggctctttttaataggctgtgccctccgaataaagaagggaagcgtagtttcagtgacattatgttcaggagattgacaaagcttgggatatccaagaccagtcctgaggagcttactcccgaggagataaagaagtttgcgaggcttgatattgatcctgcttctatcacttggagaagagtgatggatgttaatgatcggttcttgaggaagattactattggtcagggacctgaggaaaaggggatgactagagaaactggttttgacatttctgttgctagtgagattatggctgttttggctttgacaacctcactaggtgatatgagagagaggcttggtaaaatggtgattggtaacagcaaggcaggggatccgataacagcagatgatctcggtgttggaggagccttgactgttctgatgaaagacgctattaacccgacactcatgcagacactggaagggacccctgttctagtgcatgctggtccttttgcaaatatagctcatggaaattcatcgattgttgctgataaaatcgctttgaagctggtgggacctggtggatttgtggtaactgaagcgggttttggttctgatattggaacagagaagttcatgaatattaagtgccgttacagtgggctaacgcctcagtgtgcaattgttgtggcgactgttagggctttgaaaatgcatggaggtgggcctgatgttgttgccgggagacctcttgatcgtgcttatgtaagcgagaatgtttccttagttgaagctggctgtgtgaatctggcaaagcacatctcaaacacaaaggcctacggtgtgaatgtaattgttgctgtgaatatgttcgcaacagataccgaagcagaactaaatgcagttaggaaattttcaatggatgccggtgcttttgatgctgtggtctgctcccaccatgctcatagtggtaaaggagcggtggatcttggtatcgcggttgaaaaagcttgtcaaaacattacacagcccctcaggtttctctacccattggacattggtatcaaagacaaaattgaggcaatagctaagtcatatggagccagtggtgttgaatattcagaccaggcagagaaacagattgagatgtacacacaacaaggcttctcgaatcttcccatatgcatgtcgaaaacacagtactcattctcacatgatgcatcaaagaaaggagcaccttcagggtttgtattgccaattagggatgtaagaggaagcattggagctggtttcatatatccactggttggtacaatgagtacaatgcctggacttcctacaagaccttgtttctacgagattgatattgacactgaaactggaaaagttcgtggcctttcttaagtttggtagatctgtcaaagcttcaaggct

SEQ ID NO: 16137 - protein, 634 aa, Arabidopsis thaliana
MSSSTRKLEVVSPVPADIDIANSVEPLHISEIAKDLNINPLHYDLYGKYKAKVLLSAFDELQGQEDGYYVVVGGITPTPLGEGKSTTTVGLCQALGAYLDKKVVTCLRQPSQGPTFGIKGGAAGGGYSQVIPMDEFNLHLTGDIHAITASNNLLAAAIDTRIFHETSQSDKALFNRLCPPNKEGKRSFSDIMFRRLTKLGISKTSPEELTPEEIKKFARLDIDPASITWRRVMDVNDRFLRKITIGQGPEEKGMTRETGFDISVASEIMAVLALTTSLGDMRERLGKMVIGNSKAGDPITADDLGVGGALTVLMKDAINPTLMQTLEGTPVLVHAGPFANIAHGNSSIVADKIALKLVGPGGFVVTEAGFGSDIGTEKFMNIKCRYSGLTPQCAIVVATVRALKMHGGGPDVVAGRPLDRAYVSENVSLVEAGCVNLAKHISNTKAYGVNVIVAVNMFATDTEAELNAVRKFSMDAGAFDAVVCSHHAHSGKGAVDLGIAVEKACQNITQPLRFLYPLDIGIKDKIEAIAKSYGASGVEYSDQAEKQIEMYTQQGFSNLPICMSKTQYSFSHDASKKGAPSGFVLPIRDVRGSIGAGFIYPLVGTMSTMPGLPTRPCFYEIDIDTETGKVRGLS

SEQ ID NO: 16138 - DNA, 1132 bp, Arabidopsis thaliana
  CDS (1)..(1083)
atggcgtcgatgatgtttaccgattgctcctccaccacgacgtcgcgtctcatccatttgaaccgaagcagcggtactttcctcctccgtcaatgcgtcggccaactccgtttacagaccactgcttctggccgtggctgctgcattcgctcctcttcttctcccatttcttccatttccgctgatacaaaatcagagggtggcgcaattgtaatagatggaaaggctgtggcaaaaaagattagagatgaaatcacaattgaagtttcaagaatgaaggaatcaattggtgtgattcctggtttagcagtaatccttgttggtgacagaaaagattctgcaacttatgtgaggaacaagaagaaagcttgtgactccgttggaatcaaatcgttcgaagttcgtctagctgaagattcatcagaagaagaggtgttgaaatctgtatcaggattcaatgatgatccttctgtccatggaatccttgttcagttgcctctgccatcgcatatggatgaacagaacatactgaatgcggttagtatagagaaagatgttgacggatttcatccgctaaatattggacggcttgccatgcgtggaagagaacccttattcgttccttgtactccaaaaggatgcattgagttgttgcatagatacaacattgaaatcaaaggaaagagagcggttgttatcggaaggagtaacattgtcggtatgccagctgctcttttactgcagagggaggatgcaaccgttagcattatccattcaagaaccaagaaccctgaagaaatcacaagagaagctgatattataatctcagctgttggacagccaaacatggtcagaggaagctggataaaaccgggcgcagtcctcatcgatgttgggattaatcctgttgaggatccaagtgctgcgcgtggatatcgattggttggagacatttgctacgaggaggctagcaaagttgcatcagccatcacacctgttcctggcggtgtaggaccaatgaccatagccatgcttctatccaacactttaacatcagctaagaggattcacaacttccagtgacgtcacttaaaaagaagattgctggccttttgggaaacatacaaatcgt

SEQ ID NO: 16139 - protein, 360 aa, Arabidopsis thaliana
MASMMFTDCSSTTTSRLIHLNRSSGTFLLRQCVGQLRLQTTASGRGCCIRSSSSPISSISADTKSEGGAIVIDGKAVAKKIRDEITIEVSRMKESIGVIPGLAVILVGDRKDSATYVRNKKKACDSVGIKSFEVRLAEDSSEEEVLKSVSGFNDDPSVHGILVQLPLPSHMDEQNILNAVSIEKDVDGFHPLNIGRLAMRGREPLFVPCTPKGCIELLHRYNIEIKGKRAVVIGRSNIVGMPAALLLQREDATVSIIHSRTKNPEEITREADIIISAVGQPNMVRGSWIKPGAVLIDVGINPVEDPSAARGYRLVGDICYEEASKVASAITPVPGGVGPMTIAMLLSNTLTSAKRIHNFQ

SEQ ID NO: 16140 - DNA, 900 bp, Arabidopsis thaliana
  CDS (1)..(900)
atggcgtcatcatctgatcacacggcgaagataatcgacggcaaggcgattgctcataccatcagatcagagatcgccgaggaagttcgcggtctatctgagaaacacggcaaggtcccaggactagctgtagttattgttgggagccgaaaggattcacagacctatgtgaatacgaagaggaaagcgtgcgctgaggttgggattaagtcatttgacgtgggcctaccagaggaagtttctgaagctgatcttattagcaaagttcatgaactaaattcaaatccggatgtccatggcatattagttcaactcccattgccgaaacatattaatgaggagcatatattgggtgcaatcagcattgataaagatgtcgatggcttccatcctttgaatattggtaagctagccatgaaaggcagagaacccctcttccttccttgcaccccaaagggatgtttggaactcctagctagaagcggcgtaaagataaaggggcaacgagcagttgttgtaggtcggagtaacattgttggtttgcccgtttcacttcttttgctcaaggctgatgctactgtcacaactgtacattctcacaccaaggatcctgaggctatcatacgggaagctgacattgttattgctgcatgcggacaagcccacatgattaagggcaactggataaagccaggggctgcagtaattgatgttggaactaatgcagtcagcgacccgagcaagaaatcaggataccggttggttggagatgttgatttcgcagaagcttcaaaagttgcaggtttcataactccggtccctggtggtgtaggcccaatgacagtggcaatgcttctcaggaacaccgtagacggtgccaagcgtgtctttggcgagtaa

SEQ ID NO: 16141 - protein, 299 aa, Arabidopsis thaliana
MASSSDHTAKIIDGKAIAHTIRSEIAEEVRGLSEKHGKVPGLAVVIVGSRKDSQTYVNTKRKACAEVGIKSFDVGLPEEVSEADLISKVHELNSNPDVHGILVQLPLPKHINEEHILGAISIDKDVDGFHPLNIGKLAMKGREPLFLPCTPKGCLELLARSGVKIKGQRAVVVGRSNIVGLPVSLLLLKADATVTTVHSHTKDPEAIIREADIVIAACGQAHMIKGNWIKPGAAVIDVGTNAVSDPSKKSGYRLVGDVDFAEASKVAGFITPVPGGVGPMTVAMLLRNTVDGAKRVFGE

SEQ ID NO: 16142 - DNA, 1219 bp, Pisum sativum
  CDS (68)..(952)
aaggacaagtcgtgaagttgtattttaacagaaaaccacaccgcacgatctcagtttcaccgatcaaatggccaccgtaatcgacggcaaagccgttgcacaaactatccgatctgaaatcgccgacgaggttcgtcttctctcacaaaagtacggcaaggttcctggacttgcagtggtgatagtaggaaaccgaaaggactctcaaagctacgttggaatgaagagaaaagcgtgtgctgaattgggaatcaaatccttcgatatcgaccttccggaggatgcttctgaagctgaaatcataaaaaatgttcacgaattgaacgctaaccccgatgtacatggtatattggttcaacttccattgcctaagcacgtaaatgaagagaaagttttgactgaaatcagcatttcaaaggatgtagatggcttccatcccttgaacattggcaagcttgcaatgaaaggaagagaccctctgtttcttccatgtactcccaaggcatgtcttgaactattatcacgaagtggtgtaagtataaaggggaaaaaggctgttgtggttggtagaagcaacatagttggattaccagcttcattgctgcttctgaaagcagatgctacagttaccattgttcattcacacacaagtcaaccagaaactatcattcgtgaagcagatattgttattgcagcagcaggacaggcaaagatgatcaagggaagctggataaaaccaggagctgcagtgatagatgttggcacaaattctgtggatgacccaactaggaaatcaggttatagacttgttggagatgtagattttgaggaagcatctaaagttgctggttggattactcctgttcctggtggtgtgggtccaatgacagtcacaatgttgctgaagaatactttggagggcgctaaacgcaccattgagcagaataactaaatattcctttagttttaataaaaagaaagttactcttcgtttgagaatcagtttttgctgatagatcaatgtatctttataaaaccgtaagaattggtattgaaagttgtttttggttcttctcgttcattattttagtttctcccccttatagttaccttgttctctttcttgtagacttatattggaatgccgtcaagtctggtaaggcttcaaatagtacaccaaaataagggaactattatgatgttaatgtcaaaccggccc

SEQ ID NO: 16143 - protein, 294 aa, Pisum sativum
MATVIDGKAVAQTIRSEIADEVRLLSQKYGKVPGLAVVIVGNRKDSQSYVGMKRKACAELGIKSFDIDLPEDASEAEIIKNVHELNANPDVHGILVQLPLPKHVNEEKVLTEISISKDVDGFHPLNIGKLAMKGRDPLFLPCTPKACLELLSRSGVSIKGKKAVVVGRSNIVGLPASLLLLKADATVTIVHSHTSQPETIIREADIVIAAAGQAKMIKGSWIKPGAAVIDVGTNSVDDPTRKSGYRLVGDVDFEEASKVAGWITPVPGGVGPMTVTMLLKNTLEGAKRTIEQNN

SEQ ID NO: 16144 - DNA, 933 bp, Arabidopsis thaliana
  CDS (1)..(933)
atgtttactgattgctcctcctccacaacgtcgcgtctcatccatttatacaaccgcaatggtgttttcctcccccgcccgagcgtcagccaattcagcttacggacaactgcgtctacttggcgctgcactctctccattcgctcctcttcttctccatctgcgattgtaattgatggaaaggctgaggccaaaaagattagagatgatatcaaaatcgaagtttcaagaatgaaggaatcaatcggtgtggttcctgctgaagattcatcagaagaagaggtgttgaaatatgtatcaggattcaatgatgatccttctgttcacggagtccttgttcagttgcctctaccatcgcatatggatgaacagaacatattgaatgcggttagtatagagaaggacgttgatggatttcacccgctaaatattggacggcttgccatgcgtggtagagaacctttattcgttccatgtactccaaaaggatgcatcgagttgttgcacagatacaacattgaattcaaaggcaaaagagcagttgttattggaaggagtaacattgttggtatgccagctgctctgttgctgcagaaggaggatgcaaccgttagcattatccattcaagaaccatgaaccctgaagaactcacaagacaagctgatatcctaatctcagctgttgggaaaccaaacatggtcagaggaagctggataaaaccgggtgcagtcctcatcgatgttgggattaaacctgttgaggatccaagtgctgccggtggagagcggttggttggagacatttgctatgtggaggctagcaaaattgcatcagccatcacacctgttcctggtgatgtaggaccaatgaccatagccatgcttctatccaacactttaacatcagccaagagaattcacaacttccagtga

SEQ ID NO: 16145 - protein, 310 aa, Arabidopsis thaliana
MFTDCSSSTTSRLIHLYNRNGVFLPRPSVSQFSLRTTASTWRCTLSIRSSSSPSAIVIDGKAEAKKIRDDIKIEVSRMKESIGVVPAEDSSEEEVLKYVSGFNDDPSVHGVLVQLPLPSHMDEQNILNAVSIEKDVDGFHPLNIGRLAMRGREPLFVPCTPKGCIELLHRYNIEFKGKRAVVIGRSNIVGMPAALLLQKEDATVSIIHSRTMNPEELTRQADILISAVGKPNMVRGSWIKPGAVLIDVGIKPVEDPSAAGGERLVGDICYVEASKIASAITPVPGDVGPMTIAMLLSNTLTSAKRIHNFQ

SEQ ID NO: 16146 - DNA, 1299 bp, Arabidopsis thaliana
  CDS (66)..(1124)
cgatatttttcaacgccattgacgacgctttatataccactgtgactgttcttttagttttgagtatgttaatgatcgcgaggaaagctttggcctcggcgcatactaaggcgtttcgtttggcaacaagggatgtacattgctttagttccatcttagtgtctcctcctctcgtgtcacttgacttgcctgaaaattggattccttactctgatcctccacctcctgtttcctttgagactgaacagaagactgtggtgatagatggtaatgttatcgctgaggaaatcagaacaaagattattagtgaagtggggaagatgaaaaaggctgttggaaaagtccctggtcttgctgttgttttggttggtgaacaaagagactcgcaaacttatgttcgcaacaaaattaaagcttgtgaagaaactggcattaaatctgttttggctgaattaccagaggattgtactgaaggacagattatcagtgtattgagaaaattcaatgaagacacgtctattcacggaattcttgtgcaacttcctttaccccaacatcttaatgaatcaaaaatcttgaatatggtgagattggagaaagatgttgatgggtttcatccattaaacgtggggaatcttgcaatgagagggagggaaccgctgtttgtatcttgcactcctaagggctgtgtggagttgttgataagaacgggtgttgaaatagcaggaaaaaatgctgtggtcataggcagaagcaacatcgttggactaccaatgtctttattattgcagaggcatgacgcgacagtaagcacggtgcatgcgtttacaaaggatccagagcacattactaggaaggcggatatcgttatagcagcagcgggtatacctaatttagttcgtggaagttggcttaagcctggagcagttgtcattgatgttggaacaactccagtcgaggatagtagctgtgagtttggttaccgtcttgtcggggatgtatgttacgaggaagcgttaggtgttgcctcggctatcactcccgtaccgggaggagttggacctatgacgatcaccatgctactatgcaatactttggaggctgctaagcggatcttcctctgagtatggtatctctgtctattactaaatatattttgtaatgttagataggagactccatgctgttcgagttattaacgatctcttttgaattattgtataatagacctggcgattgtgatgccatggtttatcctaactcatcagcatctttagcatcaagttcaactaaacaagt

SEQ ID NO: 16147 - protein, 352 aa, Arabidopsis thaliana
MLMIARKALASAHTKAFRLATRDVHCFSSILVSPPLVSLDLPENWIPYSDPPPPVSFETEQKTVVIDGNVIAEEIRTKIISEVGKMKKAVGKVPGLAVVLVGEQRDSQTYVRNKIKACEETGIKSVLAELPEDCTEGQIISVLRKFNEDTSIHGILVQLPLPQHLNESKILNMVRLEKDVDGFHPLNVGNLAMRGREPLFVSCTPKGCVELLIRTGVEIAGKNAVVIGRSNIVGLPMSLLLQRHDATVSTVHAFTKDPEHITRKADIVIAAAGIPNLVRGSWLKPGAVVIDVGTTPVEDSSCEFGYRLVGDVCYEEALGVASAITPVPGGVGPMTITMLLCNTLEAAKRIFL

SEQ ID NO: 16148 - DNA, 2841 bp, Saccharomyces cerevisiae
  CDS (1)..(2841)
atggctggtcaagtgttggacggcaaagcatgcgctcagcagtttagaagcaatattgctaatgaaatcaaaagcattcaaggtcacgtgcctgggtttgcacctaaccttgccatcattcaagtaggcaacagaccagactcagccacatatgtacgcatgaagcgtaaggcagctgaagaggccggcattgttgctaatttcattcatttagatgaatccgctactgaatttgaagttctgcgttacgtggaccagctgaatgaggacccacatacacacggtattatcgtgcaactaccattacccgctcatttggacgaggatagaatcacctcgagagtgttggcagaaaaggacgtggacgggttcgggcccaccaacattggcgaattgaataagaagaacggacacccattctttttgccctgcacgcccaaggggatcattgagctgcttcacaaggccaacgtcacgattgaaggttcccggtccgttgtgatcggaagatctgacattgttggctctcctgttgcagaattgttaaaatctctaaactccaccgtcaccatcactcattctaaaacccgtgatatcgcatcatacttacacgacgcggacatcgtagtcgttgccatcggccaaccagaatttgtgaagggtgaatggttcaaaccaagagacggcacttccagtgataagaaaaccgtggtaattgatgttggcaccaactacgttgctgatccttccaaaaagtccggtttcaaatgtgttggtgacgttgagttcaatgaagcaatcaaatacgtccatctaatcactccagtgcccggtggtgtgggccccatgacggtggctatgttaatgcaaaataccttgattgctgccaaacgccaaatggaagaatcctcgaagcctttgcagattcctcccttgccattgaagttgctaacacctgttccttccgatatagacatctccagagcacaacagccaaagcttatcaaccagcttgctcaagaattgggtatttactctcatgagttggagctgtacggacattacaaggccaaaatttctcctaaagtcatcgaaaggctgcagacgcgccaaaatggtaagtacatcttggtgtctggtatcacaccaacaccactgggagagggtaaatccactacaacaatgggtcttgtccaggcactaacggctcacttgggcaagccagccattgcgaacgtcagacaaccctccctaggacccactttaggtgtcaaaggtggtgctgcgggtggtggttattcccaagtcatcccaatggacgaattcaacttacatttgactggtgacattcacgccattggtgcggctaacaacctacttgctgccgctattgacactagaatgttccatgagaccactcaaaagaacgacgctaccttctacaacagactagtgcctagaaagaacggaaagagaaagtttactccctccatgcaaagaagattgaacagactgggtattcaaaagaccaaccccgatgatctaacacccgaagagatcaacaaattcgccagattgaacattgacccggacactattactatcaagagggtggtcgatatcaacgacagaatgttaagacaaatcaccattggtcaagcccctaccgagaagaaccacacaagagttactggattcgatatcaccgttgcttctgaattgatggctattcttgctctttcaaaggacttgagggacatgaaggaacgtattggaagagtcgttgttgctgctgacgtaaacaggtctccagtcactgttgaagatgtgggttgtaccggtgccttaaccgctttattaagagacgctatcaagcccaacttgatgcaaactttagaaggtactcctgtcttggtccatgccggcccatttgccaacatctctatcggtgcctcttctgttattgctgatcgcgtggctttgaaattggttggtaccgagccagaggcaaaaacagaagctggttatgtggttactgaagcagggttcgatttcactatgggtggtgaaagattcttcaacatcaagtgccgttcctctggattgacacctaatgctgtggtcttggttgctactgttagggcattgaagtcacacggtggtgctccagatgtcaaacctggccaacctttaccttccgcatacactgaagagaatatcgagtttgtcgaaaaaggtgccgctaacatgtgtaaacaaattgccaacattaagcaatttggcgtccccgtcgttgtcgcaattaacaagtttgaaactgacactgaaggtgaaatagccgccattagaaaagccgctttggaagctggtgcatttgaagccgtaacctctaaccattgggccgaaggtggtaaaggtgctatcgacttggccaaggccgtcatcgaagcttccaaccaaccagtggacttccatttcctatatgacgttaactcctccgttgaagacaaattaactactatcgttcaaaagatgtacggtggtgccgcaatcgatatcttgcctgaagcacaacgcaagattgacatgtacaaggaacaaggtttcggtaacttgccaatttgtatcgccaagacacaatactctttatcccacgatgcaactttgaaaggtgttccaaccgggttcactttccccatcagagacgtcagattgtctaatggtgctggatacttatacgctcttgccgccgaaatacaaaccattcctggtttggctacctatgctggttacatggccgtggaagtcgatgatgacggtgagatcgatggcctgttctaa

SEQ ID NO: 16149 - protein, 946 aa, Saccharomyces cerevisiae
MAGQVLDGKACAQQFRSNIANEIKSIQGHVPGFAPNLAIIQVGNRPDSATYVRMKRKAAEEAGIVANFIHLDESATEFEVLRYVDQLNEDPHTHGIIVQLPLPAHLDEDRITSRVLAEKDVDGFGPTNIGELNKKNGHPFFLPCTPKGIIELLHKANVTIEGSRSVVIGRSDIVGSPVAELLKSLNSTVTITHSKTRDIASYLHDADIVVVAIGQPEFVKGEWFKPRDGTSSDKKTVVIDVGTNYVADPSKKSGFKCVGDVEFNEAIKYVHLITPVPGGVGPMTVAMLMQNTLIAAKRQMEESSKPLQIPPLPLKLLTPVPSDIDISRAQQPKLINQLAQELGIYSHELELYGHYKAKISPKVIERLQTRQNGKYILVSGITPTPLGEGKSTTTMGLVQALTAHLGKPAIANVRQPSLGPTLGVKGGAAGGGYSQVIPMDEFNLHLTGDIHAIGAANNLLAAAIDTRMFHETTQKNDATFYNRLVPRKNGKRKFTPSMQRRLNRLGIQKTNPDDLTPEEINKFARLNIDPDTITIKRVVDINDRMLRQITIGQAPTEKNHTRVTGFDITVASELMAILALSKDLRDMKERIGRVVVAADVNRSPVTVEDVGCTGALTALLRDAIKPNLMQTLEGTPVLVHAGPFANISIGASSVIADRVALKLVGTEPEAKTEAGYVVTEAGFDFTMGGERFFNIKCRSSGLTPNAVVLVATVRALKSHGGAPDVKPGQPLPSAYTEENIEFVEKGAANMCKQIANIKQFGVPVVVAINKFETDTEGEIAAIRKAALEAGAFEAVTSNHWAEGGKGAIDLAKAVIEASNQPVDFHFLYDVNSSVEDKLTTIVQKMYGGAAIDILPEAQRKIDMYKEQGFGNLPICIAKTQYSLSHDATLKGVPTGFTFPIRDVRLSNGAGYLYALAAEIQTIPGLATYAGYMAVEVDDDGEIDGLF

SEQ ID NO: 16150 - DNA, 2808 bp, Rattus norvegicus (Norway rat)
  CDS (1)..(2808)
atggcaccagcgggaatcctgaacgggaaagtggtctccgcgcaaatcaggaatcgactgaagacccaggttactcagatgcaggagcaggtacctggcttcacccctggcctggcaatcctgcaggttggcgacagagatgattccaatctttatataaatgtgaagctgaaggctgctcaagagatcgggatcaaagccactcacattaaattaccaagaacttccacagagtcggaggtgttaaaatacgtcatctccctgaatgaggatgccactgtgcacggattcatagtacagctgcctttagactccgagaattccattaacacagaggcagtcatcaatgccattgcccctgagaaggatgtggacgggttgacgagcatcaatgccgggaagcttgccagaggtgatctaaaggactgcttcattccgtgcacacccaaaggatgcttggaactcatcaaagagacaggagtgcagattgcaggaaggcacgccgtggtggtcgggcgaagtaaaatagttggtgcacccatgcacgacctgcttctgtggaacaatgccacggtgaccacctgccactccaagactgccgatctggacaaggaggtaaataaaggagacattctggtggttgcaacaggacagcctgagatggtgaaaggggagtggatcaagcctggagctgtggtcatagactgtgggatcaattatgttccagatgatacaaaaccaaatggaaggaaagttgtgggtgacgtagcatatgacgaggccaaggagaaggcgagctttatcacgcctgtccccggtggcgtggggcccatgaccgtggcaatgctgatgcagagcacagtagagagcgcacagcgcttcctgaagaaatttaagccagggaagtggacaattcagtataacaagctgaacctcaagacgcctgtaccaagtgacattgctatatcacgatcttgcaaacccaagctcatcggtaacctggcccgagaaattgggctactcactgaggaggtggaattgtatggagaaacaaaggccaaggtcttactgtcagcactagatcgcctgaagcatcagccagatgggaaatacgttgtggtgactggaattactccaacacccctgggagaagggaagagcacaaccaccatcgggcttgtgcaagcccttggcgcccacctgcatcagaatgtttttgcgtgtgtgcgacagccttctcagggccccacctttgggataaaaggtggcgctgcaggaggcggctattcccaggtcattcctatggaagagtttaatctccacctcactggtgacatccacgccatcactgccgctaataaccttgtggctgctgctattgacgctcggatatttcatgagctgacccagacagacaaggctctctttaatcgtctggtaccctcagtaaatggagtaagaaagttctctgacatccaaatccgcaggttacggaggctaggcattgagaagactgaccccgctgcgctgacagatgatgagataaacagatttgcaagactagatattgatccagaaaccataacatggcagagagtgctggatactaacgatagattcctgaggaagatcaccattggacaggctccaaccgagaaaggccacacacgcacggcccagtttgatatctctgtggccagtgaaatcatggcagtcctggccctcactagttctctggaagacatgagagcaaggctgggcaaaatggtggtagcgtccagtaagaaaggggagcctatcagctgtgaagacctgggcgtgagcggggcgctgacggtgctcatgaaggatgcgatcaagcccaatctcatgcagaccttagagggcacgccggtatttgtccatgctgggccttttgccaacattgcacatgggaattcctccatcattgcagaccggattgcactcaagctggttggccctgagggctttgtagtgacagaagcaggattcggagcagacataggaatggaaaagttcttcaacatcaagtgccggtattctggtctccagcctcatgtggtggttcttgttgccactgtcagggctcttaagatgcacgggggtggccccacggtcaccgctggactgcctcttcccaaggcttacacagaagaggacctggacctggtggaaaagggcttcagtaacttgaggaaacagatagaaaatgctagaatgtttggagtgcctgtcgtggtggccatgaatgcattcaagacagatacagatactgagctggacctcatcggccgcctctccagagagcatggggctttcgatgctgtcaagtgcacccactgggcagaagggggccagggagccttagccctggctcaggctgtccagagagcttcacaggcccccagcagcttccagctcctctatgacctcaagctctcagttgaagataaaatcaggattattgcacagaagatctacggggccgatgacatcgaattgctccctgaagcacaaaacaaagcagaaatctacacaaagcagggctttgggaatctacccatctgcatggccaaaacacacttgtctttatctcacaacccagagcaaaaaggggtgcctactggcttcgttctgcccatccgggacatccgggccagcgttggggctggtttcctgtaccctttagtaggaacgatgagcacaatgcctggactccctactcgaccctgtttttatgatatcgatttggaccctgaaactgaacaagtgaatggattgttttaa

SEQ ID NO: 16151 - protein, 935 aa, Rattus norvegicus (Norway rat)
MAPAGILNGKVVSAQIRNRLKTQVTQMQEQVPGFTPGLAILQVGDRDDSNLYINVKLKAAQEIGIKATHIKLPRTSTESEVLKYVISLNEDATVHGFIVQLPLDSENSINTEAVINAIAPEKDVDGLTSINAGKLARGDLKDCFIPCTPKGCLELIKETGVQIAGRHAVVVGRSKIVGAPMHDLLLWNNATVTTCHSKTADLDKEVNKGDILVVATGQPEMVKGEWIKPGAVVIDCGINYVPDDTKPNGRKVVGDVAYDEAKEKASFITPVPGGVGPMTVAMLMQSTVESAQRFLKKFKPGKWTIQYNKLNLKTPVPSDIAISRSCKPKLIGNLAREIGLLTEEVELYGETKAKVLLSALDRLKHQPDGKYVVVTGITPTPLGEGKSTTTIGLVQALGAHLHQNVFACVRQPSQGPTFGIKGGAAGGGYSQVIPMEEFNLHLTGDIHAITAANNLVAAAIDARIFHELTQTDKALFNRLVPSVNGVRKFSDIQIRRLRRLGIEKTDPAALTDDEINRFARLDIDPETITWQRVLDTNDRFLRKITIGQAPTEKGHTRTAQFDISVASEIMAVLALTSSLEDMRARLGKMVVASSKKGEPISCEDLGVSGALTVLMKDAIKPNLMQTLEGTPVFVHAGPFANIAHGNSSIIADRIALKLVGPEGFVVTEAGFGADIGMEKFFNIKCRYSGLQPHVVVLVATVRALKMHGGGPTVTAGLPLPKAYTEEDLDLVEKGFSNLRKQIENARMFGVPVVVAMNAFKTDTDTELDLIGRLSREHGAFDAVKCTHWAEGGQGALALAQAVQRASQAPSSFQLLYDLKLSVEDKIRIIAQKIYGADDIELLPEAQNKAEIYTKQGFGNLPICMAKTHLSLSHNPEQKGVPTGFVLPIRDIRASVGAGFLYPLVGTMSTMPGLPTRPCFYDIDLDPETEQVNGLF

SEQ ID NO: 16152 - DNA, 855 bp, Listeria innocua
  CDS (1)..(855)
atgggagaaattattgatggcaaaaagttagccaaagaaatccaagagaaagtaacatcagaagtagctgaattagtaaaacaaggtaaaaaaccgggtcttgcggttgtgctcgtaggagataaccaagcctctcgtacatatgttagaaataaacaaaagcgaacagaagaagcaggaatgaaatctgttttaattgaacttcctgaaacagtaacagaagaaaaattactaaaagtagtagaagagttaaatgaagataatacaattcatggtatattggtacaattacctttaccaaaacatatttcagaagaaaaagtcattgatgctattagttttgacaaagatgttgacggtttccacccggtgaatgtaggtaacttattcattggtaaagattctttcgttccgtgcacacccgcaggaattattgagttaattaaatcaaccggcactcaaatagaaggcaaacgagcagtcgttattggcagaagtaatattgtaggtaagccagtagcacaattattattaaatgaaaatgctacagtaacaatagctcatagccgtacaaaagatttacctcaagtggcaaaagaagccgatattctagttgttgcaacaggattagctaaatttgttaaaaaagaatacattaagccaggcgcaattgttattgatgttggtatggaccgcgatgaaaacaataaattatgtggcgatgtagattttgatgatgtcaaagagcaagcaggattcatcactccagttccaggaggcgttgggccaatgacaattaccatgcttcttgctaatacattaaaagctgcaaaacgcatttggaagatgaattga

SEQ ID NO: 16153 - protein, 284 aa, Listeria innocua
MGEIIDGKKLAKEIQEKVTSEVAELVKQGKKPGLAVVLVGDNQASRTYVRNKQKRTEEAGMKSVLIELPETVTEEKLLKVVEELNEDNTIHGILVQLPLPKHISEEKVIDAISFDKDVDGFHPVNVGNLFIGKDSFVPCTPAGIIELIKSTGTQIEGKRAVVIGRSNIVGKPVAQLLLNENATVTIAHSRTKDLPQVAKEADILVVATGLAKFVKKEYIKPGAIVIDVGMDRDENNKLCGDVDFDDVKEQAGFITPVPGGVGPMTITMLLANTLKAAKRIWKMN

SEQ ID NO: 16154 - DNA, 1281 bp, Listeria monocytogenes
  CDS (1)..(1281)
atgtcaaataaagtgaaatcagatattgaaattgcatcaaaagcagaaattctaccagttacgactattgcggaacatttaggactagacgcagatgcactcgaactttacggaaagtataaagcaaagttatcctatgataccattcactcgctaaaagacaaagaacctggaaaacttgtccttgtaacagcaattaatccaacgcctgctggtgaaggaaaatcgactgtgacagttggtcttggcgacgcactctctaaaaaagataaaaagactgttatcgcactgcgcgaaccatcacttggacctactatggggattaaaggcggggcaactggtggcggctatgcgcaagttattccaatggaagatattaatttacactttacaggcgattttcatgcaattacagcagcgaacaatgctttatcggcatttattgataaccatatgcaacaagggaatgacttagaaattgacggtagaagaatcgtttggaaacgtgtggttgatttgaacgaccgtgcgcttcgaaaagtagtggttggtctaggtggtcctattcaaggggttccacgtgaggatggttttgatattacagttgcttctgaaatcatggcgatcatttgtttagcaagtgatttaaaagatttaaagaaacgcttaagcgaaattgtcatcggttataactataaaaaagaaccaattacggttggtgaaatgggttacgaaggcgcattaacgttgttgttaaaggatgctttaaaacctaatttggtgcaaacattagaacatactcctgccatcgtacacggcggaccttttgcaaatattgctcacgggtgtaatagtgtttctgcgacaagtacagcacttcgactaggtgattatgtagtgacagaagctggatttggcgcagaccttggtgcagagaaatttttagatattaaagttcctgcccttggaaaagctccagattgcgttgttattgtagcaacgattcgcgcactgaaaatgcacggtggcgctttaaaaacagagctaagcgaggaaaatgtcgatgcgctagctaaaggctttactaacttacaaaaacatacggaatcaattcaaacatttggtattccttatgtggtagcaattaataaatttatcactgattctgacgcggaagtagcgaaattagaagcgctatgcgaagaacacgggattcctttctccctgacagaagtttgggaaaaggtggcgatggcggcctggaactcgcggataaagtaa

SEQ ID NO: 16155 - protein, 426 aa, Listeria monocytogenes
MSNKVKSDIEIASKAEILPVTTIAEHLGLDADALELYGKYKAKLSYDTIHSLKDKEPGKLVLVTAINPTPAGEGKSTVTVGLGDALSKKDKKTVIALREPSLGPTMGIKGGATGGGYAQVIPMEDINLHFTGDFHAITAANNALSAFIDNHMQQGNDLEIDGRRIVWKRVVDLNDRALRKVVVGLGGPIQGVPREDGFDITVASEIMAIICLASDLKDLKKRLSEIVIGYNYKKEPITVGEMGYEGALTLLLKDALKPNLVQTLEHTPAIVHGGPFANIAHGCNSVSATSTALRLGDYVVTEAGFGADLGAEKFLDIKVPALGKAPDCVVIVATIRALKMHGGALKTELSEENVDALAKGFTNLQKHTESIQTFGIPYVVAINKFITDSDAEVAKLEALCEEHGIPFSLTEVWEKVAMAAWNSRIK

SEQ ID NO: 16156 - DNA, 1800 bp, Vibrio cholerae
  CDS (1)..(1800)
atgcgcgcaaacgttttcctcaccatttttaccgctctagatgagggttttatgctgccagatattgaaatttgccgcgctacaccattagcgcctatcgacaccattgctcaaaaagcgggattgcacgcgaatgagtacgaaagccacggccagcataaagccaaagtgtcactgcattgtctagagcgattggccaacaagcccaaaggtaaattcattctggtcactgcgattaccccaacaccactgggtgaaggtaaaaccgttaccacgattggtttagcacaagggttggccaaacttaatcactcggtcatggcgtgcattcgccagccttcgatggggccgatttttggggtaaaaggtggcgctgcgggtggtggttattcacaagttgcaccgatggaagagctcaatctgcatttaaccggtgatattcatgccgtcacggcggcgcacaaccttgcggcagctgcgattgatgcgcgaatttatcacgagcagcgcctcggctatgcagattttgagcgccgcaccggcatgccagcgctgcgcattgaccccaaacaggtcatatggaaacgcgtgatggatcataacgatcgcgcgctgcgcatggtgacagtcggccgcaatgaaccgggaaaaaatattaatggttatgagcgcgaagatggtttcgatatctctgccgcctccgaattgatggcgattctggctctcgcctcggatctacgtgatttgcgtcgccgtatcggtaatgtggtgctggcttatgatttggacggtaatccggtcaccaccgaagatctgaaagtggctggtgcaatggcagtcagtatgaaagaagccattgagccgaccttgatgcaaactttagaaggcgtcccaacactgatccacgccggcccatttgccaatatcgcgcacggtaactcctcgatcattgccgatgaaatcgccacccgtttggcagactacaccgtgaccgaaggcggttttggctccgatatggggtttgagaaagcgtgcaacatcaaagccaaagcatccggtaaaaccccagattgtgcggtgattgtcgccaccttacgcggcttaaaagccaactcaggcctgtatgatttacgccccggccaagcggtaccggatgccctattcgcgccagacagcgccgctttgcaagccggttttgcaaacttgaaatggcatattgataacgttaaccagtatggtgtgcctgccgtggtagcgattaaccgcttcccacaagattgtgccgaagaactggaacaactggttaagctgattgaagccctgcccaaccgtgtatcggtagccatttcagaaggctttgccaaaggcggtgaaggtaccaagctgcttgccgaaaaagtggttgagcagtgtcaacatccaacgaaattcactccgctctacgattcaggcataccattggatgaaaaactcaaagcggtcgcggtaaaaggttatggcgctgccgagattgctctgagtgataaagccgcacagcaattagccaaactgcaaacccaaggctttgaccatcttgcggtttgcttggcgaaaacaccgctgtcgatttctaccgatcccgcaatcaaaggcgcgccacgtgattttatcgtaccgatccgcgagctgcgtttatgtgcaggcgccgaatttgtttacgccctgtgtggcagtgtgatgaccatgcccggtttaccggaaaaaccttcctttatggcgctcgatatcgatcagcacggcaacatcgtcggcttaagttaa

SEQ ID NO: 16157 - protein, 599 aa, Vibrio cholerae
MRANVFLTIFTALDEGFMLPDIEICRATPLAPIDTIAQKAGLHANEYESHGQHKAKVSLHCLERLANKPKGKFILVTAITPTPLGEGKTVTTIGLAQGLAKLNHSVMACIRQPSMGPIFGVKGGAAGGGYSQVAPMEELNLHLTGDIHAVTAAHNLAAAAIDARIYHEQRLGYADFERRTGMPALRIDPKQVIWKRVMDHNDRALRMVTVGRNEPGKNINGYEREDGFDISAASELMAILALASDLRDLRRRIGNVVLAYDLDGNPVTTEDLKVAGAMAVSMKEAIEPTLMQTLEGVPTLIHAGPFANIAHGNSSIIADEIATRLADYTVTEGGFGSDMGFEKACNIKAKASGKTPDCAVIVATLRGLKANSGLYDLRPGQAVPDALFAPDSAALQAGFANLKWHIDNVNQYGVPAVVAINRFPQDCAEELEQLVKLIEALPNRVSVAISEGFAKGGEGTKLLAEKVVEQCQHPTKFTPLYDSGIPLDEKLKAVAVKGYGAAEIALSDKAAQQLAKLQTQGFDHLAVCLAKTPLSISTDPAIKGAPRDFIVPIRELRLCAGAEFVYALCGSVMTMPGLPEKPSFMALDIDQHGNIVGLS

SEQ ID NO: 16158 - DNA, 1671 bp, Streptococcus pneumoniae
  CDS (1)..(1671)
atgaaaacagatattgaaatcgcacagagtattgagttgaagccaattgttgatgttgtagagaaacttggtatttcttacgacgatttggagttgtacggaaagtacaaggctaaactcagctttgataaaattcgggcagttgagagcaatccagtcggtaaattgatcttggttactgccatcaacccaacacctgcaggtgaaggaaagtcgacgcttaccattggtcttgcggatgccttgaacaagattggcaagaaaaccatgattgctatccgcgaaccgtctcttggtccagtcatggggatcaagggtggtgctgctggtggtgggtatgcacaagttctgccaatggaagacatcaacctccactttactggagatatgcatgctattacaactgccaacaatgccctttctgccttgattgacaaccacttgcaccaagggaatgagctgggaattgatcaacgtcgtatcctctggaaacgcgttgtggacttgaacgaccgtgcgctccgccatgtgactgttggtcttggtggtcctctaaacggtattccacgtgaggatggttttgatattacagttgcttcagaaatcatggcaattctttgcttggcaacggacatcgaggacttgaaacgtcgtttggcgaatatcgttattggttatcgctatgaccgtacgcctgtttctgtaggtgatttgcaggttgagggtgccttggctttgattttgaaggatgctattaagccaaacttggttcagacaatttacggtacacctgcctttgtacacggtggtccatttgccaatatcgctcatggctgtaactctgttttggcgacgacaacagcccttcacttggctgattacactgttactgaagctggttttggtgcggaccttggtgctgagaaattccttgatatcaagacaccaaacttgccaacatctccagatgcagttgttattgtcgcaacccttcgtgcccttaagatgaatggtggtgtggctaaagacgctctgactgaagaaaatgtagaggcagttcgtgcaggttttgctaacttgaaacgccacgttgaaaatatccgtaagttcggtattccagcagttgtagctattaacgaatttgtatctgatacagaagctgaaattgcagtcttaaaagaactctgtgcctcaatcgatgtaccagttgaattggctagtgtctgggctgatggagcagaaggtggagtagcacttgccgaaacagttgttaagacaattgctgaaaatccagctaactataaacgtttgtacgataatgacctttctgtccaagaaaagattgaaaaaattgtcactgaaatctatcgtggtagcaaagtgaactttgagaagaaatctcaaacacaaattgctcaaatcgttcaaaacggttgggacaaattgccaatctgtatggctaaaactcaatacagtttctcagacaatccaaatgcgcttggagcaccagaaaactttgaaattaccattcgtgaattggtaccaaaattaggtgcaggcttcatcgttgccttaactggtgatgttatgaccatgccaggtcttccaaaacgtccagcagctctcaacatggatgttgaaagcgatggaactgtactaggcttgttctag

SEQ ID NO: 16159 - protein, 556 aa, Streptococcus pneumoniae
MKTDIEIAQSIELKPIVDVVEKLGISYDDLELYGKYKAKLSFDKIRAVESNPVGKLILVTAINPTPAGEGKSTLTIGLADALNKIGKKTMIAIREPSLGPVMGIKGGAAGGGYAQVLPMEDINLHFTGDMHAITTANNALSALIDNHLHQGNELGIDQRRILWKRVVDLNDRALRHVTVGLGGPLNGIPREDGFDITVASEIMAILCLATDIEDLKRRLANIVIGYRYDRTPVSVGDLQVEGALALILKDAIKPNLVQTIYGTPAFVHGGPFANIAHGCNSVLATTTALHLADYTVTEAGFGADLGAEKFLDIKTPNLPTSPDAVVIVATLRALKMNGGVAKDALTEENVEAVRAGFANLKRHVENIRKFGIPAVVAINEFVSDTEAEIAVLKELCASIDVPVELASVWADGAEGGVALAETVVKTIAENPANYKRLYDNDLSVQEKIEKIVTEIYRGSKVNFEKKSQTQIAQIVQNGWDKLPICMAKTQYSFSDNPNALGAPENFEITIRELVPKLGAGFIVALTGDVMTMPGLPKRPAALNMDVESDGTVLGLF

SEQ ID NO: 16160 - DNA, 1629 bp, Thermotoga maritima
  CDS (1)..(1629)
atgaaaccgatcaaagagatcgccgatcagttggaattgaaagatgacattctctatccttacggccactacatagcgaagatcgaccacagattcttgaaaagccttgaaaatcatgaagatgggaaactgatcctcgtaacggcagttacccccacccctgcaggtgaaggaaaaactaccaccagcataggactttccatgtctctgaacagaatcggtaagaaatcgatagttactctgagagagccttccctcggccccacccttggattgaaaggcggtgcaacaggaggtggcaggtcgagggttcttccttctgatgagataaaccttcatttcaccggagatatgcacgccgtggcctccgcccacaatctgctggcggccgttctggactcgcacataaaacacggcaacgagctcaaaatagacataacaagagtattctggaagcgaaccatggacatgaacgaccgtgctttgagaagcatagtgatcggtcttggaggctcagcgaacggatttccaagagaggacagtttcatcatcacggccgcttccgaagtgatggccattcttgctctgtccgagaacatgaaggacctgaaagaaagacttgggaaaataatcgtggcgctcgacgctgacagaaaaatcgtcaggatctctgatcttggaatccagggtgccatggccgttcttttgaaagatgccataaatcccaacctcgttcagacaaccgaaggaactccagcgctcatacattgcggacctttcgccaacatcgcgcacggcaccaattccatcatagcgacgaagatggccatgaagctctccgaatacacggtcacggaggcgggttttggagcagacctcggtgctgagaaattcatcgactttgtttcccgtgttggtggtttttatccgaacgcagccgttctggtggccacagtgcgagctttgaagtaccatggtggtgcaaacctcaaaaacatccacgaggaaaacctggaagccctcaaagaaggattcaaaaatctcagggtacacgtggaaaacctgaggaaattcaatctgcccgtcgtggtagcgctgaacagattcagcacggacacagaaaaggaaatagcctacgtggtgaaagagtgcgaaaaactcggtgtgagggtagcagtcagtgaggtttttaaaaagggcagcgaaggcggtgtcgaactcgcaaaagccgtagcagaagctgcgaaggacgtagaaccggcttacctctacgagatgaacgatcctgtggaaaagaagatagagattctcgcaaaagaaatctacagagcgggaagagtggagttttccgatactgcaaaaaatgccctcaaattcattaaaaaacacggttttgatgagcttcccgtgatcgttgccaaaactccaaagtccatttcccacgatccgtctctcagaggtgcacctgaaggatacacgttcgttgtcagcgacctcttcgtttccgccggggcaggctttgttgttgcgctttcaggagacataaatctgatgcctggtcttccaaaaaaaccaaatgctttgaacatggacgtagacgacagcggtaacatagtaggtgtttcgtga

SEQ ID NO: 16161 - protein, 542 aa, Thermotoga maritima
MKPIKEIADQLELKDDILYPYGHYIAKIDHRFLKSLENHEDGKLILVTAVTPTPAGEGKTTTSIGLSMSLNRIGKKSIVTLREPSLGPTLGLKGGATGGGRSRVLPSDEINLHFTGDMHAVASAHNLLAAVLDSHIKHGNELKIDITRVFWKRTMDMNDRALRSIVIGLGGSANGFPREDSFIITAASEVMAILALSENMKDLKERLGKIIVALDADRKIVRISDLGIQGAMAVLLKDAINPNLVQTTEGTPALIHCGPFANIAHGTNSIIATKMAMKLSEYTVTEAGFGADLGAEKFIDFVSRVGGFYPNAAVLVATVRALKYHGGANLKNIHEENLEALKEGFKNLRVHVENLRKFNLPVVVALNRFSTDTEKEIAYVVKECEKLGVRVAVSEVFKKGSEGGVELAKAVAEAAKDVEPAYLYEMNDPVEKKIEILAKEIYRAGRVEFSDTAKNALKFIKKHGFDELPVIVAKTPKSISHDPSLRGAPEGYTFVVSDLFVSAGAGFVVALSGDINLMPGLPKKPNALNMDVDDSGNIVGVS

SEQ ID NO: 16162 - DNA, 1677 bp, Neisseria meningitidis
  CDS (1)..(1677)
atgagtttcaaaaccgatgccgaaatcgcccaatcctccaccatgcgcccgattggcgaaattgccgccaagctgggtttgaacgttgacaacattgagccttacggtcattacaaagccaaaatcaatcctgccgaagcgttcaaactgccgcaaaaacagggcaggctgattttggttaccgccatcaacccgactccggcgggcgaaggtaaaaccaccgtaaccatcggtttggcggacgcattgcgccatatcggcaaagactctgtgattgctttgcgcgagccttctttgggtccggtgttcggcgtgaaaggcggcgcggcaggcggcggctatgcccaagttttgccgatggaagacatcaacctgcacttcaccggagattttcacgccatcggtgcggcaaataatctgcttgccgcgatgctcgacaaccatatctaccaaggcaacgagttgaacatcgaccccaaacgcgtgctgtggcggcgcgtggtcgatatgaacgaccgccagttgcgcaacatcatcgacggcatgggcaagcctgttgacggcgtgatgcgtcctgacggtttcgatattaccgttgcttccgaagtgatggcggtattctgtcttgccaaagacatcagcgatttgaaagagcgtttgggcaacatccttgtcgcctacgccaaagacggcagccccgtttacgccaaagatttgaaagcgaatggcgcgatggcggcattgcttaaagatgcgattaagcccaacttggtgcaaaccatcgaaggcacgcccgccttcgtacacggcggcccgttcgccaacatcgcccacggctgcaactccgtaaccgcaacccgtctggcgaaacaccttgccgattacgccgtaaccgaagcaggcttcggcgcggacttgggcgcggaaaaattctgcgacatcaaatgccgccttgccggtttgaaacctgatgcggctgttgtcgtggcgactgtccgcgcgttgaaatataacggcggcgtggaacgcgccaacctcggcgaagaaaatttagacgctttggaaaaaggtttgcccaacctgctgaaacacatttccaacctgaaaaacgtattcggactgcccgtcgtcgttgcgctcaaccgcttcgtgtccgactccgatgccgagttggcgatgattgaaaaagcctgtgccgaacacggcgttgaagtttccctgaccgaagtgtggggcaaaggtggtgcgggcggcgcggatttggcgcgcaaagtcgtcaacgccattgaaagtcaaaccaataacttcggtttcgcctacgatgtcgagttgggcatcaaagacaaaatccgtgcgattgcccaaaaagtgtacggcgcggaagatgttgatttcagcgcggaagcgtctgccgaaatcgcttcactggaaaaactgggcttggacaaaatgccgatctgcatggcgaaaacccaatactctttgagcgacaacgccaaactgttgggctgccccgaagacttccgcatcgccgtgcgcggcatcaccgtttccgcaggcgcaggtttcatcgtcgccctgtgcggcaacatgatgaaaatgcccggcctgcccaaagttccggctgccgagaaaatcgatgtggacgcagaaggcgtgattcacggcttgttctag

SEQ ID NO: 16163 - protein, 558 aa, Neisseria meningitidis
MSFKTDAEIAQSSTMRPIGEIAAKLGLNVDNIEPYGHYKAKINPAEAFKLPQKQGRLILVTAINPTPAGEGKTTVTIGLADALRHIGKDSVIALREPSLGPVFGVKGGAAGGGYAQVLPMEDINLHFTGDFHAIGAANNLLAAMLDNHIYQGNELNIDPKRVLWRRVVDMNDRQLRNIIDGMGKPVDGVMRPDGFDITVASEVMAVFCLAKDISDLKERLGNILVAYAKDGSPVYAKDLKANGAMAALLKDAIKPNLVQTIEGTPAFVHGGPFANIAHGCNSVTATRLAKHLADYAVTEAGFGADLGAEKFCDIKCRLAGLKPDAAVVVATVRALKYNGGVERANLGEENLDALEKGLPNLLKHISNLKNVFGLPVVVALNRFVSDSDAELAMIEKACAEHGVEVSLTEVWGKGGAGGADLARKVVNAIESQTNNFGFAYDVELGIKDKIRAIAQKVYGAEDVDFSAEASAEIASLEKLGLDKMPICMAKTQYSLSDNAKLLGCPEDFRIAVRGITVSAGAGFIVALCGNMMKMPGLPKVPAAEKIDVDAEGVIHGLF

SEQ ID NO: 16164 - DNA, 1923 bp, Caenorhabditis elegans
  CDS (1)..(1923)
atgagcacatggaatgttgaatacttgaagcccaccctgttaactcctgttccatcggatattgctatttcgagagctcaaccaccaaaggacatcgaaaaggtagctggggaaattggaatcaaacaagaagagcttgacctttatggacgcaagaaggcaaaggtttctcttgacattttggatagactgagcgaggttaaaaatggaaagtacgttgtagttgctggtattacgccaacacctcttggagaaggaaaatccacaacgacaatcggactagttcaagctctcggagctcatcttcacaaaaaggtgttcgcatgtgtacgccagccatcgcaaggaccaacgtttggaattaaaggaggagctgctggaggaggatactctcaggttattccgatggaggagttcaatcttcatttgacaggagatatccatgcaattactgcagccaataatcttcttgctgctgcaatcgatgctagaatgttccatgagtcaacccaagcaactgatgcactattcaacagattggcaccaaagaacaagaagggagtccgcccactttcggagatccaacttcgtcgcctcgaccgtcttggaatcccacgtgtagatgatgctgaaaatcttagcgaagagcagagagttagctttgctcgtctcaacatagatcctgcaactatcacctggaaccgtgtgatggatacgaacgatagattcttaagaaagattgaaattggaatgggaccgaatgagaagggacacacccgaactactcagtttgatattactgttgctagtgagctcatggcgattcttgcgttgacaacttctctcgctgatatgcaagaaagaattgcacgaattgtgatcggatccgacaaggctggcaatccagtaaccgctgatgatattggagtaactggggctttgacagttcttatgcgagacaccgttcgcccaaacctgatgcaaactttggagggtactccggtttttgtccatgccggacccttcgctaatattgcacatggacaaagcagtattcttgctgacaaggttgctttgaaacttgccggacccgacggatttgtgatcactgaagctggattcggagccgatatcggaatggagaagttcttcaacatcaagtgccgttactcgggacttcagccatcagcagttgtccttgtagcaactgtaagagctcttaagatgcatggaggtggtccatctgttgtagcaggagctccactgaaacacgaataccttgacgaaaacattccacttgttgaaggaggatgcgattcaaatcttagaaagcagattgagaatgcaaacaaatttggaatccctgttgttgtctgcgtgaacaagttcgcaaccgataccgacaaggagttggaacttgtttgctccaaggccaaggaatacggagcatttgatgcagtggtttccgaacactggtcacaaggaggcgctggtgcggttgctctcgccaattctctggtcaatgctacaactggacatccaaagcaattcaaattcctttacaacctggatttgtcattggaagacaagatcgctactatcgccaaagaaatctatggtgctgatggcattgaactatctgacgaggccaaacagaaattggaaagatacacaagacagggattctcgaagttgccaatttgtatggcaaaaactcatttgtccctttcatcagacccaacaaagaagggtgctccaactggtttcacacttccgattcgcgacgtgcgtgcatccgttggagctggattcatttacccattggttggtgaaatgaccacaatgccaggactcaacactcgtccgtgcttctacgacatcaccattgacccagtcactgagatcattgatgggctattctaa

SEQ ID NO: 16165 - protein, 640 aa, Caenorhabditis elegans
MSTWNVEYLKPTLLTPVPSDIAISRAQPPKDIEKVAGEIGIKQEELDLYGRKKAKVSLDILDRLSEVKNGKYVVVAGITPTPLGEGKSTTTIGLVQALGAHLHKKVFACVRQPSQGPTFGIKGGAAGGGYSQVIPMEEFNLHLTGDIHAITAANNLLAAAIDARMFHESTQATDALFNRLAPKNKKGVRPLSEIQLRRLDRLGIPRVDDAENLSEEQRVSFARLNIDPATITWNRVMDTNDRFLRKIEIGMGPNEKGHTRTTQFDITVASELMAILALTTSLADMQERIARIVIGSDKAGNPVTADDIGVTGALTVLMRDTVRPNLMQTLEGTPVFVHAGPFANIAHGQSSILADKVALKLAGPDGFVITEAGFGADIGMEKFFNIKCRYSGLQPSAVVLVATVRALKMHGGGPSVVAGAPLKHEYLDENIPLVEGGCDSNLRKQIENANKFGIPVVVCVNKFATDTDKELELVCSKAKEYGAFDAVVSEHWSQGGAGAVALANSLVNATTGHPKQFKFLYNLDLSLEDKIATIAKEIYGADGIELSDEAKQKLERYTRQGFSKLPICMAKTHLSLSSDPTKKGAPTGFTLPIRDVRASVGAGFIYPLVGEMTTMPGLNTRPCFYDITIDPVTEIIDGLF

SEQ ID NO: 16166 - DNA, 1671 bp, Clostridium acetobutylicum
  CDS (1)..(1671)
atgaaaactgatattgaaatagctcaagaagctaaaatggaacctatagtaaaaatagcagagaagattggtttaaatgaagacgatattgatttatatggtaaatataagtgtaaaatatcgctagatgtattgaaacaaaacaagaacaaacaagatggtaaattggtgttggttactgctataaatcctacaccagctggtgagggaaaatctacagttacagtgggacttggggaagccctatgcaaaatgaacaagaatacagtgattgcacttagagaaccttctcttggacctgtttttggtattaaaggaggagctgctggaggcggttacgctcaagtagtaccaatggaagatataaatcttcattttactggagatatgcatgctataacttcagcaaacaatttactctgcgcagctatagataaccatattcaccaaggaaatagtttgaaaatagaccaaagaagaatagtatttaaaagagttatggatatgaatgatagagctcttagaagtatagtagttggtcttggaggaaaagtaaatggttttccaagagaagacggttttatgataacagttgcttctgaaataatggctatactttgtttggcaaatgatcttatggatttaaaagagagaatgggaaagatactaatagcctatgatttggatgggaatccagtatattgtagggatctcaaagttgaaggtgctatggctatgcttatgaaagacgcaatgaagcctaatttggttcaaacgcttgagaatactccagctataattcatggtggaccttttgcaaatatagcccatggatgcaacagtatcttagctacaaagatggcgttgaagcttggagattatgttattacagaggcaggtttcggtgcagatttaggagctgaaaaattcttagatataaaatgtaggtacggaaacttaaaccctgattgcgttgtattagttgcaacaattagagcacttaaacatcacggtggtgcactaaaggaggatttaagtaaaccaaatgcaaaggttcttgaaaaaggactatcaaatttaggtaaacaaatagagaatataaagaaatacggtgtgcctgttgttgttgcaataaataaatttataacagacagtgaagaagaaataaaatgcatcgaagaatactgtagtaaacagggagtaaaggtatcgcttacagaagtttgggaaaaaggcggagaaggtggaacagatcttgcaaataaggttttagacactttagaaaatgaaaagagcaattttaagtatctatatgatgaaaagctaagtataaaagaaaaaatggatataatagctaaagaaatatatggagcagatggagttcagtatactcctcaagcaaacaaacagataaaagaaattgagaaatttaatttggataaactccctatatgtgttgcgaaaacacagtattctttatctgataatccagctcttttaggaagaccaactaactttactataaatgttaaggaagtaagagtatctaatggagcaggttttgtggtagttcaaaccggaaatatcatgactatgccaggacttccaaagactccagctgcaaataaaatggatatatttgaagatggctctatagtaggtttattttaa

SEQ ID NO: 16167 - protein, 556 aa, Clostridium acetobutylicum
MKTDIEIAQEAKMEPIVKIAEKIGLNEDDIDLYGKYKCKISLDVLKQNKNKQDGKLVLVTAINPTPAGEGKSTVTVGLGEALCKMNKNTVIALREPSLGPVFGIKGGAAGGGYAQVVPMEDINLHFTGDMHAITSANNLLCAAIDNHIHQGNSLKIDQRRIVFKRVMDMNDRALRSIVVGLGGKVNGFPREDGFMITVASEIMAILCLANDLMDLKERMGKILIAYDLDGNPVYCRDLKVEGAMAMLMKDAMKPNLVQTLENTPAIIHGGPFANIAHGCNSILATKMALKLGDYVITEAGFGADLGAEKFLDIKCRYGNLNPDCVVLVATIRALKHHGGALKEDLSKPNAKVLEKGLSNLGKQIENIKKYGVPVVVAINKFITDSEEEIKCIEEYCSKQGVKVSLTEVWEKGGEGGTDLANKVLDTLENEKSNFKYLYDEKLSIKEKMDIIAKEIYGADGVQYTPQANKQIKEIEKFNLDKLPICVAKTQYSLSDNPALLGRPTNFTINVKEVRVSNGAGFVVVQTGNIMTMPGLPKTPAANKMDIFEDGSIVGLF

SEQ ID NO: 16168 - DNA, 1668 bp, Lactococcus lactis subsp. lactis
  CDS (1)..(1668)
atgaaaacggatattgaaattgctcaagctgctgacattcaacctattaccaaaattgctgaaaagattggactatcatttgatgatatcgaactttatggtaaatacaaagctaaaattcctttagaggttttagataagtttgaccaacagtctgaaggaaaacttgttttggtgacatcaattaatcccacacctgctggagaaggaaaatcgacagttactgtcggtttggctgatgcatttgcaagacaaggtaaaaatgtaatggtggccttgcgtgaaccttctttagggcctgttatgggaattaagggtggagctgctggtggtggttttgcacaggtattaccaatggaagatattaatcttcattttacaggggatattcatgcgattacaactgccaataatgctatttcggcatttcttgataattcgcttcatcaaggaaatccgttaaatatcgacccaagaagaatcatttggaaacgtgttgttgatttgaatgaccgtgcccttcgtcatgtcactgttggacttggtggccctttaaatggtgtgccccgtgaagatggttttgatattacagtagtcagtgaaattatggcggttttatgtttggcaacttcaatcagcgatttgaaagaacgtttaggaaaaattgttctggctcagtcttatgaccgtaaacctgtaacccttggtgatttgggggttcaaggggctattgcgatgctcttgaaagatgcactgaaaccaaaccttgttcagacaattgaaggaacgccagctttgattcacggtgggccttttgccaatattgcgcatggttgtaattctgttttggcaacaaaaacagccttaaaattatctgatattgtcattacagaagctgggtttggagctgaccttggtggtgagaaatttttagatatcaaaactcgtcagctcggaaaacaacctgatgcggtagtaattgtggctacacttcgtgcacttaaaatgcatggtggccttgataaaaaagaattgactaaggaaaacgtagaggctgttaaaaagggctttgctaatttagaacgtcatattaaaaatatgcagagttacggtttgccagtaattgtggcaattaatgagtttgcatcagatactaaatctgaaatttcagcattaaaagatctgacagaagcattgggagttccagtttcattgacccaagtctttgctaagggtggtgaaggtggtttagatttggccgaaaaactgtcaggaatgttacaagaaaaatctgattttagctatctttatgacctaaaagagccattatcagctaaaattgacaaagttgtgacagaaatttatggcggttccaaagtcaattattcaccaaaggctaagcgtcagatgagagaaattgaagaaaatggttggaatgatttgccagtatgcatggctaaaactcaatattcattttcagaccaaccaaatcttttagcggcaccagaaggctttgaagttacagttcgtgaactacttccaaaaattggagctggatttatcgttgctcttttgggggacgtaatgacaatgccagggcttcctaaaaatccagcatctttaaaaatggatgtcactgatgatggaaaaatctcaggattattttag

SEQ ID NO: 16169 - protein, 555 aa, Lactococcus lactis subsp. lactis
MKTDIEIAQAADIQPITKIAEKIGLSFDDIELYGKYKAKIPLEVLDKFDQQSEGKLVLVTSINPTPAGEGKSTVTVGLADAFARQGKNVMVALREPSLGPVMGIKGGAAGGGFAQVLPMEDINLHFTGDIHAITTANNAISAFLDNSLHQGNPLNIDPRRIIWKRVVDLNDRALRHVTVGLGGPLNGVPREDGFDITVVSEIMAVLCLATSISDLKERLGKIVLAQSYDRKPVTLGDLGVQGAIAMLLKDALKPNLVQTIEGTPALIHGGPFANIAHGCNSVLATKTALKLSDIVITEAGFGADLGGEKFLDIKTRQLGKQPDAVVIVATLRALKMHGGLDKKELTKENVEAVKKGFANLERHIKNMQSYGLPVIVAINEFASDTKSEISALKDLTEALGVPVSLTQVFAKGGEGGLDLAEKLSGMLQEKSDFSYLYDLKEPLSAKIDKVVTEIYGGSKVNYSPKAKRQMREIEENGWNDLPVCMAKTQYSFSDQPNLLAAPEGFEVTVRELLPKIGAGFIVALLGDVMTMPGLPKNPASLKMDVTDDGKISGLF

SEQ ID NO: 16170 - DNA, 1668 bp, Staphylococcus aureus
  CDS (1)..(1668)
atgactcatttatcagatttagatattgcgaatcaatcaacactacaaccaattaaggatattgctgcatcagtaggtatttcagaggatgcattagaaccttatggtcattacaaagctaaaatcgacattaataaaattacgccaagagaaaacaaagggaaagttgttttagtaactgcgatgagcccaacaccagctggtgaaggtaaatcaacggttacagttggtttagctgatgcattccatgagttaaataaaaacgttatggttgcattaagagagcctgctttaggaccaacatttggtatcaaaggtggtgcgactggtggtggttatgcgcaagtcttacctatggaagatatcaacttacatttcaacggagatttccatgcgattacaactgcaaataatgcattgtctgcgtttatagataatcatattcaccaaggtaatgaattaggaatcgatcaaagacgtattgaatggaaacgtgtattagatatgaatgatcgtgcacttagacatgtaaacgttgggttaggtggacctacaaatggtgtaccacgtgaagatggctttaatattacagtagcgtctgaaattatggcgattttatgtttaagtagaagtattaaagacttaaaagataaaattagtcgtattactattggttacactagagatcgcaagccagttacagttgcagatttaaaagtgcaaggtgcacttgcaatgattttaaaagatgcaattaaaccaaacttagtacaatcaattgaagggacacctgcattagttcatggtggaccatttgcgaatatcgcacacggttgtaactcaattttagcaactgaaacagcacgtgatttagctgatatcgttgtaacggaagctggatttggttcagacttaggcgctgaaaaattcatggacattaaagcgcgtgaagcaggatttgatctggcagctgtcgttgttgttgcgacaattcgtgcgttaaaaatgcatggtggtgtagcgaaagataatttaaaagaagaaaatgtagaagcagtaaaagcaggaattgttaatttagagcgtcatgttaataatattaaaaaattcggtgtagaaccggttgttgcaattaatgcatttatacatgataccgatgcagaagtagaatatgtaaaatcttgggctaaagaaaataacgtacgaattgccttaactgaagtttgggaaaaaggtggtaaaggtggcgttgacttagcaaatgaagtattagaagtcattgatcaacctaattcatttaaacctttatatgaattagaattaccattagagcaaaagattgaaaagattgtgactgaaatctatggcggttcaaaagtaacgtttagcagtaaagcgcaaaaacaattaaaacaatttaaagaaaatggttgggataattacccagtatgtatggcgaaaacacaatattcattctcagatgatcaaacgttgttaggtgcaccatcaggatttgaaattacaattcgtgaattagaagcgaaaacaggtgcaggatttatcgtagcgttgacaggtgcaatcatgactatgcctggtttacctaaaaaaccagcagcattaaacatggatgttactgatgatggtcatgcaattgggttattctaa

SEQ ID NO: 16171 - protein, 555 aa, Staphylococcus aureus
MTHLSDLDIANQSTLQPIKDIAASVGISEDALEPYGHYKAKIDINKITPRENKGKVVLVTAMSPTPAGEGKSTVTVGLADAFHELNKNVMVALREPALGPTFGIKGGATGGGYAQVLPMEDINLHFNGDFHAITTANNALSAFIDNHIHQGNELGIDQRRIEWKRVLDMNDRALRHVNVGLGGPTNGVPREDGFNITVASEIMAILCLSRSIKDLKDKISRITIGYTRDRKPVTVADLKVQGALAMILKDAIKPNLVQSIEGTPALVHGGPFANIAHGCNSILATETARDLADIVVTEAGFGSDLGAEKFMDIKAREAGFDLAAVVVVATIRALKMHGGVAKDNLKEENVEAVKAGIVNLERHVNNIKKFGVEPVVAINAFIHDTDAEVEYVKSWAKENNVRIALTEVWEKGGKGGVDLANEVLEVIDQPNSFKPLYELELPLEQKIEKIVTEIYGGSKVTFSSKAQKQLKQFKENGWDNYPVCMAKTQYSFSDDQTLLGAPSGFEITIRELEAKTGAGFIVALTGAIMTMPGLPKKPAALNMDVTDDGHAIGLF

SEQ ID NO: 16172 - DNA, 1894 bp, Clostridium cylindrosporum
  CDS (155)..(1825)
acgttcttaactcattcgaatacggtctagctctagaaggattcaataaggaacaaattctagaataccacctaatgggttaattgttacttaaatagtaattaagacacagatttttagataaaaagttaaaaacgcataggaggcttttataatgaaaacagacgttcaaatagctcaagaagctcaaatgaagccaatcactgaagtggctaactaccttggaattcaagatgatgaactagaactatacggaaagtataaggctaaggtttctctagacgttctagaaagacaaaaagataaggaagatgctaagcttgttcttgtaacagctatcaacccaactccagctggagaaggaaagacaactacaaacgttggtctttcaatgggtcttaacaaaattggtaagagaacaatcacagctcttagagagccatcactaggaccttgcttcggagttaagggaggagcagcaggtggtggatacgcacaagttgtacctatggacgatatcaacctacactttacaggtgacttccatgctataacttcagctcacaacctactagcagcactacttgacaaccatctacaccaaggaaacgctctaaacatcaatcctaagaagattgtttggaagagagttatcgacatgaacgatagatcactaagaaacgttataatcggtcttggtggaaatggtgatggattcgtaagacaagcacaattcgatatcacagttgcttcagaaataatggcaattctttgtcttgcaacatcaatgtcagaccttaaggaaagactttcaaagatgatcgtagcttatgctaaggacggaagcgcagttacagctggtcaactagaagctacaggagctatggcacttcttcttaaggatgctgttaagccaaaccttgttcaaacactagaaaacacacctgcattcatccacggtggaccattcgcgaacatcgcacatggatgtaactcagttcttgctactaaggttgctcttaagcttgctgattacgtagtaactgaaggtggattcggtgctgaccttggagctgaaaagttctttgatattaagtcaagattcgctggtcttaagccaaactgtgatgtatctgttgctacagttagagctcttaagatgaacggtggagttcctaagactgaactagctgctgaaaacgttgaagctgttaagaagggtgtagctaaccttgaaagacacattgaaaacgttgctaagttcggagtaccagcagttgttgctatcaacaagttcccactagatacagaagctgaacttaaggctgtagaagatgcttgtaacgctaagggtgcagacgttgttctttcagacgtttgggctaacggtggagaaggtggagttgaaatggctaagaaggttgttgaaatctgtgaaaagaatgaagcaaactttgcaccactatacgatgtaaacctaagcattccagaaaagatcgaaaagatcgctactactatatacagagcagacggagttgacttcacttcagattgtaagaagcaaatcgctgaacttgaaaaacttggtctagacaagatgccaatctgtatggctaagactcaatactcattctcagatgatccaacactacttggagcaccaacaggattcagaatcactgtaagagaagtaagagtatcagcaggtgcaggatttatcgtagcacttactggaaatatgatgacaatgccaggacttccaaaggttccagcagctaatggtatggatatacttgaaagcggagaaatcataggattatcataagattatcttggattttgaagtagtttaatataaatatttaaaattttgagggggtttatttatgaagtt

SEQ ID NO: 16173 - protein, 556 aa, Clostridium cylindrosporum
MKTDVQIAQEAQMKPITEVANYLGIQDDELELYGKYKAKVSLDVLERQKDKEDAKLVLVTAINPTPAGEGKTTTNVGLSMGLNKIGKRTITALREPSLGPCFGVKGGAAGGGYAQVVPMDDINLHFTGDFHAITSAHNLLAALLDNHLHQGNALNINPKKIVWKRVIDMNDRSLRNVIIGLGGNGDGFVRQAQFDITVASEIMAILCLATSMSDLKERLSKMIVAYAKDGSAVTAGQLEATGAMALLLKDAVKPNLVQTLENTPAFIHGGPFANIAHGCNSVLATKVALKLADYVVTEGGFGADLGAEKFFDIKSRFAGLKPNCDVSVATVRALKMNGGVPKTELAAENVEAVKKGVANLERHIENVAKFGVPAVVAINKFPLDTEAELKAVEDACNAKGADVVLSDVWANGGEGGVEMAKKVVEICEKNEANFAPLYDVNLSIPEKIEKIATTIYRADGVDFTSDCKKQIAELEKLGLDKMPICMAKTQYSFSDDPTLLGAPTGFRITVREVRVSAGAGFIVALTGNMMTMPGLPKVPAANGMDILESGEIIGLS

SEQ ID NO: 16174 - DNA, 3452 bp, Homo sapiens (man)
  CDS (108)..(3044)
tccttcccgccgccgccgccgccgccgccgcctgctcccctggcacgcgccccgccgccctcggcagccgcagctccgtgtcccctgagaaccagccgtcccgcgccatgggcacgcgtctgccgctcgtcctgcgccagctccgccgcccgccccagcccccgggccctccgcgccgcctccgtgtgccctgtcgcgctagcagcggcggcggcggaggcggcggcggtggccgggagggcctgcttggacagcggcggccgcaggatggccaggcccggagcagctgcagccccggcggccgaacgcccgcggcgcgggactccatcgtcagagaagtcattcagaattcaaaagaagttctaagtttattgcaagaaaaaaaccctgccttcaagccggttcttgcaattatccaggcaggtgacgacaacttgatgcaggaaatcaaccagaatttggctgaggaggctggtctgaacatcactcacatttgcctccctccagatagcagtgaagccgagattatagatgaaatcttaaagatcaatgaagataccagagtacatggccttgcccttcagatctctgagaacttgtttagcaacaaagtcctcaatgccttgaaaccagaaaaagatgtggatggagtaacagacataaacctggggaagctggtgcgaggggatgcccatgaatgttttgtttcacctgttgccaaagctgtaattgaacttcttgaaaaatcaggtgtcaacctagatggaaagaagattttggtagtgggggcccatgggtctttggaagctgctctacaatgcctgttccagagaaaagggtccatgacaatgagcatccagtggaaaacacgccagcttcaaagcaagcttcacgaggctgacattgtggtcctaggctcacctaagccagaagagattccccttacttggatacaaccaggaactactgttctcaactgctcccatgacttcctgtcagggaaggttgggtgtggctctccaagaatacattttggtggactcattgaggaagatgatgtgattctccttgctgcagctctgcgaattcagaacatggtcagtagtggaaggagatggcttcgtgaacagcagcacaggcggtggagacttcactgcttgaaacttcagcctctctcccctgtgccaagtgacattgagatttcaagaggacaaactccaaaagctgtggatgtccttgccaaggagattggattgcttgcagatgaaattgaaatctatggcaaaagcaaagccaaagtacgtttgtccgtgctagaaaggttaaaggatcaagcagatggaaaatacgtcttagttgctgggatcacacccacccctcttggagaagggaagagcacagtcaccatcgggcttgtgcaggctctgaccgcacacctgaatgtcaactcctttgcctgcttgaggcagccttcccaaggaccgacgtttggagtgaaaggaggagccgcgggtggtggatatgcccaggtcatccccatggaggagttcaaccttcacttgactggagacatccacgccatcaccgctgccaataacttgctggctgccgccatcgacacgaggattcttcatgaaaacacgcaaacagataaggctctgtataatcggctggttcctttagtgaatggtgtcagagaattttcagaaattcagcttgctcggctaaaaaaactgggaataaataagactgatccgagcacactgacagaagaggaagtgagtaaatttgcccgtctcgacatcgacccatctaccatcacgtggcagagagtattggatacaaatgaccgatttctacgaaaaataaccatcgggcagggaaacacagagaagggccattaccggcaggcgcagtttgacatcgcagtggccagcgagatcatggcggtgctggccctgacggacagcctcgcagacatgaaggcacggctgggaaggatggtggtggccagtgacaaaagcgggcagcctgtgacagcagatgatttgggggtgacaggtgctttgacagttttgatgaaagatgcaataaaaccaaacctgatgcagaccctggaagggacacctgtgttcgtgcatgcgggcccttttgctaacattgctcacggcaactcttcagtgttggctgataaaattgccctgaaactggttggtgaagaaggatttgtagtgaccgaagctggctttggtgctgacatcggaatggagaaattcttcaacatcaagtgccgagcttccggcttggtgcccaacgtggttgtgttagtggcaacggtgcgagctctgaagatgcatggaggcgggccaagtgtaacggctggtgttcctcttaagaaagaatatacagaggagaacatccagctggtggcagacggctgctgtaacctccagaagcaaattcagatcactcagctctttggggttcccgttgtggtggctctgaatgtcttcaagaccgacacccgcgctgagattgacttggtgtgtgagcttgcaaagcgggctggtgcctttgatgcagtcccctgctatcactggtccgttggtggaaaaggatcggtggacttggctcgggctgtgagagaggctgcgagtaaaagaagccgattccagttcctgtatgatgttcaggttccaattgtggacaagataaggaccattgctcaggctgtctatggagccaaagatattgaactctctcctgaggcacaagccaaaatagatcgttacactcaacagggttttggaaatttgcccatctgcatggcaaagacccacctttctctatctcaccaacctgacaaaaaaggtgtgccaagggacttcatcttacctatcagtgacgtccgggccagcataggcgctgggttcatttaccctttggtcggaacgatgagcaccatgccaggactgcccacccggccctgcttttatgacatagatcttgataccgaaacagaacaagttaaaggcttgttctaagtggacaaggctctcacaggacccgatgcagactcctgaaacagactactctttgcctttttgctgcagttggagaagaaactgaatttgaaaaatgtctgttatgcaatgctggagacgtggtgaaataggccaaagatttcttcttcgttcaagatgaattctgttcacagtggagtatggtgttcggcaaaaggacctccaccaagactgaaagaaactaatttatttctgtttctgtggagtttccattatttctactgcttacactttagaatgtttattttatggggactaagggattaggagtgtgaactaaaaggtaacattttccactctcaagttttctactttgtctttgaactgaaaataaacatggatctagaaaaccaaaaaaaaaaaaaaaaa

SEQ ID NO: 16175 - protein, 978 aa, Homo sapiens (man)
MGTRLPLVLRQLRRPPQPPGPPRRLRVPCRASSGGGGGGGGGREGLLGQRRPQDGQARSSCSPGGRTPAARDSIVREVIQNSKEVLSLLQEKNPAFKPVLAIIQAGDDNLMQEINQNLAEEAGLNITHICLPPDSSEAEIIDEILKINEDTRVHGLALQISENLFSNKVLNALKPEKDVDGVTDINLGKLVRGDAHECFVSPVAKAVIELLEKSGVNLDGKKILVVGAHGSLEAALQCLFQRKGSMTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTPKAVDVLAKEIGLLADEIEIYGKSKAKVRLSVLERLKDQADGKYVLVAGITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQVPIVDKIRTIAQAVYGAKDIELSPEAQAKIDRYTQQGFGNLPICMAKTHLSLSHQPDKKGVPRDFILPISDVRASIGAGFIYPLVGTMSTMPGLPTRPCFYDIDLDTETEQVKGLF

SEQ ID NO: 16176 - DNA, 2802 bp, Spodoptera frugiperda (fall armyworm)
  CDS (1)..(2802)
atgtgggagccgcagggaagcttggaccccgtcttagaatctatcgagaatgagcttcgtgaccaagtggctgaggctcggtcccgctgggctggcttcgacgcacggctggccatcgtgcaggtgggaggccgggaggactccaatgtctacatcaggatgaagctgagggctgcagaaaacatcggcatcaccgctgagcacatccagctgcccagggacatcactgagactgagctgctagccaacatcaccagcctgaacgagtccccgtacgtgcacggtatcatcgtgcagatgccgctggactctgtgcatccgatcgactctcacgctatcaccgatgccgtctcccccgacaaggatgtggatggattgaacacaataaacgaggggcgcgtacgcgtgggcgacttgtctggcttcattccctgcacgccagcaggttgcgtggaactcatcaaacgtactggcgtcaccatcgccggcaagaacgtcgtggtgctgggccgtagccgcatcgtcggcactccagtctccgaactgctgaagtgggaacatgccaccgtcaccgtctgccactccaagaccaagaacttgagtgaaattaccaagactgccgacattttggtggtagctatcggtaggggcgagatggttcgcggctcctggatcaaacctggggctgtagtcatcgactgcggtatcaatccaatctctgaccccacgaagaagagtggccagcgcttggtgggtgacgtggcttatgaggaggcggtgcaggtggcgtcccacgtgacgccagtgcccggaggtgtgggccccatgaccgtggccatgctcatgcgcaacacagtgcaggccgcgcgccgacagctcgaccgcttgctggcccccacgtggccactccggccactccgcatcacgccgctgtcaccaccacccagtgacattgtgattgcccgttctcaaaagcccaaggacataagtgagttggcgcatgagatcggtctgttctccaacgaagtgtcgcagtatggacgcaccaaggccaagatctctctgtcagtgctcgacaggatgaggaaccaacaaggcgcaaagtacatcgtggttgctggaattacaccaactcctctgggcgagggaaagagtacgaccctcttgggactggtgcaagcgttgtcagcacaccgtggtcgcaactcattcgctgtgatgcgtcagcccagccagggacctaccttcggagtcaaaggaggtgccgccggtggtggttattctcaagtaattcccatggaagagtttaatcttcacctaacaggagacatacacgcaggtactgctgccaacaacctgctcgctgcccaaatggacgcgaggatcttccacgaactgacccagaaggacggcccactgttcgacagacttgtacccaagatcaaaggagtcaggaaattctcccctatccaacttaggaggctgaagaggctgggcatcactaagacagaccctgacaccctgacagaaggagagaagtccaaattcgctcgtttgaacattgacacctcgaaaattatgtggaatagagttgtggacttaaacgacagatacctccgtaagatcaccgtaggacagtcccctacagagaaaggattcacaagagaaaccgccttcgatatctccgtagcttcggagatcatggccattcttgctctgggcagggatgtagaggacatcaaggaaagactagccaatatggtggtagccctcgacaagagtggcaatcctgtcaccgctgatgatttgggcatgacaggagcacttctggttctattacgtgatgcattcgagccgactctgatgcagtccctggaaggtactccagtgctggttcacactggtccattcgctaacattcgccacggctgctcatccatcctggctgacaagatcgccatgaagctggctggagagaacggatatgttgctactgaagctggttttggatctgatattggtatggagaagttcttcgatatcaagtgccgtgcgagtggagacacacctcactgcgcagtcatcgtgtctacagtacgtgccctgaagatgcacggtggtgggcccccagtgtccgctggtatgccgctcaatgatgtctacgtacaggaaaatctggaacttcttagcaaaggtctttgcaacttgggcaaacacataagcaatggaaacaagttcggtgtcccagttgtggttgccatcaacaaacatggcaatgacacgcccgctgagctgaacctggtgaaagaattcgcagttaagaatggagcattcagagcagtgctgtgcgaccactgggccaagggtggtctcggagccctggagttggcagacgctgtcattgaggcctgtgactccaaatccaagttcgatttcttgtacccactgcagctgtccatccaagagaagattcagatcattgccaaggagatgtatggagctggacaagtcgaatacactgatgaagttctcgagaagatcaaaacgtttacagatatgggttacgacaaattcccgatctgtatggccaagacatcgaactcgttgactggagacccagctgtaaaaggagcgcctactggattcacgctgaaaataaacggtatttttgcctccgtcggtgccggcttcgttgtcccaatggtgggagaaatctccaaaatgcctggtcttcccactagacctagcatttacgacatagacctcaacacgaagacaggagaaatcgaaggccttttctaa

SEQ ID NO: 16177 - protein, 933 aa, Spodoptera frugiperda (fall armyworm)
MWEPQGSLDPVLESIENELRDQVAEARSRWAGFDARLAIVQVGGREDSNVYIRMKLRAAENIGITAEHIQLPRDITETELLANITSLNESPYVHGIIVQMPLDSVHPIDSHAITDAVSPDKDVDGLNTINEGRVRVGDLSGFIPCTPAGCVELIKRTGVTIAGKNVVVLGRSRIVGTPVSELLKWEHATVTVCHSKTKNLSEITKTADILVVAIGRGEMVRGSWIKPGAVVIDCGINPISDPTKKSGQRLVGDVAYEEAVQVASHVTPVPGGVGPMTVAMLMRNTVQAARRQLDRLLAPTWPLRPLRITPLSPPPSDIVIARSQKPKDISELAHEIGLFSNEVSQYGRTKAKISLSVLDRMRNQQGAKYIVVAGITPTPLGEGKSTTLLGLVQALSAHRGRNSFAVMRQPSQGPTFGVKGGAAGGGYSQVIPMEEFNLHLTGDIHAGTAANNLLAAQMDARIFHELTQKDGPLFDRLVPKIKGVRKFSPIQLRRLKRLGITKTDPDTLTEGEKSKFARLNIDTSKIMWNRVVDLNDRYLRKITVGQSPTEKGFTRETAFDISVASEIMAILALGRDVEDIKERLANMVVALDKSGNPVTADDLGMTGALLVLLRDAFEPTLMQSLEGTPVLVHTGPFANIRHGCSSILADKIAMKLAGENGYVATEAGFGSDIGMEKFFDIKCRASGDTPHCAVIVSTVRALKMHGGGPPVSAGMPLNDVYVQENLELLSKGLCNLGKHISNGNKFGVPVVVAINKHGNDTPAELNLVKEFAVKNGAFRAVLCDHWAKGGLGALELADAVIEACDSKSKFDFLYPLQLSIQEKIQIIAKEMYGAGQVEYTDEVLEKIKTFTDMGYDKFPICMAKTSNSLTGDPAVKGAPTGFTLKINGIFASVGAGFVVPMVGEISKMPGLPTRPSIYDIDLNTKTGEIEGLF

SEQ ID NO: 16178 - DNA, 2910 bp, Schizosaccharomyces pombe
  CDS (1)..(2910)
atggtttcgtttaatcaattacgaaactattttctagaaagcaacagcttacggccatcgaaatggctttttcagtcgtatggtacttcaagttctgcgaatatcctaaatggaaaattattggcaagaaaattacaacgttctgttgctgaagaagtgcaggccttgaaagctaaggatcgaaactttaagccggcgcttgccattgtacaggttggaaaacgtgaggattctaacgtgtacgttcgaatgaaagaaaaggcggcacgattagttggtattgattttaaatactgcccgtttcctgaaacaatccaaatgcctgccttgcttcatgaattaaaaaaattgaatgacgatcatacggttcacggtgtccttgtccaacttcctcttcccaagcatctcaatgagcgtacagttactgaatctatcactccgccgaaagacgttgatggatttggtgcatttaacattggtttattggcaaagaatgatgctacccccattcattatccctgtaccccgaaaggtattatggagttattaaaagataacaagatttcagtcgctggattgaacgctgtagttctgggaagaagtgacattgtcggaaatccaattagctacttgttgagaaaggacaatgctacagtaactgtctgtcattctaaaactaaagatttaattcagcacatttctaatgctgatttggttatagcagcattaggcaaacccgaatttgttcgtggtgaatggttgaaaccaggatctgttgtggtagatgttggcataaacgctgttcaaagaaatggaaaacgcgttttggttggcgatgtgcatttcgaatctgcatccaaagttgctagcagcattactcctgtccctggaggcgtcggaccgatgactgttgctatgctaatggaaaatattgtaaacgctgccaagatagctagaacagaaaacatttatcgaaaaattgacttaaatcctttagagttaaagaagcctgttccttctgatatcgaaattgctaattcccaagaacctaaattaattagcaatcttgctaaggagatgggtatctatgacacagagttagaaaattatgggaactataaggcaaaagtaaatcttgctgtttatgaacgtttaaagcaccgaaaagatgggaactatgttgttgtaagtggtattactcctacaccttttggcgaaggtaaaagtacagttgttgctggtttggttcaagctatgggccatttgggtaagcttggaattgcttgtgtccgtcagccgtcccaagggccgacatttggtgttaaaggaggcgccgctggtggaggctacgcacaatttattcctatggatgactttaaccttcatatgactggagatatacacgctgttaccgcagcaaataatcttttagtcgcggctcttgaaactaggatgtttcatgaaaacacacaatctgatgctgcccttataaaacgtttgatccctgttaaaaacgggcgaagagtcattccacgaggattgatcggtaggtggaatcgtatttgcgcatctcataacatggatccagaagatgttaataacgcatcaccggaattactgaaagagtttgtgcggctaaacgtagatcctgacaccatcgaatgcaacagagtattggacgtcaatgatcgattcctccgttctattgaggttggaaaagcatcaactgaaaagggacatgtccgtaaaacttctttcgatatctctgtggccagtgaatgcatgtcaattctggctctttcatgtgatttaaacgacatgcattctcgtttatcccgtatggttatagccaacgacaaatacggaaatgctattactgctggcgaccttggagtttctggagcattgaccgttttgcttaaagacgctatcaaacctaacttgatgcaaactttggaaggaacaccagcgtttgttcacgcaggaccttttgcaaacattagcattggcgcgtcttctattatcgctgataaaattgctttaaaattggctggtacagaaagctttgacagacccgaagatgccggctatgtcgttaccgaagcaggatttgcgtctgacatgggaatggaaaaattctttaacatcaaatgtagatactcaaaacttgtacctaacaccgttgttttggttaccactgttaaagcgcttaagttacatggaggcggtcccaagttaaaacctggtgccccaattcctgaggaatatcttgttgaaaatctagaccttgtaaagaatggatgttccaacatggtaaaacacattcaaaattgtcataaattcaatattcctgttgttgtcgccatcaacagttataagactgatagttctaaggagcatgaaataatacgcgaggcagcgctacaagctggagctgtggatgctgtaccttcggatcattgggcccaaggcggcaaaggagctattgaattggccaagtccgtaatgacggcttgtgatcagtcatccaattcgaagtttaggcttttgtatgatagcgagacttcaattgaagataaagtaaatgtgattgcaaaagaaatgtatggagcaaacggtgttgaatttagttctctagctaaggaacgaataaatacgtttatcaaacaagggttcggtaacttaccaatttgcatggcgaaaacccaatattctctttcgcataatcccgaatttcgcaatgttccaaaaaattttacagttcctattagagatatgcgtttgaatgctggcgctggcttcatttatccgctagctgctgaaatccaaacaattcctggtttaccgactgcgcctgcctatttaaacattgatatatgtgaaaatggagaaattgttgggctgtcataa

SEQ ID NO: 16179 - protein, 969 aa, Schizosaccharomyces pombe
MVSFNQLRNYFLESNSLRPSKWLFQSYGTSSSANILNGKLLARKLQRSVAEEVQALKAKDRNFKPALAIVQVGKREDSNVYVRMKEKAARLVGIDFKYCPFPETIQMPALLHELKKLNDDHTVHGVLVQLPLPKHLNERTVTESITPPKDVDGFGAFNIGLLAKNDATPIHYPCTPKGIMELLKDNKISVAGLNAVVLGRSDIVGNPISYLLRKDNATVTVCHSKTKDLIQHISNADLVIAALGKPEFVRGEWLKPGSVVVDVGINAVQRNGKRVLVGDVHFESASKVASSITPVPGGVGPMTVAMLMENIVNAAKIARTENIYRKIDLNPLELKKPVPSDIEIANSQEPKLISNLAKEMGIYDTELENYGNYKAKVNLAVYERLKHRKDGNYVVVSGITPTPFGEGKSTVVAGLVQAMGHLGKLGIACVRQPSQGPTFGVKGGAAGGGYAQFIPMDDFNLHMTGDIHAVTAANNLLVAALETRMFHENTQSDAALIKRLIPVKNGRRVIPRGLIGRWNRICASHNMDPEDVNNASPELLKEFVRLNVDPDTIECNRVLDVNDRFLRSIEVGKASTEKGHVRKTSFDISVASECMSILALSCDLNDMHSRLSRMVIANDKYGNAITAGDLGVSGALTVLLKDAIKPNLMQTLEGTPAFVHAGPFANISIGASSIIADKIALKLAGTESFDRPEDAGYVVTEAGFASDMGMEKFFNIKCRYSKLVPNTVVLVTTVKALKLHGGGPKLKPGAPIPEEYLVENLDLVKNGCSNMVKHIQNCHKFNIPVVVAINSYKTDSSKEHEIIREAALQAGAVDAVPSDHWAQGGKGAIELAKSVMTACDQSSNSKFRLLYDSETSIEDKVNVIAKEMYGANGVEFSSLAKERINTFIKQGFGNLPICMAKTQYSLSHNPEFRNVPKNFTVPIRDMRLNAGAGFIYPLAAEIQTIPGLPTAPAYLNIDICENGEIVGLS

SEQ ID NO: 16180 - DNA, 2814 bp, Schizosaccharomyces pombe
  CDS (1)..(2814)
atggctttgcttttggagggtacttctttggcccgcaaagttcgagaagaacttcgggagcagatctcctcgattaaatctgttgacccttatttcaacgtttctttaaaaatcattcaagtcggaggtagagaggactcaaatgtatatgtgcgcatgaaaactcgtgcagctaatgaggctggaatctcctgtgagcatgtgaattttcctgaagatattacagaatacgacttgctgcttgccatcaaaggcttcaacgaggaccctactgtccacggtattattgtacagttacctctgcctgctcacatcaatgagcagattattacagaagccgtcgctcccgagaaagacgttgatggtttttgtgaaactaatttgggaaaattgaccaagcgcgaaggtcaacccttgtttaccgcatgcaccccaaaaggtattatgtgcattttaaaacattacgggattaatgtccaaggaaagcatgctgttgtcataggccgtagcaacattgttggtcgtccaatgtccatacttttggaaaaggcaaatgccacagttactttatgtcattcaaagacggaatctattgctgatattgttaggacagctgatattgtcgttgctgccattggtattcctcatttcgtcaaggctgactggttgaaaaagggcgttgtcgctattgatgttggtatcaactctattccagatgccaccaagaagtctggttaccgtcttaccggcgatattgactttgaaaatgccaaggaggtcgccagcgcaatcacacctgtccctggttctgttggtcctatgaccgtagccatgttgctgcaaaacgtggttgaatcagctgttcgctttcgcaaaatgtctcgcaagcgtaaaccaactcttcttcctttaaagcttcagacccctgttcctagtgatattgagattgcgcgttcacaaacccctaaaaatattggtgacttggcttccgaaattggtatcgcaaaatctgaattagaattttatggatcccataaagccaaggtcaaccttgaaattcttcaacgtctggctcatcgtcgcgacggccactacgttgtagttactggtatcactcctactccattcggcgagggtaaaagtacacttactgcaggactcgttcaagcgctttcaaacttggacaagcttgctattgcatgtgttcgtcaaccctctcaaggccccacatttggaattaaaggtggtgctgccggaggtggttattctcaattcatccctatggaggagttcaatcttcatttaactggtgacattcatgcaattacagcagctaccaacttgcttgctgctgccatcgatacccgtatgttccatgaaaacacacaatccgatgccgctttgtataaacgtttgactttggttaagggaaacaaacgagagtttgcacccgtcatgttccgtcgcttgaaaaagcttggcattgataaaactaatcctgaagaattaaccgaagaagagcaaagaaaatttgctaggctggatattgaaccttcaactatttcatggaatcgtactttggatgttaacgatcgctttcttcgtaaaattactattggagagaatcctacggaaaagggtttcactcgccaaaccggttttgatctttctgtcgctagcgaatgtatgtctgtcttggccttggctactgacttgaaagatatgcgtgagcgattaggccgcatggttgttgccagcaacaaatctggtgaacctgttaccgctgatgatttaggagttggtggtgccttgacagtcttgctcaaagacgcaattaaaccaacacttatgcaaacgttggagggtactcctgctcttgttcatgctggcccttttgcaaatatcagtattggtgcctcttccattctggctgatcgcattgccctcaaattagcgggtaccgaagtggatgaggatgctaagaaagaagctggatatgttgtaactgaggcaggattcgcttccgatatcggaatggaaaagttctttaatatcaagtgtcgtacttcaggtttaaagcctgatgccattgttatcgttgcaactgttcaagcattgaagttacacggcggcggtcctcctgttggacctggtaaacctatccctgaggtttataagcgcgaagacgttgatttggttcgtaaaggatgcgctaatctggctaagcacattagtaatgcacgtaagtacggtttacccgttgtggttgcaatcaataagttttcttccgattctcctaatgaaattagtgccattcgtgaagaagcccttgctgccggtgcaactgatgctgtagactctaaccactgggccgaaggtggtaaaggagctctaggtgttgcacgtgctttgataaatgcttgcgagaatgtggattctgaattccgcctcctttacgatgtacacgagcccatcgaaaagaagattgaaattattgcgaaagaaatgtatggtgctgacggcattgaattgagtcccttggctaaagaacgtcttgaaacgtttactaaacaaggatacaacaacttacccatttgcattgccaaaacacaatacagtttatcgcacgacccagatctaaaaggtgcccctactaattttaccgtgccaattcgtgatatgcgtttgagtgctggtgctggattcatttatcctttagcagcagccatatctactattcctggattacctaccaagccagcctattacaatattgatatcgcagaaaatggtgatattgttgggctgtcttaa

SEQ ID NO: 16181 - protein, 937 aa, Schizosaccharomyces pombe
MALLLEGTSLARKVREELREQISSIKSVDPYFNVSLKIIQVGGREDSNVYVRMKTRAANEAGISCEHVNFPEDITEYDLLLAIKGFNEDPTVHGIIVQLPLPAHINEQIITEAVAPEKDVDGFCETNLGKLTKREGQPLFTACTPKGIMCILKHYGINVQGKHAVVIGRSNIVGRPMSILLEKANATVTLCHSKTESIADIVRTADIVVAAIGIPHFVKADWLKKGVVAIDVGINSIPDATKKSGYRLTGDIDFENAKEVASAITPVPGSVGPMTVAMLLQNVVESAVRFRKMSRKRKPTLLPLKLQTPVPSDIEIARSQTPKNIGDLASEIGIAKSELEFYGSHKAKVNLEILQRLAHRRDGHYVVVTGITPTPFGEGKSTLTAGLVQALSNLDKLAIACVRQPSQGPTFGIKGGAAGGGYSQFIPMEEFNLHLTGDIHAITAATNLLAAAIDTRMFHENTQSDAALYKRLTLVKGNKREFAPVMFRRLKKLGIDKTNPEELTEEEQRKFARLDIEPSTISWNRTLDVNDRFLRKITIGENPTEKGFTRQTGFDLSVASECMSVLALATDLKDMRERLGRMVVASNKSGEPVTADDLGVGGALTVLLKDAIKPTLMQTLEGTPALVHAGPFANISIGASSILADRIALKLAGTEVDEDAKKEAGYVVTEAGFASDIGMEKFFNIKCRTSGLKPDAIVIVATVQALKLHGGGPPVGPGKPIPEVYKREDVDLVRKGCANLAKHISNARKYGLPVVVAINKFSSDSPNEISAIREEALAAGATDAVDSNHWAEGGKGALGVARALINACENVDSEFRLLYDVHEPIEKKIEIIAKEMYGADGIELSPLAKERLETFTKQGYNNLPICIAKTQYSLSHDPDLKGAPTNFTVPIRDMRLSAGAGFIYPLAAAISTIPGLPTKPAYYNIDIAENGDIVGLS

SEQ ID NO: 16182 - DNA, 1803 bp, Pseudomonas paucimobilis
  CDS (36)..(1709)
cccgggctcgccacgagaaaggacgaggaggacacatggcacaaggctccgatatcgagatcgcccgcgaagaaaggatgcagaatatcgcggaggtcggcgcgaaagtcggcatcccgcaggacgcgctgctgaactacggcccctacaaggccaagctgagctgggacttcatcaacagcgttcagggcaaccaggacggcaagctgatcctcgtcaccgcgatcaacccgacgccggccggcgaaggcaagaccacgaccaccgtgggcctggccgacggcctcaaccgcatcggcaagaagaccgtggcggcgctgcgcgagccttcgctcggcccctgtttcggcgtgaagggcggcgcggccggcggcggctatgcgcaggtcgtgccgatggaggacatcaaccttcacttcaccggtgacttccatgccatcacctcggcgaacaacctgctcgccgcgctgatcgacaaccacatctactggggcaacaagctcggcctcgatccgcgccgcatcgcatggcgccgcgtgctcgacatgaacgaccgggtgcgctcgatcgtcaattcgctgggcggcgtctcgaatggctatccgcgcgaggacggcttcgacatcaccgtggcttcggaagtcatggcgatcctgtgcctttcctcggacctcaaggacctcgagcggcgcctcggcaacatccacgccggctacacgcgcgagcgcaaggccgtgctggccagcgagctgaatgcctcgggcgccatgaccgtgctgctcaaggacgcgctgcagccgaacatggtgcagacgctggagaataatccggtgctcatccatggcggcccgttcgcgaacatcgcgcatggctgcaactcggtgctcgccaccaagaccgcgctcaagatcgccgattatgtggtgacggaagccggcttcggtgccgacctgggtgcggagaagttcttcgacatcaaatgccgcaaggcgggcctcaagccctcggccgcagtgatcgtggcgacgatccgcgcgctcaagatgcatggcggcgtcgacaaggccgatctcggcacggcgaacccggaggcggtccgcaagggcggcgtcaatctcgctcgccacatcgagaatgtccgccagttcggcgtgccggtggtggtcgcgatcaaccagttcatcacggacaccgacgaggaaatggccatggtgaaggaaatcgccgaggccgcgggcgccgaggcggtactgtgcagccactgggccaacggctcggccggcaccgaggaactggcgcgcaaggtcgtcgcgcacgccgagagcggttcgtccaacttcgcgccgctctatgaagacagcatgccgctgttcgagaagatcgacacgatcgccaagcgcatctaccgcgcgaccgaggccacggcggacagcagcgtgcgcaacaagctcaagggctgggaagcggacggcttcggccatctgccggtctgcatggccaagacgcagtacagcttctcgaccgacccggcgctgcgcggcgccccgaccgaccatgtcgtgcccgtgcgcgacgtgatcctctcggccggcgcggagttcatcgtggcggtctgcggcgacatcatgcgcatgcccggcctgcccaaggtcccctcggcagacttcatcaagctcgacgagcagggccagatccagggcctgttctgagccccggccatgccgatgcgcgtcatgaccgggtcatgaccgcgtgaagacatcgggaaggcccgccgcgcagatgtgtggcgggcctttcgct

SEQ ID NO: 16183 - protein, 557 aa, Pseudomonas paucimobilis
MAQGSDIEIAREERMQNIAEVGAKVGIPQDALLNYGPYKAKLSWDFINSVQGNQDGKLILVTAINPTPAGEGKTTTTVGLADGLNRIGKKTVAALREPSLGPCFGVKGGAAGGGYAQVVPMEDINLHFTGDFHAITSANNLLAALIDNHIYWGNKLGLDPRRIAWRRVLDMNDRVRSIVNSLGGVSNGYPREDGFDITVASEVMAILCLSSDLKDLERRLGNIHAGYTRERKAVLASELNASGAMTVLLKDALQPNMVQTLENNPVLIHGGPFANIAHGCNSVLATKTALKIADYVVTEAGFGADLGAEKFFDIKCRKAGLKPSAAVIVATIRALKMHGGVDKADLGTANPEAVRKGGVNLARHIENVRQFGVPVVVAINQFITDTDEEMAMVKEIAEAAGAEAVLCSHWANGSAGTEELARKVVAHAESGSSNFAPLYEDSMPLFEKIDTIAKRIYRATEATADSSVRNKLKGWEADGFGHLPVCMAKTQYSFSTDPALRGAPTDHVVPVRDVILSAGAEFIVAVCGDIMRMPGLPKVPSADFIKLDEQGQIQGLF

SEQ ID NO: 16184 - DNA, 2835 bp, Candida glabrata
  CDS (1)..(2835)
atgctaaagtttctcagaaccaataggtactaccacctattgtccgggacaaagctatcccagaagataattgagcaatgtcgcaatgagatagacaccattaggaagaaccataagtttttgcccactttgaagattctacaagtcggcaatcggttggactcatctgcctatgtgaacatgaaattgaagaaatccgaacaaagtggcgtgaagtgcattgtagaaaaactgccggagtcaattactgagtttgagctgttgagcaagatagaagccataaacaacgatacctccatacatggactgctgatccaattgcctttaccaaagcacttggatgagaccacaattactagctctgtctctgttgacaaagacgttgacgggttccacatatacaacgctggtgaactcactaagaaaaacggtcatccaaagttcattccatgcacccccaacgggtgtatagagcttttgaaggaacataatattactattgcggggaagaatgccgttgttatcggaaggtctagcattgttggaactccaataacctctttattgaaaaatttggacgctactgtaactcaatgtcatagcaagaccgttaatttaccagaaatagtcaaaacagcagatattgtaatcgcagcttgtggacaagcaaatatgatcaagggtgaatggctaaaagaaggggcagttgttattgatgtcggcatcaaccatgtaccggataacacgaagaaatctgggcataggttggttggtgacgtcgattttgactccgcatcaaagaaagcctcatacattactccggttccaggtggtgttggccagatgactgtcgctatgctagtttcgaatgttgtcctggccgccaagcgtagtttggccaattttgaaaaagtgccagaaataaaaccattacctctaaaattagaaaaacctgtcccatctgattttgaaatctcgaagtctcaagaaccaaaacatattgataacttagctaaggaattagggatatttcaagatgaactagaactccatggccattacaagggtaaaatatctacatcaatactagatagacttgagtccaagaagaatggtagatatgttcttgttgctggtatcacacctactcctttgggtgaaggtaaatcaacaacaacaatgggtttggtacaggccttgaccggccatctgggcaaaccatccattgctaatgtgcgtcagccatcaatgggacccacatttggtgtaaaaggtggagctgctggaggcggatatgctcaagtcataccaatggatcaatttaatctgcacttaactggtgatatccatgcagttggtgttgcaaacaatcttttggctgctgcaatcgatactaggatgctacacgaatctacaataaagaatgatgccaaattttatgacaaacttgttccaaaaaagaatggtatcagatctttttctcctgctatgactagaaggttagagagacttggaatcaacaaaactaatcctgatgaacttacagcagaggagataaataagttcgtgagactaaatattaaccctgatactatcaacataaaaagagttgttgatgtgaacgatagaatgctacgtaaaattacaattggtcaagctgctaccgaaaaaggacggactagagaaactggttttgacattactgttgcctcggaactaatggcaatcttagctctaagcactagtttacaagacatgaagcgtagagtttccaagttggtggttgctagcgacataaacggcaaacctgttactgtcgatgatattggttgctctggtgcaatagtagctttaatgaccgatacgatcaaaccaaacctcatgcagacacttgaaggctccccagtgcttgttcacgcaggtccatttgccaatatctcaattggtgcatcttctgttatggcagataagattgccttaaaattgatgggtacatgtttagactctcaagaaccaggttacgttgttaccgaagcagggtttgatttttccatgggcggagaacgcttctttaatattaaatgccggtcatcaggattagtcccggacactgtcgttttagttgcaactgttagagctattaagtctcacggaggtgctccggacgtcaagccaggccaagcgcttccacaagagtatatagaggagaacattgaatttgtaaagaaaggtgtcgctaacttagttaaacaaattgagaatgttaagaaattcggagtcccagttgttgttgcaatcaacaaattttccactgacactgaaaatgaaactaaagctatagaagaatcatgtaaagccgctggtgcaaacaatgtggttgtctctaatcattgggaagaaggtggaaaaggtgctattgatctagccaatgctgttgttcaatcttgtgaggaacccaaatcattccagttcctatatgacacagatttgcctataaaagagaagctagaaactatcgttaaagagatgtatggtggtgctggaatcgaactatctgaaaaagcccaaaaacagattgcattatacacagagcaaggttttgataaattgccaatttgcattgctaaaacccaatattcattatcacatgatccaaaactgaagggtgttccacaagacttcatagtccctattagagatatcagggcatctattggtgcaggctatctatatgcgttagcagctgaaatacaaacaatcccaggcttatccgtccatgcaggatacttaaatgtggaggttgatgacaagggtaacattaatggtctattttag

SEQ ID NO: 16185 - protein, 944 aa, Candida glabrata
MLKFLRTNRYYHLLSGTKLSQKIIEQCRNEIDTIRKNHKFLPTLKILQVGNRLDSSAYVNMKLKKSEQSGVKCIVEKLPESITEFELLSKIEAINNDTSIHGLLIQLPLPKHLDETTITSSVSVDKDVDGFHIYNAGELTKKNGHPKFIPCTPNGCIELLKEHNITIAGKNAVVIGRSSIVGTPITSLLKNLDATVTQCHSKTVNLPEIVKTADIVIAACGQANMIKGEWLKEGAVVIDVGINHVPDNTKKSGHRLVGDVDFDSASKKASYITPVPGGVGQMTVAMLVSNVVLAAKRSLANFEKVPEIKPLPLKLEKPVPSDFEISKSQEPKHIDNLAKELGIFQDELELHGHYKGKISTSILDRLESKKNGRYVLVAGITPTPLGEGKSTTTMGLVQALTGHLGKPSIANVRQPSMGPTFGVKGGAAGGGYAQVIPMDQFNLHLTGDIHAVGVANNLLAAAIDTRMLHESTIKNDAKFYDKLVPKKNGIRSFSPAMTRRLERLGINKTNPDELTAEEINKFVRLNINPDTINIKRVVDVNDRMLRKITIGQAATEKGRTRETGFDITVASELMAILALSTSLQDMKRRVSKLVVASDINGKPVTVDDIGCSGAIVALMTDTIKPNLMQTLEGSPVLVHAGPFANISIGASSVMADKIALKLMGTCLDSQEPGYVVTEAGFDFSMGGERFFNIKCRSSGLVPDTVVLVATVRAIKSHGGAPDVKPGQALPQEYIEENIEFVKKGVANLVKQIENVKKFGVPVVVAINKFSTDTENETKAIEESCKAAGANNVVVSNHWEEGGKGAIDLANAVVQSCEEPKSFQFLYDTDLPIKEKLETIVKEMYGGAGIELSEKAQKQIALYTEQGFDKLPICIAKTQYSLSHDPKLKGVPQDFIVPIRDIRASIGAGYLYALAAEIQTIPGLSVHAGYLNVEVDDKGNINGLF

SEQ ID NO: 16186 - DNA, 2841 bp, Candida glabrata
  CDS (1)..(2841)
atggctgaactgattgatggtaaagcctgtgctcaaggcattcgtgcttctatcaaggaggagatagaggccattaagcagcaaaatccttcctttgtgccaacgttgaccattgttcaagttggtgacagacctgactcagctacttatgtgcgtatgaagagaaaagctgctgaggaggcaggcatcagggccgacttcttgcatttggctgaggatgtgagtgagaatgagttatatgaagaagttacgaagttgaacgagaacccagatatccacggtgtcattgttcaattgccattgccaggtcacattaacgaggacaagatcacctccgcagttgtagcagagaaagatgttgatggattcggtccaattaatattggtgaattgaacaagaagaacggtaagccattcttcttgccatgtacaccaaagggtatcattgagctattgaagcaggctggtgtccagatagccggatcaaagtcagttgttattggtagatcagacattgtgggctcacctgtagctgaattgttgaaatcgttggactctaccgtaactatcacacactctaaaactccagatatcccaagttacttgaacgacgctgacattgttgtcgttgccattggtaaacctgagtttgtcaaaggagaatggtttgctaacaataagaagggtgcagtggttattgacgttggtaccaactatgttgatgactcaaccaagaagtctggttacagatgctgtggtgacgttgaattcaaagaggcttgtaaatatgttaggaaaattactcctgttccaggtggtgtcggtccaatgacggttgccatgttgatgcaaaacactcttattgcagcaaagaggcagttggaaactggtggtaagttatctgagtttgaacctttaccattacaactgaagaggccagttccttccgattttgagatttctagagctcaaaagccaaagcagattaccaaagtggcattggaagctggtattcttccatctgagcttgaaccatatggatctacaaaggccaaggtcagcttgaatattcttgatcgtctaaaggatagggagaatggtaagtatattcttgttactggtattacaccaaccccgctaggtgaaggtaagtctacaacaactgtcggtttgactcaagctctgggtgcccacttaaacaaaactgtctttgctaatgttcgtcaaccttcaatgggtcctacatttggtatcaaaggtggtgcagcaggtggtggttactcccaggttattcctatggatgagttcaatttgcatgtgactggtgacatacacgctatctcaatggctaacaacttattagctgctgcaattgatactagaatgttccatgagtcaactcaaaaagatggtccattgtacaagagacttgtgccagctaaaaagggtgaaagaaagttcaccccaactatgttaagaagattaaagaaattggggattgacaaaaccaatccagatgatttgaccgatgaagaaattaccaggtttgcacgtttagatatagatccagaaacaattacttggagaagagttgtggattgtaatgatagatttttgagaggtatcacagttggtgaagcacccaccgagaaaggcttcactagaaagactggtttcgatatttcagtcgcctcagaatgtatggcaattttggccttatgtaactcattatctgacatgagagaacgtttaggtaagattgtcgttgcggcatccaagtctggtgaaccaattacctgtgaggatatcggttgtgccggtgccatgactgctctattgaaggatgcagtaaaaccaaatatcatgcaaaccttggaaggaactccagtttttgtccatgctggtccttttgctaatatttccattggtgctaattctgtcctagctgataagatagcattaaagcttgcaggtgttgatccaaagctcccagaagaaaagaagaaagaacaagttggctatgttgtcactgaagcaggttttgattttaccatgggtggtgagagattcttaaacatcaaatgtagatcttccggattagtccctgatgttgttgtgattgttgccacagtcagagctttgaaggtacacggtggtggacctgaggtaaaggctggtgctcctttaccatctgaatacttgaacgaagatgtagaactactgaggaagggttgtgcaaacttggccaagcacattgaaaatgctaagcaatataacttaccagtagttgttgctatcaacaaaatgtcctctgatacagacaaagaacatgaagtaatccgtgaggagtccctgaaggccggagcttatgacgctatagtatcagaccactgggcagaaggtggcgctggtgctgtagacttggctaaaggtatcattaaggcagctgatgaaactgacaacagcaaattctctttcctatatgaatcacagggtaaagtagaagacaagattcaaaagatcgccaacgccatgtatggtgctaaggatgttgaattcttaccagaggctcaaaagaagatcgatctatacacaaaacaaggttttggagatctcccaatctgtattgccaagactcagtactccttgtctcatgatgctaacttgaagggtgttcctaaagacttcactttcccaatcagagacatcagagcctctattggtgctggttacttgtacgctttggcagctgaaatccaaaccatacctggtcttccaacccactgtggctttatgaacattgaagtcaacgaagatggtgaaattgaaggtatgttctaa

SEQ ID NO: 16187 - protein, 946 aa, Candida glabrata
MAELIDGKACAQGIRASIKEEIEAIKQQNPSFVPTLTIVQVGDRPDSATYVRMKRKAAEEAGIRADFLHLAEDVSENELYEEVTKLNENPDIHGVIVQLPLPGHINEDKITSAVVAEKDVDGFGPINIGELNKKNGKPFFLPCTPKGIIELLKQAGVQIAGSKSVVIGRSDIVGSPVAELLKSLDSTVTITHSKTPDIPSYLNDADIVVVAIGKPEFVKGEWFANNKKGAVVIDVGTNYVDDSTKKSGYRCCGDVEFKEACKYVRKITPVPGGVGPMTVAMLMQNTLIAAKRQLETGGKLSEFEPLPLQLKRPVPSDFEISRAQKPKQITKVALEAGILPSELEPYGSTKAKVSLNILDRLKDRENGKYILVTGITPTPLGEGKSTTTVGLTQALGAHLNKTVFANVRQPSMGPTFGIKGGAAGGGYSQVIPMDEFNLHVTGDIHAISMANNLLAAAIDTRMFHESTQKDGPLYKRLVPAKKGERKFTPTMLRRLKKLGIDKTNPDDLTDEEITRFARLDIDPETITWRRVVDCNDRFLRGITVGEAPTEKGFTRKTGFDISVASECMAILALCNSLSDMRERLGKIVVAASKSGEPITCEDIGCAGAMTALLKDAVKPNIMQTLEGTPVFVHAGPFANISIGANSVLADKIALKLAGVDPKLPEEKKKEQVGYVVTEAGFDFTMGGERFLNIKCRSSGLVPDVVVIVATVRALKVHGGGPEVKAGAPLPSEYLNEDVELLRKGCANLAKHIENAKQYNLPVVVAINKMSSDTDKEHEVIREESLKAGAYDAIVSDHWAEGGAGAVDLAKGIIKAADETDNSKFSFLYESQGKVEDKIQKIANAMYGAKDVEFLPEAQKKIDLYTKQGFGDLPICIAKTQYSLSHDANLKGVPKDFTFPIRDIRASIGAGYLYALAAEIQTIPGLPTHCGFMNIEVNEDGEIEGMF

SEQ ID NO: 16188 - DNA, 900 bp, Bartonella quintana str
  CDS (1)..(900)
atgaacaatattatcgacggaaaaaagcttgctgaagagattatcgtgaaagttaaggctgaaacaataaaactccgcaataactataagatacaacccggtattgctgtcatcattgttggagatgatcccgcaagtcatgtatatgtcacatcaaaaagcaaaaaagccgaagaatgtggttttttttcaatcaaacatatgctttccaaagaaacatcagaaaaagaactccttcaacttattgcaacattaaattctgacccaaaaatccatggcattttggtacagcttcccctccctgctcatattaatacaaattgtgtaacgcaagccatcgctttccaaaaagatgtggatggttttcattatattaatataggaaaactctcatgcaatacccttgaagatgctatcattccctgtacaccagctggtgccatgataatgattgaacaacaatgcggacgagatttatctggtcttgatgccgttgttgttgggcgctctaatattgttggcaaacctatggctgccctcttaacagcagcaaatgccactgtgacaatcgcccatagtcgtacccgcgatcttgatgacgtgtgtcgtagtgccgatatcttagtagcagctgtaggccgtccacaaataattaaaaaagactgggttaaaaatggtgctattgtgatcgacgttggcattaaccgcattgcagcaccagagaaaggcataggaaagacgcgtcttgtcggtgatgtcgattttgaagcaataaaaggaaaaactgctgccattacccccgttccaggaggcgttggacctatgacaattgccatgcttatggttaatacgctcaacgctgctgctcgattatataatctgcccgtactaaaactctaa

SEQ ID NO: 16189 - protein, 299 aa, Bartonella quintana str
MNNIIDGKKLAEEIIVKVKAETIKLRNNYKIQPGIAVIIVGDDPASHVYVTSKSKKAEECGFFSIKHMLSKETSEKELLQLIATLNSDPKIHGILVQLPLPAHINTNCVTQAIAFQKDVDGFHYINIGKLSCNTLEDAIIPCTPAGAMIMIEQQCGRDLSGLDAVVVGRSNIVGKPMAALLTAANATVTIAHSRTRDLDDVCRSADILVAAVGRPQIIKKDWVKNGAIVIDVGINRIAAPEKGIGKTRLVGDVDFEAIKGKTAAITPVPGGVGPMTIAMLMVNTLNAAARLYNLPVLKL

SEQ ID NO: 16190 - DNA, 846 bp, uncultured bacterium
  CDS (1)..(846)
atgaccgcacaactgatcgacggcaacgccctgtccaagcaactccgcgccgaggtggccgttcgcgccgccaaactctccgagcgaggcatcacccccggcctggccgtcatcctggtgggcgacaaccccgccagccaggtctatgtgcgcaacaaggtcaaggcctgcgaggacgccggcctgcattcagtgctcgaaaaataccccgccaccatgaccgaggccgaactgctggcccgtgtcgaggccctgaacagcgatccgtccatccacggcatcctggtacagctgcccctgcccaagcacatcgacgaccacaaggtcatcgaatccatctcgcccctgaaggacgtcgatggcttccacgtcgccagcgctggcgccctgctggtgggcgagcccggcttcaaggcctgcacgccctacggctgcatgaagatgctcgaatcgatcggctacgacctgcgcggcaagcatgccgtggtcatcggccgcagcaacatcgtcggcaagcccatggcgctgatgctcttgcaatcgagcgccaccgtcaccatctgccacagtgcgacgccggacctggcctaccacacccgccaggccgacgtggtcgtggcggcggtgggcaagcgcaatgtgctcactgccgacatggtcaagcccggcgccgtcgtgatcgacgtcggcatgaaccgcgatgatgaaggcaagctgtgtggcgacgtcgactttgccggcgtcaaggaagtggccagctggatcacccccgtgccgggcggtgtcggccccatgaccatcaccatgctgctggtcaacaccatcgaagccgctgagcgtctataa

SEQ ID NO: 16191 - protein, 281 aa, uncultured bacterium
MTAQLIDGNALSKQLRAEVAVRAAKLSERGITPGLAVILVGDNPASQVYVRNKVKACEDAGLHSVLEKYPATMTEAELLARVEALNSDPSIHGILVQLPLPKHIDDHKVIESISPLKDVDGFHVASAGALLVGEPGFKACTPYGCMKMLESIGYDLRGKHAVVIGRSNIVGKPMALMLLQSSATVTICHSATPDLAYHTRQADVVVAAVGKRNVLTADMVKPGAVVIDVGMNRDDEGKLCGDVDFAGVKEVASWITPVPGGVGPMTITMLLVNTIEAAERL

SEQ ID NO: 16192 - DNA, 1608 bp, Picrophilus torridus DSM 9790
  CDS (1)..(1608)
atgaagaatatatcagagattattaacataccagaagactactatgatctttatggcaggtacatcgcaaaggtcagcttaaacgtacttgattatttaaaaaataaaagatacggtaaattgatacttgtcacagccatgacaccaacgccggctggcgagggtaagaccacaactgcaataggccttggaaatgcattaaagcttcttggaaagaatgcaggaatagccataagagagccatcccttggcccgtgctttggtgttaagggtggtgcaactggtggtggaaaatccactgtggagccatcaaataagataaatttgatgtttaccggcgatttccctgcagtttctgcggcacacaaccttttatcggctgtaataaacaatcacatgtaccatggcaatgaattaaaactcgatccaaagaatatagtgtttccaaggaccatagacatggacgacagatcattaaggagcataatcgttggttccggtgataggagtaccggggttatgatgaatgataaatatgttataacagcggcatcagaggtaatggcaatactggccctatccaggaattataatgaacttaagcaaagacttggaaacatcatgataggatataatttaaataaggcgccaatatttgcaagggatttaaaagttcatggcgcaatggcatcgctccttgttgatgcattaagaccaaatattgcgcagacatcagagcatgtaccggcaataatacacaccgggccattcggcaacattgcccatggcacatcaagcattcttggagatataataggtttaaaaatgtttgattaccttgtaacagaggcaggttttggctcagatctgggatttgaaaaatttatagacattgttttaaggttatcagattttaaattatcggcagtggttctggtcgcaactgtacgtgcaatgaggtaccacggtggtggaagaatcaacgagcccgatgttaatgccgttcttaggggctctgagaatttaatgtggcacgttcagaatataaaaaagtttggttttaatcctgttgtggcaataaacaggcattcaaacgatacggatgcagagataaatgccatttcaaatatattaacaaagaatggcgtagagttctcgatctcggatgcatacagtgatggtggccatggcgcattagatcttgccgggaaggttctaaagagcatatctgattataatccaaggtatatttatggaataaacgatgaccctgaggagaagatatcaaaaatagcaatgaatgtctacaatgcaaattccgtcgaattttcacatgatgcggttaagaccatgaaattgataaaggatgatttcagcgatctctatgtatgcatggccaagacccagtcatcaataagcgacaatgcaaagcttataaacgtgccagaaggatttacagttaaaataaacggtataaacataaattcaggctcaggatttataataccgctgcttgggaatataatgacaatgcccggtcttccaagaaggccagcctcagaaaacattgatatagatgattatggcaatatcaccggccttcaataa

SEQ ID NO: 16193 - protein, 535 aa, Picrophilus torridus DSM 9790
MKNISEIINIPEDYYDLYGRYIAKVSLNVLDYLKNKRYGKLILVTAMTPTPAGEGKTTTAIGLGNALKLLGKNAGIAIREPSLGPCFGVKGGATGGGKSTVEPSNKINLMFTGDFPAVSAAHNLLSAVINNHMYHGNELKLDPKNIVFPRTIDMDDRSLRSIIVGSGDRSTGVMMNDKYVITAASEVMAILALSRNYNELKQRLGNIMIGYNLNKAPIFARDLKVHGAMASLLVDALRPNIAQTSEHVPAIIHTGPFGNIAHGTSSILGDIIGLKMFDYLVTEAGFGSDLGFEKFIDIVLRLSDFKLSAVVLVATVRAMRYHGGGRINEPDVNAVLRGSENLMWHVQNIKKFGFNPVVAINRHSNDTDAEINAISNILTKNGVEFSISDAYSDGGHGALDLAGKVLKSISDYNPRYIYGINDDPEEKISKIAMNVYNANSVEFSHDAVKTMKLIKDDFSDLYVCMAKTQSSISDNAKLINVPEGFTVKINGININSGSGFIIPLLGNIMTMPGLPRRPASENIDIDDYGNITGLQ

SEQ ID NO: 16194 - DNA, 1755 bp, Photobacterium profundum
  CDS (1)..(1755)
atgaaaagcgacattcaaatttgccgcgacaccgcactcactcctattgaccaaattgccctaatggcgggtattgaacctcaagatttaaccccgcaaggtacgttaaaagcaaaagtaaaaccgtcaatcctcaaccgcttagcagataagcctgaaggtaaattggtattagtgacagcgattacccccacaccactcggtgaaggcaaaaccgttaccaccatcggccttgcacaaggtttagcaaagattaataaacgtgttatcgcctgtattcgccagccatcaatggggccagtatttggcgtaaaaggcggtgcagcaggcggtggttatagccaagtcgcaccaatggaaaagttgaatttgcacctaaccggtgatatccatgcggttaccgcagcccataatcttgctgctgccgctcttgatgcccgcttgtatcatgaagagcgccatggctacgaagcatttagcgataaaacaggcttacctgcgttacgtatcgatataaaaaatatcgtatggaagcgtgtgatggaccataatgatcgtgcattacgcatgatcactgttggtaaaaatgaagcaggaaaagccatcaatggccttgaacgtgaagatggttttgatatttctgccgcttctgaaatcatggcaattcttgctctttcaaaagatcttgcagacatgcgccaacgtattggtcgtgttgttttagcttacaacatcgacggtaatccaatcactgctgaagatttacaagtcgcaggcgcaatgaccgtcactatgtgtgaagccattgagccgacactcatgcagacgctggaaggtgtagcaacgctgatccatgcggggccttttgccaatattgcccatggtaactcctctattattgccgatcgtatcgccttaaagctgagtgaatttacggttacagagggtggttttggttctgatatgggctttgagaaagcctgtaatattaaagcgcagcaagccgatcgtggcccagattgcgccgtggtcgtcgctacattacgcggcttgaaagccaattctggtttatatgatttgcgcccagggcaagcactacccgatgcgattttttcacccgatgaaaaagccttaatcgcaggttttgataacttaaaatggcatatccgcaatgccgctcaatatggtttaccggttgtggtagcaataaaccgcttcccacaagataccgatgtagagcttgagctgctaaaaaacatggttgcagacacagatttcagtacctacgtgggtgtcgccattagcgaagcctttggcaaaggcggtgaaggtgcaacagaattagcacaagcggttgttaaagcgtgtgaaacaccagccaactttaagccattatatagcttgtcgcagtctcttgaagaaaagctaatggctgttgctgaagtcggttatggcgcacgtagtatcgaactctctgattgtgcgaaagaacagctcgcgacactgaaaaaacacggccatgataacttagcggtttgccttgctaaaacaccactttcgatcaccaccgatccaggtattaaaggcgccccctctgattttgtggtgcctgtacgagagttaaaattatgtgcgggtgcaggatttgtgtacgcactgtgcggtaatgtaatgacaatgcccggcttacctgaaaaaccggcttatatgaatcttgatatcgacgctgacggtaatattgttggtttaagttaa

SEQ ID NO: 16195 - protein, 584 aa, Photobacterium profundum
MKSDIQICRDTALTPIDQIALMAGIEPQDLTPQGTLKAKVKPSILNRLADKPEGKLVLVTAITPTPLGEGKTVTTIGLAQGLAKINKRVIACIRQPSMGPVFGVKGGAAGGGYSQVAPMEKLNLHLTGDIHAVTAAHNLAAAALDARLYHEERHGYEAFSDKTGLPALRIDIKNIVWKRVMDHNDRALRMITVGKNEAGKAINGLEREDGFDISAASEIMAILALSKDLADMRQRIGRVVLAYNIDGNPITAEDLQVAGAMTVTMCEAIEPTLMQTLEGVATLIHAGPFANIAHGNSSIIADRIALKLSEFTVTEGGFGSDMGFEKACNIKAQQADRGPDCAVVVATLRGLKANSGLYDLRPGQALPDAIFSPDEKALIAGFDNLKWHIRNAAQYGLPVVVAINRFPQDTDVELELLKNMVADTDFSTYVGVAISEAFGKGGEGATELAQAVVKACETPANFKPLYSLSQSLEEKLMAVAEVGYGARSIELSDCAKEQLATLKKHGHDNLAVCLAKTPLSITTDPGIKGAPSDFVVPVRELKLCAGAGFVYALCGNVMTMPGLPEKPAYMNLDIDADGNIVGLS

SEQ ID NO: 16196 - DNA, 1653 bp, Corynebacterium diphtheriae
  CDS (1)..(1653)
atgccgacggacgttgaaattgcccaagctcataccctcgagcccatcactgacattgccaatcgagctggagtaccttccgatgctctgatcccttatggctttacaaaagcgaaaatagatattaatcggattgcgagcgaaaacactggaaagctcgtgctcgtgacagggatttcaccaacgcctgccggcgaaggtaaatcgactgtcctcattggtctttcggacgcaatgagactacgcggccataattccattgttgctattcgcgaaccttctctaggccccgtaatgggaattaaaggtggagccgcaggtggtggatattcacagatcgttcctatggaagacatcaatctgcatttcactggagactttcatgcaatcacggcagctaacaacacgctggcagcaatgattgacaatcatattcatcaaggcaatactctaggaattgatgtccgtcggattacttggcaacgttgcctggatgtaaacgaccgctgtttgcgcaaagttgtgactggcctaggtggtaaagcacatggggtgccaactgaaacaggattcacgattacagccgcgagtgaaatcatggcgattctatgtctggcattagatctaacagatttggaagcacgcttggcacggattgttgtaggccagacatttagcagtgaaccagttaccgttggtcaacttaatgcgcaaggagcacttgcagcgttgcttcgtgatgcagttaatccaaatttagttcaaacattgggtggaacacctgcgttgtgccatggtgggccattcgcgaatattgcccatgggtgtaactctcttatcgctacaaaaacggcgctgtcactcggagatgtcgtactgacggaagcaggattcgggtccgacctcggtgccgaaaaattcttcgatattaagtcgcgcgtaggtgacctcaatgttgctgcaaccgtcgttgtcgcaactgtaaggtctcttaaatacaacgccggcgttcctaaagatgagctcacaaccgaaaaccttgaagctcttgcatctggagtcgtcaatctcgaacggcacgttgaaaatattcgtgcgtttggtatcgaaccaattgttgcactgaataaatttgcctcggacactgatgcagaaatcaatcagctcaaagcttgggctgaaaccatgtcggttcaattgatcccagtcgaagtttgggctcatggtgggcaaggcgcgctagaacttgccgacgcagttgcagtctcgatgcaaaatcaaacttcgcatcacctttatgaccccgaactgggaattgaagcatcactgctcacaattgcgcaaaaaatctacggcgcggcagatgttgagttgtcgaagcaagcgcgtcaagatctggcatatttgcaagaaaatggatgggatcgcttgccagtatgtatttccaaaacacaatattcattcagtgatgatccatctcagctagggcgtccagaaggacatactcttcacgttcgcaatttattgccacgaatcggtgcaggatttatcgttgctcttaccggtgatgtcatgaccatgcctggccttccgaaaaaaccagccgctgaaaacatcggagttgaaaatggagagattaaaggccttttctaa

SEQ ID NO: 16197 - protein, 550 aa, Corynebacterium diphtheriae
MPTDVEIAQAHTLEPITDIANRAGVPSDALIPYGFTKAKIDINRIASENTGKLVLVTGISPTPAGEGKSTVLIGLSDAMRLRGHNSIVAIREPSLGPVMGIKGGAAGGGYSQIVPMEDINLHFTGDFHAITAANNTLAAMIDNHIHQGNTLGIDVRRITWQRCLDVNDRCLRKVVTGLGGKAHGVPTETGFTITAASEIMAILCLALDLTDLEARLARIVVGQTFSSEPVTVGQLNAQGALAALLRDAVNPNLVQTLGGTPALCHGGPFANIAHGCNSLIATKTALSLGDVVLTEAGFGSDLGAEKFFDIKSRVGDLNVAATVVVATVRSLKYNAGVPKDELTTENLEALASGVVNLERHVENIRAFGIEPIVALNKFASDTDAEINQLKAWAETMSVQLIPVEVWAHGGQGALELADAVAVSMQNQTSHHLYDPELGIEASLLTIAQKIYGAADVELSKQARQDLAYLQENGWDRLPVCISKTQYSFSDDPSQLGRPEGHTLHVRNLLPRIGAGFIVALTGDVMTMPGLPKKPAAENIGVENGEIKGLF

SEQ ID NO: 16198 - DNA, 1683 bp, Listeria monocytogenes str
  CDS (1)..(1683)
atgtcaaataaagtgaaatcagatattgaaattgcatcaaaagcagaaattctaccagttacgactattgcggaacatttaggactagacgcagatgcactcgaactttacggaaagtataaagcaaagttatcctatgataccattcactcgctaaaagataaagaaccaggaaaacttgttcttgttacggcgattaacccaacgcctgctggtgaagggaaatcgacagtgacagttggtcttggcgacgcactctctaaaaaagataagaaaaccgttattgcacttcgcgaaccatcgctcggacctaccatgggtattaagggcggggcaacaggtggcggatacgcgcaggttattccaatggaagatattaatttacattttactggtgattttcacgcgattacagcagcaaacaatgctttatcggcatttattgataaccatatgcaacaagggaatgacctagatattgacggtagaagaatcgtttggaaacgtgtagttgatttgaacgaccgtgcacttcgaaaagtggttgttggtcttggaggtcctattcaaggggttccacgtgaagacggttttgatattacggttgcttctgaaattatggcgatcatttgtttagcaagtgatttaaaagatttaaagaaacgtttaagtgaaatcgtgatcggttataactataaaaaagaaccaattacagttggcgaaatgggctacgaaggcgctctaaccttactattaaaagatgctttaaaacctaatttggtgcaaacattagaacatacacctgccatcgtacacggtggaccttttgctaatattgctcacggatgtaatagtgtttctgcgacaagcacagcacttcgactaggtgagtatgtagtgacagaggctggatttggtgcagaccttggtgccgagaaatttttagatattaaagttcctgcccttggaaaagcgccagattgcgttgttattgtagcaacgattcgcgcactgaaaatgcacggtggcgctttgaaaaccgagcttagcgaagaaaatgtggatgcgctagctaaaggttttactaatttacaaaaacatacggaatctattcaaacatttggtattccttatgttgtagccattaataaattcattaccgattctgacgcagaagtagcgaaattagaagcactttgcgaagaacacggcattcctttctctctgacagaagtttgggaaaaaggcggcgacggtggccttgaactcgcggataaagtcattgcggctgttgaaagtggcgaagcggactacaaacgcatttatgatgatgcgtggtcgatagaagaaaaactagaagcgattgtgacgaaggtttacggtggtattggtgtggaactttccagcaaggcgcagaaacaaatcgttgaattcaaaaaatatggttgggaccgctatccgatttgtatggcgaaaacccaatattccttatcggatgacccaacattacttggacgcccaactgattttgttattcacattcgcgaattcattccaaaacttggtgctggttttgtcgttgctttaacaggcgatgtaatgacgatgccaggtttaccgaaaaaaccagcggcacttaatatggatgtcgatgaaaatgggaatgcacaaggtttattttaa

SEQ ID NO: 16199 - protein, 560 aa, Listeria monocytogenes str
MSNKVKSDIEIASKAEILPVTTIAEHLGLDADALELYGKYKAKLSYDTIHSLKDKEPGKLVLVTAINPTPAGEGKSTVTVGLGDALSKKDKKTVIALREPSLGPTMGIKGGATGGGYAQVIPMEDINLHFTGDFHAITAANNALSAFIDNHMQQGNDLDIDGRRIVWKRVVDLNDRALRKVVVGLGGPIQGVPREDGFDITVASEIMAIICLASDLKDLKKRLSEIVIGYNYKKEPITVGEMGYEGALTLLLKDALKPNLVQTLEHTPAIVHGGPFANIAHGCNSVSATSTALRLGEYVVTEAGFGADLGAEKFLDIKVPALGKAPDCVVIVATIRALKMHGGALKTELSEENVDALAKGFTNLQKHTESIQTFGIPYVVAINKFITDSDAEVAKLEALCEEHGIPFSLTEVWEKGGDGGLELADKVIAAVESGEADYKRIYDDAWSIEEKLEAIVTKVYGGIGVELSSKAQKQIVEFKKYGWDRYPICMAKTQYSLSDDPTLLGRPTDFVIHIREFIPKLGAGFVVALTGDVMTMPGLPKKPAALNMDVDENGNAQGLF

SEQ ID NO: 16200 - DNA, 1632 bp, Thermus thermophilus
  CDS (1)..(1632)
atgatcgtcaaggaagatctcctacccatagaggaagtggccgccaagctcggcctggaccgggaccggctttacctctacggcccccacatggccaaggtcctgggggagcccccgaaggccaagggcaagctggtcctcgtcacggccatcacccccacgccggcgggggaaggcaaaaccaccacggccatcggcctcgtggacgccctctggcgcctggggaagcgggcggccttggccctgagggagccctctttggggcccgtcttcggggtcaagggcggggccacggggggcgggaaggcccgcgtggagccccggcacgagatcaacctccacttcaccggggacttccacgcggtcaccagcgccgtgaacctcctgaacgcccttctggacaaccaccttcaccaagggaacgagctcggcatagaccccaggcgcatagagctcaagcgggccatagacatgaacgaccgcgccctcaggcacatcgtcttgggccttgggggcaaggcccacggggtgccccgggaaggggggtttgagctcaccgtggccagcgaggtcatggccctcatgagcctggcccgggacttccaggacctgaagcggcgcctcggccggatgcgggtggccttcacccacgagggcaagcccgtctacgctgaggaccttatggcggtgggggccatggccgccctcctccggcaggccttcctccccaacctggtgcagaccgccgagggcaaccccgccttcattcacatggggcccttcggcaacatcgcccacgggacgaactccctgagggcgagcctcttcgccttgggccttgcggacctcgtggtgcaggaggcgggtttcgccacggacctcggcctggagaagttcatgaacgtggtggcccgcaccacgggcctcgtccccgaggcggtggtcctggtggccaccataagggccctccgctaccacggagggcaggacgcctacgggatgccggacccgaaggcggtgaaggcgggcctcgccaacctggaaaagcacgtggagaacgtggagcttttcggctacaagcccgtgatcgccctaaaccgcttcccgagcgacgccccggaggagatcgccctggtgcgggccttcgccgaggaacggggcctccccttcgccccgagcgaggtctacgcccaggggggcgaggggggcctggagctcgccgagcgggtcctggaggccctggacctgccccacgcctaccggcccctctaccccctcgaggcctccctggaggcgaaggtggaggccatcgccacccgggtctacggggcggaaggggtggagtggagcgaggaggccaagagggccctcaaggccgccaagaaggaggggtgcgaggccctgcccgtggtcgtggccaaggccgccacctccctctccgacaaccccaggctccggggcaggccccggggcttcaccgtgcgggtcacggacctccgctgccgcctgggggcggggtttgtggtggtctacatgggagggatagagacccttcccggcctccccaagaccccccaggccttcgggattgacgtggacgaggagggaaacatccgggggatggactactga

SEQ ID NO: 16201 - protein, 543 aa, Thermus thermophilus
MIVKEDLLPIEEVAAKLGLDRDRLYLYGPHMAKVLGEPPKAKGKLVLVTAITPTPAGEGKTTTAIGLVDALWRLGKRAALALREPSLGPVFGVKGGATGGGKARVEPRHEINLHFTGDFHAVTSAVNLLNALLDNHLHQGNELGIDPRRIELKRAIDMNDRALRHIVLGLGGKAHGVPREGGFELTVASEVMALMSLARDFQDLKRRLGRMRVAFTHEGKPVYAEDLMAVGAMAALLRQAFLPNLVQTAEGNPAFIHMGPFGNIAHGTNSLRASLFALGLADLVVQEAGFATDLGLEKFMNVVARTTGLVPEAVVLVATIRALRYHGGQDAYGMPDPKAVKAGLANLEKHVENVELFGYKPVIALNRFPSDAPEEIALVRAFAEERGLPFAPSEVYAQGGEGGLELAERVLEALDLPHAYRPLYPLEASLEAKVEAIATRVYGAEGVEWSEEAKRALKAAKKEGCEALPVVVAKAATSLSDNPRLRGRPRGFTVRVTDLRCRLGAGFVVVYMGGIETLPGLPKTPQAFGIDVDEEGNIRGMDY

SEQ ID NO: 16202 - DNA, 1689 bp, Bacillus cereus
  CDS (1)..(1689)
atgacaactactacaacagttaaatccgatattgaaatcgcacaagaagcgagtatgaaaaagattcaagaaattgcagctgatttaaatattttagaagatgaattagagccatacgggcattataaaggtaagttatctcttgatatttttaagcgcttacaaaatgagaaagacggtaaagttgttttagtaacagcgattaacccaactccagctggagaaggtaaatcaacagtaacagttggtttaggtcaagcttttaataaaattggtaagaaaacagtaattgcacttcgcgaaccatctcttggaccaacgatggggctaaaaggcggagcagcaggtggtggtttttcacaggttgtaccaatggaagacattaaccttcactttactggagatatccatgcgatcacaactgctaataacgcgttagccgcgtttattgataatcatatccaacaaggaaatacacttggaattgatacgcgtaaaatcgtttggaaacgttgtgttgacttaaatgatcgtgcccttcgtaacgtagtaattggtcttggtggaccggttcaaggtgtaccacgtgaagacggttttgatattacagtagcatctgaaattatggccgtattctgccttgcaacagatattcaagatttaaaagcacgtctatcacgcatcgtagttgcttataattttgcaaatcaacctgtaacggttaaagatttaggtgtagaaggtgcgttaacattattattaaaagatgcattaaagccaaacttagtgcaaacgttagaaaatacaccagctatcattcacggcggaccatttgcgaatatcgctcatggttgtaacagtgttatcgctacaacaatggcagcaaaattaggtgattatgttattacagaagctggatttggtgcagatttaggtgctgagaagtttttagatattaaagctcgtgcagctggcattaaaccagaagcagttgttattgttgcgacgattcgtgcgcttaaaatgcatggtggcgtagcaaaagatcaattaaaagaagaaaatgtagatgcattagcaaaaggtatggagaacttacagaagcacgttgaaacaattcaaagcttcggtgtgcctttcgtaattgcaattaataaattcattacagatacagatgcagaagttgcatacttacaagaatggtgtaatgagcgtggctatgcggtatccttaacagaagtttgggagaaaggtggccaaggcggagttgaccttgctgaaaaagtgttaaaagagattgaaaaaggtgaaaacaactacgcaccactttatgaattagaattaccattagaagagaaaattcgtacaattgctcaaaaagtgtacggcgcaaaagacattgaatttgctccgaaagcacgtaagcaattagctcaatatgaaggcgaaggttggagtaacctaccaatttgtatggcgaaaacacaatactctctttctgacgatgcaacgaaattaggtcgtccatctgactttatcgttacaattcgtgagttaaaaccatctattggtgcaggctttatcgttgcgttaacaggaacaatgttaacaatgccaggccttccaaaacaaccagcagcactacaaatggatgtaaatgaagatggaaaagcagtaggtttattctaa

SEQ ID NO: 16203 - protein, 562 aa, Bacillus cereus
MTTTTTVKSDIEIAQEASMKKIQEIAADLNILEDELEPYGHYKGKLSLDIFKRLQNEKDGKVVLVTAINPTPAGEGKSTVTVGLGQAFNKIGKKTVIALREPSLGPTMGLKGGAAGGGFSQVVPMEDINLHFTGDIHAITTANNALAAFIDNHIQQGNTLGIDTRKIVWKRCVDLNDRALRNVVIGLGGPVQGVPREDGFDITVASEIMAVFCLATDIQDLKARLSRIVVAYNFANQPVTVKDLGVEGALTLLLKDALKPNLVQTLENTPAIIHGGPFANIAHGCNSVIATTMAAKLGDYVITEAGFGADLGAEKFLDIKARAAGIKPEAVVIVATIRALKMHGGVAKDQLKEENVDALAKGMENLQKHVETIQSFGVPFVIAINKFITDTDAEVAYLQEWCNERGYAVSLTEVWEKGGQGGVDLAEKVLKEIEKGENNYAPLYELELPLEEKIRTIAQKVYGAKDIEFAPKARKQLAQYEGEGWSNLPICMAKTQYSLSDDATKLGRPSDFIVTIRELKPSIGAGFIVALTGTMLTMPGLPKQPAALQMDVNEDGKAVGLF

SEQ ID NO: 16204 - DNA, 879 bp, Wolbachia pipientis wMel
  CDS (1)..(879)
atgacaattattattgatggtaaaaaaatagcaaacgacctatgtgagaggctatcacaaaaaattgatattttaaagagagagtataacatttttccttgcctgaaagtaattctcataggtagcaatccagcaagtcaggtttatgttcgcaacaaacagaaaaaagcagaatcaataggcataagttctgagaccattgttttgcctaataatattttagaagatgaattaattgaaaaaatcaatgaattaaatgaagatccatctgtgcatggcattttagtgcaattgcctttaccaaatcatattagtgcaagcagagtaattaacacagtaagtgttgaaaaagatgtagatggctttcatgatgaaaacgttggcaaattagttaaaggtgaaaaaaactgccttataccttgcactcctaaaggttctttgcatttaattaagtcaattgaagagaacctttccggtaaaaacgcagtggtaattggtaggtcaaatatcgtgggcaagccaatgttttacctgctattgcaagaaaactgcactgtcaccatcttgcattcacaaagcaaggatttagctgaatattgctctaaagcggatatagtagttgcagcagtcggaaagccaaattttgttcaagcagactggataaagaaaggtgcaatagtgatcgatgttggcataaatagcgttaacgtaggaaagcttgtaggtgatgttgactttgaaggaataaaagggaaagccaaagctatgaccccagtacccgggggcgttggcccaatgaccattgcatttctaatgatgaacactgttattgctgcttgcttgcaaaagggagttgatgcttctgatttcattagttga

SEQ ID NO: 16205 - protein, 292 aa, Wolbachia pipientis wMel
MTIIIDGKKIANDLCERLSQKIDILKREYNIFPCLKVILIGSNPASQVYVRNKQKKAESIGISSETIVLPNNILEDELIEKINELNEDPSVHGILVQLPLPNHISASRVINTVSVEKDVDGFHDENVGKLVKGEKNCLIPCTPKGSLHLIKSIEENLSGKNAVVIGRSNIVGKPMFYLLLQENCTVTILHSQSKDLAEYCSKADIVVAAVGKPNFVQADWIKKGAIVIDVGINSVNVGKLVGDVDFEGIKGKAKAMTPVPGGVGPMTIAFLMMNTVIAACLQKGVDASDFIS

SEQ ID NO: 16206 - DNA, 1665 bp, Treponema denticola
  CDS (1)..(1665)
atgaaaactgatatagaaatagctagagaagcgaagctaaaaaaaatcgctgaaattgcagacggtttagggattcatgacgataatgtcattccctatggaaagtatatagccaaggttccctatagcgttatagatgatgcaaaggtaaaaaagaataatttaattcttgttactgctatcacgcctacaaaggccggaatcggaaaaacgaccgtttctatcggccttgccttgggcttaaacaagatcggaaagaaggctgttgcagccttgagggagccctctttgggtccttgtttcggtatgaagggcggggcagcaggaggaggctatgcccaagttttgcctatggaagacattaacctccactttacgggagacttccatgcaataacctcggctcataacatgataagcgccctttttgataactacattttcagagctcaaggaactccgaaggctataaaaaccgtactttggaaaagagttttggatgttaacgacagaaacttacgccaagttgttaccggcttaggagagggtaacggcgtagtaatggaatcgggctttgatattacgcctgcttccgaaattatggctattttctgccttgcaaaagacattgaagatttacgccgaagaatcgaaaatatcatattgggttatgataccgaaaacaatgccgtaaaggtaaaagatttaggtattgcgggttcaatagtagttcttttaaagaatgccatcaaccccaaccttgtacaaacaacggaaaatactcctgcctttatccatggcggtccctttgcaaacattgctcacggatgtaactcggtaatagcgacaaaaacagcccttacctacggagaatatgtaattaccgaagcaggctttgccgcagacctcggtgcggaaaaattcttcgatattaaatgtcgaaaagcaggtttaaacccgaaattgacaataattgcggccactacaggcgggttaaaaatgcacggagacgttcccgaaaaggaaatatccaagcccaatgcagaagccctcaaaaaaggcttggccaaccttgacaagcacattgaaaacatgaaaaaattcggacagactgtagttgtagcccttaacagatacggctatgatattgactccgaattggaactggttagaaaacactgtgaagcacaaggtgtaggctttgccgtaaacaatgcctttgttgaaggcggaaaaggtgccgttgaacttgccgagctcgttgtaaagaccatcgaaacaaatccgtcaaagccattaaaatttgtttacgaagataaagactccataaaaacaaagataggaaaaatctgtaaagaaatctatggggctgctgatgttacatattcgggagctgccgacaagatgatcaaaaagattgaagaagccggaatggcagacttccctgtttgtgtcgctaaaacacagtattcgttctcatcggatcctaaactttacggagttcctacaggttttgaaatgaatgtcagggatatagttttaaactcgggttccgaaatgattgtagccattatgggcgacatgatgagaatgccgggccttccgaaagatccgcaggccgtcagaattgaccttgtaaacggaaatgttgaaggcttgtcataa

SEQ ID NO: 16207 - protein, 554 aa, Treponema denticola
MKTDIEIAREAKLKKIAEIADGLGIHDDNVIPYGKYIAKVPYSVIDDAKVKKNNLILVTAITPTKAGIGKTTVSIGLALGLNKIGKKAVAALREPSLGPCFGMKGGAAGGGYAQVLPMEDINLHFTGDFHAITSAHNMISALFDNYIFRAQGTPKAIKTVLWKRVLDVNDRNLRQVVTGLGEGNGVVMESGFDITPASEIMAIFCLAKDIEDLRRRIENIILGYDTENNAVKVKDLGIAGSIVVLLKNAINPNLVQTTENTPAFIHGGPFANIAHGCNSVIATKTALTYGEYVITEAGFAADLGAEKFFDIKCRKAGLNPKLTIIAATTGGLKMHGDVPEKEISKPNAEALKKGLANLDKHIENMKKFGQTVVVALNRYGYDIDSELELVRKHCEAQGVGFAVNNAFVEGGKGAVELAELVVKTIETNPSKPLKFVYEDKDSIKTKIGKICKEIYGAADVTYSGAADKMIKKIEEAGMADFPVCVAKTQYSFSSDPKLYGVPTGFEMNVRDIVLNSGSEMIVAIMGDMMRMPGLPKDPQAVRIDLVNGNVEGLS

SEQ ID NO: 16208 - DNA, 882 bp, Treponema denticola
  CDS (1)..(882)
atgagtgcaaaaattattgacggtgcccggatagcggcagacctacgggccgatattgcaaaagacgttgaaaaaataaaggcaaagggagtccaacccaccttggccgttattttggtaggaaatgaccctgcgtcccaatcttacgtaaagggaaagacaaatgctcttcatgaagtaggaatgaatgacaggacattcaggcttccggagactactacgcaggatgaattactaaaacttataaaagagctgaatgccgataaacttataaacggtattttagtgcagttacctttacccaaacaaatcgatcccgatgccgtaattgaagctataaatcccgaaaaagacgtagacggtttccatcctgtaaatgtcggaaaacttcttttgggacacgatacctttattccttgtaccccccatggtgtaattcatcttttaaagagaaccggagttgaaacaaaaggtgcaaaggttgtaattgtaggacgctccaatatcgttgggaaacctctttccgttttgatgatgaataaggatgtaaacgcaacggtaaccgtctgccacagcggtacaaagaatttaaccgaagtaacaaaagaagctgatatactggttgcagctatgggaaagccccggtttatcaaagccgatatgattaaaaaaggcgccgtcgtcatagatgtaggtgtaaaccggattgatgacagtaccaaaaaaagcggctttaggcttgtaggcgatgtagactttgagcctgcctgtgaaattgcttctgcaataacgcctgttccgaaaggggtaggcccaatgaccatagctatgctcgttgccaataccctcatcgcagcaaaaaggcaaaacggtttggaataa

SEQ ID NO: 16209 - protein, 293 aa, Treponema denticola
MSAKIIDGARIAADLRADIAKDVEKIKAKGVQPTLAVILVGNDPASQSYVKGKTNALHEVGMNDRTFRLPETTTQDELLKLIKELNADKLINGILVQLPLPKQIDPDAVIEAINPEKDVDGFHPVNVGKLLLGHDTFIPCTPHGVIHLLKRTGVETKGAKVVIVGRSNIVGKPLSVLMMNKDVNATVTVCHSGTKNLTEVTKEADILVAAMGKPRFIKADMIKKGAVVIDVGVNRIDDSTKKSGFRLVGDVDFEPACEIASAITPVPKGVGPMTIAMLVANTLIAAKRQNGLE

SEQ ID NO: 16210 - DNA, 858 bp, Geobacter sulfurreducens
  CDS (1)..(858)
atggccacaatcatcgacggaaaagccattgccgaaaagatccgggcggacctcgccgcccaggtgaaagaactgcagtccaggggaataacccccggcctcgccacggtcctggtggggagcgacccagccagcgaagtctacgtccggatgaagggcgatgcctgcaataagctcggcatgcactcggtgaagatcacgcgccccgcggaaacgaccgaggaggagctcctcgcgctcatcaacgaactcaataacgatccggcgatccacggcatcctcgtgcagctcccccttccgccgcagatcaacgcggatcgtgtcctggaagccatctcacccgccaaggacgtggacggcttccatccttacaatgtgggacgcctggtgaccggcaagccgaccttccagccctgcaccccctacggcgtaatggtgatgctgcaagaagcgggagtcgacttggccggcaaggaagtggtggtagtgggacgctcaaacatcgtgggcaagccagtggcactgatgtgccttcagcgcaacgccaccgtcaccatctgtcactcgaagacccgcgacctccccggccgggtcagggccgccgacgtggtcatcgccgcagtcggggtccccgagatgatcaaaggggactggattaaggaaggagcggttgtcatcgacgtgggcgtcaaccgggtgggagaaaagaaacttgtgggagacgtggagttcgccgcagcagccgaacgggcttcggccatcacgccggtccccggcggggtgggccccatgaccatcaccatgcttcttcacaacacccttgaggccgcaaaaatggcgggttccgggaatcgctag

SEQ ID NO: 16211 - protein, 285 aa, Geobacter sulfurreducens
MATIIDGKAIAEKIRADLAAQVKELQSRGITPGLATVLVGSDPASEVYVRMKGDACNKLGMHSVKITRPAETTEEELLALINELNNDPAIHGILVQLPLPPQINADRVLEAISPAKDVDGFHPYNVGRLVTGKPTFQPCTPYGVMVMLQEAGVDLAGKEVVVVGRSNIVGKPVALMCLQRNATVTICHSKTRDLPGRVRAADVVIAAVGVPEMIKGDWIKEGAVVIDVGVNRVGEKKLVGDVEFAAAAERASAITPVPGGVGPMTITMLLHNTLEAAKMAGSGNR

SEQ ID NO: 16212 - DNA, 1674 bp, Lactobacillus johnsonii
  CDS (1)..(1674)
atgaagtcagatattgaaatcgcacaagacactaaagaattacctattacagaaattgcaaaaaaagttgatcttcaaccagatgaaattgaactttatggtaatgataaggctaagattagctggaagggaattaacagaattaaacaaggtaaaaagcttggtaagctaattcttgttacttcaattagtcctacgccagctggtgaaggaaaatctactattaccattggtttaggggatgcaatcagcaaccaacttcacaaaaatactttaattgcattaagagaaccctcaatgggtcctgtttttggattaaaaggtggtgcaactggtggtggatatgcacagatcatcacaatggaagatattaatttacactttactggtgatatgcacgcattaactagtgcaattgatactttggctgctttagttgataactatatttatcaagataatagtctagagctagatcctaatcgtatcttattaaaacgtggaattgacgttaatgatcgtactttaagaaaaatcactatcggacaaggttcacgttttaatggaatagaacatgaagctagctttgcaattactgtagctaatgaattaatggctattttatgtttagcaactgatattgatgacttgaaaaagcgcattggaaatatgctagttggcttttctgtgaaagatgaacctgtttatgttaaagacttagggtttgagggggcaattgctgcgcttttatcaaccgcattaaagcctaacttagttcaaacacttgaacataccccagcaattgttcacggcggtccatttgctaacattgctcatggtgctaattcagtaattgctactaatactgctttacacttaagcgactatgttttgactgaagctggttttggggcagatctgggtggccaaaagtttatggactttgtttctaaccatttggacaaacgtcctgatgctgtggtagttgttgcaaccgtaagagcgttgaagtatcaagcagaagagacaactgatcacttagatgaagaaaatattccagctttagaaaaaggttttgagaacttaaagcgccatatggaaaacatggctcattatggtgtacctgtaattgtactaataaataaatttgctagtgatactgaacaagaactatcaaaattgaaagaacttgttaaagctgatggttttgaatgtgaagtggtctcttaccatgatgaaggatcaaagggcggaattaaggcggcagaaaaagtggttgagttaactaataaagctagtgactttacctcagtatatgaacctactgactctgtagaagaaaaaattagtaaaatcgctcataatatttatcatgccaaggatattgaatattctgataaagctaaggaccaattagcagaaattaagaaaatgggtaaagacaacttaccagtaattatggctaaaacacagtatagctttactgataaaaagagtatcttaggagctccaaaagattttacactccatgttaagaatttagctcttaaaaatggagcaggttttattgtggtagctacgggatctattttagatatgccaggattgccaaaatatccagctgccttagatattgatgtagataataacggaaagatttcaggattattctaa

SEQ ID NO: 16213 - protein, 557 aa, Lactobacillus johnsonii
MKSDIEIAQDTKELPITEIAKKVDLQPDEIELYGNDKAKISWKGINRIKQGKKLGKLILVTSISPTPAGEGKSTITIGLGDAISNQLHKNTLIALREPSMGPVFGLKGGATGGGYAQIITMEDINLHFTGDMHALTSAIDTLAALVDNYIYQDNSLELDPNRILLKRGIDVNDRTLRKITIGQGSRFNGIEHEASFAITVANELMAILCLATDIDDLKKRIGNMLVGFSVKDEPVYVKDLGFEGAIAALLSTALKPNLVQTLEHTPAIVHGGPFANIAHGANSVIATNTALHLSDYVLTEAGFGADLGGQKFMDFVSNHLDKRPDAVVVVATVRALKYQAEETTDHLDEENIPALEKGFENLKRHMENMAHYGVPVIVLINKFASDTEQELSKLKELVKADGFECEVVSYHDEGSKGGIKAAEKVVELTNKASDFTSVYEPTDSVEEKISKIAHNIYHAKDIEYSDKAKDQLAEIKKMGKDNLPVIMAKTQYSFTDKKSILGAPKDFTLHVKNLALKNGAGFIVVATGSILDMPGLPKYPAALDIDVDNNGKISGLF

SEQ ID NO: 16214 - DNA, 2898 bp, Ashbya gossypii
  CDS (1)..(2898)
atgcttcgcacctttacggagtggagtattctaaggagtaatactcagctcggggctttcagctgcccagtacgaagacattaccatttaatttctggtaaaagcatcgcgaaaaccattagagacaatgctctgagagaggtgaaagagattaggcagcaagttccagattttaatccaaaactgaagatcttgcaggttggctcccgccctgattcatctgcatatgtccggatgaagttgaaagcatccaccgagtctggtgtagaatgtgacgttgaaaagcttccagaagatattacgcaactcgaactactcagaaagatcgagaaaatcaactctgacgccgaagtgcatgggattctgattcagctgccactgccaaagcatctagatgaagtgacagttaccaatgctgtggaccatgaaaaggacgttgatgggttccatcgctataatgttggtgagctcgctaaacgtggcgggaaaccatacttcctgccatgtacacctaatgcgtgtatacagcttttgaaagagtgcggtgttgagataagagggaaacaggcagtcgtaattggccgctctgacatcgtggggaccccagttgcaacgatgctcaaaaatcttgatgccacggtgactgttgcgcacagacatacgacaaatcttccacaagtcctctccactgcggatattgtagttgctgcgtgtggcgtgcctaactacataaagggcgaatggttaaaagatggcgccgtggttattgacgttggcatcaattatgttcaggattccaccaaaaaatcaggccaaagattagtcggtgatgtggacttcgaatcggcaaaggagaaggcttctcacatcacgcctgtacctggcggcgtgggtcctatgaccgtggccatgctggtgcaaaatgtcttgactgcagcaaaaagatcgttgcagaaggacgcagaggtgccagtgatcacaccactgcctgtgaattttgagatgcctgtgccatcggatatcgatatatcaaggaaacagaatccgaaacatatttctcaggtggcagccgagttgggtattagggatcacgagctggagttgtttgggcattataaagccaagatttctccaaaactcctccaaagattgcatgctaaccaaaatgcaaactatgtcttagttgctgggattacaccgacccctctaggagagggaaagtcgaccaccactatggggctagtccaagcgctttccgctcacctaggcaaacgggctattgcaaacgttcgtcaaccttcaatgggacccacgtttggagtcaagggaggcgcggcaggcgggggttacgcccaggtcattccaatggatgagttcaacttgcatttgacaggcgacatccacgccatttcagccgccaacaatctgctagccgcagccatagatacaaggatgtttcacgaacacacgcaaaagaacgatgctactttttataacagattggtgcccaagaagggcggctcgcggaagttcacgaaatcaatgctgaagaggctccagaagctgggaattaacaaaacagacccagacagtttgtctccaaaagaaatcaaacgatttgcacgcctaaacatagacacggataccatcactatcaaacgggtggttgatgtcaacgatagacttctacggcagattacgatcggccaagctcatactgagaagggttttaccagaaccaccgggtttgatatcactgttgcatctgaattgatggccattttggcactttctaaggacttcgctgatatgagagaacgtgtaggtcgcatggttgtcgctgcgaatctagacggcgagccgattacagcagaagatgtaggctgtgctggagctgttgctgcccttctgaaggacgctatcaagccaacactaatgcagtctttggaaggcacccctgttttagtccatgcagggccgttcgccaacatctctatcggagcctcctcagtaattgctgacagaattgccctgaagttggtgggcacttctccacattctccggaaggcaccgacgccggctatgtggttaccgaggccggattcgactttacaatgggcggagaacgattcctgaacataaagtgccgctcctcaggcttgaagccaaatactatcgtcatcgtggccactgtccgtgccctgaagctgcacggcggtggccctgaggtaaagccgggccagccacttactccccactatactgaggaaaacctcgagctagtcacaagaggtgcggccaacctgcagaagcaaataagaaatgccaagcttttcggggtccctgtcgtagtcgctgtgaacaggtttgagtcagacactgacgcagaaattgagattattcagaaggcggcgaaggaggctggtgcacatgacgccatcgctgcaaatcactgggccgaaggcggaaaaggagcagtcacgctggccgaagccgtcatcaactcatgcaaacaacccagttcttttaagttcctttatgacgtcgatcaacctgtgacagaaaagctctccaccattgttcggaaaatgtatggcggttccgcgatagatctctctcctacggcgcaaaagaagattgccttgtacacggcccaaggttttgataaactacctatctgtatcgcgaaaactcagtactccctgtcccatgatgccactttgaagaacgtcccctccgattttgtgttccccataagggatatcagggcttccattggagcgggctacctgtacgcgctagcggcagagattcaaactatccccggtctctccactaacgcaggctacatgaatgttgaagtcagtgatgacggcgagattgaaggtcttttctag

SEQ ID NO: 16215 - protein, 965 aa, Ashbya gossypii
MLRTFTEWSILRSNTQLGAFSCPVRRHYHLISGKSIAKTIRDNALREVKEIRQQVPDFNPKLKILQVGSRPDSSAYVRMKLKASTESGVECDVEKLPEDITQLELLRKIEKINSDAEVHGILIQLPLPKHLDEVTVTNAVDHEKDVDGFHRYNVGELAKRGGKPYFLPCTPNACIQLLKECGVEIRGKQAVVIGRSDIVGTPVATMLKNLDATVTVAHRHTTNLPQVLSTADIVVAACGVPNYIKGEWLKDGAVVIDVGINYVQDSTKKSGQRLVGDVDFESAKEKASHITPVPGGVGPMTVAMLVQNVLTAAKRSLQKDAEVPVITPLPVNFEMPVPSDIDISRKQNPKHISQVAAELGIRDHELELFGHYKAKISPKLLQRLHANQNANYVLVAGITPTPLGEGKSTTTMGLVQALSAHLGKRAIANVRQPSMGPTFGVKGGAAGGGYAQVIPMDEFNLHLTGDIHAISAANNLLAAAIDTRMFHEHTQKNDATFYNRLVPKKGGSRKFTKSMLKRLQKLGINKTDPDSLSPKEIKRFARLNIDTDTITIKRVVDVNDRLLRQITIGQAHTEKGFTRTTGFDITVASELMAILALSKDFADMRERVGRMVVAANLDGEPITAEDVGCAGAVAALLKDAIKPTLMQSLEGTPVLVHAGPFANISIGASSVIADRIALKLVGTSPHSPEGTDAGYVVTEAGFDFTMGGERFLNIKCRSSGLKPNTIVIVATVRALKLHGGGPEVKPGQPLTPHYTEENLELVTRGAANLQKQIRNAKLFGVPVVVAVNRFESDTDAEIEIIQKAAKEAGAHDAIAANHWAEGGKGAVTLAEAVINSCKQPSSFKFLYDVDQPVTEKLSTIVRKMYGGSAIDLSPTAQKKIALYTAQGFDKLPICIAKTQYSLSHDATLKNVPSDFVFPIRDIRASIGAGYLYALAAEIQTIPGLSTNAGYMNVEVSDDGEIEGLF

SEQ ID NO: 16216 - DNA, 2820 bp, Ashbya gossypii
  CDS (1)..(2820)
atgacacttattgacggcaaggctattgcggcggagatccggggagagatcgcagaggagatagcacggctctgtgcagacgggctgttccaggccaagctgacgattttccaggtgggcgagcggcacgactcgagcacgtacgtgaggatgaagcggcgagcggcggccgaggcagggatcgaggtggagttcgtgcagctgggcgcggatgtggacgaggaagaggttttggcggcgatcgacgcgcgcaacgcggacgagacggtgcacgggattctggtgcagctgccgctgccgccggggatggacgaagagcgggtgacgtcgcgcgtcgcgccggagaaggatgtggatgggtttgggtcctacaacatcggggagttgaataagcgccacgggcggccacacttccacccatgcacgccgaagggcatcatcgagctgctgcggcgcatggacgtgcagatagcgggtgcaaacgtggtggtcctgggacggtctgacatcgttggtgccccggttgcgtgtctcctgcgggcgctcgacgcgacggtcacggtgctgcactcgcgttcgcgcgacatccctggctacgtggggcgcgcggacatcgtggtggtggcgattgggcagccggagtttgtcaagggcgcttggtttacgaatccggacgccgtggtgatcgacgtggggaccaacttcgtggaggattcgacgcgcaagaccggctaccggtgtgtgggcgacgtcgagttcggtgtggcgtctgaaaaggtacggctcatcacgccggtgcccggaggtgtcgggccaatgacggtggcaatgctgatgcagaatacgctggatgccgcgaagaagtgccactcggccccccgcaagctgtcgcccttgccgctgcaattgcagaagccggttccctctgactacgagatttcgcggtcgcaggtgcccaagaacatcgctgtcgttgccagggaagccggattgcttccgtctgaggtggagctctacggctccgtgaaggccaaggtcaagctagacaccttggatagacttgcacaccgtgagaacggcaaatatgtacttgttacgggtataacgcctacgcctttgggtgaaggcaagtcgaccaccacagtgggcctggtgcaggccctggccgcacatctcgataaggtcgcatttgcaaccgttcggcagccatcgatggggcctactttcggcatcaagggcggtgctgcaggtggcggttactcccaggtcattccgatggatgagtttaatttgcatgtgaccggggatatccacgctatttccatggcgaacaatttgctagcagcggcgattgacacccgtatgtttcacgaggcaacacaaaaggatgctgcgctgtacaagaggctagttcccgagaagaatgggacacggaagtttacgtcaacgatgctccgccgcctgcagaagttagggattcacaagactgatccaaactccctcacggagtctgaaattgctcgttttgcccgcctcgacattgacgcagatacgatcacttggagacgtgtggtggattgtaatgatcgcttcctgcggggaattactgttggggaagccccaacggagcgcggatacaaacgccagaccggatttgacatttctgttgcgtcggagtgtatggccattctggcgctagctgattccctccacgatttaagggagcggttgggcaggatcgtcgtagccgcgtccaggaacggggagcccataacctgcgaggatattggttgtgcaggtgctatggccgccctgctgaaggatgccatcaagccaaacattatgcagacgttagaggggacaccggtctttgtgcatgctggtccgttcgcaaacatctccattggcgcaaactctgttcttgccgacaagatcgcgttgaagcttgctggtgtagaccccaattggtccgaagcggagaagaagaagcgccaaggctatgttgtcacggaggctggctttgatttcaccatgggcggcgaacgcttcttgaatatcaagtgcagggccagcggcatctcgccagatgttgtcgtaattgtggcgacggtgagggccttaaaggtacacggtggcggtcccgaggtgaaggcgggcgcaccattgcctagtgcctacctgaacgaagacgttgacctcctacggaagggctgtgcaaacctcgccaagcatattgccaatgcaagaacatacaacctccccgttgtggtagggatcaaccgcatgtcttcggacactgagcgcgagcacgaggtgatcagagaagaggccatcaaggctggtgcatttgatgcaatcgtctcgaaccactgggaggagggcggccagggggctgtcaagctcgcggaaggtgttatcagagccacggaggaatgcaggcccgagttccactacctgtacgacaccgaggggccgtccatcgaagacaagatctccaccattgccaagaccatgtatggcgctgcagaggtcgagtttctgcccgaggcccgcaagaaaatcgagctgtacaccaagcagggcttcaaccacctgcctatctgcatcgcgaagacacagtactccctctcgcacgacgctaacctcaagggtgtgcccaccggcttcaagttcccagtgcgcgacattcgcgcgtccattggcgccggctacttgtacgcgctagccgcggaaatccagaccatacctggcctccccacccactgtgggttcatgaacatcgaaattaacgacaagggcgagatcgacggaatgttctaa

SEQ ID NO: 16217 - protein, 939 aa, Ashbya gossypii
MTLIDGKAIAAEIRGEIAEEIARLCADGLFQAKLTIFQVGERHDSSTYVRMKRRAAAEAGIEVEFVQLGADVDEEEVLAAIDARNADETVHGILVQLPLPPGMDEERVTSRVAPEKDVDGFGSYNIGELNKRHGRPHFHPCTPKGIIELLRRMDVQIAGANVVVLGRSDIVGAPVACLLRALDATVTVLHSRSRDIPGYVGRADIVVVAIGQPEFVKGAWFTNPDAVVIDVGTNFVEDSTRKTGYRCVGDVEFGVASEKVRLITPVPGGVGPMTVAMLMQNTLDAAKKCHSAPRKLSPLPLQLQKPVPSDYEISRSQVPKNIAVVAREAGLLPSEVELYGSVKAKVKLDTLDRLAHRENGKYVLVTGITPTPLGEGKSTTTVGLVQALAAHLDKVAFATVRQPSMGPTFGIKGGAAGGGYSQVIPMDEFNLHVTGDIHAISMANNLLAAAIDTRMFHEATQKDAALYKRLVPEKNGTRKFTSTMLRRLQKLGIHKTDPNSLTESEIARFARLDIDADTITWRRVVDCNDRFLRGITVGEAPTERGYKRQTGFDISVASECMAILALADSLHDLRERLGRIVVAASRNGEPITCEDIGCAGAMAALLKDAIKPNIMQTLEGTPVFVHAGPFANISIGANSVLADKIALKLAGVDPNWSEAEKKKRQGYVVTEAGFDFTMGGERFLNIKCRASGISPDVVVIVATVRALKVHGGGPEVKAGAPLPSAYLNEDVDLLRKGCANLAKHIANARTYNLPVVVGINRMSSDTEREHEVIREEAIKAGAFDAIVSNHWEEGGQGAVKLAEGVIRATEECRPEFHYLYDTEGPSIEDKISTIAKTMYGAAEVEFLPEARKKIELYTKQGFNHLPICIAKTQYSLSHDANLKGVPTGFKFPVRDIRASIGAGYLYALAAEIQTIPGLPTHCGFMNIEINDKGEIDGMF

SEQ ID NO: 16218 - DNA, 1674 bp, Streptococcus pyogenes SSI
  CDS (1)..(1674)
atggttttatcagatattgaaatagccaactctgtcactatggaacctatcagtaaggttgccaatcaattagggattgacgaggaagcgctctgtctctatggcaagtacaaggcaaaaattgatgcccgtcaactggtcgccttaaaagacaaacctgatggcaaactcattcttgtcactgctatctcaccaacaccagctggtgaaggcaaaaccactacttccgttggattggtagatgctctttctgccattggaaaaaaagcagttattgcccttcgtgaaccttctcttggtcctgtttttggggttaagggaggagctgctggcggtggccacgcgcaagttgtcccaatggaagacatcaaccttcactttacaggggactttcatgccatcggtgtcgccaacaacttattagctgccttgattgataaccacattcaccatggcaatagcctaggcattgattccagacgtattacttggaaacgtgtggtggatatgaatgaccgccagcttcgtcatattgttgacggcttgcaaggcaaggtcaacggggcccctcgtgaggatggttacgacattaccgtcgcctctgaaatcatggcaatcctgtgcctatccgaaaatatttctgacctcaaagcccgccttgaaaaaatcatcatcggttacaactatcgaggcgaacctgtaacagctaaagacttgaaagctggtggtgccctagccgcactgctcaaggatgcgattcatcctaatctcgtgcaaaccctggaacacacaccagccctcattcacggtggcccatttgctaatatcgcccatggctgtaatagtgtcctagccaccaaactagccttgaaatatggtgattatgccgttaccgaagctggatttggtgctgaccttggagctgaaaaattcattgacatcaaatgccgcatgtccggccttcgtccagcagccgttgtcctagtagccactattcgtgcccttaaaatgcatgggggtgtgccaaaagcagacctggctactgaaaatgttcaggccgttgtggatggtttacctaaccttgacaaacatttggctaatatccaagacgtctatggccttccagttgtcgtggcgatcaataaattcccgcttgataccgatgctgaattacaagctgtctatgatgcctgcgacaaacgtggcgttgacgttgtgatttctgatgtttgggcaaatggcggagctggtgcccgtgaattagctgaaaaagtcgtgacactagccgagcaagacaatcaattccgctttgtttatgaggaagacgatagcattgaaaccaaactgactaaaatcgttaccaaagtttacggtggtaaaggcatcaccttgagcccagcagccaaacgtgaactggctgacttagaacgcctcggctttggcaactacccaatttgcatggccaaaacccaatattccttctcagacgatgccaaaaaacttggcgcaccaactgactttacagtgactattagcaaccttaaagtgtccgcaggagcaggatttatcgttgctctgacgggtgctatcatgaccatgcctggccttccaaaagtacctgccagcgaaaccattgatattgacgaggagggcaacatcacaggactattctaa

SEQ ID NO: 16219 - protein, 557 aa, Streptococcus pyogenes SSI
MVLSDIEIANSVTMEPISKVANQLGIDEEALCLYGKYKAKIDARQLVALKDKPDGKLILVTAISPTPAGEGKTTTSVGLVDALSAIGKKAVIALREPSLGPVFGVKGGAAGGGHAQVVPMEDINLHFTGDFHAIGVANNLLAALIDNHIHHGNSLGIDSRRITWKRVVDMNDRQLRHIVDGLQGKVNGAPREDGYDITVASEIMAILCLSENISDLKARLEKIIIGYNYRGEPVTAKDLKAGGALAALLKDAIHPNLVQTLEHTPALIHGGPFANIAHGCNSVLATKLALKYGDYAVTEAGFGADLGAEKFIDIKCRMSGLRPAAVVLVATIRALKMHGGVPKADLATENVQAVVDGLPNLDKHLANIQDVYGLPVVVAINKFPLDTDAELQAVYDACDKRGVDVVISDVWANGGAGARELAEKVVTLAEQDNQFRFVYEEDDSIETKLTKIVTKVYGGKGITLSPAAKRELADLERLGFGNYPICMAKTQYSFSDDAKKLGAPTDFTVTISNLKVSAGAGFIVALTGAIMTMPGLPKVPASETIDIDEEGNITGLF

SEQ ID NO: 16220 - DNA, 1749 bp, Vibrio vulnificus
  CDS (1)..(1749)
atgctttcagatatcgatatttgtcgtacgacacctcttaaaccaattgaacagattgccgcaaaagcaggactgctggcagatgagtttgaaactcacggtttatataaagcgaaagtgtctgcccgatgtgtaaaacgccttgctgagcaacaagatggcaaacttgttttggttacggcaatcacaccaaccccacttggagaaggtaaaaccgtcaccactatcggtctagcacaagggttacagagcctcaatcaatcggtgatggcgtgtatccgtcaaccttctatggggcctgtttttggtgtcaaagggggcgctgcgggtggtggctattcacaggtcgccccgatggatgaacttaatttgcatcttactggcgacattcacgccgttactgcggcgcacaatcttgccgcggccgccattgatgcccgcatctaccacgaacagcgtgctggttatcaagcctttgaagctcgcactgggctccctgcattaagaattgacccagatcgcgtggtttggaaacgcgtaatggaccataacgatcgcgcactgcgtaaagttcgcgttggactcaatgacgaaggcaaaaccatcaatggatttgaacgtgaagaaggctttgatatttcagccgcatctgaactgatggcaattttggcgttgtcgaaaaaccttcaagatatgcgtgaacgtattggtaaagtggttctcgcttacaatctggatggcgagcctgtcagtgcagaacagttacaagtggcaggagcgatgacagtaacgctgaaagaagcgatcaaaccgacactgatgcaaacgcttgaaggtgtacctacccttattcatgcgggtccatttgccaacattgcgcacgggaactcatccatcatcgctgatgagattgccttaaaattgtcgagttacgttgtcaccgaggccggttttggctcagatatggggcttgaaaaagcatgcaacatcaaatcttcaacttcgcacaaagcccccgattgcgtggtgattgttgcgactttgcgcggtttgaaagcaaactcagggctgtatgacctaaaacctggtatgccattaccagacgccttatttcaaccggatcgcgcagcgctggaatccggctttagtaacctaaaatggcatattgataacgcgcaaaaatacggtttaccagcggtcgttgctatcaatcagtttccgcaagacagcgcagaggagctcgggcaactcaagctttggattcagcaactgccactcaatgttcgtgtcgcgatcagtgagggctttgccaaaggtggtaaaggcatggaggcggtagctcgtgaagtgattgaagcatgtgatgcgccagcaaactttcgcccactgtatcgagcagagcaaacgctcgaggagaaaatcatcaccgtttgtactaaaggttacggttgtggtgaggtgcaatttagcgataccgcaaaacagcagttagctctttatcaaacattaggatttggcgagttggccgtgtgtatggcaaaaacccccctttctatctcgtccgattcctctctcaaaggtgcaccaagtggatttaccatcatggtccgtgaagttaggctctgtgctggcgcgggcttcgtttacgcgctcactggcaatgtgatgacgatgccaggtctgccagacatccccgcttttatggcattggatatcgatgaaaatggcgatattgttggcctaagctaa

SEQ ID NO: 16221 - protein, 582 aa, Vibrio vulnificus
MLSDIDICRTTPLKPIEQIAAKAGLLADEFETHGLYKAKVSARCVKRLAEQQDGKLVLVTAITPTPLGEGKTVTTIGLAQGLQSLNQSVMACIRQPSMGPVFGVKGGAAGGGYSQVAPMDELNLHLTGDIHAVTAAHNLAAAAIDARIYHEQRAGYQAFEARTGLPALRIDPDRVVWKRVMDHNDRALRKVRVGLNDEGKTINGFEREEGFDISAASELMAILALSKNLQDMRERIGKVVLAYNLDGEPVSAEQLQVAGAMTVTLKEAIKPTLMQTLEGVPTLIHAGPFANIAHGNSSIIADEIALKLSSYVVTEAGFGSDMGLEKACNIKSSTSHKAPDCVVIVATLRGLKANSGLYDLKPGMPLPDALFQPDRAALESGFSNLKWHIDNAQKYGLPAVVAINQFPQDSAEELGQLKLWIQQLPLNVRVAISEGFAKGGKGMEAVAREVIEACDAPANFRPLYRAEQTLEEKIITVCTKGYGCGEVQFSDTAKQQLALYQTLGFGELAVCMAKTPLSISSDSSLKGAPSGFTIMVREVRLCAGAGFVYALTGNVMTMPGLPDIPAFMALDIDENGDIVGLS

SEQ ID NO: 16222 - DNA, 1668 bp, Porphyromonas gingivalis W83
  CDS (1)..(1668)
atgaaatcggacattcagattgcacgtgacatcgaactgcaaagaatcgaacagatagcagagtcaatcgacttgcctgtcgaacaattagaaccatacggacgatacacggccaaagtgccgctaagctgtatcgacgaagagaaagtaaaaaagggaaatctgattctggtgacagccattacgccgaacaaggccggtgtgggaaaaaccactgtctccatcggattggctctgggactcaaccatatcgggaagaaggcaatcgtagccttgcgcgaaccttcgctcggaccttgcttcggtatgaaagggggggctgccggaggtggctatgcacaggtactgcccatggagaacatcaacctccacttcaccggtgatttccatgctgtcacttcggctcacaacatgattacggctcttttggagaactatatttatcagaaccgcaatacttgcgacggcctctccgaaatactttggaagcgtgtactggacgttaacgaccgctctttgcgcaatgccgttacggggttgggtaccatctcggacggaatacctcgccagaccggttttgacattacgccggcttccgagatcatggctatcctctgtctggccaaagactttgaagacctccgcagccgtcttgaaaatattcttctcggctataccaaagaaggtgctccctttacggtcaaagacctcggcatagcaggatccattgccgtcttgctcaaagatgccataaagcctaatctggtacagaccacagagcacactccggcatttgtacatggaggcccctttgccaatatcgcacatggctgtaactccatcttggccacaaagatggctctctctttcggcgaatatgccgtcaccgaggccggtttcggtgcagatctgggtgcagaaaaattccttgacatcaaatgtcgggaaatgggtgtcgcacccaagcttaccgtcctcgtggccacgctgcgcgcgctcaaattgcatggcggcgttgccgaaacggaaatcaaggcacccaatgccgaagctctcagaagaggtttgtccaatctggatcgccacatatacaatctgaaaaaattcggtcagcaagtaatcgttgcattcaaccgcttcgacaccgacgaagaagaagagatcagcatcgttcgtgagcattgtatcgggcaaaatgtcggcttcgctgtgaacaacgcctttgcagaaggcggaaaaggtgcggaagaactggcaaaacttgttgtggaaatggtagagaataaaccctcccagcctctgaaatatgcctatgagccggagaatcccgtgaaaatgaagatcgagaagatcgccaaggaaatatacagcgcagggagtgtagtgtatagctccaaagcagacggcaagctcaaaaagattgccatgcaatcgctggatcatctccccgtttgtattgccaagacgcagtactctttctcatccgaccccaaagccaagggagatgtcagagggtttgagctcaaagtatccgacatcatcatcaaccgtggagcaggcatgctggtcgttatcatcggagagatcatgcgtatgcccggactccccaaagaaccgcaagctgtacatatagatatagtagacggtttcatcgaaggccttagctga

SEQ ID NO: 16223 - protein, 555 aa, Porphyromonas gingivalis W83
MKSDIQIARDIELQRIEQIAESIDLPVEQLEPYGRYTAKVPLSCIDEEKVKKGNLILVTAITPNKAGVGKTTVSIGLALGLNHIGKKAIVALREPSLGPCFGMKGGAAGGGYAQVLPMENINLHFTGDFHAVTSAHNMITALLENYIYQNRNTCDGLSEILWKRVLDVNDRSLRNAVTGLGTISDGIPRQTGFDITPASEIMAILCLAKDFEDLRSRLENILLGYTKEGAPFTVKDLGIAGSIAVLLKDAIKPNLVQTTEHTPAFVHGGPFANIAHGCNSILATKMALSFGEYAVTEAGFGADLGAEKFLDIKCREMGVAPKLTVLVATLRALKLHGGVAETEIKAPNAEALRRGLSNLDRHIYNLKKFGQQVIVAFNRFDTDEEEEISIVREHCIGQNVGFAVNNAFAEGGKGAEELAKLVVEMVENKPSQPLKYAYEPENPVKMKIEKIAKEIYSAGSVVYSSKADGKLKKIAMQSLDHLPVCIAKTQYSFSSDPKAKGDVRGFELKVSDIIINRGAGMLVVIIGEIMRMPGLPKEPQAVHIDIVDGFIEGLS

SEQ ID NO: 16224 - DNA, 2826 bp, Neurospora crassa
  CDS (1)..(2826)
atggcctccaagatcgacggcaccgcgctggccaagcgcatccgcgacggtctccgcgctaccatcgacgagaccaagaagaccaacccgcgcttccgcccctgcctcaagatcatccaagttggtgatcgatccgattcctctacctatgtgcgcatgaagttgaaggctgctgaggagtgcggtatcgaggccgagctgatcaagttcgacgagaatgccaccgaggccgagcttgttgccaaggtggtgcagctcaacaacgactcgaccgtccatggcatgctcgtccagttgcccctccccaagcacatttccgagtatgctgtcacatcggccgttgccgacgagaaggatgtcgacggtttcggcaccctcaacatcggcgagcttgccaagcgcggcggccacccttatttcatcccctgcacccccaagggtgtcatggctcttcttgccgaggctggtgttgagctcaagggaaagaacgctgttgtcctcggtcgtagcgatatcgtgggcagccctgtcagctacctcctcaagaacgccgacgccaccgtcaccgtctgccactccaagaccgccgatctccagcagtatctcaaggaggccgacgttgttgttgctgccattggccagcctaactttgtcaagggcgagtggctcaagaagggtgccgttgtcattgatgtcggtaccaattacgttcccgacgatacaaagaagtctggcgtccgcctggttggtgacgtcgagttcgagtcggcctcccaggtcgcttccgccataactcctgttcccggcggtgtcggtcccatgacggttgctatgcttttgcagaacgttgttgacgccactagtttctacttcgagaaccagaagaagaggggatccattcctctccctttaaagctggcggagcccgttccttccgatatcgatatttccagggcccaggttcccaagcccatcacccaaatcgccaccgagatcggtcttgcgccctccgagctcgagccctacggtgcttacaaggccaaggttgacctcagcatcctcaagcgccttgagcaccgccgtaacggtcgctatgtcgttgtcactggtatcacccccactcctctcggtgagggcaagtccaccaccactatgggcctggctcaggctcttggtgctcacgttggtcgtttgactttcgccaacgtccgccagcccagccagggtcctactttcggcatcaagggtggtgctgctggtggtggttacagtcaggtcatccccatggatgagttcaaccttcacttgactggtgatatccatgccatcaccgccgccaacaaccttctcgctgccgctatcgatacccgcatgttccatgagaacacccagaaggacggtcctctttacaaacgtctagtccctgccaaaaacggaaagagggagttccctcccatcatgttccgccgcttgaagaagcttggcattgagaagacgaaccccgatgatctcaccgaggaggagattagccgctttgctcgtctcgatattgaccccgagaccattacctggagacgtgttctggatgtaaacgaccgtcatctgcgcggtatcgttatcggcaatgctcccaccgagaagggccacaagcgtgacactggcttcgacatttctgttgccagtgaatgcatggctattctggccctcagtactagtcttgctgacatgcgtgagcgtctcggcagaatggttgttgccagctccaagagcggcgaccctgtcactgctgacgaccttggtgttggcggtgccctgactgttttgatgagggatgccatcaagccaaacctcatgcagaccttggagggcactccagtcttcgttcacgccggtcctttcgccaacattagtatcggtaacagctcgatcctggccgacaagatggccctcaagcttgccggtacggagcccgatgaggattacgctaccaagtctggttttgtcgttactgaagccggtttcgacttcaccatgggtggcgagcgtttcttcaacatcaagtgccgcacctctggcctcatgcctgacgttgttgttgttgtcgctactatccgtgccctcaaagttcatggtggtggtcccccgatctcgcccggtgcgccgctcaaccctgtgtacaaggaggagaatgttgagattctgcgcgctggttgcgtcaacctcgccaagcacatccagaatgcccgttcgtatggtgtccctgtcgtcgttgccatcaacaagttctcgaccgatacccaggccgagattgacgttgttcgcgaggaggccatcagggccggtgccgaggacgccgtgctcgccaaccattgggccgagggtggtaagggtgctgttgacctcgctcaggccgtcatttctgctagcgagaagtctacccctgagactcagaagcttctatatgaggttgagggcaacaccgtccaggagcgtatcgagaagatcgcttgtgagatgtacggtgccgccagcgtcgagttcagcgagctcgcccagaagaaggtcgatacctatactcgccagggattcggcaacctgcccatctgcatcgccaagacccaatattcactcagccacgaccccgagcttaagggtgcccccaccggcttcaccgtccccatcagagatgtccgtatggccgcgggcgccgggtatctctacgctttggctgccgatatccagactattcctggtctgcctacggctcctggttactttaatgtggacgtggataccgagactggtgagatccagggtctgttctag

SEQ ID NO: 16225 - protein, 941 aa, Neurospora crassa
MASKIDGTALAKRIRDGLRATIDETKKTNPRFRPCLKIIQVGDRSDSSTYVRMKLKAAEECGIEAELIKFDENATEAELVAKVVQLNNDSTVHGMLVQLPLPKHISEYAVTSAVADEKDVDGFGTLNIGELAKRGGHPYFIPCTPKGVMALLAEAGVELKGKNAVVLGRSDIVGSPVSYLLKNADATVTVCHSKTADLQQYLKEADVVVAAIGQPNFVKGEWLKKGAVVIDVGTNYVPDDTKKSGVRLVGDVEFESASQVASAITPVPGGVGPMTVAMLLQNVVDATSFYFENQKKRGSIPLPLKLAEPVPSDIDISRAQVPKPITQIATEIGLAPSELEPYGAYKAKVDLSILKRLEHRRNGRYVVVTGITPTPLGEGKSTTTMGLAQALGAHVGRLTFANVRQPSQGPTFGIKGGAAGGGYSQVIPMDEFNLHLTGDIHAITAANNLLAAAIDTRMFHENTQKDGPLYKRLVPAKNGKREFPPIMFRRLKKLGIEKTNPDDLTEEEISRFARLDIDPETITWRRVLDVNDRHLRGIVIGNAPTEKGHKRDTGFDISVASECMAILALSTSLADMRERLGRMVVASSKSGDPVTADDLGVGGALTVLMRDAIKPNLMQTLEGTPVFVHAGPFANISIGNSSILADKMALKLAGTEPDEDYATKSGFVVTEAGFDFTMGGERFFNIKCRTSGLMPDVVVVVATIRALKVHGGGPPISPGAPLNPVYKEENVEILRAGCVNLAKHIQNARSYGVPVVVAINKFSTDTQAEIDVVREEAIRAGAEDAVLANHWAEGGKGAVDLAQAVISASEKSTPETQKLLYEVEGNTVQERIEKIACEMYGAASVEFSELAQKKVDTYTRQGFGNLPICIAKTQYSLSHDPELKGAPTGFTVPIRDVRMAAGAGYLYALAADIQTIPGLPTAPGYFNVDVDTETGEIQGLF

SEQ ID NO: 16226 - DNA, 1671 bp, Haemophilus ducreyi 35000HP
  CDS (1)..(1671)
atgaaaagcgatgtagaaattgcacaatctgcaactatgcaacacattaatcatatagccgaaaaactaggtttaacggtagatcaaatcgagcaatatggtaaatataaagccaaaattaatcctgccgatgcctttaaattgcccgctaaaaacggtaaattaattttagttactgcgattaatccaactccggcaggcgaaggaaaaacaaccgtaacaattggattaactgatgcgttaaatcatattggtaagcaagcggtagttgctgctcgtgaaccatctttaggccccgtgttcggagtaaaaggcggtgctgcgggtggggggtatgcacaagtattgccaatggaagatattaatttgcattttaccggtgattttcatgcaattacgagtgctaataatttactcgcggcgttattagataaccatatttatcaaggtaatgcattaaacattgatccaaaacggattctatggcgacgcgtaattgatatgaatgatcgtcaattacgtaatattctaggcggtttaggcaacactaccgatggtgttattcgcccagatggttttgatattaccgttgcgtctgaagtaatggcgattttctgcttagccaaagatttagcggatttaaaaacacggttaggcaatattttagttgcatataccaaagataaacaaccggtttacgctaaagatttaaatgcacaaggtgcaatggccgcgctgttaaaagatgcaatcaaaccaaacttagtacaaacaatggcaggcagtcctgcatttattcatggtggcccttttgccaatattgcccatggttgtaattcggttatcgccacccgtttagcattacatttaggtgattatgccgttacagaagcgggctttggcgctgatcttggtgcagaaaaattctgtgatattaaatgccgtttagcagaattaaaacccgatgttgcagtcattgtggctactgtacgtgcattaaaatataacggtggcgtagaaaaagctaatttagcggaagaaaatcttgaggcattaacagaaggtttaccaaatttgctgaagcacattgctaatttaaaaaatgtactaggtttgccggttgtggtcgccttaaaccgttttgtatcagattctgatgcagaattagcgctaatccaaaccgcttgtgctaaacaaggcgttgaagtttcattaacagaagtttgggctagaagtgctgtcggtggcgtcgatttagcgcataaggtgttaaaagcaattgatgaacaacaaaataatttccaatttgcttacgatgttaatgaccgtattcaacataaaatcactgcaatagcacaaaaaatttatggtgcaaccgatgtaaactttagtgctgaagcgcttgcagaaattaaaaacttagaaaaattagctttagataagttaccaatctgtatggcaaaaacacaatattcattaagcgatagtgctaaattacttggctgtcctactggttttaacattactgtgcgaagtattactgtttcagcgggtgctggttttattgttgcaatttgtggcagtatcatgcgaatgccaggcctacctaaaaatccagcaacaaatcggattgatgtcgatgaaaacggtgtaattagcggtttgttttaa

SEQ ID NO: 16227 - protein, 556 aa, Haemophilus ducreyi 35000HP
MKSDVEIAQSATMQHINHIAEKLGLTVDQIEQYGKYKAKINPADAFKLPAKNGKLILVTAINPTPAGEGKTTVTIGLTDALNHIGKQAVVAAREPSLGPVFGVKGGAAGGGYAQVLPMEDINLHFTGDFHAITSANNLLAALLDNHIYQGNALNIDPKRILWRRVIDMNDRQLRNILGGLGNTTDGVIRPDGFDITVASEVMAIFCLAKDLADLKTRLGNILVAYTKDKQPVYAKDLNAQGAMAALLKDAIKPNLVQTMAGSPAFIHGGPFANIAHGCNSVIATRLALHLGDYAVTEAGFGADLGAEKFCDIKCRLAELKPDVAVIVATVRALKYNGGVEKANLAEENLEALTEGLPNLLKHIANLKNVLGLPVVVALNRFVSDSDAELALIQTACAKQGVEVSLTEVWARSAVGGVDLAHKVLKAIDEQQNNFQFAYDVNDRIQHKITAIAQKIYGATDVNFSAEALAEIKNLEKLALDKLPICMAKTQYSLSDSAKLLGCPTGFNITVRSITVSAGAGFIVAICGSIMRMPGLPKNPATNRIDVDENGVISGLF

SEQ ID NO: 16228 - DNA, 1671 bp, Enterococcus faecalis V583
  CDS (1)..(1671)
atgaagacagatattaacattgcacaagcagcaacattaaaacctattcaagagattgccgaaacaatcggtctttcagaagattcgctcgaactttatggaaaatacaaagcgaaaatagattttccaacgcttcaatccttagaagcgcaaccagaaggtaaattaatcctcgttacatcgattaatccaacaccagcaggagaaggaaagtcaaccgtgaccattggtttaggagatgcattaaatcaaatcaataaaaaaacagttattgccctaagagaaccatcattaggtcctgtgatggggattaaaggtggcgcaacaggtggcggttacgcacaagtattaccaatggaagaaatcaatttgcattttactggtgatatgcatgcgattacgacagccaataatgccttagctgcgttactagataatcatttacagcaaggaaatgaattaaagattgattctcgacgggtgatttggaaacgggcagtggatctaaatgatcgtgcgctcagacaggtcgttgttggtttaggcggtcctttccaaggtgtaccaagagaagacggtttcgatattactgtggcaagcgaaattatggcgattctttgtttagcgcaaaatttaacggacttaaaagaacgcttaagtcggattattgtcgcctataatgaccaaagagagccggtgacggttaaagatttaaacgtggcaggtgcgctgactttattattaaaagacgccttaaaacctaatttagttcaaacgattgaaggaactccagcttttgttcacggtggtccttttgccaatatcgctcatggatgtaacagtattttagcgacaaaaacggctttgcatctaggggattatgtcgtaacagaagcaggttttggtggcgacttaggtggcgaaaaatttttagatattaaagtaccttctttaggaaaagcacccgatgccgttgtgattgtggcaacgattcgcgcgttgaaaatgcatggcggtttggcgaaagatcagttagcagaagaaaatttaccagcgttacaaaaaggctttgccaacttagaaaaacatattcaaaacatgcaacgttatgatgtaccagtagttgttgcaattaatgagtttacacaggatacagagaaggaaattcaactgttgaaagaagcctgccaagcgttaggcgtgcccgtcgagttaacaagtgtttgggcgcaaggtggcgcaggtggcacgaatctagcgaaaacagtagtagcagagattgaagccgatacaaaacagtttcaacctttatataatcctcgccaaactattgaagaaaaaattcaagccattgtacaaacgatttacggcggggaacaggcgattttttctccgaaagcgcaaaaacaaatcgcagactttacaaaaaatggttgggatcaattaccaatctgcatggcgaagacacagtattcactttctgacgatcctcaaaaattaggacggccagaaggatttacgattacaattcgtgaactagttccaaaaatcggtgcagggtttatcgtggcgttaacgggtgacattttaacgatgcctggcttgccgaaggttcctgctgcgttaaatatggatgtggacgaaacgggtcaagcgagcggtctcttttaa

SEQ ID NO: 16229 - protein, 556 aa, Enterococcus faecalis V583
MKTDINIAQAATLKPIQEIAETIGLSEDSLELYGKYKAKIDFPTLQSLEAQPEGKLILVTSINPTPAGEGKSTVTIGLGDALNQINKKTVIALREPSLGPVMGIKGGATGGGYAQVLPMEEINLHFTGDMHAITTANNALAALLDNHLQQGNELKIDSRRVIWKRAVDLNDRALRQVVVGLGGPFQGVPREDGFDITVASEIMAILCLAQNLTDLKERLSRIIVAYNDQREPVTVKDLNVAGALTLLLKDALKPNLVQTIEGTPAFVHGGPFANIAHGCNSILATKTALHLGDYVVTEAGFGGDLGGEKFLDIKVPSLGKAPDAVVIVATIRALKMHGGLAKDQLAEENLPALQKGFANLEKHIQNMQRYDVPVVVAINEFTQDTEKEIQLLKEACQALGVPVELTSVWAQGGAGGTNLAKTVVAEIEADTKQFQPLYNPRQTIEEKIQAIVQTIYGGEQAIFSPKAQKQIADFTKNGWDQLPICMAKTQYSLSDDPQKLGRPEGFTITIRELVPKIGAGFIVALTGDILTMPGLPKVPAALNMDVDETGQASGLF

SEQ ID NO: 16230 - DNA, 846 bp, Enterococcus faecalis V583
  CDS (1)..(846)
atgagtacagtaattaacggtcgtgaattagcagatcaaatgcaagcagagattcaaaaagatgtagaaaagatgacacaacaaggcatccaaccaggattagttgttttattagttggggaaaatcctgccagccaaacgtatgtgagaaataaagaacgtgcagcagccaaaattggcattctgtcaaaggtcgaaaaactgccagaaactatttcagaagaagaattattggctgagattgacaaatataatcaagattcacgctttcatggcattcttgtacaactacctttgccaaaacatattgatgaagaaaagattttattagcgattgatcccaaaaaagatgtagatgggttccatccaatgaatttaggccgtttgtttgtaggcaaacctgaaatgattccttgcacgccgtatggaattatgaagatgtttgaagcttatgatattgatttaacaggtaaacgtgcggtggttattggtcgaagcaatattgttggcaagccaatggcacaattattgttaatgaaaaatgcgaccgtgacgattgcccattctaaaactgaacatttagcagaagttgcaaaagaagcggatattttagttgtagcaattggacgcgggcattttgtcaccaaagagttcgtgaaaccaggtgcggtagtgattgatgtgggcatgaatcgcaatcaagaaggaaaactgattggtgatgtagcattcgatgaagtttctgaaattgcaagctatatcacgccggttcccaaaggtgttggcccaatgacgattaccatgttaatgtatcaaacagtcgaggcagcaaaaaaacaaaagtaa

SEQ ID NO: 16231 - protein, 281 aa, Enterococcus faecalis V583
MSTVINGRELADQMQAEIQKDVEKMTQQGIQPGLVVLLVGENPASQTYVRNKERAAAKIGILSKVEKLPETISEEELLAEIDKYNQDSRFHGILVQLPLPKHIDEEKILLAIDPKKDVDGFHPMNLGRLFVGKPEMIPCTPYGIMKMFEAYDIDLTGKRAVVIGRSNIVGKPMAQLLLMKNATVTIAHSKTEHLAEVAKEADILVVAIGRGHFVTKEFVKPGAVVIDVGMNRNQEGKLIGDVAFDEVSEIASYITPVPKGVGPMTITMLMYQTVEAAKKQK

SEQ ID NO: 16232 - DNA, 2186 bp, Methylobacterium extorquens
  CDS (301)..(1974)
tcgacgtggctcaagcgctgacccaggccggttacaccgccaccgcgatgaccggttgaaaccattcggcctcgcgcgccggccggcggcggatcacctgtcccaaaccacctgtcccatgagaaaacttaacggtcgggttaaaaaaaatccgagacgcttttcgtcgtcgtttcgctcacactgccacgatcggtttatcgtggccgttccgttcgctaccacggaagcatagggacggaccgggcgacggctcggcacgccgcgagcccgcgtgaacaagaaacgacggtgagagaaatgccctcagatatcgagatcgcccgcgcggcgaccctgaagccgatcgcccaggtcgccgaaaagctcggcatcccggacgaggcgcttcacaactacggcaagcacatcgccaagatcgaccacgacttcatcgcctcgctcgagggtaagcccgagggcaagctggtgctcgtcaccgcgatctcgccgacgcccgcgggcgagggcaagaccaccacgaccgtgggtctcggcgacgcactcaaccggatcggcaagcgggcggtgatgtgcctgcgcgagccctcgctcggcccctgcttcggcatgaagggcggcgcggccggtggcggcaaggcccaggtcgtgccgatggagcagatcaacctgcacttcaccggggacttccacgccatcacctcggcgcactcgctcgccgccgcgctgatcgacaaccacatctactgggccaacgagctcaacatcgacgtgcgccgcatccactggcgccgcgtggtcgacatgaacgaccgggcgctgcgcgcgatcaaccagtcgctcggcggcgtcgccaacggctttccgcgtgaggacgggttcgacatcaccgtcgcctccgaggtgatggcggtgttctgcctcgccaagaatctggccgacctcgaggagcggctcggccgcatcgtcatcgccgagacccgcgaccgcaagccggtgacgctggccgacgtgaaggcgaccggcgcgatgaccgttctcctcaaggatgcgctgcagccgaacctcgtgcagacgctggagggcaacccggccctgatccatggcggcccgttcgccaacatcgcccacggctgcaactcggtgatcgccacccgtaccggcctgcggctggccgactacaccgtcaccgaggccggcttcggcgcggatctcggcgcggagaagttcatcgacatcaagtgccgccagaccggcctcaagccctcggcggtggtgatcgtcgccacgatccgcgccctcaagatgcatggcggcgtcaacaagaaggatctccaggctgagaacctcgacgcgctggagaagggtttcgccaacctcgagcgccacgtgaacaacgtgcggagcttcggcctgccggtggtggtgggcgtgaaccacttcttccaggacaccgacgccgagcatgcccggttgaaggagctctgccgcgaccgtcttcaggtcgaggcgatcacctgcaagcactgggcggagggcggcgcgggcgccgaggctctggcgcaggccgtggtgaagctcgccgagggcgagcagaagccgctgaccttcgcctacgaaactgagacgaagatcaccgacaagatcaaggcgatcgcgaccaagctctacggtgcggccgatatccagatcgagtcgaaggccgccaccaagctcgccggcttcgagaaggatggctacggcggattgcccgtctgcatggccaagacgcagtactcgttctcgaccgacccgaccctgatgggcgcgccctcgggccacctcgtctcggtgcgcgacgtgcgcctctcggcgggcgccggcttcgtcgtggtgatctgcggtgagatcatgaccatgccgggcctgcccaaggtgccggcggcggacaccatccgcctcgacgccaacggtcagatcgacgggctgttctagccgctgctctcagccctccccctacccaagtcgggcttgcccgacttgggcggatcgttgcggatctcgggcaagcccgaggtccgtcgggggagggccctttgccctctgcgctacgccgccagcccgcgcttcttcagcagcggctcgatgctcggcagccgcccccggaacgccgtataggcctcgcgcgcatcgcgcaggttgcccgc

SEQ ID NO: 16233 - protein, 557 aa, Methylobacterium extorquens
MPSDIEIARAATLKPIAQVAEKLGIPDEALHNYGKHIAKIDHDFIASLEGKPEGKLVLVTAISPTPAGEGKTTTTVGLGDALNRIGKRAVMCLREPSLGPCFGMKGGAAGGGKAQVVPMEQINLHFTGDFHAITSAHSLAAALIDNHIYWANELNIDVRRIHWRRVVDMNDRALRAINQSLGGVANGFPREDGFDITVASEVMAVFCLAKNLADLEERLGRIVIAETRDRKPVTLADVKATGAMTVLLKDALQPNLVQTLEGNPALIHGGPFANIAHGCNSVIATRTGLRLADYTVTEAGFGADLGAEKFIDIKCRQTGLKPSAVVIVATIRALKMHGGVNKKDLQAENLDALEKGFANLERHVNNVRSFGLPVVVGVNHFFQDTDAEHARLKELCRDRLQVEAITCKHWAEGGAGAEALAQAVVKLAEGEQKPLTFAYETETKITDKIKAIATKLYGAADIQIESKAATKLAGFEKDGYGGLPVCMAKTQYSFSTDPTLMGAPSGHLVSVRDVRLSAGAGFVVVICGEIMTMPGLPKVPAADTIRLDANGQIDGLF

SEQ ID NO: 16234 - DNA, 1749 bp, Vibrio parahaemolyticus
  CDS (1)..(1749)
atgcagtctgatattgaaatttgccgaaacacaccgttatcttccatcgatgttatcgctgaaaaagcaggtctattgcctgaagaatttgatacacatggaaaatacaaagccaaagtacaccctaagtgtttagcccgcctgaatgacaaccaaaacggcaaattggttctggtcaccgcgattaccccaactccactaggtgaaggcaaaaccgtgacaaccattggccttgctcaaggactggcgaagctaaagcaatccgtgatggcatgtattcgacaaccatcaatgggacctgtctttggcatcaaaggtggtgccgcaggtggcggatattcccaagttgcgccaatggaagagctcaatttgcatttgacgggtgatattcacgccgttacggctgcacacaacttagcgtctgcagctttagatgcgcgcttattccacgagcagcgcgaaggatatgacgcctttgaagctcgaactggtttaaaagcattaaaaattgacgttgaaagcattacttggaaacgcgtgatggaccacaacgaccgtgcacttcgcatggtcaaaattggtttgaacgaacatggcaaaaccattaacggatttgagcgtaacgaagggtttgatatttcagccgcatccgagttgatggccattattgcgttggcaaaaaatcttaaagacttacgtcagcgcattggcaaaattgttgttgcttatgatctcgacggtcagcctatcaccacagaagatttacaagtagcaggtgcgatggccgtaacgttgaaagaagccattgcaccaacattgatgcaaacgcttgaaggtgtccctactctgatccacgcaggcccttttgctaacattgcgcatggcaattcttctattatcgctgatgagattgcgttaaagctttcgcgttacacggtaactgaagcaggatttggctctgacatgggatttgagaaagcctgtaatattaaagcagcggctgccaacaaagcgcctgactgtgtggtgattgttgcgacgttaagaggtcttaaagcgaactccggccactacgacttgcgcccaggcatggcaattccagattcgattttctcacctgaccaagcggcattggtagccgggtttgaaaacttaaagtggcacatcaagaacgtccataaatatggaatcccagccgttgttgcgattaaccagttccctcaagattgcgaacaagaactcaccgcgcttcaagatctcattcacgcattcgatccaaatgttaaagtcgctatcagcactgcttttgcccaaggtggtgaaggtacgagagatctagcacagtatgtcgttgatgcttgcgaaaaaaccacgaatttccgacctctatatcagaaacatcaatcccttcaggagaagctgatgtctgtgtgtgaagctggatatggtgcgacaaatgttgaaatgagtgaacttgcaactaagcaattggctcattttgaaaaactagggtttaacgaattagctgtttgtattgctaaaacgccactttctgtcaccacagattcttcagtaaaaggcgcgccagttggctttactgttccaattcgtgaactgcgtttgtgtgccggtgctggcttcgtatacgcattatcgggtagcgttatgaccatgcccggtcttcctgacaagccagcgtttatgaatctcgaccttgatgaagatggtaatatcatcggtttgtcataa

SEQ ID NO: 16235 - protein, 582 aa, Vibrio parahaemolyticus
MQSDIEICRNTPLSSIDVIAEKAGLLPEEFDTHGKYKAKVHPKCLARLNDNQNGKLVLVTAITPTPLGEGKTVTTIGLAQGLAKLKQSVMACIRQPSMGPVFGIKGGAAGGGYSQVAPMEELNLHLTGDIHAVTAAHNLASAALDARLFHEQREGYDAFEARTGLKALKIDVESITWKRVMDHNDRALRMVKIGLNEHGKTINGFERNEGFDISAASELMAIIALAKNLKDLRQRIGKIVVAYDLDGQPITTEDLQVAGAMAVTLKEAIAPTLMQTLEGVPTLIHAGPFANIAHGNSSIIADEIALKLSRYTVTEAGFGSDMGFEKACNIKAAAANKAPDCVVIVATLRGLKANSGHYDLRPGMAIPDSIFSPDQAALVAGFENLKWHIKNVHKYGIPAVVAINQFPQDCEQELTALQDLIHAFDPNVKVAISTAFAQGGEGTRDLAQYVVDACEKTTNFRPLYQKHQSLQEKLMSVCEAGYGATNVEMSELATKQLAHFEKLGFNELAVCIAKTPLSVTTDSSVKGAPVGFTVPIRELRLCAGAGFVYALSGSVMTMPGLPDKPAFMNLDLDEDGNIIGLS

SEQ ID NO: 16236 - DNA, 1656 bp, Lactobacillus plantarum
  CDS (1)..(1656)
atgaaggatattgaaattgcacagcaagtgacaccagaaccgattacggcgattgcggctaaagcgggcttgacggttgaccagatcgaccaatatgggagcacgaaggctaaactcaaattaccgttaccggttaagaaaactcaacgcaaccttattttagtaacgtcgattaacccgacgcctgctggtgagggaaagtcaaccgtgactattgggttaggtgacgcgttgactaagattggtaagtcaacgatgattgcattgcgggaaccttcattaggaccagttatggggatgaagggtggcgccactggtggcgggtactcacaagtgattccaatggaagatatcaatttgcacttcaccggcgacatgcatgccctgacggctgcgaacaacacgctcgcggccttaattgacaaccatattcaacaaggtaaccagttgggtatcgatcagcgtcgaattcaatggaagcgcgcgttggatattaatgatcgggcgctccggcatacggtgattggccttggtggtgcaacgtcgggtgtacctcgtgaagatgggtttgacattaccgtcgcgagtgaactgatggccattctctgtctttcagaaaatattgcggacttgaaacaacgtgttaatcgaattgtaattggctacacacatgaccgtcaaccagtgacagttgctgatttgaacgtcggtggcgcgatcacgttacttttgaaagacgcgttacgtccaaatttagttcaaaccctggcgcataccccagcactcgttcatggtggtccgttcgccaatatcgcgcatggttgtaacagtgtacttgccacgcaagctggattgaatctagccgactatacggtaaccgaggcgggcttcggtgctgatttgggtggtcagaaattcatggatattaacgtgccagcggtcggacaagcgcccaatgccgtggtaatcgtggcgacgattcgggctttaaagttacatggtggcgtggctttgcaagatttggcaaccgaaaatgtagcggccttgaaagccggtgcggctaatttaggacatcatatccatgccatgcaacgttatggggtgccagtcgtggtggccatcaacgaatttacggccgatactgacgccgaaatccatgccgtcaaagactattgtgccgatcttggagtcgatgcagtcttggctgatgtctggggtcgtgggggtgacggggcaaccgacttagctgccgcagtggttgatttatgtgctcagccaagtcattttcaaccgttatcaccagcggatgcggatcttaagacgaaaatcaacgatattgtcactaagacgtatggtggagccaatgtcgaatattcagcgaaagctcagcgccaattgagaacgtttgctaagcaagggtgggatcatttgccagtctgcatggcgaagacgcaatattcattgagcgatgatcccaaacgtctcggagcaccaaccggatttacaattaatgttcgtgaatttgtgccgaagttaggtgcgggtttcattgtcgctttgaccgggaatgtgttgacgatgccaggactgccaaaacatccggccgcactcgatatggacattagtgatgatggaaaaatctcaggtttgttctaa

SEQ ID NO: 16237 - protein, 551 aa, Lactobacillus plantarum
MKDIEIAQQVTPEPITAIAAKAGLTVDQIDQYGSTKAKLKLPLPVKKTQRNLILVTSINPTPAGEGKSTVTIGLGDALTKIGKSTMIALREPSLGPVMGMKGGATGGGYSQVIPMEDINLHFTGDMHALTAANNTLAALIDNHIQQGNQLGIDQRRIQWKRALDINDRALRHTVIGLGGATSGVPREDGFDITVASELMAILCLSENIADLKQRVNRIVIGYTHDRQPVTVADLNVGGAITLLLKDALRPNLVQTLAHTPALVHGGPFANIAHGCNSVLATQAGLNLADYTVTEAGFGADLGGQKFMDINVPAVGQAPNAVVIVATIRALKLHGGVALQDLATENVAALKAGAANLGHHIHAMQRYGVPVVVAINEFTADTDAEIHAVKDYCADLGVDAVLADVWGRGGDGATDLAAAVVDLCAQPSHFQPLSPADADLKTKINDIVTKTYGGANVEYSAKAQRQLRTFAKQGWDHLPVCMAKTQYSLSDDPKRLGAPTGFTINVREFVPKLGAGFIVALTGNVLTMPGLPKHPAALDMDISDDGKISGLF

SEQ ID NO: 16238 - DNA, 1680 bp, Clostridium tetani
  CDS (1)..(1680)
atggaaaaagtattaacagatatagaaatagcacaaaaggcacaaatgaaacctataggagaaatagctgaaaagtatggcatattagaagatgaattagagttatatggtaaatataaggctaaattatctttagatatatttgatagattaaaggatgaaaaggacggaaagttagttttagttacagcaatatctccgacacctgctggagaaggaaagtcaactacttcaataggattaggtcaagctttaaataaaataggaaagaaaacttttatagctttaagagaaccatccctaggaccagtttttggagttaaaggaggagcagcaggaggaggatatgcccaagttgttccaatggaagatataaacttacactttactggtgatatgcatgctataggtataactaataacttattatcagctgctatagataatcacattcaccaaggaaatgctcttaaaatagattccagagaaattgtttggaaaagagttgtagacatgaatgatagggcattaagaaatgtagttgtgggaatgggtggaaaagcttgtggatttacaagacaagatggattcatgataacagttgcatcagaagttatggccatactttgcttagctaaagatcttatggacttaaaagaaagattaggaaatataatagttgcttacagtttagaaggaaaaccagtaacagctggagatttaaaggtaaatggtgctatggctatgcttttaaaagatgctataaaaccaaatatagtccaaactcttgaaaatacaccagctcttattcatggtggaccatttgcaaacatagctcatggatgtaactcattaatagctactagacttggattaaaactaggagatatattagtaacagaagcaggattcggagctgaccttggagcagaaaaattcttagacattaaatgtagatatggtggtttaaagccagatgcagtagttatagttgctacaattagagcattaaaaatgcatggtggagttaagaaaactgaattaagtggggaaaatcttgaagctttagataagggatttgctaatttacaaaaacatataacaaatatgaagaattttggtttaccagtaatggtagcagttaatagatttataactgattcagaagctgaaatagatttattaattaaaaaatgtaaagaaatcggtgttgaagtatccttaaatgaagtttgggcaaaaggtggagaaggcggaatagaaatggctgaaaagctagttaaaatactagaaacagaaaagccaaactataaaccactatatgacgttgaagattcaatacctgaaaaattaaataaaatagtaaaagaattatacggtggagaaggcgtagtaatagaatcatctgcaatgaaacaaattaaaaagttagaagaaataggattagataaattaccaatttgtatggctaaaactcagttctcattctcagatgatgcaacattgatgggagctcctaaaggatttaacattactattaaaaatgttagagtttcagcaggtgcaggatttatagtatgcgaaacaggaaacataatggtaatgccaggacttccaaaagttccagcagcagaaaaaatggatgttgatgaaaacggaaatatatcaggattattctaa

SEQ ID NO: 16239 - protein, 559 aa, Clostridium tetani
MEKVLTDIEIAQKAQMKPIGEIAEKYGILEDELELYGKYKAKLSLDIFDRLKDEKDGKLVLVTAISPTPAGEGKSTTSIGLGQALNKIGKKTFIALREPSLGPVFGVKGGAAGGGYAQVVPMEDINLHFTGDMHAIGITNNLLSAAIDNHIHQGNALKIDSREIVWKRVVDMNDRALRNVVVGMGGKACGFTRQDGFMITVASEVMAILCLAKDLMDLKERLGNIIVAYSLEGKPVTAGDLKVNGAMAMLLKDAIKPNIVQTLENTPALIHGGPFANIAHGCNSLIATRLGLKLGDILVTEAGFGADLGAEKFLDIKCRYGGLKPDAVVIVATIRALKMHGGVKKTELSGENLEALDKGFANLQKHITNMKNFGLPVMVAVNRFITDSEAEIDLLIKKCKEIGVEVSLNEVWAKGGEGGIEMAEKLVKILETEKPNYKPLYDVEDSIPEKLNKIVKELYGGEGVVIESSAMKQIKKLEEIGLDKLPICMAKTQFSFSDDATLMGAPKGFNITIKNVRVSAGAGFIVCETGNIMVMPGLPKVPAAEKMDVDENGNISGLF

SEQ ID NO: 16240 - DNA, 1668 bp, Bacteroides thetaiotaomicron VPI
  CDS (1)..(1668)
atgaaatcagacatagaaatagctcgcagtgtcgagttgaaaaagatcaagcaagttgccgaaagcatcggaattcctcgtgaagaagtcgaaaattatggtcgctacatcgcgaagattcccgaacaactgatcgacgaggagaaagtgaagaaaagtaaccttgtcctggtaactgccatcacagcgacaaaggcgggtatcggcaaaactacagtatctatcggtctcgccctgggactgaacaaaatcggaaagaaggcgattgtcgctttgcgcgagccgtctctcggtccttgcttcggtatgaagggaggagcagcgggtgggggatatgcacaggtgcttccgatggagaagatcaaccttcattttacgggagactttcatgcgattacttccgcgcataacatgatttctgctttgctcgataattatctttatcagaatcaggcgaaaggtttcggattgaaagaaattctctggcgtcgggtgctcgacgtgaacgaccgttcgttgcgcagcatcgtagtcggactcggacccaagtcgaacggcatcacgcaggagtcaggcttcgatattactccggcttcggaaattatggccattctctgcctttccaaagatgtggaagacttgcgccgccgcattgaaaatattctgcttggttttacatatgatgaccagccttttacggtgaaagatctcggagtggcgggagctatcacggtattgctgaaagacgccatccatccgaatctggtgcaaacgaccgaaggtaccgccgctttcgtacacggcggaccgtttgccaatatcgctcatggctgtaactctattcttgccaccaaactggcaatgtcattcggtgactatgtgatcacggaagccggattcggcgcagacctcggtgctgaaaagttctataacatcaaatgccgcaaaagcggactccagcccaaactgactgtgattgtcgctacggcgcaaggactgaagatgcacggtggtgtcagtctcgaccgcatcaaggaaccgaacatggaaggactgaaagaaggattgcgcaatctggataaacatattcgtaatcttcgctccttcggacagacggtagtggttgctttcaataagtttgccaccgacacggacgaggaaatggaaatgctgcgcgagcactgcgaacagttgggggtaggttacgccatcaataatgcgttcagcgacggtggtgatggagcggtagatatggcccgcctcgtagtcgatacgatagaaaataatccgtccgaacctttgcgttatacgtataaagaagaagacagcatacagcagaagattgagaaagtggctaccaacctttatggagccagcgtcattacgtacagcagcatcgcccgcaaccgcatcaagctgattgagaaaatgggaatcactcattatccggtttgtattgccaagacacaatactctttttctgccgatccgaagatttatggcgccgtgaataatttcgagttccatatcaaggatatagtgattaataacggtgccgaaatgattgtagcgattgcaggagaaatccttcgtatgccgggattgcccaaagaaccgcaagcgttgcatatcgacattgtagatggtgaaattgaaggactgagctga

SEQ ID NO: 16241 - protein, 555 aa, Bacteroides thetaiotaomicron VPI
MKSDIEIARSVELKKIKQVAESIGIPREEVENYGRYIAKIPEQLIDEEKVKKSNLVLVTAITATKAGIGKTTVSIGLALGLNKIGKKAIVALREPSLGPCFGMKGGAAGGGYAQVLPMEKINLHFTGDFHAITSAHNMISALLDNYLYQNQAKGFGLKEILWRRVLDVNDRSLRSIVVGLGPKSNGITQESGFDITPASEIMAILCLSKDVEDLRRRIENILLGFTYDDQPFTVKDLGVAGAITVLLKDAIHPNLVQTTEGTAAFVHGGPFANIAHGCNSILATKLAMSFGDYVITEAGFGADLGAEKFYNIKCRKSGLQPKLTVIVATAQGLKMHGGVSLDRIKEPNMEGLKEGLRNLDKHIRNLRSFGQTVVVAFNKFATDTDEEMEMLREHCEQLGVGYAINNAFSDGGDGAVDMARLVVDTIENNPSEPLRYTYKEEDSIQQKIEKVATNLYGASVITYSSIARNRIKLIEKMGITHYPVCIAKTQYSFSADPKIYGAVNNFEFHIKDIVINNGAEMIVAIAGEILRMPGLPKEPQALHIDIVDGEIEGLS

SEQ ID NO: 16242 - DNA, 1668 bp, Staphylococcus epidermidis ATCC 12228
  CDS (1)..(1668)
atggcacaattatcagatttagaaatagcaaacttatcaaaacttaaaccaataagtgaaattgcaagaaaagtagggattactgaggatgctttagaaccatacggccactataaagctaaaatagatattaatcagatacaagaacaggagaaaaaagggaaagtcgtattagtaactgctatgagcccaacaccagctggtgaaggaaaatccacagtaactgtaggtttagcagatgcatttaacaagttgaatcataatgttactgttgcattacgagaacctgccttaggaccaacttttggtattaaaggaggcgcaacaggtggtggttatgctcaagtacttcctatggaagatattaatttacattttaatggtgattttcatgcaattactactgcaaacaatgcactttccgcatttatcgacaaccacctacatcaaggaaatgaattgggaattgatcaacgaagaattgaatggaaacgtgttttagatatgaatgatcgtgcgttacgtcatgttaacgtaggattaggtggtacaactcacggagtacctagagaagatggttttaatataacagttgcgtcagagataatggctattttatgtctaagccgaaatatcaaagatttaaaagaaaaaataagtcgaattaccattggttatacacgtcatcataaacctataacagtttctgatttgaaagtagaaggtgcattaactttaatacttaaagatgcgattaaaccaaatttagttcaaacaattgagggaactccagctcttgttcacggaggcccttttgccaatattgctcatggttgtaactctatattagcaactgaaactgctagaaacttatctgatattgttgttacagaagcaggatttggttctgatttaggtgccgagaagtttatgaacattaaagctcgtgaagcaggtttcgatccatcagcagttgttgttgtagcaacgattcgtgctttgaaaatgcacggtggtgttgcaaaagaccaacttcaacatgagaacatagaggctgttgaagcgggacttgttaatcttgaaagacatgtgaataatattaaaaaatacggtgtcgaaccaatagtagctttaaatgcatttattcatgacacaccttctgaaacagcgtgtgtgaaacaatgggctaaagataatcaagtgcgtattgctttaacagaagtatgggaaaaaggtggagaaggtggaattgaacttgctaaccaagtgttcgatgtaatgcaggaacctcaaaactttaagcatttatatgagttaaaacaaccactcgaagctaaaattgaaacgattgttaaagaaatttatggaggttcaaaagtaaatttcagtagtaaagcacaaaaacaattaaagcaatttaaagagaatggctgggatgaatatccgatttgtatggctaaaactcaatattcatttagtgatgatcagacattgttaggtgccccgaatgattttgaaataacaattagagaacttgaagccaaaacaggcgctggattcatcgttgcattaactggtgctataatgactatgcctggtttaccgaagaaaccagctgcactaaatatggatgttactgatgatgggaaagcaataggtcttttctaa

SEQ ID NO: 16243 - protein, 555 aa, Staphylococcus epidermidis ATCC 12228
MAQLSDLEIANLSKLKPISEIARKVGITEDALEPYGHYKAKIDINQIQEQEKKGKVVLVTAMSPTPAGEGKSTVTVGLADAFNKLNHNVTVALREPALGPTFGIKGGATGGGYAQVLPMEDINLHFNGDFHAITTANNALSAFIDNHLHQGNELGIDQRRIEWKRVLDMNDRALRHVNVGLGGTTHGVPREDGFNITVASEIMAILCLSRNIKDLKEKISRITIGYTRHHKPITVSDLKVEGALTLILKDAIKPNLVQTIEGTPALVHGGPFANIAHGCNSILATETARNLSDIVVTEAGFGSDLGAEKFMNIKAREAGFDPSAVVVVATIRALKMHGGVAKDQLQHENIEAVEAGLVNLERHVNNIKKYGVEPIVALNAFIHDTPSETACVKQWAKDNQVRIALTEVWEKGGEGGIELANQVFDVMQEPQNFKHLYELKQPLEAKIETIVKEIYGGSKVNFSSKAQKQLKQFKENGWDEYPICMAKTQYSFSDDQTLLGAPNDFEITIRELEAKTGAGFIVALTGAIMTMPGLPKKPAALNMDVTDDGKAIGLF

SEQ ID NO: 16244 - DNA, 1671 bp, Streptococcus agalactiae 2603V
  CDS (1)..(1671)
atgaaaacagatattgaaatagcgcaaagcgtcgccctaaagcctattgctgagattgttgagcaagtaggaattggttttgatgatatagaattgtatggtaaatacaaagcaaaattatcttttgataagattgaagctgtaaaatctcaaaaagtaggaaagttaattttagtaactgctattaatccgacaccagcaggtgagggaaaatccactatgagcattggattagctgatgctttaaataaaattggtaaaaaaacgatgattgctcttcgcgaaccttctttaggtcctgtaatgggtattaaaggaggagctgctggaggtggatacgcacaagtactaccaatggaagatattaatttgcattttactggtgatatgcacgcaatcacaactgctaataatgctttatcagctctacttgataatcatattcatcaaggcaatgaattagatattgaccaacgtcgagtgatttggaagcgtgtagttgatcttaatgatcgtgctcttcgtcaggtgatcgttggcttaggaagccctgtcaatgggataccacgtgaagatggctttgatattactgttgcttctgaaataatggctattctatgtttagctactgacctatcagatttaaagaaacgcctgtcaaatattgttgtggcttactcaaggaaccgtaaaccaatctatgttaaagatttgaagattgaaggagctctcacacttatcctaaaagatactatcaaacctaatttggttcaaaccatttatgggacaccggctcttgtccatgggggaccatttgctaatattgcacatggatgtaattctgtcttagcgacttcaacagctctacgcttagcagattacgttgttactgaagcgggttttggagcagacttgggcgctgaaaagtttcttgatataaaaacgccaaaccttccgacttctcccgatgcgattgttattgttgctacattgcgtgcattgaaaatgcatggaggtgtttcaaaagaagatctctcacaagagaacgtcgaagcagttaaaagaggttttacaaatctcgagcgtcacgttaacaatatgcgtcaatatggtgttccggtagttgtagctatcaatcagtttactgcagatacagaaagtgaaattgcaactcttaaaaccttatgtagtaatattgatgtggcagttgaattagcaagtgtgtgggaagatggagcagacggtggtcttgaacttgcacagactgttgctaatgtgattgaaacacaatcatccaattacaaacgcttatataatgatgaagacactattgaagaaaaaattaaaaaaattgttactaaaatatatggtggtaataaagttcattttggacctaaggcacaaatacaattaaaagagtttagtgacaatggctgggacaagatgcctatttgtatggcaaagacacaatatagcttttctgataatccaaatttacttggtgctccaactgactttgatataactgttcgtgaatttgttccaaaaacaggagctggttttatagttgctcttactggagacgtattgacaatgcctggtttacctaaaaaacctgcagctctcaatatggatgttttagaagacggtacagccattggattattttaa

SEQ ID NO: 16245 - protein, 556 aa, Streptococcus agalactiae 2603V
MKTDIEIAQSVALKPIAEIVEQVGIGFDDIELYGKYKAKLSFDKIEAVKSQKVGKLILVTAINPTPAGEGKSTMSIGLADALNKIGKKTMIALREPSLGPVMGIKGGAAGGGYAQVLPMEDINLHFTGDMHAITTANNALSALLDNHIHQGNELDIDQRRVIWKRVVDLNDRALRQVIVGLGSPVNGIPREDGFDITVASEIMAILCLATDLSDLKKRLSNIVVAYSRNRKPIYVKDLKIEGALTLILKDTIKPNLVQTIYGTPALVHGGPFANIAHGCNSVLATSTALRLADYVVTEAGFGADLGAEKFLDIKTPNLPTSPDAIVIVATLRALKMHGGVSKEDLSQENVEAVKRGFTNLERHVNNMRQYGVPVVVAINQFTADTESEIATLKTLCSNIDVAVELASVWEDGADGGLELAQTVANVIETQSSNYKRLYNDEDTIEEKIKKIVTKIYGGNKVHFGPKAQIQLKEFSDNGWDKMPICMAKTQYSFSDNPNLLGAPTDFDITVREFVPKTGAGFIVALTGDVLTMPGLPKKPAALNMDVLEDGTAIGLF

SEQ ID NO: 16246 - DNA, 1713 bp, Shewanella oneidensis
  CDS (1)..(1713)
atgctaaccgatatggagatttcgcgccgcgcgcatctaaaagatatcgcacaacttggtgccgagtttgggttgttgcccgaagagatgcagctatttggcaataccaaggcgaaggtggatctgcaagtacagcagcgcttagccgggcaaccaaagggcaaattgattattgttaccgctgttacgccaacgcctcacggtgaaggtaaaaccgtgacgaccattggtttaacgcaatcactcaaggcgctcggcaataaagtgtgtgcctgtattcgccaacccagtatggggccagtatttggggtaaaaggtggggctgctggtggcggttatgcccaagttgtgcctatgcaggagctgaatctgcatctaacgggtgatattcatgctgtgagtagcgctcataatcttggggctgcggcgattgcttctcggctttaccatgaaatgcgtttaggcaaggctgaatttgagcgtcaatctggcttaagctacttagatatcgatccaaagggcattcgctggcaccgggtagttgatcataacgatcgttgtttacgggagattgaggtgggactgggggaaaacaacggccctgcttatacctcagggtttgatattaccgccgcttctgagttaatggccattttggcgctaagccgtaatttgactgatatgcgcgtacgtattggcaagctagtgttagcccttaatcgacagggagaggccgttagcgccgacgaactcggtgtagctggagccatgacagcgattatggcggatgcggtaaaacctacgttgatgcaaaccttaaacggtgcgccttgtcttattcatgcgggaccctttgcgaatatcgcccatggtaactcgtcggttattgccgatgatatcgccttaaaactggccgattttgtggtgaccgaaggtgggttcggctccgatatgggctttgaaaagttctgcaatatcaaagcgcggcagtcggggttaattccgagtgccgcagtattagtgaccacattaaaggcgcttaaggccaatagcggtttagcgtcggatacggatattaatgcgcctgaccaagcacgtcttgaagccggttttgccaatttaaattggcatatcaataatgtggtccaatatggtcttcctgttgttgttgctatcaatcgttttgccagcgatacggacgccgagctcaactggttaatggaagccgtgcgtggtactgcggcatttggctgcgaactcagcgaagcttttagccaaggtgaagatggggcgatggctttggcacaaaccgtaattcgcgcttgtgaacaaccaagtgagtttaggttgctgtatcccgataatatggagttggaagctaaattatcgaccttagcagaattaggttatggcgcagccggtataaatttatccgctgtggcaaaacagcaattacaggagctgagtgcgctcggttatgcgcatttgcccgtgtgtatggcaaagacccctttatcgatcagtcacgacccccagcttaaaggtgtccctcaaggttttatcgtgccagtgcgtgaattagtgttaaatgcgggcgctggatttatcacggcacttgtgggcaatgtgatgacaatgccagggcttggattaaccccaggctatttaaaaatagatatcgatgtcgatggtgagattattggactcggttaa

SEQ ID NO: 16247 - protein, 570 aa, Shewanella oneidensis
MLTDMEISRRAHLKDIAQLGAEFGLLPEEMQLFGNTKAKVDLQVQQRLAGQPKGKLIIVTAVTPTPHGEGKTVTTIGLTQSLKALGNKVCACIRQPSMGPVFGVKGGAAGGGYAQVVPMQELNLHLTGDIHAVSSAHNLGAAAIASRLYHEMRLGKAEFERQSGLSYLDIDPKGIRWHRVVDHNDRCLREIEVGLGENNGPAYTSGFDITAASELMAILALSRNLTDMRVRIGKLVLALNRQGEAVSADELGVAGAMTAIMADAVKPTLMQTLNGAPCLIHAGPFANIAHGNSSVIADDIALKLADFVVTEGGFGSDMGFEKFCNIKARQSGLIPSAAVLVTTLKALKANSGLASDTDINAPDQARLEAGFANLNWHINNVVQYGLPVVVAINRFASDTDAELNWLMEAVRGTAAFGCELSEAFSQGEDGAMALAQTVIRACEQPSEFRLLYPDNMELEAKLSTLAELGYGAAGINLSAVAKQQLQELSALGYAHLPVCMAKTPLSISHDPQLKGVPQGFIVPVRELVLNAGAGFITALVGNVMTMPGLGLTPGYLKIDIDVDGEIIGLG

SEQ ID NO: 16248 - DNA, 3061 bp, Mus musculus
  CDS (247)..(2448)
ccacgcgtccgcaaagttctcaatgctttgaaaccagaaaaagatgtggacggggtgaccgacatcaatctggggaagctcgtacgaggtgacgctccggagtgttttgtttcacccttggccaaagctgctgtagaacttgttgaaaagtcagggatcactttggatggaaagaaggtcttggtcgtaggggcgcacgggcccctggaagctgccctgcagtggcttttccagagaaaaggatctatgacaatgagctgcccctgggcaacacctcagcttccagacaagcttcgagaggcagacattgtggtcttaggctcacctaagccagaagagattcctgctgcgtggattccatcaggaaccaccattctcaattgcttccatgacttcttgtcagggaagctgagcggaggttctcctggggtccccgtggacaaactcattgcagaagagagcgtgagtctccttgctgcggctctgcgcattcagaacatggtgagcagcggcaggaggtggctcagagagcagcaacatcgaagatggcgactgcactgcttgaaactgcagcctctctcacctgtgcccagtgatattgagatttctcgaggacagactccaaaagctgtggatgtccttgccaaggagataggattgcttgcagatgaaattgaaatctatggcaagagcaaagccaaagtccaattgtccctgctggagaggttaaaggatcaaacagatggaaaatacgtcttggttgctgggatcacgcccaccccgctcggagaagggaagagtacagtcaccatcggactagtgcaggcgctgaccgctcacctgaaagtcaactccttcgcctgtctgaggcagccttctcagggacccacttttggagtgaaaggaggagctgcaggaggtggatatgctcaggtcatccccatggaggagttcaaccttcacctgactggggacatccatgccatcactgccgctaataacttgctggccgcagccatcgacacgagaattttacatgagagcactcaaacagacaaggctctctacaatcgactggttcccttagtgaatggtgtcagagaattttcagaaattcaactttctcggctgaagaaactggggatacataagactgatccaagcacactgaccgaggaggaagtgaggaagttcgcccgcctcaacattgaccccgcaaccatcacgtggcagagagtattggacacgaacgaccgatttctgagaaaaataaccattggacagggaagtacagagaaaggatattcccggcaggcacagtttgacattgcagtggccagcgagatcatggccgtgctggccttgactgatagcctcacagacatgaaagagcggctaggaagaatggtggtggccagtgacaaagacgggcagcctgtgacagctgaggacttgggggtgaccggcgctctgacagttttgatgaaagacgccatcaagccaaatctgatgcagacccttgaaggaacacctgtgtttgtgcatgctggtccctttgccaacatcgctcacggcaactcatcagtattagctgataaaatcgcgctgaaattggtcggcgaagaagggtttgtggtgactgaagctggctttggggctgatattgggatggagaaattcttcaatatcaaatgccgagcttctggcctggtgcccaacgttgtcgtgctggtagccaccgttcgagctctgaagatgcatggaggcgggccgagtgtaactgctggggttcctctcaagaaagaatatacagaggagaacattcagctggtagctgatggctgctgcaacctacagaagcaaattcagatcgctcagctcttcggggtgccggtggtggtggcactgaatgtcttcaagacggacacccgtgcagagattgacttggtgtgtgagctcgctaaacgggccggtgcctttgatgcggtcccctgctatcactggtcggctggagggaaaggatctgtggacttggcccgggctgtgagagaagctgcgaataaaagaagccgcttccagttcctgtatgatgttcagcttcccatcgtggaaaagataagagtcattgcccagactgtctatggagccaaggacattgagctgtctcctgaggcgcagtccaaaatcgatcgctatacgcaacagggttttggaaatttgcccatttgcatggcgaagacccacctctctctctctcatgaacctgacaaaaagggagtgccgagggatttcactctgcccatcagtgatgtccgggccagcatcggggctgggttcatttatcctttggtgggaacgatgagcacaatgccaggactgcccacccgaccctgcttttatgatatagaccttgacacagaaacggagcaagttaaaggcttgttctaatggaatgaaacccacaggactgggcaagaaaacagctcacacaagaatcccagcctttaaaaccacaacacaagtaagagtttaacaccagaggaaaagacgacttggctctgagaccccaccccctcttttttcagagtcttcaaacaaaaaacgtctccttgcctttttgctgcagttggagaagaaaatgaattttgaaatcttgtgatgcaatgctggagcaatcctgagacaggccaaagaccgcttcctcatacaagattaactctgtttccagccaagtggtgttcaacagaaggacctgcgccacatctggaaggagtgaagttactcttggttccgatagtgtttacaccatttctgctgcttatactttagaaagtttattttatggggactagggctttgcaagagtgtgaactaaaagctaatgcttccgtctttggagttttctctttcatcttttttattcttcctttcctcacctgtgttgaggatgggatgtcaggcctctgcttgcaccgtccagcgctgtgctgccaaactgtatttgtttttgtctttgaactgaaaataaacatgtgttctagaaaaaaaaaaaaaaaaaaaa

SEQ ID NO: 16249 - protein, 733 aa, Mus musculus
MTMSCPWATPQLPDKLREADIVVLGSPKPEEIPAAWIPSGTTILNCFHDFLSGKLSGGSPGVPVDKLIAEESVSLLAAALRIQNMVSSGRRWLREQQHRRWRLHCLKLQPLSPVPSDIEISRGQTPKAVDVLAKEIGLLADEIEIYGKSKAKVQLSLLERLKDQTDGKYVLVAGITPTPLGEGKSTVTIGLVQALTAHLKVNSFACLRQPSQGPTFGVKGGAAGGGYAQVIPMEEFNLHLTGDIHAITAANNLLAAAIDTRILHESTQTDKALYNRLVPLVNGVREFSEIQLSRLKKLGIHKTDPSTLTEEEVRKFARLNIDPATITWQRVLDTNDRFLRKITIGQGSTEKGYSRQAQFDIAVASEIMAVLALTDSLTDMKERLGRMVVASDKDGQPVTAEDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQIAQLFGVPVVVALNVFKTDTRAEIDLVCELAKRAGAFDAVPCYHWSAGGKGSVDLARAVREAANKRSRFQFLYDVQLPIVEKIRVIAQTVYGAKDIELSPEAQSKIDRYTQQGFGNLPICMAKTHLSLSHEPDKKGVPRDFTLPISDVRASIGAGFIYPLVGTMSTMPGLPTRPCFYDIDLDTETEQVKGLF

SEQ ID NO: 16250 - DNA, 1671 bp, Streptococcus pyogenes
  CDS (1)..(1671)
atgaaatcagatatcgaaattgcccaaagtgtcgccctacaaccaatcactgacattgttaaaaaggttggaatagacggcgatgacattgagctttatggcaaatataaggctaaattgtcttttgagaaaatgaaagctgtcgaagctaatgagcctggaaaattactcttggtaactgctattaaccctactccagcgggagaaggaaaatcaaccatgtctattggactggcagatgccttaaatcaaatgggaaaaaaaaccatgcttgccttacgtgaaccctcccttggtcctgttatggggattaaaggcggggcagcaggtggtggttatgcccaagtattgcctatggaagacattaatcttcactttactggtgacatgcatgccattacaaccgctaataatgcattatctgctttgattgacaatcatttgcagcaaggaaacgatttaggaattgatcctcgccgcattatttggaagcgcgtgttggaccttaatgatcgtgctcttcgtcaggtaattgttggcttaggcagtccagtgaatggtgtgccacgcgaagatgggtttgatatcacagtagcttctgaaatcatggcaattttatgtttggcaactgacttgaaagatctaaagaaacgtcttgctgatatcgtcgtggcttatacctatgatcgtaagcctgtctatgtgcgtgacttgaaggttgaaggagcattgacattaattctaaaagatgctatcaagccaaacttggtgcagactatttatggaacaccagctcttattcatggggggccatttgctaatattgctcatggttgtaattctgtccttgctacctcaacagctttgcgattagcagattacactgttaccgaagcaggattcggggccgacctaggagctgaaaaattcctaaatatcaaagtacctaatcttcctaaagcaccagatgctatcgtcattgttgcaaccttgcgcgcccttaaaatgcatggaggtgtcgccaaatcagatttagccgctgaaaattgtgaggctgttcgcttaggatttgccaacttaaaacgtcacgtggaaaacatgcgccaattcaaagttccagttgtggtggctatcaatgaatttgtagcagataccgaggctgaaattgctaccttaaaagcgctttgtgaagagattaaggttccagtagaattagccagtgtttgggcaaatggagctgagggaggcttagcattagctaaaacagcggttcgtgtgattgatcaagaagctgctgactacaaacgtctctattcagatgaggatactttggaagaaaaagtgatcaatatcgttacccagatttatggtggcaaagctgttcaatttggccccaaggccaaaacacaattgaagcagttcgcagaattcggttgggataaattgcctgtttgtatggctaagacccaatacagtttttcagataacccatccttgcttggagcgccaaccgattttgatattaccattcgtgaatttgttcctaaaacaggggcaggttttattgttggtttaacaggtgatgtgatgaccatgcctggtttgcctaaagttccagctgccatggcaatggacgtagcagaaaatggcacagccctcggtctcttttag

SEQ ID NO: 16251 - protein, 556 aa, Streptococcus pyogenes
MKSDIEIAQSVALQPITDIVKKVGIDGDDIELYGKYKAKLSFEKMKAVEANEPGKLLLVTAINPTPAGEGKSTMSIGLADALNQMGKKTMLALREPSLGPVMGIKGGAAGGGYAQVLPMEDINLHFTGDMHAITTANNALSALIDNHLQQGNDLGIDPRRIIWKRVLDLNDRALRQVIVGLGSPVNGVPREDGFDITVASEIMAILCLATDLKDLKKRLADIVVAYTYDRKPVYVRDLKVEGALTLILKDAIKPNLVQTIYGTPALIHGGPFANIAHGCNSVLATSTALRLADYTVTEAGFGADLGAEKFLNIKVPNLPKAPDAIVIVATLRALKMHGGVAKSDLAAENCEAVRLGFANLKRHVENMRQFKVPVVVAINEFVADTEAEIATLKALCEEIKVPVELASVWANGAEGGLALAKTAVRVIDQEAADYKRLYSDEDTLEEKVINIVTQIYGGKAVQFGPKAKTQLKQFAEFGWDKLPVCMAKTQYSFSDNPSLLGAPTDFDITIREFVPKTGAGFIVGLTGDVMTMPGLPKVPAAMAMDVAENGTALGLF

SEQ ID NO: 16252 - DNA, 1668 bp, Thermoanaerobacter tengcongensis
  CDS (1)..(1668)
atgaaatcagatattgaaatagctcaggaagcgaagatgctgcacataagagatgtggcagcaaaattgggcattgaggaggattatctggaatattacggcaaatacaaagctaagatttcccccgctttgtgggataaaattaaagacaggaaagacggaaaactcatcttagttacagctataactcccactcctgctggagagggaaagaccacgacgactgtaggactggggcaagctcttgcaaaattagggaaaaaagccatgattgccttgagagagccttctttaggtccttcctttggaataaaaggaggagcagctggaggcggttattctcaagtagtacctatggaagatataaatttgcattttactggagatatacatgccattacagcggctcacaatttgctggctgctatgattgacaatcacattcaccatgggaatgagctaaatatcgatataaggactataacgtggaaaagagcaatggacatgaatgacagggctttaagggaaataatagtagggctaggaggaaaagctaacggctatccaaggcaggacggctttataataactgttgcctcggagataatggcaattctgtgcctttctcacgatttaatggatttaaagagaaggctgggggatataatagtagcttatgacaaagatggaagtcctgtaactgcaagggatttaaaagcagacggggcaatggcagtgcttttaaaggatgctataaagcctaatttggtacagacgattgaaaacgttccagcttttgtccatggaggcccttttgcaaatatcgctcacggatgcaacagcttgattgcgacaaaatatgggttaaagcttgcagattatctggtgacagaagcaggttttggagcagatctgggagcagaaaaatttttcgatgtgaaggcgaggtttggaggtctcactccaaatgctgctgtagttgtggcaacggtaagggctttgaaaatgcacgggggagtgaagaaggaggatttgcagaaggaggacgtagaggcagtaagaaggggaatagaaaaccttgaaaaacaagtggaaaatgtaaggaaatttggcgtgcctgtggtggttgcgcttaacaaatttgtctttgatacagaaagagaaattgaagaagtgagaaaagcttgtgacagaataggtgtagatatggcggtggcagaggtttgggagaaaggtggagaaggcggaatagaacttgccgaaaaagtgataaaagctgcggacactccctctaatttcagattcctatacgatgtaaacttgcctataaaggataagctccacataatcgctactgagatatacggagctgacggcgtagaatatactgcaagtgctttaaaggatatagctaatatagagaaattaggacttgacaagatgcctatagtagtagctaagacccagtattccctgtcagatgaccccaagcttttagggcgtcctagaggatttaagataaccgtaagagaattaagaatttctagaggtgccgggtttatagttgctctgacaggtgacataatgacaatgccagggcttccaaaacaccctgccgctgagaacatagatatagatgaaaatggtagaataaaggggttgttctag

SEQ ID NO: 16253 - protein, 555 aa, Thermoanaerobacter tengcongensis
MKSDIEIAQEAKMLHIRDVAAKLGIEEDYLEYYGKYKAKISPALWDKIKDRKDGKLILVTAITPTPAGEGKTTTTVGLGQALAKLGKKAMIALREPSLGPSFGIKGGAAGGGYSQVVPMEDINLHFTGDIHAITAAHNLLAAMIDNHIHHGNELNIDIRTITWKRAMDMNDRALREIIVGLGGKANGYPRQDGFIITVASEIMAILCLSHDLMDLKRRLGDIIVAYDKDGSPVTARDLKADGAMAVLLKDAIKPNLVQTIENVPAFVHGGPFANIAHGCNSLIATKYGLKLADYLVTEAGFGADLGAEKFFDVKARFGGLTPNAAVVVATVRALKMHGGVKKEDLQKEDVEAVRRGIENLEKQVENVRKFGVPVVVALNKFVFDTEREIEEVRKACDRIGVDMAVAEVWEKGGEGGIELAEKVIKAADTPSNFRFLYDVNLPIKDKLHIIATEIYGADGVEYTASALKDIANIEKLGLDKMPIVVAKTQYSLSDDPKLLGRPRGFKITVRELRISRGAGFIVALTGDIMTMPGLPKHPAAENIDIDENGRIKGLF

SEQ ID NO: 16254 - DNA, 1635 bp, Fusobacterium nucleatum
  CDS (1)..(1635)
atgactgatattcaaattgcacaagcagctaaaaaggaaaacattgtagaaatcgctaaaaaattagggttgacagaggacgatatagaacaatatggaaaatataaagctaaggttaatttagatgttcttcaaaaaaataaaagacctaatggtaaattaattttagtaactgcaattacacctactccagccggggaaggaaaatcaactgtaactattgggcttacacaagctttaaataaaatgggtaaattatcagcagcagcaataagagaaccatctttaggaccagtttttggaatgaaaggtggagcagcaggtggaggatatgcacaagttgttccaatggaagatataaatctacatttcactggtgatatgcatgcaataggtatagctcataacttaatctctgcttgtatagataaccatatcaattctggaaatgctttaggaatagatgtaactaaaataacttggaaaagagttgtggatatgaatgacagagctcttagaaatatagttattggacttggaggaaaagctaatggatatccaagacaagattctttccaaatcacagttggatctgaaataatggcaatactttgcttatctaattcaataactgaattaaaagaaaaaattaaaaatatagttattggaacatcagtaactggaaaattaataaaagttggagattttcatatagaaggagctgttgctgcacttcttaaagatgcaataaaacctaacttagttcaaacattagaaaatacacctgtatttatccacggaggaccttttgctaatatagctcatggatgtaactcgatacttgctacaaaaatggcattaaaattgactgattatgttgttacagaagcaggatttgctgctgacttaggagcagaaaaattcatagatatcaaatgtagacttggtggattaaaacctgattgtgctgttatagttgcaacagttagagctttagaacatcacggaaaaggtgacttaaaagcaggattagaaaacttagataaacatatagataacattaaaaataaatataaattaccattagttgttgcaatcaacaaatttataacagacactgatgaacaaattaatatgatagaaaaattctgtaatgaaagaggagcagaagtttctctatgtgaagtttgggcaaaaggtggagaaggtggtatagaccttgcagaaaaagttttaaaagcaatagataataataaaactgaatttgattatttttatgatataaacttaactattaaagaaaaaatagaaaaaatctgtaaagaaatttatggagcagatggagttatatttgcacctgcaactaaaaaggtatttgatgtaatagaagctgaaggattaaataaacttccagtatgtatgtcaaaaactcaaaaatcaatttctgataatccagcattattaggaaaacctactggatttaaagtaactataaatgatttacgtctagctgttggggcaggatttgttatagctatggcaggagatatcatagatatgccaggattacctaagaaaccatcagcagaagtaattgatattgatgaaaatggagttatctctggattattctaa

SEQ ID NO: 16255 - protein, 544 aa, Fusobacterium nucleatum
MTDIQIAQAAKKENIVEIAKKLGLTEDDIEQYGKYKAKVNLDVLQKNKRPNGKLILVTAITPTPAGEGKSTVTIGLTQALNKMGKLSAAAIREPSLGPVFGMKGGAAGGGYAQVVPMEDINLHFTGDMHAIGIAHNLISACIDNHINSGNALGIDVTKITWKRVVDMNDRALRNIVIGLGGKANGYPRQDSFQITVGSEIMAILCLSNSITELKEKIKNIVIGTSVTGKLIKVGDFHIEGAVAALLKDAIKPNLVQTLENTPVFIHGGPFANIAHGCNSILATKMALKLTDYVVTEAGFAADLGAEKFIDIKCRLGGLKPDCAVIVATVRALEHHGKGDLKAGLENLDKHIDNIKNKYKLPLVVAINKFITDTDEQINMIEKFCNERGAEVSLCEVWAKGGEGGIDLAEKVLKAIDNNKTEFDYFYDINLTIKEKIEKICKEIYGADGVIFAPATKKVFDVIEAEGLNKLPVCMSKTQKSISDNPALLGKPTGFKVTINDLRLAVGAGFVIAMAGDIIDMPGLPKKPSAEVIDIDENGVISGLF

SEQ ID NO: 16256 - DNA, 3452 bp, Homo sapiens; identical to SEQ ID NO: 16174
  CDS (843)..(3044)

SEQ ID NO: 16257 - protein, 733 aa, Homo sapiens
MTMSIQWKTRQLQSKLHEADIVVLGSPKPEEIPLTWIQPGTTVLNCSHDFLSGKVGCGSPRIHFGGLIEEDDVILLAAALRIQNMVSSGRRWLREQQHRRWRLHCLKLQPLSPVPSDIEISRGQTPKAVDVLAKEIGLLADEIEIYGKSKAKVRLSVLERLKDQADGKYVLVAGITPTPLGEGKSTVTIGLVQALTAHLNVNSFACLRQPSQGPTFGVKGGAAGGGYAQVIPMEEFNLHLTGDIHAITAANNLLAAAIDTRILHENTQTDKALYNRLVPLVNGVREFSEIQLARLKKLGINKTDPSTLTEEEVSKFARLDIDPSTITWQRVLDTNDRFLRKITIGQGNTEKGHYRQAQFDIAVASEIMAVLALTDSLADMKARLGRMVVASDKSGQPVTADDLGVTGALTVLMKDAIKPNLMQTLEGTPVFVHAGPFANIAHGNSSVLADKIALKLVGEEGFVVTEAGFGADIGMEKFFNIKCRASGLVPNVVVLVATVRALKMHGGGPSVTAGVPLKKEYTEENIQLVADGCCNLQKQIQITQLFGVPVVVALNVFKTDTRAEIDLVCELAKRAGAFDAVPCYHWSVGGKGSVDLARAVREAASKRSRFQFLYDVQVPIVDKIRTIAQAVYGAKDIELSPEAQAKIDRYTQQGFGNLPICMAKTHLSLSHQPDKKGVPRDFILPISDVRASIGAGFIYPLVGTMSTMPGLPTRPCFYDIDLDTETEQVKGLF

SEQ ID NO: 16258 - DNA, 1671 bp, Clostridium perfringens str
  CDS (1)..(1671)
atgaaaaatgatattgaaatagcacaaagtgctaaaatggagccaataataaatattgctaaaaaaataggtcttggagaagatgatattgagctttatggaaaatataaatgtaagatatctttagatgcaataaaaaaactagaaaataataaggatggtaagcttgttttagttacagctataaatccaacaccggcaggagagggaaaatctactgttacagtaggattaggacaagcgttaaataaaataggaaaaaatactgttatagccttaagagagccatcattaggacctgtatttggaataaaaggtggagcagctggtggtggatatgctcaagtagttcctatggaagatataaatcttcattttacaggggatatgcatgcaataacttcagctaataatcttttatgtgcagctatagataaccatattcatcaaggtaatttattaagaatagattcaagaagaattgtatttaaaagagttatggatatgaatgatagagccttaagaaatatagttgttggaatgggtggtaaaataaacggattcttaagagaagatggatttatgatcactgttgcatcagaaataatggctatattatgtatggctagtgatttagaagacttaaaagagagaatgggaaatattttaattgcatataacttagatggagagcctgtttatgctaaggaattagaagttcaaggagctatggctttacttatgaaagatgccataaaacctaaccttgttcaaactttagaaaatactccagcaataattcatggaggcccatttgccaatatagctcatggatgtaattcaataatagcaactaagacagctttaaaaatgagtgatataactataacagaagctggttttggagcagatttaggtgcagaaaaattcttagatataaaatgtagatacggaaatttaaatcctgattgtgtagttttagtagctactataagagctttaaaacatcacggtggagtaaagaaagatgaattaaatatatcaaatgtagatgctttaaataaaggaatgaaaaacttagaaaagcaaatagaaaatataaaagcttatggagtaccagttgttgttgctataaataagtttataactgattcagatgaagaggttaaagctatagaagacttctgcaaaaatataggagtagaagttagcttaacagaagtatgggaaaaaggtggagaaggcggaattgatttagctaataaagttataaaaacaatggaaaccgagccttcaaactttaagatgatttacgattcagaagaatcaataaaggataaaatactaaaaatagttcaaactatatatggcggaaaaggagtaaactatactcctcaagctcttaaacaaatagctgaaattgagaaatttaatttagataagcttccaatatgtatggctaaaacacagtattcattatcagataatccaagtcttttaggaagacctgaaaactttgatataactgttaaagaggttagagtttcaaatggagctggattcatagttgttttaacaggggatgttatgacaatgccagggttacctaaagttcctgctgctaatagaatggatataaaagacaatggagaaatcgtaggattattctaa

SEQ ID NO: 16259 - protein, 556 aa, Clostridium perfringens str
MKNDIEIAQSAKMEPIINIAKKIGLGEDDIELYGKYKCKISLDAIKKLENNKDGKLVLVTAINPTPAGEGKSTVTVGLGQALNKIGKNTVIALREPSLGPVFGIKGGAAGGGYAQVVPMEDINLHFTGDMHAITSANNLLCAAIDNHIHQGNLLRIDSRRIVFKRVMDMNDRALRNIVVGMGGKINGFLREDGFMITVASEIMAILCMASDLEDLKERMGNILIAYNLDGEPVYAKELEVQGAMALLMKDAIKPNLVQTLENTPAIIHGGPFANIAHGCNSIIATKTALKMSDITITEAGFGADLGAEKFLDIKCRYGNLNPDCVVLVATIRALKHHGGVKKDELNISNVDALNKGMKNLEKQIENIKAYGVPVVVAINKFITDSDEEVKAIEDFCKNIGVEVSLTEVWEKGGEGGIDLANKVIKTMETEPSNFKMIYDSEESIKDKILKIVQTIYGGKGVNYTPQALKQIAEIEKFNLDKLPICMAKTQYSLSDNPSLLGRPENFDITVKEVRVSNGAGFIVVLTGDVMTMPGLPKVPAANRMDIKDNGEIVGLF

SEQ ID NO: 16260 - DNA, 1707 bp, Rhizobium meliloti
  CDS (1)..(1707)
atgcgcgaggcaaactggggggaagccgtgggagaggtaaagtccgacatcgagatcgcgcgcgccgcgcgcaagcagccgatcatggaggtcggcgcgaagctcggcattccgccggagcatctgcttccctacggccatgacaaggccaaggtcagcgccgaattcatcgcggcgcaaaacgagaaaaggaacggccggctcattctggtgacggcgatcaacccgacgccggcgggcgagggcaagacgacgacgaccgtcggcctcggcgacggcttgaaccgcatcggcaagaaggcgatcgtctgcatccgcgaggcgtcgctcggtccctgcttcggtatcaagggcggggcggcgggcggcggttacgcccaggttgtgccgatggaggacatcaatctccatttcaccggcgatttccatgcgatcacgtcggcgcataatctgctctccgccttgatcgacaaccatatctattggggcaacgagcaggcgatcgacattcgccgcatcgcctggcggcgggtcatggacatgaacgaccgggcgcttcgccagatcgtcggctccctcggcggcgtcgccaacggctatccaagagagaccggcttcgacatcaccgtcgcctcggaagtcatggcgatcctgtgcctggctatggacatcaaggatctcgaaaagcggctcggtaacatcattatcgggtaccgtcgtgacaagagcccggtcttcgcccgggacatcaaggcggatggggcaatggcggtactgctcaaggacgcgatgcagccgaacctggtgcagacgctcgagaacaaccccgccttcgtccatggcggccccttcgccaatatcgcgcatggctgcaattcggtcgtggccaccacgacggcgttgaagcttgccgactatgtggtaaccgaggccggcttcggtgccgatctcggcgccgagaaattcttcgacatcaagtgccgcaaggcagggctcacgcccgatgccgccgtaatcgtcgcgactgtccgcgcgatcaagatgaacggcggagtgaagagggaagacctcgggagagagagcgtcgaggcggtcaggaaggggtgcgccaatctcggccgccacatccagaacgtcaagaagttcggcgtaccggtgctcgtcgcgatcaaccatttcacctccgataccgaggccgaggtccgggcgatcaaggattatgtcagaacgctcggttccgaagcggttctctgcaagcactgggccgagggttcggcgggcatcgaggagctcgcttacaaggtcgtggacctcgccaatgccggccattcgcaattttcgccgctctaccccgacgagatgccgctcttccagaagatcgagacgatcgcaaaggacatctatcacgcaagcgaggtgattgccgacaagctggtgcgcgaacaactccggacctgggaagaccagggctatggcgatctgccgatctgcatggcgaagacccaatattccttctccaccgacccgaacctgcgcggagcaccgacgggccacgccgtgccgatacgcgaggttcggctggccgccggggccggcttcatcgtcgtgataaccggcgagatcatgacgatgcccggcctgccgaaggtgccttcttcggagcggatccggctgaacgagcaggggtacattgaagggttgttctga

SEQ ID NO: 16261 - protein, 568 aa, Rhizobium meliloti
MREANWGEAVGEVKSDIEIARAARKQPIMEVGAKLGIPPEHLLPYGHDKAKVSAEFIAAQNEKRNGRLILVTAINPTPAGEGKTTTTVGLGDGLNRIGKKAIVCIREASLGPCFGIKGGAAGGGYAQVVPMEDINLHFTGDFHAITSAHNLLSALIDNHIYWGNEQAIDIRRIAWRRVMDMNDRALRQIVGSLGGVANGYPRETGFDITVASEVMAILCLAMDIKDLEKRLGNIIIGYRRDKSPVFARDIKADGAMAVLLKDAMQPNLVQTLENNPAFVHGGPFANIAHGCNSVVATTTALKLADYVVTEAGFGADLGAEKFFDIKCRKAGLTPDAAVIVATVRAIKMNGGVKREDLGRESVEAVRKGCANLGRHIQNVKKFGVPVLVAINHFTSDTEAEVRAIKDYVRTLGSEAVLCKHWAEGSAGIEELAYKVVDLANAGHSQFSPLYPDEMPLFQKIETIAKDIYHASEVIADKLVREQLRTWEDQGYGDLPICMAKTQYSFSTDPNLRGAPTGHAVPIREVRLAAGAGFIVVITGEIMTMPGLPKVPSSERIRLNEQGYIEGLF

SEQ ID NO: 16262 - DNA, 1611 bp, Thermoplasma volcanium
  CDS (1)..(1611)
atgagggatattgaagaaattttgcatgagatgggtttatcaaaagatgactacgagctttatggcagatacatggctaagttgtcccttaaccttcaagaagtgaataaaaagaaggctaagttgatacttgtaacagccatgacgcctacggctgcaggcgaaggaaagaccacgacaaccattggcctcggccaggcattcaaaaaacttggaaagaacgtagccatagctatcagggagccttctcttggcccgtgcttcggtataaagggtggagctaccggcggaggtaaatctaaagtagaaccaagcgacaggataaatttgctctttacaggcgacttccccgccataagcgcagctcataacttactttcggcaatgataaataaccacatataccatggaaacgagctaaacctagatccgaagaggataacgttcccaaggacaattgacatgaacgacagatccctaaggagcatagttgtaggcgttggcccaagagatatgggtgctatagcaaacgacaacttcgttataacgcctgctagcgaggtaatggcaataactggcttgtccttaaactataaagacttgaaagaaaagctgtctaggatactagctggcttcacagtaaagaacaaaccagtattcgctgcggacttaaaagcggaaggatcaatggcagctttacttagggacgcactaaaaccaaatcttgtgcagacaacagaaggagtacctgcattcgtgcacaccggacctttcggaaacatagcacatggaacgtcaagcatagttgcagacagaattgcaatgaatctctttgattacgtcataacagaggcgggtttcggatcggatctcggcgcagagaagtttttcaatatagtatctaggataggtaatttgcctatcaatgcggttgttcttgtcgccacaataagagctctgaaacttcatggtggaagcaagaaacagggcgaggatgtagaagctgtgaaagaaggttcaaagaatctactaaggcacgttgcaaatataagaaagtttggtgtagaacctgtcgtagctctaaacaaattcccgacagatacagaaaacgagataatggcaataggcgagatactggattcgcacggcataaagtgggcgctgtctgaagtatttgaaaaaggtggtgaaggcggcatagaactcgcaaacaaggtgctttcatcgatcggtgattaccagatcaagaggacatacgaagtaagggaagatctaaagacaaagatcgaaaaaattgctgtgaacgtatacggagcggatggtgtcatttttgagaaaaaagcactcaacgatcttaagaaagctgaagagataatgaatgatccgtatgtttgtatggctaaaactcagtactctttcagtgatgatgcctcccttctcaacgatccgcatggcttcaaagtaagggtccaatcggtaaacatatcctctggtgcaggttttgttgtgccaatactaggggaaataatgactatgccgggcctgccaaagaggcctgctgctgaaaacattgatttggcagaagatggagaaataacagggttattctaa

SEQ ID NO: 16263 - protein, 536 aa, Thermoplasma volcanium
MRDIEEILHEMGLSKDDYELYGRYMAKLSLNLQEVNKKKAKLILVTAMTPTAAGEGKTTTTIGLGQAFKKLGKNVAIAIREPSLGPCFGIKGGATGGGKSKVEPSDRINLLFTGDFPAISAAHNLLSAMINNHIYHGNELNLDPKRITFPRTIDMNDRSLRSIVVGVGPRDMGAIANDNFVITPASEVMAITGLSLNYKDLKEKLSRILAGFTVKNKPVFAADLKAEGSMAALLRDALKPNLVQTTEGVPAFVHTGPFGNIAHGTSSIVADRIAMNLFDYVITEAGFGSDLGAEKFFNIVSRIGNLPINAVVLVATIRALKLHGGSKKQGEDVEAVKEGSKNLLRHVANIRKFGVEPVVALNKFPTDTENEIMAIGEILDSHGIKWALSEVFEKGGEGGIELANKVLSSIGDYQIKRTYEVREDLKTKIEKIAVNVYGADGVIFEKKALNDLKKAEEIMNDPYVCMAKTQYSFSDDASLLNDPHGFKVRVQSVNISSGAGFVVPILGEIMTMPGLPKRPAAENIDLAEDGEITGLF

SEQ ID NO: 16264 - DNA, 1680 bp, Rhizobium loti
  CDS (1)..(1680)
atggccgaagtgaagtccgacatcgagatcgcgcgcgccgccaagaaaaagcagatccaggagatcggccagaagatcggcatcccgaccgaacatctgctgccctatggccacgacaaggccaagatctcggccgaattcatcaaatcggtgaagggcaacaaggacggcaagctgatcctggtcaccgccatcaacccgacgcctgccggcgaaggcaagaccaccaccacggtcggcctcggcgatggcctcaaccgcatcggcaagaaggcgatcgtctgcatccgcgaagcttcgctcggcccgaatttcggcgtcaagggcggtgccgccggcggcggctatgcacaagtggtgccgatggaggacatgaacctccatttcaccggcgattttcacgccatcaccacggcgcacaaccttctgtcggcgctgatcgacaaccacatctactggggcaatgagctcggcatcgacacacgccgcgtggtgtggcgccgcgtcatggacatgaacgatcgggcactgcgcgaaatgatctgttcgctcggcggcgtcgccaacggctttccgcgcgagggcggcttcgacatcaccgtcgcctcggaagtcatggccatcctgtgcctgtccaccgacctcaaggacctggaaaagcgcctcggcgacatcatcgttgcctaccgtcgcgacaagtcgccggtctatgcccgcgacctcaaggccgacggcgccatggccgtgcttctgaaggacgccatgcagcccaatttggtgcagacgctggagaacaacccggccttcgtccatggcggcccgttcgccaacatcgcgcatggctgcaactcggtcgtcgccaccaccacggcgctgaagctcgccgactatgtcgtcaccgaagccggtttcggcgccgaccttggtgccgagaaattctttgacatcaagtgccgcaaggcgggcctcaagccggcggccgccgtcatcgtcgccaccgtgcgcgccatgaagatgaatggcggcgtcaagaaggaagacctcggcaaggaaaacatcgaggcggtgaagaagggctgcgccaatctcggccgccacatcgagaacatcaggcagttcggcgtgccggcggtggttgccatcaaccacttctattccgacaccgacgccgaaatccaggcgatgaaggactatgtcgcctcgatgggcgaagaggctgtcctgtgcaagcactgggccaagggctcggccggcatcgaggaactcgccaacaaggtggtggcgctggccgaatccggcgcctcgcagttcgcgccgctctatcccgacgccatgccgctgttcgagaagatcaacaccattgtccagcgcatctatcgcggctcggaagcgatcgccgacaagtcggtgcgcgaccagttgcacgcctgggagcaggccggctacggcaacctgccggtctgcatggccaagacgcagtactcgttctcgaccgacccgaacctgcgcggcgcgccgaccggccacaccgtgccggtgcgcgaggtcaggctttcggcgggcgccggcttcgtcgtcatcatctgcggcgaggtcatgaccatgcccggcctgcccaaggcgccgtcctcggaaaagatcttcctcaacgaggccggccagatcgaaggcctgttctag

SEQ ID NO: 16265 - protein, 559 aa, Rhizobium loti
MAEVKSDIEIARAAKKKQIQEIGQKIGIPTEHLLPYGHDKAKISAEFIKSVKGNKDGKLILVTAINPTPAGEGKTTTTVGLGDGLNRIGKKAIVCIREASLGPNFGVKGGAAGGGYAQVVPMEDMNLHFTGDFHAITTAHNLLSALIDNHIYWGNELGIDTRRVVWRRVMDMNDRALREMICSLGGVANGFPREGGFDITVASEVMAILCLSTDLKDLEKRLGDIIVAYRRDKSPVYARDLKADGAMAVLLKDAMQPNLVQTLENNPAFVHGGPFANIAHGCNSVVATTTALKLADYVVTEAGFGADLGAEKFFDIKCRKAGLKPAAAVIVATVRAMKMNGGVKKEDLGKENIEAVKKGCANLGRHIENIRQFGVPAVVAINHFYSDTDAEIQAMKDYVASMGEEAVLCKHWAKGSAGIEELANKVVALAESGASQFAPLYPDAMPLFEKINTIVQRIYRGSEAIADKSVRDQLHAWEQAGYGNLPVCMAKTQYSFSTDPNLRGAPTGHTVPVREVRLSAGAGFVVIICGEVMTMPGLPKAPSSEKIFLNEAGQIEGLF

SEQ ID NO: 16266 - DNA, 4160 bp, Yarrowia lipolytica
  CDS (180)..(2993)
gaattctgggcctactacgtagtctttgttacccctcactgctccgctgggccatattcattggtgtaattgtcacaccccacgttctccacattaactttagaggttattcttgtcaggttggtgaaggtcgatttcaggagctaaacatctttctttcctctacaactatccacacaatggcctccatcatcgacggcaattccattgccaaaaacatccgagaacggctgcacaccgaaatcgccgatgtgcaacagaccaacccccgattccagccctctctggtcatcatccaggtcggcgatcgacccgactcgtccacctacgtgcgaatgaagctcaaggccgcggacgaggccgccatcaagtgcgagctcaagaaactggacgagaacgtgtcccagcacgagctgctgcgggagatcacccacctgaacgaggacccctccgtggacggtgttctggtccagctccctctgcccaagcacattgacgagaccaccatcaccaatgccgtcgccgccgacaaggacgttgatggcttcggtcctctcaacattggcgagctcgccaagcgaggtggaaacccttccttcgtcgcttgcacccccaagggagtcatggagctgctcaaggttgccggcatcgatgttgctggcaagaccgctgttgttcttggccgatccgacattgtcggagcccccgtttcctatctgctgcgaaacgctgacgctaccgtcactgtcgtgcactccaaaactgccaacatccccgagattgtcaagactgccgacattgttgtcgccgccattggccagcccggctttgtcaagggtgagtggctcaagcctggcgccgttgtcatcgacgtgggaaccaactacattcccgatgataccaagaagtctggccagcgacttgttggagatgttgactttgagtctgccaagaacgtagcctcccacatcacccccgtccccggaggagtgggtcccatgaccgtggccatgctgctggacaacgttgtgctctctgccaagcgacaggccgagaagttgaccgctcgatccatcacccctctgcctcttaagaaggagaaccctgtgccctccgactttgccatttctcgagcccaagagcccaagcacatcaccgaggtggctgccgaaattggcgtgctgccctctgagctcgagccctacggagcctacaaggccaaggtccagctgcccattcttgaccgtctggcccaccgaaagaacggaaagtacgttctagtcaccggaatcactcccacccctcttggagagggcaagtccaccaccaccattggtctggtgcaggctcttggtgcccatcttggtaagatggcttttgccaacgtcagacagccctccatgggccctacctttggtattaagggaggagctgctggaggaggatacgcccaggttatccccatggatgagttcaacatgcacctgaccggtgacattcacgccatttcagctgccaacaacctgcttgccgctgccattgacacccgaatgtttcatgagtctacccagaaggacgctgctctttacaagcgtctggtgcctgccaagaagggcgttcgaaccttcactcgaggcatgcagacccgactcaagaagcttggtatcgacaagaccaaccccgacgatctgactgaggaggagattgccaagtttgtgcgtctcgacattgatcctgagaccatcacctggcgacgagtggtcgattgcaatgatcgacatctgcgaggtatcactgttggacaggcccctaccgagaagggccgaacccgagagaccggctttgacatttccgtcgcctccgagtgtatggccattctggctcttgccaacgatctcgaggacatgcgagagcgacttggaaacatggtcattggttcttccaagaacggcgaccccgtcacttgtgacgatatcggtgctggtggtgctcttactgctctcatgaaggacgccatcaagcccaacctcatgcagactctggagggtacccccgtctttgtgcatgccggtcccttcgccaacatttccattggtgctaactccgtgctggccgacaagatggctctcaagctggctggtaccgaacccaacgagtctgacgacaaggccggctttgtggtcaccgaggccggtttcgatttcaccatgggaggtgagcgattcttcaacatcaagtgccgatcttccggtctggctcctgacgttgttgtcattgtcgctaccgttcgagccctgaagtctcatggaggaggtcctgaggtcaaggccggtgctcctctccccaaggagtacaccgaggagaacgtggagctcctgcgagagggatgcaagaacctcggaaagcacattgagaacgcccgacagtacggtctgcccgtggttgttgccatcaacgagtttgtctccgataccgctgccgagcacgatgtcatccgagaggaggctcttaagtacggtgccgaggacgctgttgtcgccaagcactgggccgaaggaggcgctggagccgtggatcttgcccaggccgtcgttgacgcctccaacaagatcgacaaggatttcaagctgctttacgaggccgacacaaccgctgaggagaagctcaacaccattgcccagaagatgtacggcgccaaggacgtggagctttccgagctggcccgaaagaagattgacgcctacaccaagcagggcttcggcaacctgcccatctgtgtggccaagacccagtactctctttcccacgaccctactctcaagggagtgcccactggcttcactgtgcccattcgagatgttcgagcctctgttggtgctggctacctctacgctctggctgccgagatccagaccattcctggtctccccactcattgtggcttcatgaacgttgaggtcaacgacaagggcgagatcgagggtcttttctaagaccgcagtgtgacaccacacgattaaattattcaactaagcatcctaccagttcaacacgtatataagaatgcacgccaaagcgcgacttgtgatatgacctgaatgaaatctgcttgtaatgtgttggggtgttcactatactctaatttgctattgctgtatttttggccgtatggcaacaccatgatgtagtgtttggatgcttttagggatcatgaaaagtatatcgatcgattcagaatttcgcgctgattcgattgataccaaaatatcctcctggaatatattgtagcttaacctattgctgctcagttacattgatacttacggcgtggtgtcataccgcccgtatacctgtttcaaacagtagtcatggtctatgccggatcagggggaaataaccgacggactatacaactacaacaaggagaaccgtttattgatgctatttccggatacgtataatccgtaagtacttctattcgtacttactgtataatgtataatgtacttgtaataaggtcatgtctcgtatcgtatttctaggtttcttcactccatgtccaccccgaagttatttacagcatgttgcagcttcaggtgcatgagtggagatcgtcggatccggatgaatctgcgcacaaagtggtatacattgaagttagtttctcacagaacgattcaagcgtttgattaattcaataaggggggattacatgcggtaccagacgtgcatcctttgcgagtgccggtaccagtcgctagctatgctttagtatcactggatctgttcaaaattccgtggtgatggaaactaccaatgacgtcaaatgtgccttcttgttaccatcacatgtctatggcataatttgttactcagacacattcactacaagaaagtgcgatacaactacagtaattggcgtgttgcgtcgtcttcctacttgtagtaaactcaggcctaaaatagcgtgggtctatagagctgcggcgctatcacttttagctgctgaattgcgtactataaaccatgtcggctgaaaatatggactttagccaggggtgtctgattacaaataacaagtctgtatctgcctgcacggctaccgtacaatagttaccaggatggttatgggtatgtattcaatgctacgtaaaccaata

SEQ ID NO: 16267 - protein, 937 aa, Yarrowia lipolytica
MASIIDGNSIAKNIRERLHTEIADVQQTNPRFQPSLVIIQVGDRPDSSTYVRMKLKAADEAAIKCELKKLDENVSQHELLREITHLNEDPSVDGVLVQLPLPKHIDETTITNAVAADKDVDGFGPLNIGELAKRGGNPSFVACTPKGVMELLKVAGIDVAGKTAVVLGRSDIVGAPVSYLLRNADATVTVVHSKTANIPEIVKTADIVVAAIGQPGFVKGEWLKPGAVVIDVGTNYIPDDTKKSGQRLVGDVDFESAKNVASHITPVPGGVGPMTVAMLLDNVVLSAKRQAEKLTARSITPLPLKKENPVPSDFAISRAQEPKHITEVAAEIGVLPSELEPYGAYKAKVQLPILDRLAHRKNGKYVLVTGITPTPLGEGKSTTTIGLVQALGAHLGKMAFANVRQPSMGPTFGIKGGAAGGGYAQVIPMDEFNMHLTGDIHAISAANNLLAAAIDTRMFHESTQKDAALYKRLVPAKKGVRTFTRGMQTRLKKLGIDKTNPDDLTEEEIAKFVRLDIDPETITWRRVVDCNDRHLRGITVGQAPTEKGRTRETGFDISVASECMAILALANDLEDMRERLGNMVIGSSKNGDPVTCDDIGAGGALTALMKDAIKPNLMQTLEGTPVFVHAGPFANISIGANSVLADKMALKLAGTEPNESDDKAGFVVTEAGFDFTMGGERFFNIKCRSSGLAPDVVVIVATVRALKSHGGGPEVKAGAPLPKEYTEENVELLREGCKNLGKHIENARQYGLPVVVAINEFVSDTAAEHDVIREEALKYGAEDAVVAKHWAEGGAGAVDLAQAVVDASNKIDKDFKLLYEADTTAEEKLNTIAQKMYGAKDVELSELARKKIDAYTKQGFGNLPICVAKTQYSLSHDPTLKGVPTGFTVPIRDVRASVGAGYLYALAAEIQTIPGLPTHCGFMNVEVNDKGEIEGLF

SEQ ID NO: 16268 - DNA, 1611 bp, Thermoplasma acidophilum
  CDS (1)..(1611)
atgagggatatagaggaaattataaaggaaattggccttggaagagatgattatgaactgtacggcagatacatggccaagctggatcttggcctgcagaacagaggaaggcccagggcgaagctgatactggtcacggccatgaccccgacaccagctggagaaggcaagaccacgacaaccataggtctcggtcaggcaatgaagaagcttggcaagaatgtggccatagcgatcagggaaccatcacttggcccatgctttggcataaagggaggtgcaaccggaggcggaaaatcaaaggtcgaacctagcgacagaataaacctgttcttcacgggagacttcccgacgataaccgcagcacacaacctgctgtcagcaatgataaacaaccacatgtaccatggaaacgaactcaacctggatcccaagaggataactttccccagaacgatagacatgaacgacagatccctgcgcagcatactggtcggtgtgggtcccagggacatgggcgtccttgcaggcgacagcttcgtcataacgcctgcgagcgaggtcatggcgataaccggcctctcactcaattaccaggatctcaaggcaaggctttcaaggatacttgccggcttcacaaccaagaataagcctgtatttgccggagatctcaaagccgagggatcgatggccgcgcttctaagggatgccctaaagcccaatctcgtccagacaacagagggtgtccctgctttcgttcacactggcccattcggcaacatcgcccatggaacctcaagcctcgtagcggacaagatagcgctgaacctcttcgattacgtgatcacggaggcgggcttcgggtccgatcttggcgcagagaagttctttaacctggcctccagaattggcgatctccccataaacgcggtggtacttgtggcaacaataagggccataaagcaccacgggggcagcaagaaggaaggcgaggacatagacgccgtaaagaccggatctaaaaacctcataaggcatgtccagaacatcagaaacttcggaatagatccagtggtcgcagtcaaccgcttcccgacggacacggatggagagataagggcgctgggagagatcctcgattccaacggcatcaaatgggcactttcagaggtgttcgcaaagggaggagagggcggcattgacctggcaaacaaggttcttgcttccctgggcagccacgaaataaagaggacatacgacctgaaggacgacataaggaccaagatcgagaagatagcaaggaacgtgtacggcgctgatggagtcatattcgaaaagaaggccctgtcagatatgaagaaggctgaggagatcatggagaatccgtacgtgtgcatggccaagacgcagtactcgttcagcgatgatgcctcccttctcaacgatccgcatggcttcacgataaaggttcagagcatcaacatatcctccggtgcgggcttcgttgtgccaatactcggcgagataatgacgatgcctggccttccaaagcacccggccgcggagaacatcgatcttaccgattccggagagatcacaggcctgttctga

SEQ ID NO: 16269 - protein, 536 aa, Thermoplasma acidophilum
MRDIEEIIKEIGLGRDDYELYGRYMAKLDLGLQNRGRPRAKLILVTAMTPTPAGEGKTTTTIGLGQAMKKLGKNVAIAIREPSLGPCFGIKGGATGGGKSKVEPSDRINLFFTGDFPTITAAHNLLSAMINNHMYHGNELNLDPKRITFPRTIDMNDRSLRSILVGVGPRDMGVLAGDSFVITPASEVMAITGLSLNYQDLKARLSRILAGFTTKNKPVFAGDLKAEGSMAALLRDALKPNLVQTTEGVPAFVHTGPFGNIAHGTSSLVADKIALNLFDYVITEAGFGSDLGAEKFFNLASRIGDLPINAVVLVATIRAIKHHGGSKKEGEDIDAVKTGSKNLIRHVQNIRNFGIDPVVAVNRFPTDTDGEIRALGEILDSNGIKWALSEVFAKGGEGGIDLANKVLASLGSHEIKRTYDLKDDIRTKIEKIARNVYGADGVIFEKKALSDMKKAEEIMENPYVCMAKTQYSFSDDASLLNDPHGFTIKVQSINISSGAGFVVPILGEIMTMPGLPKHPAAENIDLTDSGEITGLF

SEQ ID NO: 16270 - DNA, 2808 bp, Homo sapiens
  CDS (1)..(2808)
atggcgccagcagaaatcctgaacgggaaggagatctccgcgcaaataagggcgagactgaaaaatcaagtcactcagttgaaggagcaagtacctggtttcacaccacgcctggcaatattacaggttggcaacagagatgattccaatctttatataaatgtgaagctgaaggctgctgaagagattgggatcaaagccactcacattaagttaccaagaacaaccacagaatctgaggtgatgaagtacattacatctttgaatgaagactctactgtacatgggttcttagtgcagctacctttagattcagagaattccattaacactgaagaagtgatcaatgctattgcacccgagaaggatgtggatggattgactagcatcaatgctgggagacttgctagaggtgacctcaatgactgtttcattccttgtacgcctaagggatgcttggaactcatcaaagagacaggggtgccgattgccggaaggcatgctgtggtggttgggcgcagtaaaatagttggggccccgatgcatgacttgcttctgtggaacaatgccacagtgaccacctgccactccaagactgcccatctggatgaggaggtaaataaaggtgacatcctggtggttgcaactggtcagcctgaaatggttaaaggggagtggatcaaacctggggcaatagtcatcgactgtggaatcaattatgtcccagatgataaaaaaccaaatgggagaaaagttgtgggtgatgtggcatacgacgaggccaaagagagggcgagcttcatcactcctgttcctggcggcgtagggcccatgacagttgcaatgctcatgcagagcacagtagagagtgccaagcgtttcctggagaaatttaagccaggaaagtggatgattcagtataacaaccttaacctcaagacacctgttccaagtgacattgatatatcacgatcttgtaaaccgaagcccattggtaagctggctcgagaaattggtctgctgtctgaagaggtagaattatatggtgaaacaaaggccaaagttctgctgtcagcactagaacgcctgaagcaccggcctgatgggaaatacgtggtggtgactggaataactccaacacccctgggagaagggaaaagcacaactacaatcgggctagtgcaagcccttggtgcccatctctaccagaatgtctttgcgtgtgtgcgacagccttctcagggccccacctttggaataaaaggtggcgctgcaggaggcggctactcccaggtcattcctatggaagagtttaatctccacctcacaggtgacatccatgccatcactgcagctaataacctcgttgctgcggccattgatgctcggatatttcatgaactgacccagacagacaaggctctctttaatcgtttggtgccatcagtaaatggagtgagaaggttctctgacatccaaatccgaaggttaaagagactaggcattgaaaagactgaccctaccacactgacagatgaagagataaacagatttgcaagattggacattgatccagaaaccataacttggcaaagagtgttggataccaatgatagattcctgaggaagatcacgattggacaggctccaacggagaagggtcacacacggacggcccagtttgatatctctgtggccagtgaaattatggctgtcctggctctcaccacttctctagaagacatgagagagagactgggcaaaatggtggtggcatccagtaagaaaggagagcccgtcagtgccgaagatctgggggtgagtggtgcactgacagtgcttatgaaggacgcaatcaagcccaatctcatgcagacactggagggcactccagtgtttgtccatgctggcccgtttgccaacatcgcacatggcaattcctccatcattgcagaccggatcgcactcaagcttgttggcccagaagggtttgtagtgacggaagcaggatttggagcagacattggaatggaaaagttttttaacatcaaatgccggtattccggcctctgcccccacgtggtggtgcttgttgccactgtcagggctctcaagatgcacgggggcggccccacggtcactgctggactgcctcttcccaaggcttacatacaggagaacctggagctggttgaaaaaggcttcagtaacttgaagaaacaaattgaaaatgccagaatgtttggaattccagtagtagtggccgtgaatgcattcaagacggatacagagtctgagctggacctcatcagccgcctttccagagaacatggggcttttgatgccgtgaagtgcactcactgggcagaagggggcaagggtgccttagccctggctcaggccgtccagagagcagcacaagcacccagcagcttccagctcctttatgacctcaagctcccagttgaggataaaatcaggatcattgcacagaagatctatggagcagatgacattgaattacttcccgaagctcaacacaaagctgaagtctacacgaagcagggctttgggaatctccccatctgcatggctaaaacacacttgtctttgtctcacaacccagagcaaaaaggtgtccctacaggcttcattctgcccattcgcgacatccgcgccagcgttggggctggttttctgtaccccttagtaggaacgatgagcacaatgcctggactccccacccggccctgtttttatgatattgatttggaccctgaaacagaacaggtgaatggattattctaa

SEQ ID NO: 16271 - protein, 935 aa, Homo sapiens [sequence omitted]

SEQ ID NO: 16272 - DNA, 1914 bp, Spinacia oleracea
  CDS (1)..(1914)
atgggaggttcatcgaaaacggtgaggaagttagaggtggcgacaccggtaccggcggacattgacatagcaaatgcggtggagccgcttcatatcgctgatattgccgccgatctcaatctctctcctcgtcactacgacctttatggcaaatacaaggccaaggttttgctgtctgtgttggatgaagttcaagaaacccaggatggatattacgtcgtggttggtggaattactcctactcctctcggggaaggcaaatctaccaccactgttggtctttgtcaagccttgggagctttccttgataagaaggttgtcacttgccttcgtcaaccatcacaagggccaacttttggaataaaaggtggtgcagctggtggtggttatagtcaagtgattccaatggatgagttcaaccttcacttaactggggatatacatgctataacagcttcaaacaatcttctcgctgctgccatagacaccagaatgttccatgagtccacccagtcagataaagctctctttaaccgtttgtgcccccctaacaaagaaggtaaaagaaccttttgtaacattatgcacaggcgtttgaaaaagcttggtattgataagactaatccagacgaccttacaccggaagaggtcacaaaatttgctaggcttgatattgaccccgattccattacatggagaagagttatggatgtgaatgaccggtttttgaggaaaattagtgttggtcaggggcctgatgagaaggggatggtaagagaaactggatttgatatttccgttgctagtgagataatggcagttctggctctaacaacttctctggctgatatgagggagagacttgggaaaatggtgattggaaatagcaaggctggagaaccgattactgctgatgatcttggcttaggtggtgctttgactgtattaatgaaggatgcaatcaaccccacgctgatgcagactctggaaggaacacctgtgcttgttcatgctggtccttttgcaaatattgctcatggtaattcctctattgttgctgacaagattgccctgaagctggttggacctggtgggtttgtggttactgaagcagggtttggttctgatatcggaactgagaagttcatgaacataaagtgccgatatagtggtttgactccacagtgtgctattgttgttgcgacagtgagggctttgaaaatgcatggtggtggaccacaagtagtggctggcaagcctcttgatcgtgcatacttaacagagaatgtgggtcttgttgaggctggctgtgttaatcttgccaggcatattataaatacgaaggcctatggttcaaatgtcgtggttgccatcaacatgttttcttctgacacagaagcagagctgaatgctgttaaaaaagcagcaatggatgctggagcgtttgacgcagttatttgtacccatcacgcccatggtggaaaaggagcggtggatcttggcatagctgttcagaaagcatgtgagaacgtaacgcagcctttgaggttcttatatcctctggatattagcatcaaagagaaaatagaggcaattgcaaagtcttatggtgctgctggcgtcgaatactcagaacaggctgagaaaaagattgagatgtacagcaagcaagggttctccaatcttccaatatgcatggcaaaaacgcaatattcattttcccacaatgctgctgaaaagggagctccaagcggatttatcttgcctattcgggatgttagaggtagcatcggagctggattcatttacccgttggtaggaaccatgagtacaatgcctgggctcccaacaaggccgtgcttctttgatattgatctcgacactacaacagggaaggttatcggtctttcttag

SEQ ID NO: 16273 - protein, 637 aa, Spinacia oleracea
MGGSSKTVRKLEVATPVPADIDIANAVEPLHIADIAADLNLSPRHYDLYGKYKAKVLLSVLDEVQETQDGYYVVVGGITPTPLGEGKSTTTVGLCQALGAFLDKKVVTCLRQPSQGPTFGIKGGAAGGGYSQVIPMDEFNLHLTGDIHAITASNNLLAAAIDTRMFHESTQSDKALFNRLCPPNKEGKRTFCNIMHRRLKKLGIDKTNPDDLTPEEVTKFARLDIDPDSITWRRVMDVNDRFLRKISVGQGPDEKGMVRETGFDISVASEIMAVLALTTSLADMRERLGKMVIGNSKAGEPITADDLGLGGALTVLMKDAINPTLMQTLEGTPVLVHAGPFANIAHGNSSIVADKIALKLVGPGGFVVTEAGFGSDIGTEKFMNIKCRYSGLTPQCAIVVATVRALKMHGGGPQVVAGKPLDRAYLTENVGLVEAGCVNLARHIINTKAYGSNVVVAINMFSSDTEAELNAVKKAAMDAGAFDAVICTHHAHGGKGAVDLGIAVQKACENVTQPLRFLYPLDISIKEKIEAIAKSYGAAGVEYSEQAEKKIEMYSKQGFSNLPICMAKTQYSFSHNAAEKGAPSGFILPIRDVRGSIGAGFIYPLVGTMSTMPGLPTRPCFFDIDLDTTTGKVIGLS

SEQ ID NO: 16274 - DNA, 1671 bp, Streptococcus mutans
  CDS (1)..(1671)
atgaaaacagatattgaaattgcacaaagtgttgacttgcgacccattacaaatgttgttaaaaagttaggatttgactttgatgatcttgaactttatggtaaatataaggctaaattgacttttgataagattaaagcggttgaagaaaatgcacccggaaaacttgtcttagtaacagctattaatccaacgccggctggtgaagggaaatcaacaattaccatcgggcttgcagatgcccttaataaaatcggcaagaaaacaatgattgctattcgtgaaccttcccttggtccggttatgggcattaaaggcggcgctgctggtggtggttacgctcaagttttaccaatggaagatatcaatttgcattttacaggtgatatgcatgctattacgacagctaataatgctctttcagctcttattgacaaccatctgcatcagggaaacgaattgggcatagatcaacgtcggattatttggaagcgcgttgtcgatttaaatgaccgtgctcttcgtcatgttacagttggtttaggcagccctataaatggcattccacgtgaggatggttttgatatcactgtagcatctgaaatcatggctatcctttgtttggcaacgaatgttgaagatctaaaagaacgcttggccaacatcgtcattggttatcgttttgatcgtagtccggtttacgttcgtgatttagaagtgcaaggagcactggctcttatcctaaaagaggctatcaagcctaacttagtacaaacgatttatggaacacctgcttttgtccacggcggtcctttcgccaatatcgctcatggctgcaattccgtccttgcaacttcaacagctcttcgtttagcggattatactataacagaagctggtttcggagctgatcttggtgctgaaaaattccttgatatcaaagcaccaaacttaccgacaagccctgatgcggtagttatcgttgcaactattcgtgccctgaagatgaatggtggtgtggctaaagatgctcttaatcaagaaaatgttgaagcggtcaaggctggttttgccaatttagcacgtcatgttgaaaatatgcgtaaatatggcgttcctgtagtagtagctatcaatgaatttatcacagatacgaacgatgaaattgctgttcttcgtaacttgtgtgcggctatcgatgtacctgttgaattagccagtgtctgggctaacggggctgatggcggtgtagacttggcaaatacgcttatcaataccattgaaaataatccatcccattataaacgtctttatgataataatctttcagttgaagaaaaagtcactgagattgccaaggaaatctaccgtgctgataaagttatttttgaaaagaaagctaaaacacaaattgcccaaattgttaaaaatggttgggataacttaccaatttgtatggctaagacacagtacagtttttcagacgatccgaaattactgggtgccccaactggctttgatattactattcgtgaattggttcccaagttgggtgcaggttttatcgttgcacttacaggagatgtcatgaccatgcctggattgccaaaaaaaccagcagctcttaatatggatgttgctgcagatggaacagcccttggcttgttctaa

SEQ ID NO: 16275 - protein, 556 aa, Streptococcus mutans
MKTDIEIAQSVDLRPITNVVKKLGFDFDDLELYGKYKAKLTFDKIKAVEENAPGKLVLVTAINPTPAGEGKSTITIGLADALNKIGKKTMIAIREPSLGPVMGIKGGAAGGGYAQVLPMEDINLHFTGDMHAITTANNALSALIDNHLHQGNELGIDQRRIIWKRVVDLNDRALRHVTVGLGSPINGIPREDGFDITVASEIMAILCLATNVEDLKERLANIVIGYRFDRSPVYVRDLEVQGALALILKEAIKPNLVQTIYGTPAFVHGGPFANIAHGCNSVLATSTALRLADYTITEAGFGADLGAEKFLDIKAPNLPTSPDAVVIVATIRALKMNGGVAKDALNQENVEAVKAGFANLARHVENMRKYGVPVVVAINEFITDTNDEIAVLRNLCAAIDVPVELASVWANGADGGVDLANTLINTIENNPSHYKRLYDNNLSVEEKVTEIAKEIYRADKVIFEKKAKTQIAQIVKNGWDNLPICMAKTQYSFSDDPKLLGAPTGFDITIRELVPKLGAGFIVALTGDVMTMPGLPKKPAALNMDVAADGTALGLF

SEQ ID NO: 16276 - DNA, 3003 bp, Drosophila melanogaster
  CDS (199)..(3003)
taccaaatgggaacacacccttgttaatagtatcgaataactatcgactgctgttccacctccagcaaaaacgtgtgtttttgttgcgctgctatttgtttaatttaatttttaagttgaaacaattatgtcggcgcaatatcaaagattcctgaaagtactagaaaagtggccagcggagaaatcaaaagtcggcagatgagtggggccaagatcatatcgggcacggcggtggccaaatccattcgcgaagagctgcgtaacgaggtgacggctatgagcaagcaattggcggattttgtgcccggcttaaggattgtccaggttggtggacgtgaggactccaacgtttacatccgcatgaagatcaaggcggctacggagatcggtatcgatgccgcccacgtccagctgccccgatccatcaccgaggtggaattgctcgataagataaacgatctgaacgaggacccccgggtgcacggcatcatagtgcaaatgcccctggattgtgacacacccatcgattcgcaccgaattacggacgccgtttccccggagaaggatgttgacggcttgcacacggttaacgaaggtcgcctggccatcggtgaccttggtggtttcctgccctgcactccttggggttgcctggagttaattcgccgttctggagtagagatcgccggagccagggctgtggttctgggacgcagcaagatcgtgggcactcccgccgccgaactgctcaagtgggccaatgccacggtcacagtgtgccactcaaagacccgcaacctggaggagatcacccgaagtgcagacattctggtggtcggaattggagtggccgagatggttaagggatcgtggataaagcccggagcagtggtcatcgattgcggcatcaatgtgaagccagacgccagcaaggccagtggcagcaagctggtcggggacgtggactacgcggaagctctccaagtggcaggacatttgacgccagtgcccggcggcgtgggacccatgacggtggccatgcttatgaaaaacaccgtgcgatctgcggcccgattccttgagcgtcttgctaagagccagtgggcccttcaaacgctgcccctcaagccccagcgtcccgtgcccagcgatattgtgattgcccgtgcccaaaaaccgaaggacattgccgtgctggccaaggagattggtctggaagctcgtgaggtttccttgtacggaaataagaaggccaagatttcactgtcagtgttggagcgtctgaaggacaaggaggtgggtcactatgtggttgtagccggtatgacaccaacgcctttgggtgagggtaagaccaccacactaatgggcttggtccaggctctcggcgcgcacaagctgagaaacaccatggctgctctgcgacagccctcccaaggtccaacctttggcatcaaaggaggagctgctggcggcggatacgcccaggtgattcccatggaggagttcaatctccatctgacaggagacattcatgcggtatcggcagccaataacttgctggccgcccagctggacacccgcatcttccacgagaatacccaaaaggacaaggccttgtatgacagattggtgcccgcgatcaagggtcagcggaaattcagccccattcagctacgccggctccagaaattgggaatcaccaaaaccgatcccgatacccttaccgctgacgaatacggaccttttgcccggctggacatcgatccggacacgattatgtgggagcgtgtggtggacatcaacgatcggtacctacgcaccattaccgttgggcaatcgcccactgaaaagggtatttcgagggagacccggttctccatctcggtggccagcgagatcatggctgtgctagcactatcccgaagtctggaggacatgaagcagcggctggctgacatggtggtggcattcgacaaacgaggcaagcccgtaaccgctgacgatttgggtgtcaccggtgccctggcagttcttttgaaggacgctctcgagccgaacctgatgcagtcgctcgagggaactccagtgctggtgcacgctggtccctttgccaacatcgcccacggttgcaactcgatcatcgctgatgaagtcggcctaaagctggttggtaaaaatggatttgtctgcacggaggccgggttcggatcagatattggcatggaaaagttttgcaacattaagtgtcggacatccggtcgcaagccgaacgccatggtgctggtagccactgtgagggccatcaagatgcacggcggcggagctcccgtcactcccggagcccccttgaacaagcagtacaccgaggagaacttggagctcgtccagaagggtctgcccaatctgctgcagcacatcgagaacggaaaggccttcggcatgccagtggtggtgagccttaatgctcattcagcagacaccccggcggagcatgagttggtcaaaaaggctgctctggaggcaggtgcattcgccgccgtagtctccactcactgggcggacggaggagccggagccgttcagctggccgatgccgtgatcaaggcctgcgaacagggcaatcaattccgattgctctacgatctggagctgccgctggtggataagatgaacaagatcgctacgacgatgtacggcgctggaaaggtggtgctctcgccggcggctgaggagaaggtcaaacgcctgacggatgcgggttttggcaatctacctatctgcatgtccaaagtctccggctccttcaccggcgatgccaaaatcaaaggcgcccccaagggcttcaccctggacgttgaggacgtatatgtttcagccggagccggctttgtggtcgccatgtgcggtgaggtcaccaaaatgccgggtcttcccacccgcccggcgatctacgatatcgatctgaatacggaaaccggagaaattgagggcctattttag

SEQ ID NO: 16277 - protein, 934 aa, Drosophila melanogaster
MSGAKIISGTAVAKSIREELRNEVTAMSKQLADFVPGLRIVQVGGREDSNVYIRMKIKAATEIGIDAAHVQLPRSITEVELLDKINDLNEDPRVHGIIVQMPLDCDTPIDSHRITDAVSPEKDVDGLHTVNEGRLAIGDLGGFLPCTPWGCLELIRRSGVEIAGARAVVLGRSKIVGTPAAELLKWANATVTVCHSKTRNLEEITRSADILVVGIGVAEMVKGSWIKPGAVVIDCGINVKPDASKASGSKLVGDVDYAEALQVAGHLTPVPGGVGPMTVAMLMKNTVRSAARFLERLAKSQWALQTLPLKPQRPVPSDIVIARAQKPKDIAVLAKEIGLEAREVSLYGNKKAKISLSVLERLKDKEVGHYVVVAGMTPTPLGEGKTTTLMGLVQALGAHKLRNTMAALRQPSQGPTFGIKGGAAGGGYAQVIPMEEFNLHLTGDIHAVSAANNLLAAQLDTRIFHENTQKDKALYDRLVPAIKGQRKFSPIQLRRLQKLGITKTDPDTLTADEYGPFARLDIDPDTIMWERVVDINDRYLRTITVGQSPTEKGISRETRFSISVASEIMAVLALSRSLEDMKQRLADMVVAFDKRGKPVTADDLGVTGALAVLLKDALEPNLMQSLEGTPVLVHAGPFANIAHGCNSIIADEVGLKLVGKNGFVCTEAGFGSDIGMEKFCNIKCRTSGRKPNAMVLVATVRAIKMHGGGAPVTPGAPLNKQYTEENLELVQKGLPNLLQHIENGKAFGMPVVVSLNAHSADTPAEHELVKKAALEAGAFAAVVSTHWADGGAGAVQLADAVIKACEQGNQFRLLYDLELPLVDKMNKIATTMYGAGKVVLSPAAEEKVKRLTDAGFGNLPICMSKVSGSFTGDAKIKGAPKGFTLDVEDVYVSAGAGFVVAMCGEVTKMPGLPTRPAIYDIDLNTETGEIEGLF

SEQ ID NO: 16278 - DNA, 1358 bp, Oryza sativa
  CDS (32)..(1219)
acacgttgcgctcgccgccgcttcgacggagatgggcggcgccgccgccgccgccgccgtggccctgctcgcggccactcgccggcgccccgctgcgggcccgctggcgttcctcctccctcgcgcggcccgcgcggggctccacgaggctgctgctccggcggcggaggaggagaaggggaggacccggaggaggcggaggaggaggagcagcagcagccgccttctcgggccggacatccccgacacctgggactcgcccccgcgcgccgcggcgcggccgtctcccccgagcggcgccggagttgattatgactccactgcgaccattattgatggcaagtctgtcgcggaagacataaggtttcagatcgctgaagaagttcgtcaaatgaaaaatgcagtggggcatgtgcctggcctagctgttgtattggtcggcgatagaagggactctgagtcatacgtgcgatacaaaattaagggctgtgaggaggttggaataaagtccttgttggcggagttgcctgggaactgtacggaagacgtagtggtggattctgtgtcaagattcaatgaagatccatctgttcatggcattcttgtgcaactacctctaccacagcatatggatgaagaaaggattctgagcgctattagcctagagaaggatgttgatggtttccatccattgaatgttggtaatcttgccctcagaagccggaagcctttatttgtgccctgtgctgcaaaggcttgccttgagttattgctccagtctgggattgaactcatggggaaacatgtcactgtgattgggagaagcaaagttgttgggttgcccacttctttacttttacagagacaccatgccactgttagtattatccatgctttcacaacaaatccagaagagattacccgtcaatctgatattgtgatctcagctgctggagtggccaatcttgtaagaggaagctggttgaagaaaggtgcagttgtgatcgatgttggaacaaacccaattgaggatccaaccagtgattacggctatcgattaactggagatgtctgcttcgaagaagctgtgaagttggcctctgctataactccagttcctggtggtgtgggaccggtgaccattgcgatgcttcttgcgaatacacttgactcagcgaaactagcttacggcttagctactgaatcccctgaattgtaatcttgcttcactttgcctttgtaaattacttttttttcccctttttatcgctcgttgctctcacttttggctgtttgagagctgggatgtaagtgtaacatacattttgctgaataaatattgtatgattagcatgtcc

SEQ ID NO: 16279 - protein, 395 aa, Oryza sativa
MGGAAAAAAVALLAATRRRPAAGPLAFLLPRAARAGLHEAAAPAAEEEKGRTRRRRRRRSSSSRLLGPDIPDTWDSPPRAAARPSPPSGAGVDYDSTATIIDGKSVAEDIRFQIAEEVRQMKNAVGHVPGLAVVLVGDRRDSESYVRYKIKGCEEVGIKSLLAELPGNCTEDVVVDSVSRFNEDPSVHGILVQLPLPQHMDEERILSAISLEKDVDGFHPLNVGNLALRSRKPLFVPCAAKACLELLLQSGIELMGKHVTVIGRSKVVGLPTSLLLQRHHATVSIIHAFTTNPEEITRQSDIVISAAGVANLVRGSWLKKGAVVIDVGTNPIEDPTSDYGYRLTGDVCFEEAVKLASAITPVPGGVGPVTIAMLLANTLDSAKLAYGLATESPEL

SEQ ID NO: 16280 - DNA, 876 bp, Oryza sativa
  CDS (1)..(876)
atggcgcagatcatcgacgggaaggcggtcgccgccgacatccgccgcgaggtcgccgccgacgtcgccgccctctcctccgcccacaacctcgtgcccgggctggcggtggtgatcgtggggagcaggaaggactcgcagacgtacgtgcagatgaagcgcaaggcgtgcgccgaggtcggcatccgctccgtcgacgtcgacctcgccgaggacatctccgaggcggcgctcgtcgccgaggtccaccgcctcaacgccgacccagccgtccatggcatacttgtccagcttccattgccaaagcatattaatgaggaaaagatattgaacgagatcagcttagagaaagatgttgatgggttccatcctctgaatattggcaagcttgcaatgaaaggcagagacccactgttcctaccatgcacgccgaagggatgcatggagctcctaacacggagcggagttaccatcaatgggaagcgagcggtcgtggttggccgcagcaacattgtcgggctacctgtatccctgcttcttctgaaggcggatgcgaccgtatccattgttcactcccggaccccaaaccctgaaagtattgtccgtgaagcagacattgtcattgcagcggctggccaggctatgatggtacattactggatcaaaccaggcgctgctgtcatcgacgttgggacgaactccatcagtgacccaaccaggaaatcggggtacagactcgtcggcgatgtggatttcgcagaggtgagcaaggttgctggtcacctgactccagtcccaggtggcgttggccccatgacggtggcgatgttgctgaagaacacggtggatggagcgaaacgtggtatagttcagtaa

SEQ ID NO: 16281 - protein, 291 aa, Oryza sativa
MAQIIDGKAVAADIRREVAADVAALSSAHNLVPGLAVVIVGSRKDSQTYVQMKRKACAEVGIRSVDVDLAEDISEAALVAEVHRLNADPAVHGILVQLPLPKHINEEKILNEISLEKDVDGFHPLNIGKLAMKGRDPLFLPCTPKGCMELLTRSGVTINGKRAVVVGRSNIVGLPVSLLLLKADATVSIVHSRTPNPESIVREADIVIAAAGQAMMVHYWIKPGAAVIDVGTNSISDPTRKSGYRLVGDVDFAEVSKVAGHLTPVPGGVGPMTVAMLLKNTVDGAKRGIVQ

SEQ ID NO: 16282 - DNA, 26 bp, Primer
atgttgtcgagactatctttattgag

SEQ ID NO: 16283 - DNA, 26 bp, Primer
ttaaaatagaccttcaatttcaccgt

SEQ ID NO: 16284 - DNA, 2280 bp, Escherichia coli K12
  CDS (470)..(1951)
gctgcatcagcacgaaattcttaaagccctggttacgtaccagtgacataccgataactgacgtgaatataaccagcacgagggtcagcaatacccccaatacatgggcaacctgaataaagattgaaatctcaatatagacataaaggaaaatggcaataaaaggtaaccagcgcaaaggtttctcctgtaatagcagccggttaaccccggctacctgaatgggttgcgaatcgcgtttagcttatattgtggtcattagcaaaatttcaagatgtttgcgcaactatttttggtagtaatcccaaagcggtgatctatttcacaaattaataattaaggggtaaaaaccgacacttaaagtgatccagattacggtagaaatcctcaagcagcatatgatctcgggtattcggtcgatgcaggggataatcgtcggtcgaaaaacattcgaaaccacatatattctatgtgtttaaagcaaatcattggcagcttgaaaaagaaggttcacatgtcaaacaacattcgtatcgaagaagatctgttgggtaccagggaagttccagctgatgcctactatggtgttcacactctgagagcgattgaaaacttctatatcagcaacaacaaaatcagtgatattcctgaatttgttcgcggtatggtaatggttaaaaaagccgcagctatggcaaacaaagagctgcaaaccattcctaaaagtgtagcgaatgccatcattgccgcatgtgatgaagtcctgaacaacggaaaatgcatggatcagttcccggtagacgtctaccagggcggcgcaggtacttccgtaaacatgaacaccaacgaagtgctggccaatatcggtctggaactgatgggtcaccaaaaaggtgaatatcagtacctgaacccgaacgaccatgttaacaaatgtcagtccactaacgacgcctacccgaccggtttccgtatcgcagtttactcttccctgattaagctggtagatgcgattaaccaactgcgtgaaggctttgaacgtaaagctgtcgaattccaggacatcctgaaaatgggtcgtacccagctgcaggacgcagtaccgatgaccctcggtcaggaattccgcgctttcagcatcctgctgaaagaagaagtgaaaaacatccaacgtaccgctgaactgctgctggaagttaaccttggtgcaacagcaatcggtactggtctgaacacgccgaaagagtactctccgctggcagtgaaaaaactggctgaagttactggcttcccatgcgtaccggctgaagacctgatcgaagcgacctctgactgcggcgcttatgttatggttcacggcgcgctgaaacgcctggctgtgaagatgtccaaaatctgtaacgacctgcgcttgctctcttcaggcccacgtgccggcctgaacgagatcaacctgccggaactgcaggcgggctcttccatcatgccagctaaagtaaacccggttgttccggaagtggttaaccaggtatgcttcaaagtcatcggtaacgacaccactgttaccatggcagcagaagcaggtcagctgcagttgaacgttatggagccggtcattggccaggccatgttcgaatccgttcacattctgaccaacgcttgctacaacctgctggaaaaatgcattaacggcatcactgctaacaaagaagtgtgcgaaggttacgtttacaactctatcggtatcgttacttacctgaacccgttcatcggtcaccacaacggtgacatcgtgggtaaaatctgtgccgaaaccggtaagagtgtacgtgaagtcgttctggaacgcggtctgttgactgaagcggaacttgacgatattttctccgtacagaatctgatgcacccggcttacaaagcaaaacgctatactgatgaaagcgaacagtaatcgtacagggtagtacaaataaaaaaggcacgtcagatgacgtgccttttttcttgtgagcagtaacttaaaaataacaatctaatatcaacttgttaaaaaacaaggaaggctaatatgctagttgtagaactcatcatagttttgctggcgatcttcttgggcgccagattggggggaataggtattggttttgcaggcggattgggggtgctggttcttgccgctattggcgttaaacccggtaacatcccgttcgatgtcatctccattatcatggcggttatcgccgctatttctgccatgcaggttgctggcggtctggacta

SEQ ID NO: 16285 - protein, 493 aa, Escherichia coli K12
MCLKQIIGSLKKKVHMSNNIRIEEDLLGTREVPADAYYGVHTLRAIENFYISNNKISDIPEFVRGMVMVKKAAAMANKELQTIPKSVANAIIAACDEVLNNGKCMDQFPVDVYQGGAGTSVNMNTNEVLANIGLELMGHQKGEYQYLNPNDHVNKCQSTNDAYPTGFRIAVYSSLIKLVDAINQLREGFERKAVEFQDILKMGRTQLQDAVPMTLGQEFRAFSILLKEEVKNIQRTAELLLEVNLGATAIGTGLNTPKEYSPLAVKKLAEVTGFPCVPAEDLIEATSDCGAYVMVHGALKRLAVKMSKICNDLRLLSSGPRAGLNEINLPELQAGSSIMPAKVNPVVPEVVNQVCFKVIGNDTTVTMAAEAGQLQLNVMEPVIGQAMFESVHILTNACYNLLEKCINGITANKEVCEGYVYNSIGIVTYLNPFIGHHNGDIVGKICAETGKSVREVVLERGLLTEAELDDIFSVQNLMHPAYKAKRYTDESEQ

SEQ ID NO: 16286 - DNA, 1770 bp, Arabidopsis thaliana
  CDS (84)..(1559)
gtcgccacgcgccgacttgatccgtcgtcttctctcagtctccatctccgtcttccaagttttactgtcaggcagaagaatccatgtcgatttacgtcgcgtcggcactctccggcggaacaactgtgacggcgctgcgttatgccacctctctgagatcttattcgacctcgtttagggaggagagggacaccttcgggccgattcaagttccttccgataaattgtggggagcccagacgcagagatcgctgcagaacttcgaaatcggtggtgagcgcgagcgcatgcctgaaccaattgtccgcgcttttggcgtcttgaagaaatgcgctgccaaggttaacatggaatacggtcttgatccgacgattgggaaagcaattatgcaagctgctcaggaagtagctgagggaaagctcaatgatcatttcccccttgttgtctggcaaactggtagtgggactcagagtaatatgaatgctaatgaggtcattgctaatagagcagctgagattcttggtcgcaaacgtggtgagaaatgtgtgcacccaaatgaccatgtgaacagatcacaatcttctaacgacacttttcctaccgtcatgcacattgcagctgcaaccgagattaattcgaggctcatccctagtttaaaaactttgcatcgcactttggaatctaagtccttcgagttcaaagatattgtgaaaattggaagaactcacactcaagatgctacacctttgacactaggacaggaatttggtggctatgctactcaagttaagtacggactaaatagagtcacctgcactcttcctcgcctctatcagcttgcacaaggtggaactgcggttgggacaggattaaacactaagaaagggtttgatgtaaagatagctgctgcagtagctgaagaaacaaacttgccatttgtcactgcagaaaacaagtttgaagctctggctgcacacgatgcttgtgttgaaaccagtgggtcacttaacacaatcgccacatcgctgatgaagatcgccaatgatatacgttttcttggaagtggcccaagatgtggtcttggtgaacttgtactacctgaaaatgagccaggaagcagtatcatgcctgggaaggtaaatcctacacagtgtgaggccttgactatggtttgtgcacaggttatgggaaaccatgtagctgtgacagttggtgggtcaaatggtcatttcgaattgaatgtattcaagccggtgacgtcgagtgctcttttacattccgtcagattaatagcagatgcttcagcttcgttcgagaaaaactgtgtgaggggcattgaggccaacagagaaaggatctcaaagctattgcacgagtctcttatgcttgtgacatcattgaatcggaaaatcgggtgtgacaatgctgcagcagttgccaagaaagctcacaaagaaggatgtacattgaaggaagcggctctgaatttaggcgtgcttactgcggaagagtttgatacacttgttgttcctgagaagatgattggtccctccgattgatagttgtttttggagccaaagcttcaagtaccattattcttctgatgcttttatttaggttataataaaaatgagcaaatccagaaacaattcaaattttcttgggagggcaacattgttcttcatcttacggctaaactatgatcttctttatgtatcaattttttttttgtgttgaataagagagtgagtactcagcgagaagaatttc

SEQ ID NO: 16287 - protein, 491 aa, Arabidopsis thaliana
MSIYVASALSGGTTVTALRYATSLRSYSTSFREERDTFGPIQVPSDKLWGAQTQRSLQNFEIGGERERMPEPIVRAFGVLKKCAAKVNMEYGLDPTIGKAIMQAAQEVAEGKLNDHFPLVVWQTGSGTQSNMNANEVIANRAAEILGRKRGEKCVHPNDHVNRSQSSNDTFPTVMHIAAATEINSRLIPSLKTLHRTLESKSFEFKDIVKIGRTHTQDATPLTLGQEFGGYATQVKYGLNRVTCTLPRLYQLAQGGTAVGTGLNTKKGFDVKIAAAVAEETNLPFVTAENKFEALAAHDACVETSGSLNTIATSLMKIANDIRFLGSGPRCGLGELVLPENEPGSSIMPGKVNPTQCEALTMVCAQVMGNHVAVTVGGSNGHFELNVFKPVTSSALLHSVRLIADASASFEKNCVRGIEANRERISKLLHESLMLVTSLNRKIGCDNAAAVAKKAHKEGCTLKEAALNLGVLTAEEFDTLVVPEKMIGPSD

SEQ ID NO: 16288 - DNA, 1512 bp, Arabidopsis thaliana
  CDS (1)..(1479)
atgtcgatttacgtcgcgtcgcgacggctctccggcggaacaactgtgacggcgctgcgttatgccacctctctgagatcttattcgacctcgtttagggaggagagggacaccttcgggccgattcaagttccttccgataaattgtggggagcccagacgcagagatcgctgcagaacttcgaaatcggtggtgagcgcgagcgaatgcctgaaccaattgtccgcgcttttggcgtcttgaagaaatgcgctgccaaggttaacatggaatacggtcttgatccgacgattgggaaagcaattatgcaagctgctcaggaagtagctgagggaaagctcaatgatcatttcccccttgttgtctggcaaactggtagtgggactcagagtaatatgaatgctaatgaggtcattgctaatagagcagctgagattcttggtcgcaaacgtggtgagaaatgtgtgcacccaaatgaccatgtgaacagatcacaatcttctaacgacacttttcctaccgtcatgcacattgcagctgcaaccgagattaattcgaggctcatccctagtttaaaaactttgcatagcactttggaatctaagtccttcgagttcaaagatattgtgaaaattggaagaactcacactcaagatgctacacctttgacactaggacaagaatttggtggctatgctactcaagttaagtatggactaaatagagtcacctgcactcttcctcgcctctatcagcttgcacaaggtggaactgcggttgggacaggattaaacactaagaaagggtttgatgtaaagatagctgctgcagtagctgaagaaacaaacttgccatttgtcactgcagaaaacaagtttgaagctctggctgcacacgatgcttgtgttgaaaccagtgggtcacttaacacaatcgccacatcgctgatgaagatcgccaatgatatacgttttcttggaagtggcccaagatgtggtcttggtgaacttgtactacctgaaaatgagccaggaagcagtatcatgcctgggaaggtaaatcctacacagtgtgaggccttgactatggtttgtgcacaggttatgggaaaccatgtagctgtgacagttggtgggtcaaatggtcatttcgaattgaatgtattcaagccggtgatcgcgagtgctcttttacattccgtcagattaatagcagatgcttcagcttcgttcgagaaaaactgtgtgaggggcattgaggccaacagagaaagaatctcaaagctattgcacgagtctcttatgcttgtgacatcattgaatccgaaaatcgggtatgacaatgctgcagcagttgccaagaaagctcacaaagaaggatgtacattgaaggaagcggctctgaatttaggcgtgcttactgcggaagagtttgatacacttgttgttcctgagaagatgattggtccctccgattgatagttgtttttggagccaaagcttcaagtacca

SEQ ID NO: 16289 - protein, 492 aa, Arabidopsis thaliana
MSIYVASRRLSGGTTVTALRYATSLRSYSTSFREERDTFGPIQVPSDKLWGAQTQRSLQNFEIGGERERMPEPIVRAFGVLKKCAAKVNMEYGLDPTIGKAIMQAAQEVAEGKLNDHFPLVVWQTGSGTQSNMNANEVIANRAAEILGRKRGEKCVHPNDHVNRSQSSNDTFPTVMHIAAATEINSRLIPSLKTLHSTLESKSFEFKDIVKIGRTHTQDATPLTLGQEFGGYATQVKYGLNRVTCTLPRLYQLAQGGTAVGTGLNTKKGFDVKIAAAVAEETNLPFVTAENKFEALAAHDACVETSGSLNTIATSLMKIANDIRFLGSGPRCGLGELVLPENEPGSSIMPGKVNPTQCEALTMVCAQVMGNHVAVTVGGSNGHFELNVFKPVIASALLHSVRLIADASASFEKNCVRGIEANRERISKLLHESLMLVTSLNPKIGYDNAAAVAKKAHKEGCTLKEAALNLGVLTAEEFDTLVVPEKMIGPSD

SEQ ID NO: 16290 - DNA, 1500 bp, Arabidopsis thaliana
  CDS (1)..(1500)
atggccgctttgacaatgcagtttgaaggagagaagaaaaacgtatccgaagttgcagacgtaaccctcaagcaagaagatgaacaacaagaacgtagatcttattcgacgccgtttagggaagagagagacacctttggcccgatccaagttccttccgataaattatggggagcacagacgcagagatcgcttcagaacttcgagattggtggtgaccgcgagcgaatgcccgaaccaatcgtccgagcttttggtgtcttgaagaaatgtgctgccaaggttaacatggagtatggtcttgatccaatgattggggaagccataatggaagctgcacaagaagtagcagaaggaaagctcaatgatcatttccctcttgttgtatggcaaactggtagtgggacgcagagtaatatgaatgctaatgaggtcattgccaatagagcagctgagattcttggtcacaaacgtggtgaaaaaattgtgcacccaaatgaccatgtgaacagatcacaatcttctaatgacacttttccaactgtcatgcacattgcagctgcaaccgagattacttcgaggctaatccctagtttgaaaaatttgcatagctctttggaatctaagtccttcgagtttaaagatatagtgaaaatcggaagaactcatactcaagatgctacacctttgacattaggacaagaatttggtggctatgctactcaagttgagtatggacttaatagagtcgcatgtactctaccccgcatctatcagcttgcacaaggtggaactgctgttgggaccggattaaacactaagaaagggtttgatgtaaagatcgctgctgcagtagctgaagaaacaaacttgccattcgtcaccgcagaaaacaagtttgaagctctggctgcacacgatgcttgtgttgaaacaagtggatctcttaacacaatcgccacatcattgatgaagattgccaatgatatacgttttcttggaagtggtccaagatgtggtcttggtgaactttctctgcctgagaatgaaccaggaagcagtattatgcctggaaaggtaaatcctacacagtgtgaggccttgactatggtttgtgctcaagttatgggaaaccatgtagccgtgacaattggtgggtcgaatggtcattttgaattgaatgtattcaagccggttatcgcaagcgctctcttacattccattagactaatagcagatgcttcagcttcatttgagaaaaactgtgttagaggcattgaggccaacagagaaaggatctcaaagctattgcacgagtctcttatgcttgtgacatcattgaatcctaaaattggctatgacaatgctgcagcagtagccaaaagagctcacaaagaaggatgcacattaaagcacgcagctatgaagttaggtgttcttacttcggaagagtttgatactcttgttgttcccgagaagatgattggtccatctgattaa

SEQ ID NO: 16291 - protein, 499 aa, Arabidopsis thaliana
MAALTMQFEGEKKNVSEVADVTLKQEDEQQERRSYSTPFREERDTFGPIQVPSDKLWGAQTQRSLQNFEIGGDRERMPEPIVRAFGVLKKCAAKVNMEYGLDPMIGEAIMEAAQEVAEGKLNDHFPLVVWQTGSGTQSNMNANEVIANRAAEILGHKRGEKIVHPNDHVNRSQSSNDTFPTVMHIAAATEITSRLIPSLKNLHSSLESKSFEFKDIVKIGRTHTQDATPLTLGQEFGGYATQVEYGLNRVACTLPRIYQLAQGGTAVGTGLNTKKGFDVKIAAAVAEETNLPFVTAENKFEALAAHDACVETSGSLNTIATSLMKIANDIRFLGSGPRCGLGELSLPENEPGSSIMPGKVNPTQCEALTMVCAQVMGNHVAVTIGGSNGHFELNVFKPVIASALLHSIRLIADASASFEKNCVRGIEANRERISKLLHESLMLVTSLNPKIGYDNAAAVAKRAHKEGCTLKHAAMKLGVLTSEEFDTLVVPEKMIGPSD

SEQ ID NO: 16292 - DNA, 1865 bp, Solanum tuberosum
  CDS (66)..(1547)
ctcagactcagcatcaacattcccaccaactcgcatacaggcggcggcgcattgactgctgagatatggcgatgttaaatgcggctcgtcgattatcagctggatcagctttatcagattcactgcgttatacttcttcctggaggtttttctctacgtctttcagggaggaaagagatacgtttggtcctattctcgttccatcggacaagttatggggggctcaaactcaaagatcattgcagaattttgaaattgggggtgatcgtgaaagaatgcctgagccaatcatacgtgcattcggtattattaaaaagtgtgcagccaaggtgaacatggactatggccttgaccaatctattggaaaagcaataatgcaagcagctgaagaggttgcagaaggaaaattaaatgaccattttcctttggtggtttggcagactggcagtggcactcaaagtaacatgaatgctaacgaggttattgcaaatcgagcagctgaaatacttggccataaccgcggagacaaacatgtgcatccaaatgaccatgtaaataaatcgcaatcttcaaatgatactttctctacggtgatgcacattgctgcagcaatggagctaaataaaagattagtaccaaaccttgaaacagttgcatactcactaaattcaaagtcagtcgaattcaaggacattatcaagattgggcgaacccacacacaagatgcaacacctttgactcttggacaagagtttagtggctatgcaactcaagtgaaatatggaatcgatagagtcttatgcacgcttcagcgcatgtatcagctcgcacaagggggcacagcagtagggacaggattgaatacaaagaaagggtttgacataaaaattgctgcagcagttgcagaggaaacaaatttcccatttgttacagctgaaaacaagtttgaagcattggctgctcatgatgcatttgctgaaactagtggagccttaaataccctggctgcttcccttatgaagattgggaatgatatacgcttcttgggaagtggtccccgctgtggtcttggcgagctcagtcttcctgaaaatgaacccggaagcagtataatgcctggcaaggtaaatcctactcagtgtgaggctctcaccatggtctgtgctcaggttatggggaatcatgtggctgttactgttggtgcatcaaatggccattttgagctgaatgtcttcaagccgatgattgctaatgctctcctacattcagtaagattgctaggcgatgcatctgcttcctttgaaaagaattgtgtgagggatatccaagctaacagagacagaattgctaaattgttgcacgagtcactcatgctcgttacatgtttgaacccaaaaattggttatgataatgctgctgcagttgccaagaaagcccacaaggagggaaccagtttgaaggaagctgctctcaatctaggagtcctcaccagtgaagagtttgatcaacttgtagtccctgagaaaatgattggtccaactgactgatctgattcattagctcttcgaaatgagaaagaggaccatggctagcttcttctgtccatcagattcgaacgagggaaataaacatttgacacaattcttgaggttttcttattcctggtaatttatcagtgttttttactgtgagaatgcctccatttttttttttgtaatgagtccctggagcgatagccaagtaaataatgaactgaattagtattttttatgaggttgggccatgaataatgagggagaaaatcatcttttatgaaatggagacggggaaatgatcaaaatggtcttatgtatgggttttgattc

SEQ ID NO: 16293 - protein, 493 aa, Solanum tuberosum
MAMLNAARRLSAGSALSDSLRYTSSWRFFSTSFREERDTFGPILVPSDKLWGAQTQRSLQNFEIGGDRERMPEPIIRAFGIIKKCAAKVNMDYGLDQSIGKAIMQAAEEVAEGKLNDHFPLVVWQTGSGTQSNMNANEVIANRAAEILGHNRGDKHVHPNDHVNKSQSSNDTFSTVMHIAAAMELNKRLVPNLETVAYSLNSKSVEFKDIIKIGRTHTQDATPLTLGQEFSGYATQVKYGIDRVLCTLQRMYQLAQGGTAVGTGLNTKKGFDIKIAAAVAEETNFPFVTAENKFEALAAHDAFAETSGALNTLAASLMKIGNDIRFLGSGPRCGLGELSLPENEPGSSIMPGKVNPTQCEALTMVCAQVMGNHVAVTVGASNGHFELNVFKPMIANALLHSVRLLGDASASFEKNCVRDIQANRDRIAKLLHESLMLVTCLNPKIGYDNAAAVAKKAHKEGTSLKEAALNLGVLTSEEFDQLVVPEKMIGPTD

SEQ ID NO: 16294 - DNA, 1616 bp, Arabidopsis thaliana
  CDS (44)..(1576)
acacgtttaataggcccgaagttgctatctagcagttgtagccatggccgctttgacaatgcagtttgaaggagagaagaaaaacgtatccgaagttgcagacgtaaccctcaagcaagaagatgaacaacaagaacgtagatcttattcgacgccgtttagggaagagagagacacctttggcccgatccaagttccttccgataaattatggggagcacagacgcagagatcgcttcagaacttcgagattggtggtgaccgcgagcgaatgcccgaaccaatcgtccgagcttttggtgtcttgaagaaatgtgctgccaaggttaacatggagtatggtcttgatccaatgattggggaagccataatggaagctgcacaagaagtagcagaaggaaagctcaatgatcatttccctcttgttgtatggcaaactggtagtgggacgcagagtaatatgaatgctaatgaggtcattgccaatagagcagctgagattcttggtcacaaacgtggtgaaaaaattgtgcacccaaatgaccatgtgaacagatcacaatcttctaatgacacttttccaactgtcatgcacattgcagctgcaaccgagattacttcgaggctaatccctagtttgaaaaatttgcatagctctttggaatctaagtccttcgagtttaaagatatagtgaaaatcggaagaactcatactcaagatgctacacctttgacattaggacaagaatttggtggctatgctactcaagttgagtatggacttaatagagtcgcatgtactctaccccgcatctatcagcttgcacaaggtggaactgctgttgggaccggattaaacactaagaaagggtttgatgtaaagatcgctgctgcagtagctgaagaaacaaacttgccattcgtcaccgcagaaaacaagtttgaagctctggctgcacacgatgcttgtgttgaaacaagtggatctcttaacacaatcgccacatcattgatgaagattgccaatgatatacgttttcttggaagtggtccaagatgtggtcttggtgaactttctctgcctgagaatgaaccaggaagcagtattatgcctggaaaggtaaatcctacacagtgtgaggccttgactatggtttgtgctcaagttatgggaaaccatgtagccgtgacaattggtgggtcgaatggtcattttgaattgaatgtattcaagccggttatcgcaagcgctctcttacattccattagactaatagcagatgcttcagcttcatttgagaaaaactgtgttagaggcattgaggccaacagagaaaggatctcaaagctattgcacgagtctcttatgcttgtgacatcattgaatcctaaaattggctatgacaatgctgcagcagtagccaaaagagctcacaaagaaggatgcacattaaaggtaaacaataaactattaacgttttcatcactaaataaatcggaatttaaacccatttttagcaagagaaaacatgttcatgtttgttacaatatatttgttgttctattttggatttaaaccttctccagtgaaaattatataatacaatacctttgag

SEQ ID NO: 16295 - protein, 510 aa, Arabidopsis thaliana
MAALTMQFEGEKKNVSEVADVTLKQEDEQQERRSYSTPFREERDTFGPIQVPSDKLWGAQTQRSLQNFEIGGDRERMPEPIVRAFGVLKKCAAKVNMEYGLDPMIGEAIMEAAQEVAEGKLNDHFPLVVWQTGSGTQSNMNANEVIANRAAEILGHKRGEKIVHPNDHVNRSQSSNDTFPTVMHIAAATEITSRLIPSLKNLHSSLESKSFEFKDIVKIGRTHTQDATPLTLGQEFGGYATQVEYGLNRVACTLPRIYQLAQGGTAVGTGLNTKKGFDVKIAAAVAEETNLPFVTAENKFEALAAHDACVETSGSLNTIATSLMKIANDIRFLGSGPRCGLGELSLPENEPGSSIMPGKVNPTQCEALTMVCAQVMGNHVAVTIGGSNGHFELNVFKPVIASALLHSIRLIADASASFEKNCVRGIEANRERISKLLHESLMLVTSLNPKIGYDNAAAVAKRAHKEGCTLKVNNKLLTFSSLNKSEFKPIFSKRKHVHVCYNIFVVLFWI

SEQ ID NO: 16296 - DNA, 1416 bp, Nostoc sp. PCC 7120
  CDS (1)..(1416)
atgactacaaatacagattttcgtattgaacgcgattcgatgggcgatcgccaaattgctagtgatgtttattacggtattcaaactctccgagccgttgaaaatttccccattagtggtcttaagcccttacctacttacgtagatgctggtcttttaattaaaaaagctacagcaattgtcaatggagaactaggttgtattccccaagatattagccaagcgattgtgcaagcaaccgatgaaattctggcagggaagttaagagatcagttcgtcgttgatgtctatcaagctggtgcaggcacatcccaccacatgaacattaacgaagtcctagcaaatcgggctttggaaattttgggtgcagaaaagggcaattaccaacgagttagccctaatgatcatgtgaactacgggcagtctaccaacgatgttattcccacagcaattcgcatcggtggcttattggcactgaccaaaacattacagccagcattagaaaaagcgatcgccgccttagaacacaaagctgtagaatttcaagatattgtcaaatctggcagaacccatttacaggatgccgttcccgtccgcttgggtgataatttcgccgcttgggcgcatatcctctcagaacatcaaaaccgcatttacactgcctctggagacttgatggtactcggtttaggtggtagtgcggcgggaacaggcttaaacacccatcctcaataccgcgcccgtgtggtggaagtactggcagaattactaaacttaccactccaacccgccccccatctcatggctgccatgcagagtatgtccccatttgtgaacgtttccggggcgatacgcaacctagcccaagacttagcgaaaatttcccacgacttgaggctgatggactccgggccaaaaactggtttaaaagaaattcaactacccccagtccaacccggttcctcaatcatgccaggcaaatataaccccgttatggcagagatgacatcgatggtgtgtttccaggtgatgggttacgatcaggcgatcgctcttgcagcccaagccggacaattagaattaaacgtgatgatgccgttgattgcctatgatttgatccacagcatcgaaattctggggtcaaccatcgccgcccttacagaacgctgcattcaaggaattaccgccaacaaagaacgctgtttagcctacgccgaaggcagtttagctttagttaccgccctcaacactcacattggttatttaaatgccgcagatgtcgccaaagaatccttaaacacaggaaaatctctaaggcagattgtgttagaaaaaggactgatgagcgaagcagagttagccaccgtgttaaatctagaagaaatgagtagtatattgccactccaaacagagtaa

SEQ ID NO: 16297 - protein, 471 aa, Nostoc sp. PCC 7120
MTTNTDFRIERDSMGDRQIASDVYYGIQTLRAVENFPISGLKPLPTYVDAGLLIKKATAIVNGELGCIPQDISQAIVQATDEILAGKLRDQFVVDVYQAGAGTSHHMNINEVLANRALEILGAEKGNYQRVSPNDHVNYGQSTNDVIPTAIRIGGLLALTKTLQPALEKAIAALEHKAVEFQDIVKSGRTHLQDAVPVRLGDNFAAWAHILSEHQNRIYTASGDLMVLGLGGSAAGTGLNTHPQYRARVVEVLAELLNLPLQPAPHLMAAMQSMSPFVNVSGAIRNLAQDLAKISHDLRLMDSGPKTGLKEIQLPPVQPGSSIMPGKYNPVMAEMTSMVCFQVMGYDQAIALAAQAGQLELNVMMPLIAYDLIHSIEILGSTIAALTERCIQGITANKERCLAYAEGSLALVTALNTHIGYLNAADVAKESLNTGKSLRQIVLEKGLMSEAELATVLNLEEMSSILPLQTE

SEQ ID NO: 16298 - DNA, 1437 bp, Salmonella enterica subsp. enterica serovar Typhi
  CDS (1)..(1437)
atgtcaaacaacattcgtatcgaagaagatctgttgggtaccagggaagttccagctgaagcctactatggtgttcacactctgagagcgattgaaaacttctacattagcaataacaaaatcagcgacatccctgaatttgtgcgtggcatggttatggtaaaaaaagcggcggcgctggccaacaaagagctgcaaaccattcctaagagtgtggcgaatgccatcattgccgcatgtgatgaagtccttaacaacggtaagtgcatggaccagttcccggtagatgtctaccagggcggcgcgggcacttccgtcaacatgaataccaacgaagtgctggccaacatcgggctggaactgatgggtcatcagaaaggtgaatatcagtacctgaacccgaacgaccacgtgaataaatgtcaatccactaacgacgcctatccgacaggcttccgtgtagcggtttacgcctctatcgtcaaactgatcgatgccatcaaccagttgcgtgaaggtttcgaacgtaaagcggttgaattccaggacatcctgaaaatgggtcgtacccagttgcaggacgccgtaccgatgacgcttggtcaagaattccgtgcgttcagcattctgctgaaagaagaagtgaaaagcatcgagcgtactgctgagctgctgctggaagtcaaccttggcgcaacggcaatcggtactggtctgaacacgccgaaagaatactctccgctggcggtgaaaaaactggctgaagtcactggtttcgcctgtgttccggctgaagatctgattgaggcgacatctgactgtggcgcgtatgttatggttcacagcgcgctgaaacgtctggcagtgaagatgtccaaaatctgtaacgacctgcgcttgctctcttctggtcctcgtgccggcctgaacgagatcaacctgccggaactgcaggcgggctcttccatcatgccagccaaagtgaacccggtagtaccggaagtcgtaaaccaggtatgctttaaagtcatcggtaacgacaccaccgttacgatggcggcggaagccggtcagttgcagttgaacgttatggagccggttatcggtcaggcgatgttcgaatccatccacattctgagcaacgcgtgctacaacctgctggaaaaatgcgttaacggcattaccgcgaataaagaagtgtgcgaagggtacgtttataactccatcggtatcgtcacttacctcaacccgttcatcggccaccacaacggcgacatcgtcggtaaaatctgtgctgaaaccggtaagagcgtacgtgaagttgtgctagagcgcggcctgttaacggaagccgagctggacgatattttctccgtacagaacttgatgcacccggcttataaagctaaacgttatactgatgaaagcgaacagtaa

SEQ ID NO: 16299 - protein, 478 aa, Salmonella enterica subsp. enterica serovar Typhi
MSNNIRIEEDLLGTREVPAEAYYGVHTLRAIENFYISNNKISDIPEFVRGMVMVKKAAALANKELQTIPKSVANAIIAACDEVLNNGKCMDQFPVDVYQGGAGTSVNMNTNEVLANIGLELMGHQKGEYQYLNPNDHVNKCQSTNDAYPTGFRVAVYASIVKLIDAINQLREGFERKAVEFQDILKMGRTQLQDAVPMTLGQEFRAFSILLKEEVKSIERTAELLLEVNLGATAIGTGLNTPKEYSPLAVKKLAEVTGFACVPAEDLIEATSDCGAYVMVHSALKRLAVKMSKICNDLRLLSSGPRAGLNEINLPELQAGSSIMPAKVNPVVPEVVNQVCFKVIGNDTTVTMAAEAGQLQLNVMEPVIGQAMFESIHILSNACYNLLEKCVNGITANKEVCEGYVYNSIGIVTYLNPFIGHHNGDIVGKICAETGKSVREVVLERGLLTEAELDDIFSVQNLMHPAYKAKRYTDESEQ

SEQ ID NO: 16300 - DNA, 1452 bp, Brucella melitensis
  CDS (1)..(1452)
atgacaaccctggaaaatattcatcccctgacacggcgcgagcaggattcccttggggagcgcgatattcccatggatgcctatttcggcatccagaccctacgggcagttgaaaacttctcgctttccgatgttgcgctgaaccatattcctgccctcgttcgcgcccttgcaatggtcaagaaagcggctgccaccgccaattacaagctgcggcagctgccggagcccaaatatgcggccatcgtcgccgcctgcgacaacatcattgacgggcttttgatggagcaattcgtcgtggatgtgtttcagggcggcgcgggcacctcaagcaatatgaacgcaaatgaggttatcgcaaaccgcgcccttgaacatctggggcggccgcgaggcgactaccagacgatccatcccaatgatgacgtcaacatgtcgcagtccaccaatgatgtgtatccaaccgcggtaaggctggcgcttcttctcagccagaaccaggttcagacggcgctgcaccggctgattgccgcctttgaagcaaaggggcgggaattcgcgacggtcatcaagatcgggcgcacacagttgcaggatgcggttccgatcactcttggacaggagttcgaggcatttgccgcaacgttgcgggaggacacagcccggctggaggaggttgccgcgcttttccgcgaagtaaacctcgatggaaccgctatcggcacgcgcatcaacgcctcgcacgcctatgccgaacaggccatcgcggaactttcgcagatttccggtatcgaactgaaagccgccggcaatctcgtggaagcgagctgggataccggtgcgttcgtcaccttttccgggatattgcgccggatcgcagtcaagctttccaagatcgccaacgatctgcggctactctcaagcgggccgcgaagcggccttggtgaaatccgcctgcctgcggttcagccgggatcgtcgatcatgccgggaaaggtcaatccggtcataccggaatcggtcaatcaggtctgctatcaggtgatcggcaatgacctaactgtaaccatggcagccgaaagcgggcaattgcagctcaacgcgttcgagccgctgatcgtctacaatatcctcagttccatgcgactgctcggccgcgccatgaccaatctggccgaacgttgcgtcgacggaatcgaagccaatgtggaacgctgtcgcgcaggcgcggaggaaagcatttcgcttgcaaccgccctcgtcccggtcgtgggctatgccagggcggcagagatcgccaagcaggcgcttgcctcagggcagaccgtcatggaagtggcgatttccaaggggctggacgcatctgcgctcacgataatgcttgaccccttgagaatggcattcccgccggaaacgcacgacaaggaggcacatcatgcatctgtcggctaa

SEQ ID NO: 16301 - protein, 483 aa, Brucella melitensis
MTTLENIHPLTRREQDSLGERDIPMDAYFGIQTLRAVENFSLSDVALNHIPALVRALAMVKKAAATANYKLRQLPEPKYAAIVAACDNIIDGLLMEQFVVDVFQGGAGTSSNMNANEVIANRALEHLGRPRGDYQTIHPNDDVNMSQSTNDVYPTAVRLALLLSQNQVQTALHRLIAAFEAKGREFATVIKIGRTQLQDAVPITLGQEFEAFAATLREDTARLEEVAALFREVNLDGTAIGTRINASHAYAEQAIAELSQISGIELKAAGNLVEASWDTGAFVTFSGILRRIAVKLSKIANDLRLLSSGPRSGLGEIRLPAVQPGSSIMPGKVNPVIPESVNQVCYQVIGNDLTVTMAAESGQLQLNAFEPLIVYNILSSMRLLGRAMTNLAERCVDGIEANVERCRAGAEESISLATALVPVVGYARAAEIAKQALASGQTVMEVAISKGLDASALTIMLDPLRMAFPPETHDKEAHHASVG

SEQ ID NO: 16302 - DNA, 1416 bp, Bacillus halodurans
  CDS (1)..(1416)
atgacagactatcgtgtagagcgagatttaattggtgaaaagaaagtaccgaaagaggcatattatggaattcaaacgatgagagcgagggaaaacttccccattacagggtatccccctcatgaggaattgattcgcgcctttggctttgtcaaaaaggctgctgcgatggcgaatcgggatgtaggggtgttgccagctaacattgtcgatgcgatcattaccgcagcagacgaagtgatcgaaggaacgttcaacgatcaatttatcgttgatgcgatccaaggtggtgcaggtacttcttttaatatgaatgcaaatgaagtgattgccaatcgtgcgattgaaatccttggaggagagaagggggaatacctccgcgtaagcccaaatactcacgtgaacatggcgcaatcgacaaacgatgctttcccgacagctattcatattgcctgtctttatttagccaaaggattaattcaatcactagaagacctgattgcagccattaaggaaaaggaacaacagtttgacgatgtgttaaaaatggggcgaacccatttacaggatgcagttccgatacggatgggacaagaatttggcgcttaccgccgcgtgctcactcgtgatttgggacgaatccgcagctcaattgatcatatgcatgaaattaatatgggggcgacagcagtagggacaggacttaacgcaaagcctgaatatatggaaaaagtggttgcctatttaagtgacattactgaatttccgttccgccatgcagcagatttagtggacgcgacgcaaaatacggatgcttacacagaattatcgagtgcgctgaaaattttggcgatcaatttatcaaaaatggcgaatgacatccgcttgatgagctctgggccacgcacggggttaaatgaaatcaaccttccaccgcgtcaaccagggtcgtcgatcatgccaggaaaggtaaatccagtaatggctgaagtgatcaaccaaatttcgttccaagtcatcggcaatgaccatacgattagcttagcgtcagaagctgggcagcttgaactaaacgttatggagccggttctcgtctttaacttacttcaatcgttatcgatcctgcaaaacgggatgaaggtgttccgtcagcacgcgattgaaggaatgacggccaacgtagagcgctgcaaagaaatggtggagagcagtgttgggatcattactgcgatcaacccccatgtaggatatgaaacagcctctcgaatcgcaaaggaagcgatccaaacagggcgtccagtacgagaaatttgtctagaacgagggattttaacagaagaggaactaaacgaaattttggatccgaaagaaatgacgaagcctggtattgctggggcaaggttcatttacggataa

SEQ ID NO: 16303 - protein, 471 aa, Bacillus halodurans
MTDYRVERDLIGEKKVPKEAYYGIQTMRARENFPITGYPPHEELIRAFGFVKKAAAMANRDVGVLPANIVDAIITAADEVIEGTFNDQFIVDAIQGGAGTSFNMNANEVIANRAIEILGGEKGEYLRVSPNTHVNMAQSTNDAFPTAIHIACLYLAKGLIQSLEDLIAAIKEKEQQFDDVLKMGRTHLQDAVPIRMGQEFGAYRRVLTRDLGRIRSSIDHMHEINMGATAVGTGLNAKPEYMEKVVAYLSDITEFPFRHAADLVDATQNTDAYTELSSALKILAINLSKMANDIRLMSSGPRTGLNEINLPPRQPGSSIMPGKVNPVMAEVINQISFQVIGNDHTISLASEAGQLELNVMEPVLVFNLLQSLSILQNGMKVFRQHAIEGMTANVERCKEMVESSVGIITAINPHVGYETASRIAKEAIQTGRPVREICLERGILTEEELNEILDPKEMTKPGIAGARFIYG

SEQ ID NO: 16304 - DNA, 1428 bp, Haemophilus influenzae
  CDS (1)..(1428)
atgattacaatgactcaatttagaaaagaagtagatttacttggcgaacgtgatgtgcctgcagaagcatattgggggattcatacattaagagcggtagaaaatttcaatatttctaacgtaaccatttctgacgtgcctgagtttgtgcgtggtatggtaatggtaaaaaaagcaacagctttagccaatggcgaattaggtgcaattccaagtgatattgcaaaagcgattgtagcagcttgtgatgaaattcttaccactggaaaatgcttagatcaattcccatcagacgtatatcaaggtggtgcaggtacgtctgtcaatatgaatactaatgaagtggttgctaatcttgcccttgaaaaaattggtcataaaaaaggcgaatataacgtgattaatccgatggatcacgttaatgcaagccaatcgaccaacgatgcgtatcctaccggtttccgtattgcggtgtacaacagcatcttaaaattgatcgataaaattcaatatttacacgacagttttgataataaagcaaaagagtttgcaaatatcttaaaaatgggtcgtacccaattgcaagatgcggtgccaatgactgttggtcaagaattcaaagctttcgccgtattacttgaagaagaagtgcgtaacttaaaacgtacagcaggtttattacttgaagtaaaccttggtgcaacggcaatcggtactggtttaaatacgccacaaggctatacagaattagttgtaaaacatcttgctgaagtgactggattagcttgtgtaccagcagaaaacttaattgaagcaacatctgactgtggtgcttatgtcatggttcacggtgcattaaaacgtactgcagtgaaactttctaaagtatgtaatgacttacgtttactttcttctggcccacgtgcaggtttaaaagaaattaatcttcctgaattacaagcgggttcttctattatgccagcaaaagtaaacccagttgttccagaggtggtaaaccaagtgtgctttaaagtaattggtaacgataccactgtgaccttcgcatctgaagcaggtcaattacaattaaacgtaatggaaccagtgattggtcaagcaatgtttgaatctatcgatatcttaaccaatgcttgtgtgaacttacgcgataaatgtgtggatggcatcactgtaaacaaagaaatttgtgaaaactacgtgtttaattcaattggtattgtgacttacttgaatccatttatcggtcaccacaacggcgacttagtgggtaaaatctgtgcacaaacaggcaaaggcgtacgtgaagttgtgttagaaaaaggtttattaacagaagaacaattagatgacattctttctgtagaaaacttaatgaatccaacttacaaagcgaaattaaataaataa

SEQ ID NO: 16305 - protein, 475 aa, Haemophilus influenzae
MITMTQFRKEVDLLGERDVPAEAYWGIHTLRAVENFNISNVTISDVPEFVRGMVMVKKATALANGELGAIPSDIAKAIVAACDEILTTGKCLDQFPSDVYQGGAGTSVNMNTNEVVANLALEKIGHKKGEYNVINPMDHVNASQSTNDAYPTGFRIAVYNSILKLIDKIQYLHDSFDNKAKEFANILKMGRTQLQDAVPMTVGQEFKAFAVLLEEEVRNLKRTAGLLLEVNLGATAIGTGLNTPQGYTELVVKHLAEVTGLACVPAENLIEATSDCGAYVMVHGALKRTAVKLSKVCNDLRLLSSGPRAGLKEINLPELQAGSSIMPAKVNPVVPEVVNQVCFKVIGNDTTVTFASEAGQLQLNVMEPVIGQAMFESIDILTNACVNLRDKCVDGITVNKEICENYVFNSIGIVTYLNPFIGHHNGDLVGKICAQTGKGVREVVLEKGLLTEEQLDDILSVENLMNPTYKAKLNK

SEQ ID NO: 16306 - DNA, 1398 bp, Neisseria meningitidis
  CDS (1)..(1398)
atgactgtccgtatcgaacacgatttattgggcgaccgcgagattcccgccgaagtgtattggggcatccacaccctgcgcgccattgaaaactttaaaatctccacacaaaaaatttctgacgtgccgcagtttgtccgcagtatggtgatggtgaaaaaggcgacggcacaggcaaacggtgagttgggcgcggtcaagcccgaaatcgccgccgccattgaaaaagcctgcgacgaagttctgctgaacaaccgctgcctcgaccaattcccgtccgacgtgtatcagggcggtgcgggtacttcggtcaatatgaacaccaacgaagtcatcgccaacctcgcattggaagtcttgggatacgaaaaaggccgctacgacatcgtcaatccgatggatcacgtcaatgccagccaatcgaccaacgatgcctatcccacgggcttccgccttgccgtgtattacagcatcggcgaattgctcgacaaactgactgtcctgaaaaacgcctttgccgccaaagccgaagaatttaaagacgttttgaaaatgggccgcacccagcttcaagatgccgtgccgatgactgccggccaagaattccaatctttccaagtgttgttggaagaagaaatcctcaacctcgaccgcacccgccaactgctgttggaagtcaatttgggcgcaacggcaatcggcacgggcgtgaacacgcccaaaggctacgccgaactggtggtcaaaaaactctccgaagtcagcggcttgccttgcaaactgaccgaaaacctgattgaggcgacctccgactgcggcgcatatgtgatggtacacggcgcattgaagcgcacggcggtcaaactctccaaaatctgcaacgacttgcgcctgctctcttccggcccgcgtgccggcttgaaagaaatcaacctgcccgaattgcaggccggttcttccataatgcccgccaaagtcaatcccgtgattcccgaagtggtcaaccaagtctgcttcaaagtcatcggcaacgacacgacgattaccttcgccgccgaagccgggcaactgcaattaaacgtgatggagccggtcatcgcccaatgtatgtttgaaaccatttccctcttgggcaatgccgcagtcaacctgtccgacaaatgcgtcaaaggcattacggtcaaccgcgaaatctgcgaacgttacgttttcaactccatcggtttggtgacttatctgaatccgtatatcggacaccacaacggcgatttggtcggcaaaatctgcgcccaaaccggcaaaggcgtgcgcgaggttgtcttggaacgcgggctgttgagcgaagaagaactcaaccgcatcctctctcccgagaacctgatgaacccccatctgtaa

SEQ ID NO: 16307 - protein, 465 aa, Neisseria meningitidis
MTVRIEHDLLGDREIPAEVYWGIHTLRAIENFKISTQKISDVPQFVRSMVMVKKATAQANGELGAVKPEIAAAIEKACDEVLLNNRCLDQFPSDVYQGGAGTSVNMNTNEVIANLALEVLGYEKGRYDIVNPMDHVNASQSTNDAYPTGFRLAVYYSIGELLDKLTVLKNAFAAKAEEFKDVLKMGRTQLQDAVPMTAGQEFQSFQVLLEEEILNLDRTRQLLLEVNLGATAIGTGVNTPKGYAELVVKKLSEVSGLPCKLTENLIEATSDCGAYVMVHGALKRTAVKLSKICNDLRLLSSGPRAGLKEINLPELQAGSSIMPAKVNPVIPEVVNQVCFKVIGNDTTITFAAEAGQLQLNVMEPVIAQCMFETISLLGNAAVNLSDKCVKGITVNREICERYVFNSIGLVTYLNPYIGHHNGDLVGKICAQTGKGVREVVLERGLLSEEELNRILSPENLMNPHL

SEQ ID NO: 16308 - DNA, 1425 bp, Pseudomonas aeruginosa
  CDS (1)..(1425)
atgtcccccgttgcatcttcccgtatcgagaaagacctgctcggcaccctcgaagtgcccgctgacgcctactacggcatccagaccctgcgcgccgtgaacaacttccgcctctccggggtgccgctgtcgcactacccgaagctggtcgttgccctggccatggtcaagcaggccgccgccgacgccaaccgtcagctcggccatctcccggaagacaagcacgccgccatcagcgaggcctgcgcccgcctgatccgcggcgatttccacgagcagttcgtggtggacatgatccagggcggcgccggcacctccaccaacatgaacgcgaacgaagtgatcgcgaacatcgcgctggaagccatgggccacaccaagggtgagtacaagtacctgcacccgaacaacgatgtgaacatggcgcagtcgaccaacgacgcctacccaaccgccatccgcctgggcctgctgctcggccacgacaccctgctggccagcctcgacagcctgatccaggccttcgccgccaagggcgtcgaattcgccggcgtactgaagatgggccgcacccagttgcaggacgccgtgccgatgaccctcggccaggaattccacgctttcgccaccaccctcggcgaagacctcgaccgcctgcgtcgcctggcgccggagctgctcaccgaagtgaacctcggtggcaccgccatcggcaccggcatcaacgccgaccccggctaccagaagctcgccgtcgagcgcctggccgccatcagcgggcagccgctgaagccggccgccgacctgatcgaagccacctccgacatgggcgccttcgtgctgttctccggcatgctcaagcgcaccgcggtcaagctgtcgaagatctgcaacgacctgcgcctgctctccagcggcccgcgcaccggcatcaacgagatcaacctgccgccgcgccagccgggcagttcgatcatgccgggcaaggtcaacccggtgatcccggaagcggtcaaccaggtcgccttcgaagtgatcggcaacgacctcgccctgaccctggcggccgaaggcggccagttgcaactgaacgtgatggagccgctgatcgcctacaagatcttcgactcgatccgcctgctgcaacgcgccatggacatgctccgcgagcactgcatcaccggcatcaccgccaacgtcgagcgctgccacgaactggtcgagcacagcatcggtctggtcaccgcgctgaacccgtacatcggctacgagaactccacgcggatcgccaagaccgccctggagagcggccgcggcgtcctggaactggtacgcgaggaaaagctgctggacgaagccaccctggccgacatcctgctgccggaaaacatgatcgcgccgcgcctgattccgctgcgcgcctga

SEQ ID NO: 16309 - protein, 474 aa, Pseudomonas aeruginosa
MSPVASSRIEKDLLGTLEVPADAYYGIQTLRAVNNFRLSGVPLSHYPKLVVALAMVKQAAADANRQLGHLPEDKHAAISEACARLIRGDFHEQFVVDMIQGGAGTSTNMNANEVIANIALEAMGHTKGEYKYLHPNNDVNMAQSTNDAYPTAIRLGLLLGHDTLLASLDSLIQAFAAKGVEFAGVLKMGRTQLQDAVPMTLGQEFHAFATTLGEDLDRLRRLAPELLTEVNLGGTAIGTGINADPGYQKLAVERLAAISGQPLKPAADLIEATSDMGAFVLFSGMLKRTAVKLSKICNDLRLLSSGPRTGINEINLPPRQPGSSIMPGKVNPVIPEAVNQVAFEVIGNDLALTLAAEGGQLQLNVMEPLIAYKIFDSIRLLQRAMDMLREHCITGITANVERCHELVEHSIGLVTALNPYIGYENSTRIAKTALESGRGVLELVREEKLLDEATLADILLPENMIAPRLIPLRA

SEQ ID NO: 16310 - DNA, 1398 bp, Clostridium acetobutylicum
  CDS (1)..(1398)
atggattttaggattgagagtgattccataggtgataagaaggttcctaaggaggtatactatggagttcaaacattgagaggtgcggataattttaaaataacaggacttaggttaaatgaagagtttataaagagtgttgttcaaataaaaaaagcagctgcaattactaatttagaaattggagagctagaggttaacataggaaaagccataattaaagcctgtgatgaggtgatagctgggaagtttaatgaagactttataatagaccctattcaaggtggagcaggaacatctataaatatgaatgccaatgaggttattgcaaatagagctatagaaattttaggatatgaaaaaggaaattatagaattgtacatccaaacgatcatgtcaatatgggacaatcaactaatgatgttataccaacagcaggaaagataactgcattaagacttgtgatcaagaatttagacaaactcaaagaattaagcaatgcctttagtgagaaagcagaacaattcaaagatgtaattaaaatgggtagaacacagcttcaagatgctgtacctataacgttgggacaagaatttagtgcttacagtgcggttgtaaaaagagatatcgctaggattcaaaaagctcaagatgagctgaaagttgtaaatataggtggaactgcggttgggacaggtattaatgcagatagcagatatgtggatagaatagttccaaggctttcttttgtttctggattaaatttaaaaaaagctgacgatttaatcgatggtacacagaatttggatagctttgctagtttatccgcaacaataaaaacctgtgctttaaatctatctaaaatagccaatgacttaaggcttatgtcttctggaccaaggacggggttaggggagatcaatcttcctgcaaagcaaaatggatcatcaataatgcctggaaaagttaatcctgtaatacctgaagttataaatcaaatagcctttaatattgcaggaaatgatgtagctatttctatggctgttgaggcagggcagctagaactaaatgcttttgagccagttatattttataatatatttgaatctatccaaactttaacaaatggtgtagatacatttattaaaaattgtattctagatattactgcaaatgaagagatatgtagtgaatacgtaaataatagtgttggaatagttacagcactctgtccttatataggttatgcagaatcagcaaagatagcgaagatggctataaaaagtggagagtcaataaaaaaagtagttttaagagaaggcgttctcaaggaaaaggaacttaatagtattattaatccactaaaaatgactaaaccagggattgtaggaaaatag

SEQ ID NO: 16311 - protein, 465 aa, Clostridium acetobutylicum
MDFRIESDSIGDKKVPKEVYYGVQTLRGADNFKITGLRLNEEFIKSVVQIKKAAAITNLEIGELEVNIGKAIIKACDEVIAGKFNEDFIIDPIQGGAGTSINMNANEVIANRAIEILGYEKGNYRIVHPNDHVNMGQSTNDVIPTAGKITALRLVIKNLDKLKELSNAFSEKAEQFKDVIKMGRTQLQDAVPITLGQEFSAYSAVVKRDIARIQKAQDELKVVNIGGTAVGTGINADSRYVDRIVPRLSFVSGLNLKKADDLIDGTQNLDSFASLSATIKTCALNLSKIANDLRLMSSGPRTGLGEINLPAKQNGSSIMPGKVNPVIPEVINQIAFNIAGNDVAISMAVEAGQLELNAFEPVIFYNIFESIQTLTNGVDTFIKNCILDITANEEICSEYVNNSVGIVTALCPYIGYAESAKIAKMAIKSGESIKKVVLREGVLKEKELNSIINPLKMTKPGIVGK

SEQ ID NO: 16312 - DNA, 1446 bp, Agrobacterium tumefaciens
  CDS (1)..(1446)
atggaggaaaaagtgagtgtgacgcgcagggagcatgatttgctcgggacgaaggaaattccggctgatgtctattggggcgtgcacaccgcgcgcgccgtggaaaacttcaagatcaccggggtaaccattggccataacccttatctcgtcaggggactggcctatgtgaaggaggcagccgcacgcgcaaatcacgaactcggcctgctcgacaaggagcgcatggaagcgatcgcggaagcctgccgcgaaatccgcgccggcgcgctgcacgagcaattcgtggtcgacgagatccaggggggagccggcacttccactaacatgaacgccaacgaggtcatttccaaccgtgcgctggaactgctcggccacgaaaaaggcgattattcccgtcttcacccgaatgaccatgtcaatctcagccagtccaccaacgacgcctatccaacggcgatcaatgtcgggctgatcgaggcgatcgacgatctggcggtctccatgggcgtgctgaaagacgctttcgaccgcaaggcgcaggaatttgccggcttcatcaagatcggtcgcacccagctgcaggatgccgtgccgatgacgctcggccaggaattccgcactttcgtggtgatgctcggcgaagatcaggctcgcctgatcgaatccgccgcactgctgcacgaaatcaatctcggcgccaccgccatcggcaccggtctcaatgcgccgcgcggttatgccgagcttgcctgccagcatctggctaagctgaccggacggccactggtgacggcagcagacctgatcgaagccacacaggatcccggtgccttcgtgcacctttccggcgtgctgaagcgcgttgccgtcaagctgtccaagacctgcaacgaccttcgcctgctctcctccggtccgcgcgccggcatcggcgagatcaccctgccctccgttcaggcgggttccagcatcatgcctggcaagatcaacccggtcattcccgaagtggtcaaccaggtcgcctatgcggtgatcggcaacgacatcaccatcaccatggcggccgaagccgggcagctgcaattgaacgcctttgaacccatcatcgtgcgggcattgtcgcagagcatcagccagctcagcgccgcctgccgcacattggcggaacgctgcgttgagggcatcgtcgcaaaccccggcatcatggcgcagcgcgtggaagaatcgatcggtctcgccaccgcgctcaatccgctgatcggttattacgccgcgacggaagtggcgaaggaagcgcttgccagcggccgcaccgtgccgcaggtcgttctggaacggggttatctgacggaaacgcaattgcagcaggcgctcagcccgcgtcatcttgccaacctgcccgcggttaccgttacggctggcgaagccgatcttcgccgatga

SEQ ID NO: 16313 - protein, 481 aa, Agrobacterium tumefaciens
MEEKVSVTRREHDLLGTKEIPADVYWGVHTARAVENFKITGVTIGHNPYLVRGLAYVKEAAARANHELGLLDKERMEAIAEACREIRAGALHEQFVVDEIQGGAGTSTNMNANEVISNRALELLGHEKGDYSRLHPNDHVNLSQSTNDAYPTAINVGLIEAIDDLAVSMGVLKDAFDRKAQEFAGFIKIGRTQLQDAVPMTLGQEFRTFVVMLGEDQARLIESAALLHEINLGATAIGTGLNAPRGYAELACQHLAKLTGRPLVTAADLIEATQDPGAFVHLSGVLKRVAVKLSKTCNDLRLLSSGPRAGIGEITLPSVQAGSSIMPGKINPVIPEVVNQVAYAVIGNDITITMAAEAGQLQLNAFEPIIVRALSQSISQLSAACRTLAERCVEGIVANPGIMAQRVEESIGLATALNPLIGYYAATEVAKEALASGRTVPQVVLERGYLTETQLQQALSPRHLANLPAVTVTAGEADLRR

SEQ ID NO: 16314 - DNA, 1377 bp, Thermotoga maritima
  CDS (1)..(1377)
atgagaaaggaacgcgattacctcgggaaactggagatagaaggcgaagtctactatggaatacacacaaagagagccctcatgaacttcccatccacgggtgaaaagctcgacgaaactttcatctgggcctatttcatggtgaaaaaagcctgcgcccttttgaacacagagcttggttatctggacgaacgaacaggaaacgccattgtgaaagcctgtgacgaatgggaagacctgaaaaaacacgtggttgtggatccactctctggtggggctggaacttccataaacatgaacgtaaacgaagtgatcgcaaacagggctacggaaatactcggtggaaagaaaggagaatacctggtcgatcccatagaccacgtgaacctgcaccagtccacaaacgataccttcccaacgagtgcgaaaatcgccaccatcgtgaaactcagaagactcatagatgaagtgataaaccttcaggagaagattcaggagaaagagaaggagttctactccatcagaaaaccgggaagaacacagctcatggatggaccgcccatcatgttagggcaggaattcggtgccttcgcggatgccctcgcgagagacagatggaggctctacaaagtcgaagaaagaataagaagtgtaaacatcgggggaacggccatcggaacgggagttggggcgccgaaagactacatcctcaagatcgtggaaaaggtgagagaagtgacgaaagtgaagattgctaaagcagaaaacctcatagacgccacgcagaactgggacgtttttgccgaggttcatggtcttttgaaatcccttgctgtgaacctctacaagatttcaaacgacatcagactgctgggaagcggaccaaacaccgtgatcggggaactgattcttccagctgtgcaggcgggaagctccatcatgccaggaaaaataaacccggttgtttccgagtacgtaatgcaaatctgtcatatggttttcggtcacgacatgatcctgaaccatgcctgcgcgcttgggaatttagaactcaaccagttcgctcctctgatagttcacctcacactgaaatctctcacactcctcacaaacgcctgtagatcactcgccagctacatctcaaaaataaaagcgaacaacgagcggtgtgaggaacaccttcgaaggtctgtttcgaacctcacacctttgataaagttgtttggatacgaagcggtctctgaagcaataaaaaaagcgaattgggacataaagaaagccgttgaaattctatcccaggagaaaaacattcctgtcgaagagatactgaaggttctcaacctcaaaaagatgacggggcttggctactccttgtaa

SEQ ID NO: 16315 - protein, 458 aa, Thermotoga maritima
MRKERDYLGKLEIEGEVYYGIHTKRALMNFPSTGEKLDETFIWAYFMVKKACALLNTELGYLDERTGNAIVKACDEWEDLKKHVVVDPLSGGAGTSINMNVNEVIANRATEILGGKKGEYLVDPIDHVNLHQSTNDTFPTSAKIATIVKLRRLIDEVINLQEKIQEKEKEFYSIRKPGRTQLMDGPPIMLGQEFGAFADALARDRWRLYKVEERIRSVNIGGTAIGTGVGAPKDYILKIVEKVREVTKVKIAKAENLIDATQNWDVFAEVHGLLKSLAVNLYKISNDIRLLGSGPNTVIGELILPAVQAGSSIMPGKINPVVSEYVMQICHMVFGHDMILNHACALGNLELNQFAPLIVHLTLKSLTLLTNACRSLASYISKIKANNERCEEHLRRSVSNLTPLIKLFGYEAVSEAIKKANWDIKKAVEILSQEKNIPVEEILKVLNLKKMTGLGYSL

SEQ ID NO: 16316 - DNA, 1407 bp, Campylobacter jejuni
  CDS (1)..(1407)
atgggaacaagaaaagaacatgattttattggggaattggaaatctctgatgaggtttattatggagtgcaaacttttagagctgttgaaaattttgatatttctcatgatagattaaaagattttcctcgctttgttagggctttggctagagtaaaaaaagctgcagctatggcaaatcatgaattaggtcttttggataaaaatatccaagatgcgattattaaagcgtgtgataaaattttagaaggtgggtattatgatcaatttgtagtagatatgatccaaggaggtgctggaacaagtacaaatatgaatgctaatgaagttatagcaaacataggacttgaacttatgggtcataaaaaaggtgaataccaatatcttcatccaaatgatcatgttaatttaagccaaagtactaatgatgcttatcctacagctttacaccttgccttgcatgattatttaagtgatttggcaaaagctatggaacatctaaaaaaagcttatgagagaaaagctgaagaatttaaagatgttcttaaaatgggtagaacccaactgcaagatgctgtacctatgactttaggtcgtgaatttaaaacttttgccgtaatgataggtgaagatatacaaagagtattagaagctagaaaattgattttagagatcaatttgggtggaactgctattggaacaggaattaattctcatcctgattatccgaaggttgtagaaagaaaaataagagaagtgacaggttttgaatatactgtggctgaggatttaatcgaggcgactcaagatacgggagcttatgtacaaatttcaggtgttttaaaacgtgttgcaacaaaactttctaaagtatgtaatgacttaagacttttaagtagtggtccaaaatgtggtcttaatgagattaatcttccaaaaatgcaaccaggtagttctatcatgccaggtaaggtaaatcctgttattcctgaagtagttaatcaagtttgttattttgttattggagcagacgtaactgtaacttttgcttgtgagggtggacaattacaacttaatgtttttgaaccagttgtagcatatagcttatttaattctgttgtaatgctagaaaaagcaatgtatactttagctgataaatgtatagatggtattaccgcaaatgaaaaaatttgttcagactttgtctataattcagtaggtatagtaacagctttaaatccttatattggttatgaaaattcagcttctatagccaaagaggcaatgaacactggaaaaagagtggctgatattgcgcttgaaagagggcttttaagcaaagaacaaattgatgaaattttaactccatcaaatatgctaaatcctcacatggaagctaaaaaatag

SEQ ID NO: 16317 - protein, 468 aa, Campylobacter jejuni
MGTRKEHDFIGELEISDEVYYGVQTFRAVENFDISHDRLKDFPRFVRALARVKKAAAMANHELGLLDKNIQDAIIKACDKILEGGYYDQFVVDMIQGGAGTSTNMNANEVIANIGLELMGHKKGEYQYLHPNDHVNLSQSTNDAYPTALHLALHDYLSDLAKAMEHLKKAYERKAEEFKDVLKMGRTQLQDAVPMTLGREFKTFAVMIGEDIQRVLEARKLILEINLGGTAIGTGINSHPDYPKVVERKIREVTGFEYTVAEDLIEATQDTGAYVQISGVLKRVATKLSKVCNDLRLLSSGPKCGLNEINLPKMQPGSSIMPGKVNPVIPEVVNQVCYFVIGADVTVTFACEGGQLQLNVFEPVVAYSLFNSVVMLEKAMYTLADKCIDGITANEKICSDFVYNSVGIVTALNPYIGYENSASIAKEAMNTGKRVADIALERGLLSKEQIDEILTPSNMLNPHMEAKK

SEQ ID NO: 16318 - DNA, 1452 bp, Vibrio cholerae
  CDS (1)..(1452)
atggctaccctatctgaagcgcctaaaacagcgactccggctacccgcgttgaagaagatctgttaggtcaacgtcacgttcctgctgatgcttactacggtattcatacccttcgcgctgtcgaaaacttcaacatctctaacgttacgatctctgacgtgcctgaatttgtacgcggcatgatcatgaccaaaaaagcggccactctggcaaacaaagagctgggcgtgattcctaaagatgtggcgaactacatccttcaagcgtgtgatttgattcttgaaacaggtaagtgcatggatcaattcccgtcagatgtattccaaggtggtgcgggcacgtcagtgaacatgaacaccaacgaagtgattgctaacgttgcactcgagctgatgggcaaacaaaaaggtcaatacgagttcatcaaccccaatgaccacgtaaacaagagccaatcaaccaactgtgcatacccaacgggtttccgcatcgcggtttacaacagcatcctgaaagtgattgatgcgattgaatacctaaaaggctcattcgaacttaaagcggctgagtacaaaaacatcctgaaaatgggtcgtactcagttgcaagacgctgtacctatgaccgtaggtcaagaattccacgcatgggctgtgacgctgaatgaagagatccgcgcgctgcaatacacttcaaaactgcttttggaagtgaacttgggcgcaaccgcgatcggtactggcctgaacgccgctccgggttaccaagagctggccgtgaaatatctggcgcaagtgacaggtttagaaaccgttccagcagaagatctgattgaagccacctctgactgtggtgcttacgtgatgactcacggcgcgttgaaacgtctagcgatgaagctctctaagatctgtaacgatctacgtctgctctcttctggtccacgtgcaggtctgaatgaaatcaacttgcctgaactgcaagcgggttcgtccatcatgccagcgaaagtaaacccagtaatcccagaagtggtgaaccaagtttgctttaaagtattcggtaacgacaacaccattacattcgccgcagaagcgggtcaactgcagttgaacgtcatggagcctgtgattgctcaagcgatgtttgagtctatctctctgctgactaacgcctgtgtcaacctacgcgacaagtgcattgatggcatcacagtcaacaaagaaatctgtgaaaacttcgtgtttaactctatcggtatcgtgacttacttaaacccatacattggccaccatgagggtgacattgtcggtaagatctgtgccgaaaccggtaagagcgtacgcgaagtggtacttgagcgcggcttgctaactgaagagcagctcgatgacatcttctcggttgagaacctgatgcatcctcagtacaaagcaaaacgttacgaataa

SEQ ID NO: 16319 - protein, 483 aa, Vibrio cholerae
MATLSEAPKTATPATRVEEDLLGQRHVPADAYYGIHTLRAVENFNISNVTISDVPEFVRGMIMTKKAATLANKELGVIPKDVANYILQACDLILETGKCMDQFPSDVFQGGAGTSVNMNTNEVIANVALELMGKQKGQYEFINPNDHVNKSQSTNCAYPTGFRIAVYNSILKVIDAIEYLKGSFELKAAEYKNILKMGRTQLQDAVPMTVGQEFHAWAVTLNEEIRALQYTSKLLLEVNLGATAIGTGLNAAPGYQELAVKYLAQVTGLETVPAEDLIEATSDCGAYVMTHGALKRLAMKLSKICNDLRLLSSGPRAGLNEINLPELQAGSSIMPAKVNPVIPEVVNQVCFKVFGNDNTITFAAEAGQLQLNVMEPVIAQAMFESISLLTNACVNLRDKCIDGITVNKEICENFVFNSIGIVTYLNPYIGHHEGDIVGKICAETGKSVREVVLERGLLTEEQLDDIFSVENLMHPQYKAKRYE

SEQ ID NO: 16320 - DNA, 1413 bp, Clostridium acetobutylicum
  CDS (1)..(1413)
atgtttgatttgccttctgattttagaatagaaaaagacttacttggagaaaaaaacttacctaaagagtcctactacggaataaactctctaagagcctttgaaaactttaatataagcaataaaaaagtaaatttaaatttaatatatgcagtggtaattgtaaaaaaagcggctgctttagctcataaaaaactcaaggaacttaaagatgaaaaagcagatgctataataagcgcttgtgatgacatattaagtggaaaatttgacgatgagttcattacaaattctcttcaaggcggtgctggaacctcaaccaacatgaatgtaaatgaagtcattgcaaacagagctattgaattacttaatggctcaaagggtgactactctataatccacccaattgaagatgttaatatgtctcagtcaaccaatgatgtatacccaactgctcttagaattgcagctataaaacttctaaggcctttatctgatgctttaagtaaacttcaagaatcctttcaaataaaagaaaatgatttttcagatatacttatgcttggaaggacagaacttatggatgccttacctatgatggtaggtcagggctttggagcttatgcaaaagcctttgctagggatagatggcgaatatataaggttgaagagagacttcgtgagataaatattggaggaaatgccataggaactggaataaatgcttcctatgattatattttcactgttactgacatacttcaagatttaacaggactcgggcttgcaagaagtgattacccaatggatgtaacacaaaacatggatgtatttgtagaggtgtcaggtcttttaaaatcctgcgctgttaatcttataaaaatttcaaatgacataagacttttaaatagcggccctgtaggtggtataggagaatttattgttgaagaggttcaagctggttcatcaattatgccaggaaaagtaaaccctgttatatgtgaaatgacagctcaaacttctatgaaggttatggcaaacgatactgctatctccctcgcctcatcttttggacagcttcaattaaatgctttttctcctctaattgctgaaagccttttagaatctcttgaaatacttactaatgcagttaatgtgttcagggaaaaatgcatagattcaataaaaattaatgaagaaaaatgtcttgagaatttagaagcttctacagcactcgttacagccttagttcattatataggttatgataaagcatctattatagcaaaaaaagctctaaaagaaaaaaaatccatacgggaattactccttttagaaaaaattttaacaaaagaagaaatagataaaatacttaatccttatgagattacaaaacctggcataccaggactatag

SEQ ID NO: 16321 - protein, 470 aa, Clostridium acetobutylicum
MFDLPSDFRIEKDLLGEKNLPKESYYGINSLRAFENFNISNKKVNLNLIYAVVIVKKAAALAHKKLKELKDEKADAIISACDDILSGKFDDEFITNSLQGGAGTSTNMNVNEVIANRAIELLNGSKGDYSIIHPIEDVNMSQSTNDVYPTALRIAAIKLLRPLSDALSKLQESFQIKENDFSDILMLGRTELMDALPMMVGQGFGAYAKAFARDRWRIYKVEERLREINIGGNAIGTGINASYDYIFTVTDILQDLTGLGLARSDYPMDVTQNMDVFVEVSGLLKSCAVNLIKISNDIRLLNSGPVGGIGEFIVEEVQAGSSIMPGKVNPVICEMTAQTSMKVMANDTAISLASSFGQLQLNAFSPLIAESLLESLEILTNAVNVFREKCIDSIKINEEKCLENLEASTALVTALVHYIGYDKASIIAKKALKEKKSIRELLLLEKILTKEEIDKILNPYEITKPGIPGL

SEQ ID NO: 16322 - DNA, 1407 bp, Helicobacter pylori
  CDS (1)..(1407)
atgcgtattgagcatgatttcattgggcaaatggaaattagcgatgaagtttattacgggattcaaactttaagggcgagtgaaaattttttcatcaccaacgacaagctttgcagttatcctgtttttatcaaatcttttgctcaagtcaaaaaagcggccgctttagcgaacgcgcaattaggcttgattgatgaaaagcttaaaattgcgatttgccatgcgtgcgatttgttggttgatggcaaataccatgatcaattcattgtggatatgattcaagggggggctggcacaagcacgaacatgaacatgaatgaagtgattgctaatttggctttagaatacatggggcatcaaaagggcgagtatcaattttgccacccaaacgaccatgtcaaccgctctcaatccaccaatgacgcctatcctagcgcgttaaaaatcgcgatttatgagcgcttgagcaatctagttgcccccatgaaagccttaagggacgctttcgctcaaaaggctaaggaattcgctcatgtgattaaaatggggcgcacccagcttcaagacgctgtgcctatgactttagggcaagagtttgaaacttatgcgttgatggttgatagggatattgagcaggttttagacgctaggaattgggtaagagagcttaatttaggcggcacggttattggcacagggatcaattcgcacccggattatcgcagtttgattgaaaagaaaatccaagaagtaacgggccgcccctttgtcatggctaacaacttgatagaagccactcaaagcacgggggcgtatgtgcaagtgagcggggtgttaaagcgtattgcggtgaaactttctaaggtttgtaacgatttaaggctgctcagttcaggccctagagccgggttgaatgaaatcaatttgcctaaaatgcagccgggtagctctatcatgcccggtaaagtcaatccggtgatccctgaagtggtcaatcaagtgtgctttgcggtgattgggaacgatttgagcgtggcgttagccgcagaaggagggcaattgcaactcaatgtgtttgagccggttatcgcttacaagcttttccattcctttgtgattttagggcgcgcgattgaaactttaacgactaaatgcgtggaaggcatcacggctaatgaaaagatttgccacgattatgtttttaacagcattggcattgttaccgcgctcaaccctcatatcggctatgaaaaatccgctatgatcgccaaagaagccttaaaaagcgatcgctctatctatgatatcgctttagaaaagaaaatcttaaccaaagagcaactggacgatattttcaagccagaaaacatgctaagccctcacgctttcaaaaagcataaagactga

SEQ ID NO: 16323 - protein, 468 aa, Helicobacter pylori
MRIEHDFIGQMEISDEVYYGIQTLRASENFFITNDKLCSYPVFIKSFAQVKKAAALANAQLGLIDEKLKIAICHACDLLVDGKYHDQFIVDMIQGGAGTSTNMNMNEVIANLALEYMGHQKGEYQFCHPNDHVNRSQSTNDAYPSALKIAIYERLSNLVAPMKALRDAFAQKAKEFAHVIKMGRTQLQDAVPMTLGQEFETYALMVDRDIEQVLDARNWVRELNLGGTVIGTGINSHPDYRSLIEKKIQEVTGRPFVMANNLIEATQSTGAYVQVSGVLKRIAVKLSKVCNDLRLLSSGPRAGLNEINLPKMQPGSSIMPGKVNPVIPEVVNQVCFAVIGNDLSVALAAEGGQLQLNVFEPVIAYKLFHSFVILGRAIETLTTKCVEGITANEKICHDYVFNSIGIVTALNPHIGYEKSAMIAKEALKSDRSIYDIALEKKILTKEQLDDIFKPENMLSPHAFKKHKD

SEQ ID NO: 16324 - DNA, 2867 bp, Serratia marcescens
  CDS (787)..(2223)
gaattcgccgtcgaaggtattgccgttggcggcgtcgccgcccgtccaaccgccggggcgatacaccgacaggtgcggcatcagtttcagcgtcagcgatttttgcaccggcggcagcagcagcaacaggccgaggaaatcggtgaagaaacccggtatcagcagcaggaagcccgccagcaccagcgaaacgcttttcaccatttccgccgccgggctttcgccggccgccagtttttgctgcatctgcacgaaggttttcatgccctgattgcgcaccagcgaaatgccgacgcaggagctgaacaccaccagcagcagggtgacagccacgccgagcacggcggcgactttgataaagatggatatttctatgtaagccagcagaaatatcagcagtagcggtaaccagcgcacctggttctcctatcggtaggtaaggcacggccgccacggggcgacggcgcgaaaaaagaggccgtaaacggccgacactattacaatgagggcatccccccaccatttcaaccgagagccggtttttattgctaaagttcacaaacgtgaaagaagtcacagaaccgaaaaagggcatatccttaaacaccataaggtgatctggattcagtcatttcttaccaaccagcatatgatctgggcagctacgggcgatttggttaatcgtttcacgccccaagccttcggcaatattaatttaggctgtgcccttactagccttgacctgacaaattattaattcggcagcaacacatagagaaggttctcatgtcaaacaacattcgtatcgaagaagacctgttaggaacacgtgaagtccccgcagacgcttactacggagttcacactctgcgtgcgattgaaaacttctacatcagcaacagcaaaatcagcgatgtccccgagttcgttcgcggcatggtgatggtgaaaaaggccgcggcgatggccaacaaagaactcaaaaccatcccgcgcaaaatcgccgacgtgatcatccaggcctgcgacgaggtgctggataaaggcaagtgcatggatcagttcccggtggacgtattccagggcggcgcgggcacctcgctgaacatgaacaccaacgaagtgctggcgaacatcggcctggagctgatgggccatcaaaaaggcgaataccagtacctgaacccgaacgatcacctcaataagtgtcagtccaccaacgacgcctacccgaccgggttccgcatcgcggtgtacgcctccaaccagaaactgatcgacgccatcaaccagctgcgcgaaggcttcgatcgcaaggcgaaagagttcgaaaccatcctgaaaatgggccgcacccagctgcaggacgcggtgccgatgaccctaggccaggaattccacgccttcagcgtgctgctgaacgaagagacccgcaatctgcaccgcaccgcgacgctgctgctggaagtgaacctcggcgccaccgccatcggcaccgcgctcaacaccccggaaggctaccagccgctggcggtgcaaaaactggcggaagtcagcggcctgccggtggtgccggcagaagacctgatcgaagccacctccgactgcggcgcctacgtgatggtgcacagcgcgctcaaacgcctggcggtgaaactgtccaaaatctgtaacgacctgcgcctgctctcctccggcccgcgcgccggcctgaacgaaatcaacttgccggagctgcaggcgggatcgtccatcatgccggccaaagtgaatccggtggtgccggaagtggtcaatcaggtgtgtttcaaggtgattggcaacgacacttgcgttaccatggcggccgaagcgggccagctgcagctgaacgtgatggagccggtgatcggccaggcgatgttcgagtcgatccacatcctgaccaacgcctgctacaacctgctggaaaaatgcattaacggcatcaccgcgaataaagaagtctgcgaacactacgtcttcaactcgatcggtatcgtcacctatctgaacccgttcatcggccaccataacggtgacatcgtcgggaagatctgcgccgaaaccggcaagagcgtgcgcgaagtggtgctggaacgcggcctgctgaccgaagccgagctggatgacatcttctccgtggagaacctgatgcacccggcctataaagccaaacgctatacggatgaaaatgaacaataacagacctacccggtagccctgaaaggcacgctaaatcctctggatagcgtgcctttttacttttaggtgcccacaaaattttaacgttttattttcaatttacaccctaaatcattgggactgcatcaaggcggcaagagcgcaagtccccaggagcttactcaagtaagtgactggggtgagcgctcgcagccaacaccgatgcagtttcaaggatgacgggaaatctcattttaaggagtaaacactatgctagccgtagaattggttatcgttctgctggccatctttttaggggccaggttgggcggtatcggtatcgggttcgcggggggactgggcgtattggcgctggcgctgatcggcgtcaaaccgggcaacattcccttcgacgtcatctccatcatcatggcggtgattgcggcgatctccgccatgcaggtcgccggggggatggactacctggtgcaacagaccgaaaaactgctgcgcaagaaccccaagcacatcaccattctcgcccctatcgtcacctacttcctgaccatcttcgccggcaccggcaacatctcgctctcggcgctgccggtgatcgccgaggtggcgaaagaacagggcatcaagccttgccgcccgctgtcgac

SEQ ID NO: 16325 - protein, 478 aa, Serratia marcescens
MSNNIRIEEDLLGTREVPADAYYGVHTLRAIENFYISNSKISDVPEFVRGMVMVKKAAAMANKELKTIPRKIADVIIQACDEVLDKGKCMDQFPVDVFQGGAGTSLNMNTNEVLANIGLELMGHQKGEYQYLNPNDHLNKCQSTNDAYPTGFRIAVYASNQKLIDAINQLREGFDRKAKEFETILKMGRTQLQDAVPMTLGQEFHAFSVLLNEETRNLHRTATLLLEVNLGATAIGTALNTPEGYQPLAVQKLAEVSGLPVVPAEDLIEATSDCGAYVMVHSALKRLAVKLSKICNDLRLLSSGPRAGLNEINLPELQAGSSIMPAKVNPVVPEVVNQVCFKVIGNDTCVTMAAEAGQLQLNVMEPVIGQAMFESIHILTNACYNLLEKCINGITANKEVCEHYVFNSIGIVTYLNPFIGHHNGDIVGKICAETGKSVREVVLERGLLTEAELDDIFSVENLMHPAYKAKRYTDENEQ

SEQ ID NO: 16326 - DNA, 1428 bp, Bacillus subtilis
  CDS (1)..(1428)
atgttaaacggccaaaaagaatatcgcgtggaaaaagacttccttggggaaaaacaaattgaagcagatgtttattacggaattcagacgctccgtgcttctgaaaattttccgatcacaggatacaaaatccatgaggaaatgattaacgcactggcgattgtgaaaaaagctgcggctcttgccaacatggacgtgaaacggctgtatgaaggaattggccaagctatcgtacaagccgctgacgagattctggaaggcaagtggcacgatcagtttatcgtcgatccgattcagggcggtgccggaacttctatgaacatgaacgcgaatgaggttatcggaaaccgggcgcttgaaatcatgggacataaaaagggagattatatccatttaagtccaaacacacatgtgaacatgtcacagtctcagaacgatgtgttcccgactgctatccatatttccacattgaagctcttagaaaaactgctgaaaacaatggaagatatgcatagtgtgtttaaacaaaaagcacaggagtttcactctgttattaaaatgggccggacacaccttcaagatgcggttccgatccgtcttggccaggaattcgaagcttacagccgtgttctcgagcgtgatatcaaacgaatcaagcaatcgcgccagcacctgtatgaagtcaacatgggcgcaactgctgttggtacagggctgaacgctgatcctgaatatatcaaacaggtagtaaagcaccttgctgatattagcgggcttcctcttgtcggcgctgatcatcttgttgatgcgacacaaaatacagatgcctatacagaggtatcagcttcattaaaagtctgcatgatgaacatgtcgaagatcgcaaacgacctgcgcttaatggcgtcgggaccgcgcgccggacttgcggaaatttctctgcctgcacgtcagccgggttcatctattatgccggggaaagtcaatccggttatggcggagctgatcaaccaaattgcgttccaggttatcggaaatgacaatacaatctgccttgcttcagaagccggccagcttgagttgaacgtcatggagcccgtgcttgtctttaatttgcttcaatccatcagcatcatgaacaacggcttccgttcgttcactgacaactgcttaaaaggcattgaagccaacgaaaagcgtatgaagcaatacgtagaaaaaagcgcaggcgtgatcacagctgtcaatccgcatcttgggtatgaagcggcagctagaattgccagggaagcaattatgacagggcaatctgtccgggatctttgtctgcagcatgatgtgctgactgaagaagaattggatattattttaaacccatatgagatgaccaaaccaggtatcgcagggaaagaactattagaaaaataa

SEQ ID NO: 16327 - protein, 475 aa, Bacillus subtilis
MLNGQKEYRVEKDFLGEKQIEADVYYGIQTLRASENFPITGYKIHEEMINALAIVKKAAALANMDVKRLYEGIGQAIVQAADEILEGKWHDQFIVDPIQGGAGTSMNMNANEVIGNRALEIMGHKKGDYIHLSPNTHVNMSQSQNDVFPTAIHISTLKLLEKLLKTMEDMHSVFKQKAQEFHSVIKMGRTHLQDAVPIRLGQEFEAYSRVLERDIKRIKQSRQHLYEVNMGATAVGTGLNADPEYIKQVVKHLADISGLPLVGADHLVDATQNTDAYTEVSASLKVCMMNMSKIANDLRLMASGPRAGLAEISLPARQPGSSIMPGKVNPVMAELINQIAFQVIGNDNTICLASEAGQLELNVMEPVLVFNLLQSISIMNNGFRSFTDNCLKGIEANEKRMKQYVEKSAGVITAVNPHLGYEAAARIAREAIMTGQSVRDLCLQHDVLTEEELDIILNPYEMTKPGIAGKELLEK

SEQ ID NO: 16328 - DNA, 2066 bp, Pseudomonas fluorescens
  CDS (323)..(1759)
gttgaccagcgtcagccccaacgcggcttccaggctgcggatacgccgactgaacgccggctgggtgacaaagcgccgctcagccgcctgggaaaaactacgcgtcgccgccagggcgctgaagtcttccaaccacttgctctcaaggttcatcactgcctcccacggaatgcaccattttggcacacacgcccgccaagataaccgggtcacatccacattatgccgtttgtgcataggccagtgtttaacagcattggcccaaaaagtcctacaagcctagcattcgcagcgttccggccagtcccgggtccatattgagatgatctccgtcatgtcctctgctgcatctttccgtaccgaaaaagacctgcttggcgtactcgaagtaccggctcaagcgtattacggcatccagaccctgcgagcggtgaataacttccgcctctcgggcgttccgatttcgcattacccgaaattggtggtcggtctggcaatggtcaagcaagcagcggctgacgccaaccgcgagttgggccagctcagcgaacgcaagcacgctgccatcagcgaagcctgcgctcgtctgatccgcggcgatttccacgaagagttcgtggtggacatgattcaaggcggcgctggcacttcaaccaacatgaatgccaacgaagtcatcgccaacatcgcgctggaggccatgggtcaccagaagggcgaataccagtacctgcaccccaacaacgacgtgaacatggcgcagtcgaccaacgacgcctacccgaccgcgatccgcctgggtctgctgctgggccatgacgcgctgctggccagcctcgacagcctgatccaggcgttcgccgccaaaggcgccgagttcagccatgtgctgaaaatgggccgcacacaattgcaagacgccgtgccgatgaccctcggccaggaattccgcgcgttcgccaccaccctgggtgaagacctggcccgcctgaaaaccctggcgccagagctgctgaccgaagtgaacctgggcggaaccgcgatcggtaccggcatcaacgccgacccgcgctaccaggccctcgccgtacaacgcctggccaccatcagcggtcagccgctggtaccggcggccgacctgatcgaagccacctccgacatgggcgctttcgtactgttctccggcatgctcaagcgtactgccgtgaagctgtccaagatctgcaacgacctgcgcctgctgtccagcggcccacgcaccggcatcaacgagatcaacctgccggctcgccagccaggcagctcgatcatgcccggcaaggtcaacccggtcatcccggaagcggtcaaccaggtagcgttccaagtcatcggtaacgacctggccctgaccatggcagccgaaggcggccaactgcagttgaacgtgatggagccgctgatcgccttcaagatcttcgactcgatccgcctgctgcaacgcgccatggacatgctgcgcgagcactgcatcgtcggcatcaccgccaacgaagcccgctgccgcgaactggtggaacattccatcggcctggtcaccgcgctgaacccatacatcggctatgaaaacgccacccgcattgcgcgtatcgcgcttgaaagcgggcgcggcgtgctggaactggtgcgtgaagaaggcttgctcgacgacgccatgctcgacgacatcctgcgccccgaaaacatgattgccccacgcttggtcccgctgaaggcctaagcgtttgttgcaccgctcaccaggctgagggactagacacctctcaccttttgagggcttgaagactcgttcttcaggcccttttttttgctcgtaattcctctccttatataaagcgctgttagtgcgtttcacctataaaacatcacgcctgcggcgttacttgaaaaagcattcattcattgcaaattcccattgcgtgcacaaacggtgtgcagtttcgtgccatataaaaacaatggtttcatatatgaaacgctcaataagtaaccttaatctcgcaactaattaatttaaaagggaattc

SEQ ID NO: 16329 - protein, 478 aa, Pseudomonas fluorescens
MISVMSSAASFRTEKDLLGVLEVPAQAYYGIQTLRAVNNFRLSGVPISHYPKLVVGLAMVKQAAADANRELGQLSERKHAAISEACARLIRGDFHEEFVVDMIQGGAGTSTNMNANEVIANIALEAMGHQKGEYQYLHPNNDVNMAQSTNDAYPTAIRLGLLLGHDALLASLDSLIQAFAAKGAEFSHVLKMGRTQLQDAVPMTLGQEFRAFATTLGEDLARLKTLAPELLTEVNLGGTAIGTGINADPRYQALAVQRLATISGQPLVPAADLIEATSDMGAFVLFSGMLKRTAVKLSKICNDLRLLSSGPRTGINEINLPARQPGSSIMPGKVNPVIPEAVNQVAFQVIGNDLALTMAAEGGQLQLNVMEPLIAFKIFDSIRLLQRAMDMLREHCIVGITANEARCRELVEHSIGLVTALNPYIGYENATRIARIALESGRGVLELVREEGLLDDAMLDDILRPENMIAPRLVPLKA

SEQ ID NO: 16330 - DNA, 1437 bp, Bacillus cereus
  CDS (1)..(1437)
atggcaacattaactgaagttaaaaatggtgttcgaattgaaaaagattttttaggtgaaaaagaagtaccaaactatgcatactacggtgtacaaacaatgcgtgcagttgaaaacttcccaattacaggatacaaaattcatgaaggtttaattagagcgttcgcagttgtaaaaaaagctgcagcgcttgcgaatacagatgtaggaagattggaattgaacaagggcggcgcaatcgcagaagctgctcaagaaattcttgacgggaaatggcatgatcatttcatcgtagacccaatccaaggcggagcaggtacttcaatgaacatgaatgcaaatgaagtcattgccaatcgtctcttgattattaggaatggaaagggagactatcattatattagtccaaatagtcatgtaaacatggcgcaatccacaaacgatgcattcccaacggcgattcatatcgctacattaaacgcattagaaggtttattacaaacgatgggctatatgcacgatgtatttgaattaaaagcagaacagttcgatcatgtgattaaaatgggtcgtacacatttacaagacgctgttccaattcgtcttggacaagaatttaaagcatactctcgcgtacttgaacgtgatatgaaacgaattcagcagtcacgtcaacacttatatgaagtgaacatgggagcaactgcagttggtacaggcttaaatgcagatccagaatatattcaagctgttgtaaaacatttagctgcaattagtgaactaccacttgttggtgcggaagacttagtagatgcaacgcaaaatacggatgcatatacagaagtatcagcagcactgaaagtatgtatgatgaatatgtctaaaattgccaatgaccttcgcttaatggcatcaggtccacgtgttggtttagcagaaattatgttaccggctcgtcaaccaggttcatctattatgccagggaaagtaaaccctgttatgccagaggtaattaatcaaattgcgttccaagtaattggtaatgaccatacaatttgtcttgcttcagaagcaggtcaattagaattgaacgttatggaaccagtactagttttcaacttacttcaatcaattagcattatgaataacggtttccgtgcctttacagataattgcttaaaaggaattgaagcgaatgaagatcgcttaaaagagtatgttgagaagagtgtaggaattattacagccgtgaaccctcatatcggttatgaagcagcagctcgcgttgcgaaagaagcaatcgcgacagggcaatccgttcgagaactttgtgtgaaaaatggtgtactgtcacaagaagacttagaattaattctagatccattcgaaatgacgcacccagggattgcaggagcaactcttttaaagaaaaattaa

SEQ ID NO: 16331 - protein, 478 aa, Bacillus cereus
MATLTEVKNGVRIEKDFLGEKEVPNYAYYGVQTMRAVENFPITGYKIHEGLIRAFAVVKKAAALANTDVGRLELNKGGAIAEAAQEILDGKWHDHFIVDPIQGGAGTSMNMNANEVIANRLLIIRNGKGDYHYISPNSHVNMAQSTNDAFPTAIHIATLNALEGLLQTMGYMHDVFELKAEQFDHVIKMGRTHLQDAVPIRLGQEFKAYSRVLERDMKRIQQSRQHLYEVNMGATAVGTGLNADPEYIQAVVKHLAAISELPLVGAEDLVDATQNTDAYTEVSAALKVCMMNMSKIANDLRLMASGPRVGLAEIMLPARQPGSSIMPGKVNPVMPEVINQIAFQVIGNDHTICLASEAGQLELNVMEPVLVFNLLQSISIMNNGFRAFTDNCLKGIEANEDRLKEYVEKSVGIITAVNPHIGYEAAARVAKEAIATGQSVRELCVKNGVLSQEDLELILDPFEMTHPGIAGATLLKKN

SEQ ID NO: 16332 - DNA, 1419 bp, Acinetobacter sp
  CDS (1)..(1419)
atgaacgctgaaattcaaactcgtacagaaaaggatttactgggtctacgtgaagtaccaaatcaattttacttcggtatccaaactttacgagcaattgaaaacttcaatctaagctctaataaaatcaatcaatatccaaatttgatcaaatcattagcgatggtgaagcatgcatgtgcagaagcaaaccatactttgggtaaattaagtgatttaaaatttaatgcaatcaaatatagctgtgatcagttaattcaaggtttttaccacgaacagttccccattgacctcattcagggtggtgcgggtacctctaccaacatgaatgccaatgaagtaattgcaaatattgcattagagcatttgggtcataaaaaaggtgaatacaactttttacatccaaacaatgatgtgaatatgtctcaatcgaccaatgacgtttatccaactgcaattcgcttaggtttattattcagcttagatgatttaaatacgccttttgaaaatttgattgctagcctacgccgtaagggtgatgaatttgcacatattttgaaaatgggccgtactcagcttcaagacgccgttccaatgactttgggtcaagaatttaatgcttttgcttctacacttgaaaaagatttgatcaagattagagaaatcgcgcctcaaactctaaattatatgaatcttggcggtactgcgattggtacaggaatcaatacagaacaaaaatatacccaacttgccattgatgcacttgcgacaattagccagaaagatatcaagtctgctcccgatttaatcgaagcgacttcagatatgggtgattttgtattgttgtcaggattacttaaacgtacagcaactaaactctcaaaaatcgccaatgatctacgtttactttcaagtggtccacgtactgggatcaatgaaattaatctagagccgcgccaacctggcagctcaatcatgccaggtaaagtaaacccagttattccagaggcaatgaatcttgtatgtttccagattattgcgaatgatttggctgtaactttatctgctgaagcgggtcaattacaattaaatgcaatggaacccctgattgcattcaaactgtttgaatcaattgagttacttggtaatgcgctcgtcatgttccaaaccaagtgtatcgataccgtgactgcaaacgaacaacattgtaaagcacttgtcgataattccattggaattgtgactgctctgaatccttatcttggatatgaaaccacaacacgtattgctaaaactgcaaatgaaagtggtttaagcgtattgagtctgatcaaatctgaaaacctgttgtctgatgatcaactttcagaaattttagcggttgacaatatggtgcaaccgaaagctgaaatggtttaa

SEQ ID NO: 16333 - protein, 472 aa, Acinetobacter sp
MNAEIQTRTEKDLLGLREVPNQFYFGIQTLRAIENFNLSSNKINQYPNLIKSLAMVKHACAEANHTLGKLSDLKFNAIKYSCDQLIQGFYHEQFPIDLIQGGAGTSTNMNANEVIANIALEHLGHKKGEYNFLHPNNDVNMSQSTNDVYPTAIRLGLLFSLDDLNTPFENLIASLRRKGDEFAHILKMGRTQLQDAVPMTLGQEFNAFASTLEKDLIKIREIAPQTLNYMNLGGTAIGTGINTEQKYTQLAIDALATISQKDIKSAPDLIEATSDMGDFVLLSGLLKRTATKLSKIANDLRLLSSGPRTGINEINLEPRQPGSSIMPGKVNPVIPEAMNLVCFQIIANDLAVTLSAEAGQLQLNAMEPLIAFKLFESIELLGNALVMFQTKCIDTVTANEQHCKALVDNSIGIVTALNPYLGYETTTRIAKTANESGLSVLSLIKSENLLSDDQLSEILAVDNMVQPKAEMV

SEQ ID NO: 16334 - DNA, 1431 bp, Bacillus anthracis str
  CDS (1)..(1431)
atggcaatgacaaacaagaacgtgcgaatggagaaggattttttgggaggaaaggaattacctattgaggcatattacggaattcagactttacgtgctgttgaaaattttccgattacagggtataaaattcatgaaagtttaattagagcgttcgcagttgtaaaaaaagctgcagcgcttgcgaatacagatgtaggaagattggaattgaacaagggcggcgcgatcgcagaagctgctcaagaaattcttgatggaaaatggcatgatcatttcatcgtagatccaatccaaggcggagcaggtacttcaatgaacatgaatgcaaatgaagtcattgccaatcgtgcgcttgaattattagggatggaaaagggagactatcattatattagtccaaatagtcatgtaaacatggcacaatcaacaaacgatgcattcccaacggcgattcatatcgcaacattaaacgcattagaaggtttattacaaacgatgggttatatgcacgatgtatttgaattaaaagcagaacagttcgatcatgtgattaaaatggggcgtacacatttacaagacgctgtgccaattcgtcttggacaagaatttaaagcatactctcgcgtacttgaacgtgatatgaaacgaattcagcaatcgcgtcaacatttatatgaagtaaatatgggagcaactgcagttggtacaggcttaaatgcagatccagaatatattgaagcagttgtaaaacatttagctgcaattagtgaactgccacttgttggtgcagaagatttagtagatgcaacgcaaaatacggatgcatacacagaagtatcagcagcacttaaagtatgtatgatgaatatgtctaaaattgcgaatgaccttcgcttaatggcatcaggtccacgtgttggcttagcggaaattatgctacctgctcgtcaaccaggttcttctattatgccagggaaagtaaaccctgttatgccagaagtaattaatcaaattgcattccaagtaattggtaacaaccatacaatttgtcttgcttcagaagcaggtcaattagaattaaacgtgatggaaccagtacttgttttcaacttactacaatcaattagcattatgaataacggtttccgtgcctttacagataattgcttaaaaggaattgaagcgaatgaagatcgcttaaaagagtatgttgagaagagtgtaggaattattacagccgtgaaccctcatatcggttatgaagcagcagctcgcgttgcgaaagaagcaatcgcgacagggcaatccgttcgagaactttgtgtgaaaaatggtgtattgtcacaagaagatttagagttaattttagatccatttgaaatgacacacccagggattgcaggagcaactcttttaaagaaaaattaa

SEQ ID NO: 16335 - protein, 476 aa, Bacillus anthracis str
MAMTNKNVRMEKDFLGGKELPIEAYYGIQTLRAVENFPITGYKIHESLIRAFAVVKKAAALANTDVGRLELNKGGAIAEAAQEILDGKWHDHFIVDPIQGGAGTSMNMNANEVIANRALELLGMEKGDYHYISPNSHVNMAQSTNDAFPTAIHIATLNALEGLLQTMGYMHDVFELKAEQFDHVIKMGRTHLQDAVPIRLGQEFKAYSRVLERDMKRIQQSRQHLYEVNMGATAVGTGLNADPEYIEAVVKHLAAISELPLVGAEDLVDATQNTDAYTEVSAALKVCMMNMSKIANDLRLMASGPRVGLAEIMLPARQPGSSIMPGKVNPVMPEVINQIAFQVIGNNHTICLASEAGQLELNVMEPVLVFNLLQSISIMNNGFRAFTDNCLKGIEANEDRLKEYVEKSVGIITAVNPHIGYEAAARVAKEAIATGQSVRELCVKNGVLSQEDLELILDPFEMTHPGIAGATLLKKN

SEQ ID NO: 16336 - DNA, 1461 bp, Photobacterium profundum
  CDS (1)..(1461)
atgtctcagatgattgatcttgaaaagaatgaagcaactctaaatgttgctactcgcattgaagaagatttacttggtgaacgtcacgttcctgctgacgcttactggggtatccacacacttcgcgctgttgaaaacttcaacatctcaaacactacaatttctgacgttcctgattttgttcgcggtatggttttcactaagaaagcagctgcaatggcgaacaaagagctaggcgctattccttcagaagttggtaactacatcatccaagcatgtgatttaattctagacactggtaagtgtatggatcaattcccgtctgatgtttaccaaggcggtgctggtacgtcagtgaacatgaacacaaacgaagttattgccaaccttgctcttgaactgatgggcaaagacaaaggcgaatacgacgtcgttaaccctaatgatcacgtaaacaaatcgcaatcaactaactgtgcgtacccaacaggcttccgtgttgctgtatacaacagcatcatgacaatgattgaagctattgattacctaaaaggtgctttcgacgcgaaagataaagaattcgcaggcgttctaaagatgggtcgtactcagcttcaagatgctgtaccaatgactgttggtcaagagttccacgcgtactcagttcttcttaaagaagaaatcaaaaaccttaagtacacagcagatcttctacttgaagtgaacttaggtgcaacagctatcggtactggcttaaacgcagcgactggttaccaagaacttgctgttcagcgtcttgctgaaatcactggtctaccatgtacaccagcagaagatttaatcgaagcaacgtctgactgtggcgcatacgtaatgatccacggtgctcttaagcgtactgcagttaaactgtctaagatttgtaacgacttacgtctactttcttctggtcctcgtacaggtttgaacgaactaaacctaccagaaatgcaggctggttcttctatcatgccagctaaagtaaacccagtaattcctgaagtagttaaccaagtttgcttcaaggttattggtaacgacacaacaattactttcgcagcagaagctggtcagcttcagttgaacgtaatggaacctgttatcggtcaagcactgttcgaatctatttcacttctgaaaaacgcttgtgtaactctacgtgataagtgcgtatcgggtatcacagtgaataaagaagtatgtgaaagttacgtatttaactcaatcggtatcgtgacttacctaaacccattcattggccaccacgaaggtgacattgttggtaagatttgtgctgaaacaggtaaaaacgtacgcgaagttgtacttgagcgtggtcttctaacggaagagcaactagacgacatcttctcggtacaaaacctaatgcacccagaatacaaagcgaagcgttataactaa

SEQ ID NO: 16337 - protein, 486 aa, Photobacterium profundum
MSQMIDLEKNEATLNVATRIEEDLLGERHVPADAYWGIHTLRAVENFNISNTTISDVPDFVRGMVFTKKAAAMANKELGAIPSEVGNYIIQACDLILDTGKCMDQFPSDVYQGGAGTSVNMNTNEVIANLALELMGKDKGEYDVVNPNDHVNKSQSTNCAYPTGFRVAVYNSIMTMIEAIDYLKGAFDAKDKEFAGVLKMGRTQLQDAVPMTVGQEFHAYSVLLKEEIKNLKYTADLLLEVNLGATAIGTGLNAATGYQELAVQRLAEITGLPCTPAEDLIEATSDCGAYVMIHGALKRTAVKLSKICNDLRLLSSGPRTGLNELNLPEMQAGSSIMPAKVNPVIPEVVNQVCFKVIGNDTTITFAAEAGQLQLNVMEPVIGQALFESISLLKNACVTLRDKCVSGITVNKEVCESYVFNSIGIVTYLNPFIGHHEGDIVGKICAETGKNVREVVLERGLLTEEQLDDIFSVQNLMHPEYKAKRYN

SEQ ID NO: 16338 - DNA, 1431 bp, Bdellovibrio bacteriovorus
  CDS (1)..(1431)
atggagttagtgatggaaaagttccgcgtagaaaaagatttgctgggtgaaaagaaagtccctgcggaagcttattacggcattcataccctgcgggcgatggagaactttcagatctcgggcatccctgtcggagccaatcaaagtttcgtgcgtggtctggcactggtgaaaaaagcctgcgcgttggccaatggtgaactgggcacaatcccggcggatgtttccaagtccttggttgaagcctgtgacatcgttttgcaggacccgaaaaaatggggtcagcagttcccatccgacgtttatcagggcggcgcggggacttcgatcaacatgaatgccaacgaagtgattgccaatatcgcattggaaaaacgcggtctgcaaaaaggcacctacgcggtgatcaaccctaatgatcacgtgaataagtgccagtccacgaatgatgcttatccgaccgctttccgagtggcgctgtatgaacacctgaacggaactttggcggcgctggattctttggctttggccttcgagaaaaaaggcaaagaattccagagcgttttgaaaatgggccgcacgcagttgcaggatgcagttcccatgtctttggggcaggagtttaacgcttttgccactttactaaaagaagacggtcgtctgatccgcactgttcagaaattcatgctggaagtgaacttgggggccaccgcgattgggactggcatcaacacacctccgggttatgcgtctttggcggtgcaaaagctggctgaggtcaccgggcatccgtttgttcagtcggaagattacatcgaagccaccagcgactgtggtgcctacatcattatctctggcgcactgaaacgcacggcagtgaaactttcgaaaatctgcaacgacttgcgcttgcttagttctggtccgcgtgcgggcttgaaagaaatcaacctgcctgaaatgcaggcgggttcttccatcatgccggcaaaagtgaatccggtgattccggaagttgtgaatcaggtcagcttcaaaatcatcggcaatgacctggcgatcaccctggcggccgaagcagggcagctgcagctgaatgtgatggaacctgtgatcgcctccagtctgtttgagtctttggatcttttgaagaatgcctgtgaaaccctggaacataaatgtgtgaagggtattacggccaatgcagaacgctgccgggactacgtcatgaacagcatcggtattgtgacttatctggatccgatcatcggtcacgatgaaggcgaccgtatcggaaaaatctgtgcggagaccggtcgcaacgtggctgaagtggccctggagcgaggcgtggtgactcaggcgcaactggatgaactgttctcaatggaaaatctgctgaacccgaaatacgtcggcaagaagcactag

SEQ ID NO: 16339 - protein, 476 aa, Bdellovibrio bacteriovorus
MELVMEKFRVEKDLLGEKKVPAEAYYGIHTLRAMENFQISGIPVGANQSFVRGLALVKKACALANGELGTIPADVSKSLVEACDIVLQDPKKWGQQFPSDVYQGGAGTSINMNANEVIANIALEKRGLQKGTYAVINPNDHVNKCQSTNDAYPTAFRVALYEHLNGTLAALDSLALAFEKKGKEFQSVLKMGRTQLQDAVPMSLGQEFNAFATLLKEDGRLIRTVQKFMLEVNLGATAIGTGINTPPGYASLAVQKLAEVTGHPFVQSEDYIEATSDCGAYIIISGALKRTAVKLSKICNDLRLLSSGPRAGLKEINLPEMQAGSSIMPAKVNPVIPEVVNQVSFKIIGNDLAITLAAEAGQLQLNVMEPVIASSLFESLDLLKNACETLEHKCVKGITANAERCRDYVMNSIGIVTYLDPIIGHDEGDRIGKICAETGRNVAEVALERGVVTQAQLDELFSMENLLNPKYVGKKH

SEQ ID NO: 16340 - DNA, 1575 bp, Corynebacterium diphtheriae
  CDS (1)..(1575)
atggcttcccaagctaaaaacacaaagggctcgaaaaacgccgaggtaaccaatgatgttctcgacggaaaaaccgaaggcaccgcggagaaagtaaacgatgcccccattgcatcagatgtaacaacaaagcacgccactaagaaagctgcaccaggattccgtatcgaagaagacctcttgggtgagatggaagttcccgacgaggtttattatggcgtccatactcttcgtgccatcgacaattacaagatctctagcaccaccattaatgatgtgccagagttcattcgtggcatggttcaggtaaaaaaggccaccgcgcttgccaaccgacgactccatactctgccgaaagacaagtgcgatgccattgtatgggcttgcgatcaaatcttggatcacggtcgttgcatggatcagttcccaatcgatgtgttccaaggaggcgctggcacaagcgtcaacatgaacactaatgaggtaatcgccaacctcgcactggagcatctgggtaagccaaagggatcctatgacatcatcaacccaaacgatgacgtcaacatgagccaatcaactaacgatgcctacccaactggattccgtttgggtgtctatgaggcgatgcaggaactgatcactcgtattgacaatctacagttcgcattccatgccaaaggtgatgagttcaccgatattctgaagatgggtcgcacacagctccaagatgctgtaccgatgactttaggcgaggaattccaggcattcgctcataacttggctgaggagcaaagcgttctgcgtatggcttccgaccggctcaaggaagttaacttgggcgcaaccgctatcggtactggcttgaacaccccagccggttaccgttatcaggttgtagccgcattgtccgagtgcaccggcttggaaattaagtctgcacgcgatcttattgaagctacttcagacactggtgcgtatgtccttgcccatgcagctgttaagcgtactgcgatgaagctttctaagatctgcaatgatcttcgactgctcagctccggaccacgcgcaggtctcaacgagattaatcttcccgctcgagctgcaggttcatcgatcatgccggcaaaggtcaacccagttatccctgaggttgttaaccaggtttgcttcaaggtttttggtaacgatcttactgtcaccatggcggcagaagctggccagctccagctcaatgtgatggaaccggttatcggccaagccttgtttgagtcgattcgaattctcggtaatgctgcagtcacccttcagcacaagtgtgtcgaagggattaccgcaaatgctgacgtatgtcgcgcctacgtagataattccattggtatcgttacctatctcaaccctttcattggtcaccatatgggtgacgtgattggcaaggaagctgctgagaccggcaagtccgtacgtgagcttgtattggaaaagggactaatggatgaagagactttgaaccaaatcctgtccaaggaaaatctaatgcacccttcgtttcgtggaaccctctacctagataactag

SEQ ID NO: 16341 - protein, 524 aa, Corynebacterium diphtheriae
MASQAKNTKGSKNAEVTNDVLDGKTEGTAEKVNDAPIASDVTTKHATKKAAPGFRIEEDLLGEMEVPDEVYYGVHTLRAIDNYKISSTTINDVPEFIRGMVQVKKATALANRRLHTLPKDKCDAIVWACDQILDHGRCMDQFPIDVFQGGAGTSVNMNTNEVIANLALEHLGKPKGSYDIINPNDDVNMSQSTNDAYPTGFRLGVYEAMQELITRIDNLQFAFHAKGDEFTDILKMGRTQLQDAVPMTLGEEFQAFAHNLAEEQSVLRMASDRLKEVNLGATAIGTGLNTPAGYRYQVVAALSECTGLEIKSARDLIEATSDTGAYVLAHAAVKRTAMKLSKICNDLRLLSSGPRAGLNEINLPARAAGSSIMPAKVNPVIPEVVNQVCFKVFGNDLTVTMAAEAGQLQLNVMEPVIGQALFESIRILGNAAVTLQHKCVEGITANADVCRAYVDNSIGIVTYLNPFIGHHMGDVIGKEAAETGKSVRELVLEKGLMDEETLNQILSKENLMHPSFRGTLYLDN

SEQ ID NO: 16342 - DNA, 1407 bp, Desulfovibrio vulgaris
  CDS (1)..(1407)
atggaatacaggacagaacgtgacagcctcggagaaaaacgggttcctgccggtgtctactacggcgtgcagacattgcgtgccttggagaatttccagataacggccatgccggtggcgacgtttccgcggttcatacaggcactcgccgccgtcaagaaggctgcggccctcgccaacatggaactcggtctgcttgatgcgggcgtcggtgaagccatcgtcaatgcctgccgcgacgtgcgcgcgggcaggttcgacgaccagtttcccgtggatgtcatccagggcggggcgggaacctcggtgaacatgaacgccaacgaggtcatcgccaaccgggcgctggaactcctggggcacccgaaagggcgctatgaggtcataagccctctcaatcacgtgaacctctcgcagtcgaccaacgatgtctatccgacggcgctacgcatcgccctcgtctggtatgcacgcgagttgtcaacggcgctgcgcgacctgcgggccgccttcgacgcgaaaggtgacgagtttgccggggtcatcaagatggcgcgcacccagttgcaggacgcggtccccatcacgctgggtgccgaattcgcggcatggggcgtcaccatcggcgaggacatcgacaggcttgatgacgctgcgcgtctgctgtgcgaggtgaacataggtgccacggccgtcggcaccggcatcaacagtgtgccgggatatgcctcgctggtacgtgaacgtctcgcggatatatgcggtctgcctctggtcaccgccgccaacctcgtggaggcgaccagtgacgcaggtgcctatgtcatgctgtccggtctgctcaaacgcgtggccgtgaagctgtcgaagatatgcaacgacctgcggctgcttgcttccgggccgttcaccggtctgcatgaaatcaacctgccacccatgcagccggggtcgagcatcatgccgggcaaggtcaaccccgtcattcccgaagtggtcaatcaggtctgctatcaggtgatcggcaacgacctcacggtgaccttcgccgccgagggggggcagcttgaactcaatgtctttctgcctgtcatcgccctcaacctcttccagtcgttgcagatgctcacgaaggcgtcgcgcaccctgcgcgagcggtgtgttgtcggcatcaccgccaaccccgaacggtgcctcgagcttgtgcggcattctctcggggtcgtcacggcgcttgctccggtgataggctatgagaccgccgcccgactggccaaggaggcgcaggagagcgggcgttccgtgcccgaggtgctgcaggccgagggcatcatgacgccggaggagttcgaagagcttctggaccctgccaagatgctctccccacgcgatgttcgccggaggtga

SEQ ID NO: 16343 - protein, 468 aa, Desulfovibrio vulgaris
MEYRTERDSLGEKRVPAGVYYGVQTLRALENFQITAMPVATFPRFIQALAAVKKAAALANMELGLLDAGVGEAIVNACRDVRAGRFDDQFPVDVIQGGAGTSVNMNANEVIANRALELLGHPKGRYEVISPLNHVNLSQSTNDVYPTALRIALVWYARELSTALRDLRAAFDAKGDEFAGVIKMARTQLQDAVPITLGAEFAAWGVTIGEDIDRLDDAARLLCEVNIGATAVGTGINSVPGYASLVRERLADICGLPLVTAANLVEATSDAGAYVMLSGLLKRVAVKLSKICNDLRLLASGPFTGLHEINLPPMQPGSSIMPGKVNPVIPEVVNQVCYQVIGNDLTVTFAAEGGQLELNVFLPVIALNLFQSLQMLTKASRTLRERCVVGITANPERCLELVRHSLGVVTALAPVIGYETAARLAKEAQESGRSVPEVLQAEGIMTPEEFEELLDPAKMLSPRDVRRR

SEQ ID NO: 16344 - DNA, 1413 bp, Desulfovibrio vulgaris
  CDS (1)..(1413)
atgtctttgtctgatcaggacgccatccgcatcgagcacgacttgctcggcgactgtgcggttccccgcacggccttgcacggtgcgcatacgcaacgggcgctctccaatgtcgccctcagcggccgcccgttgcacccggaaatcatcagggcattcggggccgtgaagcgtgcctgtgcacgtaccaacatgaacctcggccacctctcccgtgaggtggccgaggccatcatcatggcatgtgatgagcttgaagatggcgggttgggcgagcacatcgtggtcgacgcactgcaaggcggcgctggcacctccgccaacatgaacgtcaacgaagtgctggcgaaccgcgccgaagagatgctgggcggcacgcgaggccagtaccagcttgtcgacccgctggcgcacgtcaatctgcatcagtccaccaacgatgtgttccccacggcagtgcggattgcggcattgcgtctgctggcgcgactcgaaccggcgattgccgcactccagtccgcattccagacgcacgaggcatcgttcgcgcaggtggtgcggctggggcgcacccagttgcaggatgccgtgcccatgacattcggggcagcctgtggcgcgtgggccgaagccctttcgcgggacaggtggcgcgtgttcaagtgttcggagagactgcgcgtcgtcaatctgggaggaaccgccatcggcaccggcatcgcagccccccgaagctacatcctctctgtcgtggacaggttgcgtgaagacacgggcctgcctctcgcaagagcagaaaacctcatggacgccacacagaatgtcgatgcgttcgtcgaggtgtctggcatactcaaggcccacgcctcgaatctgctcaagctttcctccgacctgcgcctgctggcgtcggggccgggtggcggcatcggcgaggtcgtactcccgcccgtccaggccgggtcgagcatcatgcccggcaaggtcaacccggtcgtgtgcgagaccgtggcacaggcggccatgcaggcaacggccaacgaccttgccatcaccctgtccgcccagcacggtcagcttgaactgaacgccttcatgccgctcatcgctgatgcgctgctgcatggcatcgagcttctcacgaatgcctgcgacctgttccgtacgcgctgtgtcgaagggttacaccctgatacggaaacctgcgcccggcacgtttccacatcgacagccacgcttacggcactcgttcctgaaatcggctacgccgccgcctctgaaatggcccgccacatgcgcgaacacggcacggacgtcttcggggctgccaaagcgacaggactcatcgacgaagaccggcttgcaaggctgctttctcctgaacgtctcgtggcactggggtacagaggatga

SEQ ID NO: 16345 - protein, 470 aa, Desulfovibrio vulgaris
MSLSDQDAIRIEHDLLGDCAVPRTALHGAHTQRALSNVALSGRPLHPEIIRAFGAVKRACARTNMNLGHLSREVAEAIIMACDELEDGGLGEHIVVDALQGGAGTSANMNVNEVLANRAEEMLGGTRGQYQLVDPLAHVNLHQSTNDVFPTAVRIAALRLLARLEPAIAALQSAFQTHEASFAQVVRLGRTQLQDAVPMTFGAACGAWAEALSRDRWRVFKCSERLRVVNLGGTAIGTGIAAPRSYILSVVDRLREDTGLPLARAENLMDATQNVDAFVEVSGILKAHASNLLKLSSDLRLLASGPGGGIGEVVLPPVQAGSSIMPGKVNPVVCETVAQAAMQATANDLAITLSAQHGQLELNAFMPLIADALLHGIELLTNACDLFRTRCVEGLHPDTETCARHVSTSTATLTALVPEIGYAAASEMARHMREHGTDVFGAAKATGLIDEDRLARLLSPERLVALGYRG

SEQ ID NO: 16346 - DNA, 1434 bp, Bacillus cereus
  CDS (1)..(1434)
atgatagcaacgaaggatatacgtatagaaaaagattttttaggtgaaaaggaagtaccaagtagagcttattatggtgtacaaacattacgtgcggtagaaaatttcccgattacagggtatcgcattcatccatcactcattacggcaatggcaattgtgaaaaaagcggcggcacttgcaaatatggatactggttacttagcgaaagacattggacacgaaattgcagaggcagcacaagaaattgttgatgggaaatttcatgatcaatttattgtagatccaattcagggcggtgctggaacttctattaatatgaatacaaatgaagtaatcgctaatcgagcgttagaacgtatgggatatgaaaaaggcgagtatgcaaaaattagcccaaatacgcatgtaaacatggctcagtcaacgaatgatgcgtttccaacaggaattcatattgcaactcttatgatgttagaagaacttcttattacaatggaagaacttcatgctgctttccttgcaaaagcaaaagagttcgatcacgtcattaaaatgggacgtacgcatttacaagatgctgttccgattcgtcttggacaagaatttgaagcgtatagcagagtgcttgcgcgtgatataaaaagaattaaacaatctcgccaacatttatatgaagtgaatatgggggcgacagctgttggtacgggattaaatgcaaaccctacctacattgaacaagtggttaaacacttacgaacatttagcggattcccacttgttggtgcagagcatttagttgatgcaacacaaaatacagatgcatacacagaagtatctgcagcattaaaagtatgtatgatgaatatgtctaaaattgcgaacgaccttcgtattatggcatctggtccacgtgttggattggcggaaattcaattaccagctcgtcaaccaggttcatctattatgccaggtaaagtaaatcctgttatggcagaagtaattaatcaagtcgctttccaagtaattggtaatgatcacacaatttgcttagcgtcagaagcaggacaactggagctcaacgtaatggagcctgtgcttgtatttaatttaattcaatctatcagtattatgaataacggattccgtgtattccgtgaatattgtattaaaggaattacagcaaatgaagaactgctgaagcaatatgttgagaaaagtgttggaattattacagcagttaaccctcatattggttatgaagtagcatcacgtattgcacgtgaagcaattgaaacaggaaaatctgttcgggagttatgtttagaacatggtgtactgacagaagaagaattagatattattttagatccattcgaaatgacgcatcctgaaattgctggtgcttctttactaaagaataagaagatgtaa

SEQ ID NO: 16347 - protein, 477 aa, Bacillus cereus
MIATKDIRIEKDFLGEKEVPSRAYYGVQTLRAVENFPITGYRIHPSLITAMAIVKKAAALANMDTGYLAKDIGHEIAEAAQEIVDGKFHDQFIVDPIQGGAGTSINMNTNEVIANRALERMGYEKGEYAKISPNTHVNMAQSTNDAFPTGIHIATLMMLEELLITMEELHAAFLAKAKEFDHVIKMGRTHLQDAVPIRLGQEFEAYSRVLARDIKRIKQSRQHLYEVNMGATAVGTGLNANPTYIEQVVKHLRTFSGFPLVGAEHLVDATQNTDAYTEVSAALKVCMMNMSKIANDLRIMASGPRVGLAEIQLPARQPGSSIMPGKVNPVMAEVINQVAFQVIGNDHTICLASEAGQLELNVMEPVLVFNLIQSISIMNNGFRVFREYCIKGITANEELLKQYVEKSVGIITAVNPHIGYEVASRIAREAIETGKSVRELCLEHGVLTEEELDIILDPFEMTHPEIAGASLLKNKKM

SEQ ID NO: 16348 - DNA, 1392 bp, Treponema denticola
  CDS (1)..(1392)
atgcgaagggaacatgacttactcggagaattggatattccggaagatgcttattatggaattcaaacattccgcagtgttgaaaattttcaaattacaggattaaggctctgtgattttcccgattttattaagggtcttgcttatacaaagcaggctgcagccgaagccaaccatgaactcggctatttaagcgatgaagtttacaaggctatgattcaggcttgtaaagaagttgccgaaggcaaattcgataaggaatttgtagtcgatatgattcagggcggagcaggaacttctaccaatatgaatgcaaatgaagttatcgccaaccgcgcaaacgaaatcttaggaaaggccaagggaacttattcgccctgccatcccaataatcacgtaaactttgctcaatctacaaacgacgcttatcctacagctgcaaagctcggcatctcgttaaatacaccggctcttatagatgaactcaaatctcttgttgcttcttttagaaaaaaggcccaagaacttggagaaaatatcaagatgggaagaacccagcttcaagatgccgtacccatgaccctcggccaagagtttgaatcctatgccgcttctttggaaaacgaaattcctcagattcagtttgcaagggaaaatcttcacaccataaacatgggagctaccgctatcggaacaggtatcaactcggatcctaactatacaccgaaagtaacctctcatctggcaaaaatttcgggtcttgatctaaaggctgcaaaaaacatgatagctgccacgaacgatacatccgactttgtaacatattcttcacaattaaagcgcctttctgcaaagctttcaaagatatgcagcgatttacgccttctttcttcgggccccagaacaggactttacgatataagtcttcctccgatgcagcccggttcttctatcatgcccggaaaggtaaacccggttattcctgaggttgtcaatcaggtttgctacagggttatcggaaatgatactgccgttatcttggctgcagaatcaggccagcttgaactcaacgtttttgaacccgttataatttattctatctttgagtcgattaagcttcttataaatgcaatgaagactttgagggaacgatgcgttacgggcattgtaggaaactatgagcattgtaaggaaagcgttcaccgaagtatcggcttggttacggccttaaatcccgtcatcggttatgaggcttcttccgatattgcaaagactgccttgcgcgataaccgcagcgtttatgaccttgttttggaaagagggcttctttcaaaagaaaaattggatgaggttttaaaacccgaaaacatgacaaagcccagaaagctttag

SEQ ID NO: 16349 - protein, 463 aa, Treponema denticola
MRREHDLLGELDIPEDAYYGIQTFRSVENFQITGLRLCDFPDFIKGLAYTKQAAAEANHELGYLSDEVYKAMIQACKEVAEGKFDKEFVVDMIQGGAGTSTNMNANEVIANRANEILGKAKGTYSPCHPNNHVNFAQSTNDAYPTAAKLGISLNTPALIDELKSLVASFRKKAQELGENIKMGRTQLQDAVPMTLGQEFESYAASLENEIPQIQFARENLHTINMGATAIGTGINSDPNYTPKVTSHLAKISGLDLKAAKNMIAATNDTSDFVTYSSQLKRLSAKLSKICSDLRLLSSGPRTGLYDISLPPMQPGSSIMPGKVNPVIPEVVNQVCYRVIGNDTAVILAAESGQLELNVFEPVIIYSIFESIKLLINAMKTLRERCVTGIVGNYEHCKESVHRSIGLVTALNPVIGYEASSDIAKTALRDNRSVYDLVLERGLLSKEKLDEVLKPENMTKPRKL

SEQ ID NO: 16350 - DNA, 1392 bp, Geobacter sulfurreducens
  CDS (1)..(1392)
atgacgttccgggtcgagaaggataccctcggtgaggtgcgggttccggcggacgcctactacggcgcccagacggtccgggccgtggagaatttccccatctccgggctgcggccccatccggccctcgtccgggcgacggtgctcgtcaaaatgtgtgcggcccgggccaacatggccacgggcaggctcgattcccggcttggagacgctatcgtccgggcggccgacgagtgcctggccggtgcctttgatgcccacttcgtggtggacccgtttcaagccggcgccggcacctcccacaacatgaacgtgaacgaggtcctcgccaaccgggccaatgaactgctgggagaggagcggggcaggtatgctcccgtccatcccaacgaccacgtgaacatggcccagtccaccaacgacgtcttccccacggccatgcgtctggcggcccttcgggtggcgggggatctccggccggccctagagggactcgttgccgcgcttcggaaaaagtccgctgaattcgacggcattctcaagagcggccggactcacctgcaggatgcggtgccgatccgtctcggccaggagttcgaggcgtgggccgtggcgctggagaagaacctggccgccatcgagggggcggtgccgggccttgcggaactgggtatcggcggcaccgcggcaggtaccggcatgaacgccgagccggcctacatcgatcttgtggtggcagagctcgcccgggaaaccggctttcccctcgtacggggtgcgaacctggttgagcggatgcagaacatggaccccttcgtggccctctcctccgctctcaagggacttgccgtaaacctcgcccgtatcgccaacgacctgcggctcctttcctctggcccccggaccgggctggccgagatcgcgctgccggcgctgcagcccggctcctctatcatgccggggaaggtcaacccggtcatggccgaggtgaccgacatggtcgcctttcaagtgatgggtgcggacacgacaatcatgctcgccgcccaggcagggcagctggagcttaacgtcatgatgccggtcatcgcgttcaaccttctgttcagccttgaaatcctgaagaacacggtgcccaagctggctgatgcctgcatcgccggcatcactgcggaccgggagcgctgcctccggtacctggagcagtcggtaggactggccacggtgctcgcgccctacatcggctatgccgcggccgcggaggtggccaaggaatcgactgccacgggccggagtatccggcagatcgtggaagaccggcagctcctgtcggccgggcgtctggcggagatcctcgaccccttccctctcaccagccctggcgttccgtga

SEQ ID NO: 16351 - protein, 463 aa, Geobacter sulfurreducens
MTFRVEKDTLGEVRVPADAYYGAQTVRAVENFPISGLRPHPALVRATVLVKMCAARANMATGRLDSRLGDAIVRAADECLAGAFDAHFVVDPFQAGAGTSHNMNVNEVLANRANELLGEERGRYAPVHPNDHVNMAQSTNDVFPTAMRLAALRVAGDLRPALEGLVAALRKKSAEFDGILKSGRTHLQDAVPIRLGQEFEAWAVALEKNLAAIEGAVPGLAELGIGGTAAGTGMNAEPAYIDLVVAELARETGFPLVRGANLVERMQNMDPFVALSSALKGLAVNLARIANDLRLLSSGPRTGLAEIALPALQPGSSIMPGKVNPVMAEVTDMVAFQVMGADTTIMLAAQAGQLELNVMMPVIAFNLLFSLEILKNTVPKLADACIAGITADRERCLRYLEQSVGLATVLAPYIGYAAAAEVAKESTATGRSIRQIVEDRQLLSAGRLAEILDPFPLTSPGVP

SEQ ID NO: 16352 - DNA, 1437 bp, Yersinia pestis
  CDS (1)..(1437)
atgtcaaataacattcgtattgaagaagacctgttaggtacacgagaagtccccgcagaggcttactacggtgttcataccctgcgtgcgattgaaaacttctatatcagtaacagtaaaatcagtgacgtgccggaatttgtacgtggcatggtcatggtaaaaaaagcggcggcaatggctaacaaagagttgcataccatcccgcgtaaaattgcagacatcattattcaggcatgtgatgaagttctggataaagggaaatgtatggatcagttccccgttgatgtgttccagggcggcgcaggtacctctctcaatatgaacaccaacgaggtcttggccaatattggcctggagctgatgggccaccaaaaaggggaatatcagtaccttaaccctaacgaccatctgaacaaatgccagtccaccaacgatgcctacccaaccggtttccgcattgcggtctacgcctccatcctcaagttgatcgatgctatcaaccaattaggcgaaggtttcggtagaaaatctaaagaattcgagaaaattctgaaaatgggccgtacccaattacaggatgccgtacccatgactctgggccaggaattccgcgctttccaggtgttattgaatgaagaaaccaagaacctgcaacggaccgccgagttgctattggaagtcaacctgggtgccactgccatcggcactgcgctgaatacaccagaaggttattcacaacttgccgtgcagaaactggcagaaatcagcggattagcctgtgttcctgccgaagatttgatcgaagcgacctctgattgcggcgcttacgtgatggtacacagcgccctgaaacgcctggctgttaagatgtcaaaaatctgtaacgacctacgtttgctctcatctggcccacgtactggtttgaatgaaatcaacctgccagaattgcaggcgggctcttctatcatgcctgcaaaagtgaacccggtgatccctgaagttgtaaatcaggtttgttttaaggtgatcggcaacgatacttgcattactatggcggctgaagcgggtcagcttcagttaaacgtgatggaaccggtaattggtcaggccatgtttgagtctatccatatcctgactaatgcgtgttacaacctgttagagaagtgcatcaatggcattaccgctaacaaagaggtctgcgagcgctacgtctttaactccataggcatcgtcacttatcttaacccgttcattggccaccataatggtgacattgtgggtaaaatctgtgcggaaaccggtaaaaatgtgcgggaagtggttctggagcgcggtttgttaactgaagccgaactggacgacattttctctgttgaaaacctgatgcacccagcctataaagcgaaacgttataccgatgaaaatgaacaataa

SEQ ID NO: 16353 - protein, 478 aa, Yersinia pestis
MSNNIRIEEDLLGTREVPAEAYYGVHTLRAIENFYISNSKISDVPEFVRGMVMVKKAAAMANKELHTIPRKIADIIIQACDEVLDKGKCMDQFPVDVFQGGAGTSLNMNTNEVLANIGLELMGHQKGEYQYLNPNDHLNKCQSTNDAYPTGFRIAVYASILKLIDAINQLGEGFGRKSKEFEKILKMGRTQLQDAVPMTLGQEFRAFQVLLNEETKNLQRTAELLLEVNLGATAIGTALNTPEGYSQLAVQKLAEISGLACVPAEDLIEATSDCGAYVMVHSALKRLAVKMSKICNDLRLLSSGPRTGLNEINLPELQAGSSIMPAKVNPVIPEVVNQVCFKVIGNDTCITMAAEAGQLQLNVMEPVIGQAMFESIHILTNACYNLLEKCINGITANKEVCERYVFNSIGIVTYLNPFIGHHNGDIVGKICAETGKNVREVVLERGLLTEAELDDIFSVENLMHPAYKAKRYTDENEQ

SEQ ID NO: 16354 - DNA, 1401 bp, Bradyrhizobium japonicum USDA 110
  CDS (1)..(1401)
atgagccgtacggagcaggatttcctcggacagcgtgagatcgccgacgatatttactacggcgtccagaccatccgcgggaaggagaacttccacatcaccggcattccgatgaaccaggagccttacttcgtgaaggcgctgggttacgtgaagaaggccgcggcgatggccaatcgcgatctcggcgtgatcgacgccagggtggccgatgcgatcatcctcggctgcgaccgcgtgattgccggcgacatgatggatcaattcgtcaccgacttcatccagggcggcgccggcacctcgaccaacatgaacgccaacgaggtgatcgccaacctcgcgctggaatcgctgggcttcaagaagggcgactaccagcacgtcagcccgaacgatcatgtgaactacggccagtcgaccaacgacacctatccgaccgcctttcgcctcgcgctgatcctgcggctcgagagctacatgacggcgctgcgccagctccaggaggcgttcttcgccaagggccgtgagttcgatcgcgtgctgaagatgggccgtacgcatcttcaggacgccgtgccgatgtcgctcggcgccgaattccgcggctggggtaccaccatgggcgaggaggtcgatcgtatctccgaggcacgggcgctgctgcgcgagatcaatctcggcgcgaccgcgatcggcacctccgtcaccgcggcgcacggctatcccaagctcgccgtccggcatctgagcgcgctgaccggcatcgacttcattctcgccggcgacctcgtcgaagcgacctcggacaccggtgcctatgtgcagctctccggcgtgctcaagcgcacggcgagcaagctgacaaaaatctgcaacgacatccggttgctggcttcgggcccgcgcgccggcttcaacgagatcaacctgccgcagctccagccgggctcctcgatcatgccggggaaggtcaatcccgtgatccccgaggtcgtcaaccagaccagcttccttgtcatcggcctcgacaccacggtgacgcttgccgcgtccgccggccagctccaactcaatgtgatggaaccggtgatctcgttcgcgctgttcttctcgatccgcaccatggagcgcgcggtcaacagcctgcgcgagaactgcgtcgtcggcatcaccgccaacgcggagcacacccgcaacatggtgctgaactcgctcggtatcgtcacggtgctgaagccgctgctcggctacaagcaatgcgccgagatcgcgcgcgagggttacaagagcggcaagtcgctgcaccagatcgtggtggtcgagcgcaagctgctgacgcaggagaagtgggacgagatgttctcgttcgagcggctgatcaatccggacctgattgcgtga

SEQ ID NO: 16355 - protein, 466 aa, Bradyrhizobium japonicum USDA 110
MSRTEQDFLGQREIADDIYYGVQTIRGKENFHITGIPMNQEPYFVKALGYVKKAAAMANRDLGVIDARVADAIILGCDRVIAGDMMDQFVTDFIQGGAGTSTNMNANEVIANLALESLGFKKGDYQHVSPNDHVNYGQSTNDTYPTAFRLALILRLESYMTALRQLQEAFFAKGREFDRVLKMGRTHLQDAVPMSLGAEFRGWGTTMGEEVDRISEARALLREINLGATAIGTSVTAAHGYPKLAVRHLSALTGIDFILAGDLVEATSDTGAYVQLSGVLKRTASKLTKICNDIRLLASGPRAGFNEINLPQLQPGSSIMPGKVNPVIPEVVNQTSFLVIGLDTTVTLAASAGQLQLNVMEPVISFALFFSIRTMERAVNSLRENCVVGITANAEHTRNMVLNSLGIVTVLKPLLGYKQCAEIAREGYKSGKSLHQIVVVERKLLTQEKWDEMFSFERLINPDLIA

SEQ ID NO: 16356 - DNA, 1416 bp, Wolinella succinogenes
  CDS (1)..(1416)
atggcatctacacgaatagaacacgatcttattggggacttagagctaagtaacgactgctattatggagttcaaactgctagagcgaaagagaacttccacatctcaggcgtcctactctcaagcatgcccactttcattgcttcactcgctaaagtcaaaaaagccgctgcactcgccaactttgagcttgggctcttggatgagaagatcaaaaacgccatctgcgaagcgtgcgatctcatcatcgctggaaaatatcacgaccaattcgtcgtggatgccatccaaggaggcgctggaacttccaccaacatgaacgccaatgaagtgatcgccaacgtcgcacttgagctcatgggacataaaaagggtgaatataaacattgccaccccaacaaccacgtcaacctctcacaatctactaatgatgcctatcctacggcattccgcgttgccctgtatgaaaaactcatcgagctcaccgtctccatgggaatcctaagagactcttttgccaaaaaggccgaggaattcaaagatatcatcaagatgggtcgaacccagctccaagacgctgtgcccatgaccctaggtcaagagtttaaaacctacgccgtcatgatgaccgaagatatcgatcgcgtgctagaggctagaaaccttgttcgagagatgaaccttggggcaaccgcgattggaacaggaatcaactctcaccctgactacgctacgcttgtagagaaaaaacttcaagaggtcacaggccgaccctttatcaccgccagcgatcttgttgaggcgactcaagacacaggggcttatgtccaaatctctggtgttcttaagcgtgtctccaccaaagtctccaaaatctgcaacgatctaagactccttagctcaggcccaagagcgggacttagcgagatcaatcttccccctatgcagcctggtagctccattatgcctggaaaggttaatcctgtgattcccgaagtggtcaatcaggtctgctaccacgttattggcgccgacatgactgtaactattgcctctgaagggggtcagcttcagctcaacgtttttgagcccgtcatcgcctttagcctctttagctctatcaacatgatgagaagagcttttgaaactttggctgaaaaatgcgtgaatggaatcaccgccaacgctgacaactgccgcgactatgtccttaagagcatcggactcgtcacagcgctcaacccctacatcggatatgagaactccacttcagtggccaaagaggcgctagagtcaggcaagtccgtccacgatatcgtcctagagcgcaaacttcttagcaaagaagagctagaagagattattcgacccgaaaacatgatcaagcccaaagtcgtcactctaacaaaaaaataa

SEQ ID NO: 16357 - protein, 471 aa, Wolinella succinogenes
MASTRIEHDLIGDLELSNDCYYGVQTARAKENFHISGVLLSSMPTFIASLAKVKKAAALANFELGLLDEKIKNAICEACDLIIAGKYHDQFVVDAIQGGAGTSTNMNANEVIANVALELMGHKKGEYKHCHPNNHVNLSQSTNDAYPTAFRVALYEKLIELTVSMGILRDSFAKKAEEFKDIIKMGRTQLQDAVPMTLGQEFKTYAVMMTEDIDRVLEARNLVREMNLGATAIGTGINSHPDYATLVEKKLQEVTGRPFITASDLVEATQDTGAYVQISGVLKRVSTKVSKICNDLRLLSSGPRAGLSEINLPPMQPGSSIMPGKVNPVIPEVVNQVCYHVIGADMTVTIASEGGQLQLNVFEPVIAFSLFSSINMMRRAFETLAEKCVNGITANADNCRDYVLKSIGLVTALNPYIGYENSTSVAKEALESGKSVHDIVLERKLLSKEELEEIIRPENMIKPKVVTLTKK

SEQ ID NO: 16358 - DNA, 1452 bp, Vibrio vulnificus
  CDS (1)..(1452)
atggctaccctaactgaagctccaaaagcatcaactccggccactcgtattgaagaagatctattaggccaacgtcacgttccggctgacgcttactacggtattcacacgctgcgcgccatcgaaaacttcaacatctcaaatgtcactatttctgacgtaccagaattcgttcgtggcatggttatgaccaaaaaagccgctgcgcttgctaacaaagaattgggcgcaattcctaagaatgtcgcggattacatcattcaagcgtgtgacctaatgttggaaactggcaaatgcatggatcagttcccatcagacgtattccaaggcggtgcgggcacttctgtgaacatgaacaccaacgaagtacttgccaacattgctctagaattaatgggcaaagagaaaggcgattacgacgtggtgaacccaaacgatcacgtgaacaagagccaatcaaccaactgtgcctacccaacaggcttccgtatcgcggtttacaacagcatccataaattgatggaagcgattgaatacctaaaaggtgcgtttgagctgaaatctcaagagtttaacgacatcctaaaaatgggccgtactcagttgcaagatgcagttccaatgactgtcggtcaagagttccacgcttgggcagtgacactaaacgaagagatccgtgcgctagactacacctcgaagctacttcttgaagtgaacctaggtgcaacggcaatcggtactggcttaaacacacctcctggttaccaagcacttgccgtgaaacacctagcggaagtaactggcctagaagtggttccagcagaagaccttatcgaagcaacttcagactgtggtgcttacgtaatggcacacggcgctctaaaacgcctagcggtgaaattgtctaagatctgtaacgacttgcgtctgctttcttctggtcctcgcgctggtttgaacgaacttaacttgccagaaatgcaagccggttcttcaatcatgccagcaaaagttaacccagttatcccagaagtggttaaccaagtgtgtttcaaagtactgggtaacgacaacacgatttctttcgcagccgaaggcggtcagctacagctgaacgtaatggagcctgtgattggtcaagcgatgtttgaatcgatttcactactacaaaacgcgtgtgtgaacctacgtgacaagtgtatcgacggcatcactgtgaacaaagagatctgtgaaaactacgtttacaactctatcggtatcgttacttacctaaacccatacatcggccaccacgaaggtgacatcgttggtaagatctgtgcggaaaccggtaagagcgtccgtgaagtagtgcttgagcgtggcttgctgacatctgaagagttggatgacatcctgtctgtgcagaacttcatgcacccaacttacaaagcaaaacgttacgaataa

SEQ ID NO: 16359 - protein, 483 aa, Vibrio vulnificus
MATLTEAPKASTPATRIEEDLLGQRHVPADAYYGIHTLRAIENFNISNVTISDVPEFVRGMVMTKKAAALANKELGAIPKNVADYIIQACDLMLETGKCMDQFPSDVFQGGAGTSVNMNTNEVLANIALELMGKEKGDYDVVNPNDHVNKSQSTNCAYPTGFRIAVYNSIHKLMEAIEYLKGAFELKSQEFNDILKMGRTQLQDAVPMTVGQEFHAWAVTLNEEIRALDYTSKLLLEVNLGATAIGTGLNTPPGYQALAVKHLAEVTGLEVVPAEDLIEATSDCGAYVMAHGALKRLAVKLSKICNDLRLLSSGPRAGLNELNLPEMQAGSSIMPAKVNPVIPEVVNQVCFKVLGNDNTISFAAEGGQLQLNVMEPVIGQAMFESISLLQNACVNLRDKCIDGITVNKEICENYVYNSIGIVTYLNPYIGHHEGDIVGKICAETGKSVREVVLERGLLTSEELDDILSVQNFMHPTYKAKRYE

SEQ ID NO: 16360 - DNA, 1428 bp, Porphyromonas gingivalis W83
  CDS (1)..(1428)
atggaattaaaaaagactacacgtatcgaaagcgatcttatcggagaacgcgagatacccggccatattctatatggcgtacagacgctgcgtggtatagaaaacttccccatcagcaattttcatctgaacgattaccccctgtttatcaatggcttggccatgacgaaatgggcggctgcagtggccaatcatcggctcggtctcttgaccgatgcccagaaagacggcatcgtgaaagcctgcaaggaaatcctcgaaggcaagcaccacgagcatttccccgtggatatgatccaaggcggtgcaggaacgaccacgaatatgaacgccaacgaggtgatttgcaaccgtgccttgcagatcatgggacacgaggcaggcgaatttgcccacctctcccccaatgatcacgtgaactgctcgcagagcaccaacgatgcttatccgacagctatccacctcggcctttacgctacatatctgaagttccgcccccatcttctggatctcatcgagtcgctgcgtgccaagagccgcgaatttgcccatgtactcaagatgggacgtactcagctcgaagatgctgtgcctatgtctctgggacagacgttcggcggatttgcttccatcttgcaggatgaaatcaaaaatctggactttgccgccgaagagttcctgaccgtgaatatgggtgctacggctatcggcacgggtatctgcgcccagccgaactatgccgaatactgcatagaggctcttcgtgaagtcaccggctgggacattcgtctcagtgccgatctggtaggggcaacgagcgacacttccgtgatggtaggatattcgtctgccttgcgccgtatctgtgtgaaggtgaacaagatttgcaacgacctgcgtctccttgccagcggtcctcgttgcggtttgcacgaattcaatctgcctgccatgcagccgggttcgtccatcatgccgggtaaggtgaatcctgtgattccggaagtaatgaatcagatctgctataaggtgatgggcaacgacctgaccgtaacgatggcaggcgatgcagcccaaatggagctgaacgctatggagcctgtgatggcacaatgctgcttcgaaagttcggatctgctcatgaacggattcgatacgctgcgtacactctgtatcgatggcatcacggccaacgaggacgaatgccgtgggtatatccgcaacagcatcggtatcgttacggctctgaatccgatcatcggctataagaattcgaccaagatcgccaaggaagcgatggaaacgggacgtggcgtttacgacctcgttttggaacacgacatcctgtcgaaagaggatctggatacgatactctcaccggagaatatgatcaagccggtcaagctcgacatcaaaccgcgtcgctga

SEQ ID NO: 16361 - protein, 475 aa, Porphyromonas gingivalis W83
MELKKTTRIESDLIGEREIPGHILYGVQTLRGIENFPISNFHLNDYPLFINGLAMTKWAAAVANHRLGLLTDAQKDGIVKACKEILEGKHHEHFPVDMIQGGAGTTTNMNANEVICNRALQIMGHEAGEFAHLSPNDHVNCSQSTNDAYPTAIHLGLYATYLKFRPHLLDLIESLRAKSREFAHVLKMGRTQLEDAVPMSLGQTFGGFASILQDEIKNLDFAAEEFLTVNMGATAIGTGICAQPNYAEYCIEALREVTGWDIRLSADLVGATSDTSVMVGYSSALRRICVKVNKICNDLRLLASGPRCGLHEFNLPAMQPGSSIMPGKVNPVIPEVMNQICYKVMGNDLTVTMAGDAAQMELNAMEPVMAQCCFESSDLLMNGFDTLRTLCIDGITANEDECRGYIRNSIGIVTALNPIIGYKNSTKIAKEAMETGRGVYDLVLEHDILSKEDLDTILSPENMIKPVKLDIKPRR

SEQ ID NO: 16362 - DNA, 1425 bp, Photorhabdus luminescens subsp
  CDS (1)..(1425)
atgtcaaacaacattcgtatcgaagaagacctgttaggtaaacgagaagtccctgctgaagcctattatggtattcacaccttacgtgcgattgaaaacttccatatcagtaacaacaccattaatgatgtacccgaattcatccgtggcatggtgatggtaaaaaaagccgcagccttagctaacaaagagctacaaactattcctaaaaaaattgctgacatcatcatcaaagcatgtgacgaagtgctctataccggcagatgcatggatcagtttccggtcgatgtgtttcaaggcggtgccggtacttcactcaacatgaataccaatgaggttctggcaaacattggtctggaactgttaggccataaaaaaggcgaatatgagtacctgaatcccaatgaccatctgaataaaagccagtcaactaacgacgcctacccaactggcttccgcatcgcggtttataactccatcctgaaactgatcgagtctattgagctgttaattgtgggtttcgataaaaaatccagagaatttaatgacattctaaaaatgggtcgtacccaattacaggatgctgttcccatgacactggggcaggaattcaacgcattctctatcctgttgaaagaagaagttaaaaacctcaaccgaacctctgaattactgctggaaattaaccttggcgctactgctatcggtacccgcttgaatacagcaccaggttatcagaaattggcggttgaaaaactggcggaagtttcaggtttaccttgcgtaccagccgaagacctgattgaagccacttctgactgtggggcttacgttatggtccacggtgctctgaagcgcctggctgtcaaactgtctaaaatttgtaatgacctgcgtttgctttcttctggccctcgtgctggcctgaatgaaatcaacctaccagaattacaggcaggctcttctattatgccggcaaaagtgaacccggttattccagaagttgtgaatcaggtttgcttcaaagttattggtaacgatatttgtgttactatggcgtccgaagcaggccagttacagctcaatgtaatggaacctgctatcggtcaggccatgtttgaatctatctccctgctaagcaacgcttgccgcaacctggtagaaaaatgcgttaatggcatcacggctaacaaagaagtttgcgaaaatttcgtattcaactcgatcggtatcgtgacatatctgaacccattcatcggtcaccataatggtgacattgttggtaaaatttgtgctgaaaccggtaaaagtgttcgtgaagtcgttctggaacgaggcttactgaccgaaactcaattggatgacatcttctctgtagagaacctaaaatgcccatcttacaaggcaaaacgttttgacgattaa

SEQ ID NO: 16363 - protein, 474 aa, Photorhabdus luminescens subsp
MSNNIRIEEDLLGKREVPAEAYYGIHTLRAIENFHISNNTINDVPEFIRGMVMVKKAAALANKELQTIPKKIADIIIKACDEVLYTGRCMDQFPVDVFQGGAGTSLNMNTNEVLANIGLELLGHKKGEYEYLNPNDHLNKSQSTNDAYPTGFRIAVYNSILKLIESIELLIVGFDKKSREFNDILKMGRTQLQDAVPMTLGQEFNAFSILLKEEVKNLNRTSELLLEINLGATAIGTRLNTAPGYQKLAVEKLAEVSGLPCVPAEDLIEATSDCGAYVMVHGALKRLAVKLSKICNDLRLLSSGPRAGLNEINLPELQAGSSIMPAKVNPVIPEVVNQVCFKVIGNDICVTMASEAGQLQLNVMEPAIGQAMFESISLLSNACRNLVEKCVNGITANKEVCENFVFNSIGIVTYLNPFIGHHNGDIVGKICAETGKSVREVVLERGLLTETQLDDIFSVENLKCPSYKAKRFDD

SEQ ID NO: 16364 - DNA, 1410 bp, Gloeobacter violaceus PCC 7421
  CDS (1)..(1410)
atgcaaccaagaaccgagcgcgactcgatgggcgagcgcaccctggaggccggagcctattacggcatccagaccctgcgcgccgtcgagaatttcccgattagcggcatcggcccgctgcccgacttcgtgcgcgcctgcaccctcatcaaacgggccgccgcccgggtgaacgccgagcttgaatgcatccccaaagacgtggcccaggcgatcattggcgcctcggacgaggtgctggcgggccagtggagcgatcagttcgtggtcgatatctttcaggcgggcgccggcacctcccaccacatgaatatcaacgaggtgctcgccaaccgcgccctcgagctgctgggttacgcgcggggcgactacaagcaggtcaaccccaacgatcacgtcaactacggccagtccaccaacgacgtgatccccactgccatccgtctgggagcgctctttgcaagcgcgccgctgttggaggcgctaagcaccctgcaacaaagtttcgaggccaagggcaacgagtttttgcccatcgtcaaatccgggcgcacccacctgcaggacgcggtgcccataaggcttggggatgaatttctggcctatgcccagatcgtcggcgagcaccgcgcccgcatcgaaaccgcctgccgcgagctattggtgctgggcctggggggcagcgccgccggtaccggcctcaacacccatccccagtaccgggtgcgcgtcgtcgccgaactggcccggctgacagggcaccccctcacccccgccccccgaccgatggcggcaatgcagagcatggcgcccttcgtggccgtctccggcagcctgcgcaatctggcccaggatctggtcaagatcgcgggcgatctgcgcctgatggattccggccccaagacgggcctgcgtgagatcgaactgccgccggtgcagccgggttcgtcgatcatgcccggcaagtacaacccggtgctgtgcgagatgctcacgatggtcgcctttcaggtgatgggctacgaccaggcgattgccttggccgcccaggcgggccaactggaattgaacgtgatgatgccgctgatcgcctacgacttgctccacagcttcacgatcctcaccaacgccctcacggtctttcgagcgcgctgcatcgacggcatccaggcccaacccgagcgctgcctggcctacgccgagggctcgatcgccctggtgaccgctctcaatccccacatcggctatctcaacgccgccgccgtcgccaaagaatcgctcgcgaccggccgctccctgcgcgagatcgttctcgagcgggggctactgaccgaagcgcaactcgccgagatcctcgaccttgaagcgatgagccggttgccggagacgcaggccgcctcagaccggtag

SEQ ID NO: 16365 - protein, 469 aa, Gloeobacter violaceus PCC 7421
MQPRTERDSMGERTLEAGAYYGIQTLRAVENFPISGIGPLPDFVRACTLIKRAAARVNAELECIPKDVAQAIIGASDEVLAGQWSDQFVVDIFQAGAGTSHHMNINEVLANRALELLGYARGDYKQVNPNDHVNYGQSTNDVIPTAIRLGALFASAPLLEALSTLQQSFEAKGNEFLPIVKSGRTHLQDAVPIRLGDEFLAYAQIVGEHRARIETACRELLVLGLGGSAAGTGLNTHPQYRVRVVAELARLTGHPLTPAPRPMAAMQSMAPFVAVSGSLRNLAQDLVKIAGDLRLMDSGPKTGLREIELPPVQPGSSIMPGKYNPVLCEMLTMVAFQVMGYDQAIALAAQAGQLELNVMMPLIAYDLLHSFTILTNALTVFRARCIDGIQAQPERCLAYAEGSIALVTALNPHIGYLNAAAVAKESLATGRSLREIVLERGLLTEAQLAEILDLEAMSRLPETQAASDR

SEQ ID NO: 16366 - DNA, 1404 bp, Chromobacterium violaceum ATCC 12472
  CDS (1)..(1404)
atgtccacccgtatcgaacacgacctgctcggcaaccgcgacgtgccggccgacgcctactggggcgtgcacacgctgcgcgccatcgaaaacttcccgatcaccggccagaccatcgccggctacggcgacctgatccgcgcgctggcctgcatcaagcaagccgccgcccaggccaaccgcgatctcggcattctcgaccccaagctggcccaggccatcgtcgacgcctgcgaggagatccgcgccggcaagctgcacgaccagttcgtcgtcgacgtgatccagggcggcgccggcacttccaccaatatgaacgccaacgaggtgatcgccaaccgcgcgctggagctgctgggccacgccaagggcgagtaccagcatctgcacccgaacgagcacgtcaacctgtgccagagcaccaacgacgtctacccgaccgcgctgcgcctggccgccttctggggcgtgctgaagctggtgtcgcggatggaaacgctgcgcaaggccttcgaggacaaggccgaggaattcaaggacatcctgaagatgggccgcacccagctgcaggacgcggtgccgatgacgctgggccaggagttccagacctatgctgtgatgctgggcgaggacgagcagcgtctgaaggaagccagcgccctgatgctggagatcaacctcggcgccaccgcgatcggcaccggcatcaccgcccacccggactacgccaagctggtgtgcctgcatctgtccgagctggtgggcagccagctgatcaccgcgcccaacctgatcgaggccacccaggactgcggcgccttcgtccagctgtccggcgtgatcaagcgcgcggcggtcaaactgtccaagacctgcaacgacctgcgcctgctgtcgtccggcccgcgcgcaggcttcggcgagatcaatctgccggcgcgccaggccggctcgtccatcatgccgggcaaggtcaatccggtgattccggaagtggtgagccaggtggcgtatgaagtcatcggcaacgacgtcaccatcaccatggcggccgaggccggccagctgcagctgaacgccttcgagccggtgatcgcctacagcctgttccgcagcgccggccacctggccaacgcctgcgacacgctgaccgagcactgcgtcaagggcatcaccgccaaccgcgagcggctgcgcctgagcgtggaaagctcgatcggcctggtcaccgcgctgaacccggtgatcggctacgaggccgccacccgcgtcgccgccgaagcccacgccaacggcagcagcgtcgccgacgtggtgctggcccatggcctgctcacccgcgagcagctggacgacatcctgcagccggagaccctgacccggccgcgctgggtgacgctgtaa

SEQ ID NO: 16367 - protein, 467 aa, Chromobacterium violaceum ATCC 12472
MSTRIEHDLLGNRDVPADAYWGVHTLRAIENFPITGQTIAGYGDLIRALACIKQAAAQANRDLGILDPKLAQAIVDACEEIRAGKLHDQFVVDVIQGGAGTSTNMNANEVIANRALELLGHAKGEYQHLHPNEHVNLCQSTNDVYPTALRLAAFWGVLKLVSRMETLRKAFEDKAEEFKDILKMGRTQLQDAVPMTLGQEFQTYAVMLGEDEQRLKEASALMLEINLGATAIGTGITAHPDYAKLVCLHLSELVGSQLITAPNLIEATQDCGAFVQLSGVIKRAAVKLSKTCNDLRLLSSGPRAGFGEINLPARQAGSSIMPGKVNPVIPEVVSQVAYEVIGNDVTITMAAEAGQLQLNAFEPVIAYSLFRSAGHLANACDTLTEHCVKGITANRERLRLSVESSIGLVTALNPVIGYEAATRVAAEAHANGSSVADVVLAHGLLTREQLDDILQPETLTRPRWVTL

SEQ ID NO: 16368 - DNA, 1440 bp, Helicobacter hepaticus ATCC 51449
  CDS (1)..(1440)
atgggcaaacgagtagaacacgattttattggcgaactagagattgccgatgatatgtattatggtgtgcaaacctttagagcattacaaaatttcaatattacaggcgataagctaagtagctatccaagctttatcaaggcttttgcgcaagtaaaaaaagctgcttgtttggcaaattatgaacttaaattgcttgatgagcaaaaaaaagatgctatttgcaaagcttgtgataggcttattgcaggcgagctaagagagcaatttgtagtagatatgcttcaaggtggagctggaacaagcacaaatatgaacacaaatgaagttgtagcaaatttggcattagagattatgggacataaaaaaggtgaatatcaatactgccacccaaatgaccacgtcaatctctcacaatctacaaatgattcatatcccactgctattcacgtagcactatatgacgagctttcagctcttgccaaagatatggaagtgctaaaagaatcttttaataaaaaatctcaagaatttaaagatgtgcttaaaatggggcgaactcaacttcaagatgctgtgcctatgactttaggacaagagtttcacacttttgcagtgatgatgggagaagatattgcgcgtgtgcttgaagcaagaaaccttgtaactgaaatcaatatgggtgggaccgcaattgggacaggcataaactcacaccctgattatcctaaaattgtccaaaagaaactctgtgaggttacaggacaccctttcaaaactgcagatgacctcattgaggccacacaagatacaggtgcgtatgtgcaagtaagtggtgtgcttaaaagagtagctgtgaaactctctaaagtctgtaatgacttacgactactaagctctggaccaagagcggggcttaatgaaatcaacctccccaaaatgcagcccggaagctccattatgcccggtaaagtaaatcctgtaatccctgaagttgttaatcaagtatgctatgcagtgattggtaatgatgtaactgtgagctttgcaagtgagggcggacaattgcagcttaatgtatttgagcctgtgattgcttatggattatttaactctatttctatgatgagaaatgctatgcttacacttgcaagcaaatgtattgacggaatcactgcaaatgaaaagatttgtagtgattttgtttataatagcattggtattgttacagctcttaatccttatattggctatgagaattctgcatcaattgctaaagaatctttacaaacaggcaaacctgttaaagaaattgcattagaaagaaagcttttaagcgaagagcaactcaatgagatttttcaaccaaaaaatatgctcaatccacatatgagcgcagaagataaggcgaaattccaaaaaaattcgccttttgcataa

SEQ ID NO: 16369 - protein, 479 aa, Helicobacter hepaticus ATCC 51449
MGKRVEHDFIGELEIADDMYYGVQTFRALQNFNITGDKLSSYPSFIKAFAQVKKAACLANYELKLLDEQKKDAICKACDRLIAGELREQFVVDMLQGGAGTSTNMNTNEVVANLALEIMGHKKGEYQYCHPNDHVNLSQSTNDSYPTAIHVALYDELSALAKDMEVLKESFNKKSQEFKDVLKMGRTQLQDAVPMTLGQEFHTFAVMMGEDIARVLEARNLVTEINMGGTAIGTGINSHPDYPKIVQKKLCEVTGHPFKTADDLIEATQDTGAYVQVSGVLKRVAVKLSKVCNDLRLLSSGPRAGLNEINLPKMQPGSSIMPGKVNPVIPEVVNQVCYAVIGNDVTVSFASEGGQLQLNVFEPVIAYGLFNSISMMRNAMLTLASKCIDGITANEKICSDFVYNSIGIVTALNPYIGYENSASIAKESLQTGKPVKEIALERKLLSEEQLNEIFQPKNMLNPHMSAEDKAKFQKNSPFA

SEQ ID NO: 16370 - DNA, 1428 bp, Haemophilus ducreyi 35000HP
  CDS (1)..(1428)
atgagtaatgtgcgtattgaagtggatttactcggcgaaagagaagtgccaaatcaggtctattggggaattcatactttaagagcggttgaaaattttaatatttctaacaatactatttcagatatacctgaatttgtccgtggtatggttatggtgaaaaaagccaccgcattagcaaatggcgaattaggtgcaattcccaaaaaagtggcacaggctattgtgcaagcgtgtgatgaaattttagtgaatggtcgttgtatggatcaatttccgtcagatgtttatcaaggcggtgccggtacctcggttaatatgaacactaatgaggttattgctaacttagcgcttgaaatgctagggcataaaaaaggggaatatcatattattgatccaatggatcacgttaatgctagtcaatcaacgaatgatgcttatcctacaggattccgcattgctgtgtataacagcttaatgcatttaattgaacaagtcctttatttacaacagggctttgaagagaaagcggtcgaatttgccaatgttcttaaaatggggcggacacagttgcaagatgcagtgcctatgacagttggtcaagaatttaaagcatttgcggtgttattagcagaagaagtacgtaatttaaaacgtactgctcaattattacttgaggttaacttaggcgcaactgcaattggcacggggttaaatacaccggcaggttattcagaattagcggtaaaatatttatcagaagtaacaggtttagcttgtgttttatcagaaaatttaattgaagcaacttcagattgtggtgcttatgtaatggtacacggtgcgttgaaacgtactgcggttaagttatctaaagtatgtaatgatttacgcttactttcatctggacctagagcgggtttgaatgaaattaatctgccggaattgcaagcgggttcttctattatgccagctaaagtaaatccagtggtacctgaggtggttaatcaagtatgctttaaagtgataggtaatgatacaaccgttacttttgcagcagaagcggggcagttacaattgaatgtaatggagccggtgattggacaggcaatgtttgaatctattgccattttagcaaatgcgtgtgtcaatttacgtgataaatgcgtcgatggcatcagtgtcaataaagaaatctgcgaaaattttgtgtttaattcaattgggattgtcacttatcttaatccatttattggccatcataatggcgatattgtgggtaagatttgtgctgaaacggggaaaggtgtacgtgaagtcattctcgaaaaaggattgctcaccgaagctcagttagatgatattctttcagtggaaaatttaatgcacccaatttataaagcaaaacggtttacggaagatgaataa

SEQ ID NO: 16371 - protein, 475 aa, Haemophilus ducreyi 35000HP
MSNVRIEVDLLGEREVPNQVYWGIHTLRAVENFNISNNTISDIPEFVRGMVMVKKATALANGELGAIPKKVAQAIVQACDEILVNGRCMDQFPSDVYQGGAGTSVNMNTNEVIANLALEMLGHKKGEYHIIDPMDHVNASQSTNDAYPTGFRIAVYNSLMHLIEQVLYLQQGFEEKAVEFANVLKMGRTQLQDAVPMTVGQEFKAFAVLLAEEVRNLKRTAQLLLEVNLGATAIGTGLNTPAGYSELAVKYLSEVTGLACVLSENLIEATSDCGAYVMVHGALKRTAVKLSKVCNDLRLLSSGPRAGLNEINLPELQAGSSIMPAKVNPVVPEVVNQVCFKVIGNDTTVTFAAEAGQLQLNVMEPVIGQAMFESIAILANACVNLRDKCVDGISVNKEICENFVFNSIGIVTYLNPFIGHHNGDIVGKICAETGKGVREVILEKGLLTEAQLDDILSVENLMHPIYKAKRFTEDE

SEQ ID NO: 16372 - DNA, 1413 bp, Streptomyces avermitilis
  CDS (1)..(1413)
atgaccgccgcagcccaccgcagcgaacacgacctgctcggagaccgcgacgtccccgccgaggcgtactggggcatccactccctgcgcgccaaggagaacttccccatcacggggacgccgatctccacgtacccgcatctgatcgacgccctcgccgccgtgaaggaggccgccgccctcgccaacgaggaactcggcctgctggagccgaagaaggccgcggccatcgtggccgcctgccgggagatccgggacggcaagctgcacgaccagttcgtcgtcgacgtcatccagggcggcgcgggcacctcgacgaacatgaacgccaacgaggtcatcgccaaccgggcccttgaactgctcggccacgccaagggcgagtaccggcacctgcaccccaacgaggacgtcaacctcggccagtcgaccaacgacgtctacccgaccgccgtgaagatcgcgaccgtgttcgcggtgcgcggtctgctcaaggccatggcggtgctccaggacgccttcgcccgcaaggccgtcgagttccgtgacgtgctgaagatgggccgcacccagctccaggacgcggtgcccatgacgctggggcaggagttctccgcgtacgccgtcatgctcgacgaggaccgcagccggctcgccgaggccgtcgaactgatccacgagatcaacctgggcgccacggcgatcggcaccggactcaacgcgcccgccggatacgccgagtcggcccgccgccagctcgccgccctcaccgggctgccgctggtcaccgccgccaacctggtcgaggccacccaggactgcggtgccttcgtccagatgtcgggggtgctcaagcggatcgccgtcaagctctccaagagctgcaacgacctgcggctgctgtcgtccgggccgcgcgcggggctcaacgagatcaacctgccgccggtacaggccggttcgagcatcatgcccggcaaggtcaacccggtcatccccgaggtcgtcaaccaggtcgccttcgaggtcatcggcaacgacgtcgcgatcaccatggccgccgaggcggggcagctccagctcaacgccttcgagccgatcatcctgcactcgctgtccgagagcatcacgcatctgcgggccgcctgcctgacgctcgccgagcggtgcgtcgacgggatcacggccaacaccgaggaactgcgcgccgccgtggagaactccatcggcctggtgaccgccctcaacccgcacatcgggtacacggcggccaccgccatcgccaaggaggccctcgccaccgggcgcggggtcgccgaactcgtcctggagaagggcctgttgccggccgaccggctcgcgtcgctgctgcggcccgaggtgctcgcgggcagcggctccccgcagatctga

SEQ ID NO: 16373 - protein, 470 aa, Streptomyces avermitilis
MTAAAHRSEHDLLGDRDVPAEAYWGIHSLRAKENFPITGTPISTYPHLIDALAAVKEAAALANEELGLLEPKKAAAIVAACREIRDGKLHDQFVVDVIQGGAGTSTNMNANEVIANRALELLGHAKGEYRHLHPNEDVNLGQSTNDVYPTAVKIATVFAVRGLLKAMAVLQDAFARKAVEFRDVLKMGRTQLQDAVPMTLGQEFSAYAVMLDEDRSRLAEAVELIHEINLGATAIGTGLNAPAGYAESARRQLAALTGLPLVTAANLVEATQDCGAFVQMSGVLKRIAVKLSKSCNDLRLLSSGPRAGLNEINLPPVQAGSSIMPGKVNPVIPEVVNQVAFEVIGNDVAITMAAEAGQLQLNAFEPIILHSLSESITHLRAACLTLAERCVDGITANTEELRAAVENSIGLVTALNPHIGYTAATAIAKEALATGRGVAELVLEKGLLPADRLASLLRPEVLAGSGSPQI

SEQ ID NO: 16374 - DNA, 1395 bp, Eikenella corrodens
  CDS (1)..(1395)
atgacaacccgaaccgaacacgacttcttcggcgaacgcgaaatccccgcaaccgcttattggggtatccacaccctgcgcgcagtggaaaacttccaaatctccgggcagaagatttccgacgtaccccagtttgtgcgcagcatggtgatggtgaaaaaagccgctgcccaggccaacggcgagctgggcgcactcaagcccgaaatcgccgccgccattgcccaagcttgcgacgaggtgctgctcaaaggccgttgcctcgaccagttcccatccgacgtattccaaggcggcgccggcacttcggtgaacatgaacaccaacgaagtgatcgccaacctcgccttggaagccttaggccaagccaaaggccgctacgacatcgtcaatcccatggatcatgtgaacgccagccaatttaccaacgacgcttaccctaccggcttccggctggctgtatacaccagcatcggcgaactgctagacaaactggcatacctgaaaaacacctttgctgccaaagctgatgaattcaaagacatattaaaaatgggccgcacccagctgcaagatgccgtgcccatgactgccggccaagaattccaatccttccaagtgctgctggcagaagaggaaaccaacctcgaacgcacccgccaactgctgctggaagtgaacctcggcgccacagccatcggcacaggcatcaatacgccgcaaggctacgcgccgctggccgtacaaaaactctccgaaatcagcggcctgccctgcaagctcaccgaaaacctgattgaagccacttccgactgcggtgcctatgtgatggtgcacggcgccctcaagcgcaccgccgtgaagctctccaaaatctgcaacgacctgcgcctactctcctccggcccgcgtgccggcctgaaagaaatcaacctgccggaaatgcaggccggctcatcgattatgcccgccaaggtgaatcccgtgattcccgaagtggtgaaccaagtttgtttcaaagtaatcggcaacgacaccaccatcaccttcgccgccgaagccggccagctccatcaacgtgatggagccggttatccgcaatccatgtttgaaagcatctcgcttttaggcaacgccgccattacgttggccgacaaatgcgtgcgcggcatcacggtaaaccgcgaaatctgcgaacgctacgtcttcaactccatcggcctggtaacctatctcaacccctatatcggccacgaaaacggcgacctggtgggcaaaatctgcgctcaaaccggcaaaaccgtgcgcgaagtggtactggagcgccagctcttgagcgaagcggagctcgaccgtatcctgtcgccacaaaacttggccaatccgcatttgtaa

SEQ ID NO: 16375 - protein, 464 aa, Eikenella corrodens
MTTRTEHDFFGEREIPATAYWGIHTLRAVENFQISGQKISDVPQFVRSMVMVKKAAAQANGELGALKPEIAAAIAQACDEVLLKGRCLDQFPSDVFQGGAGTSVNMNTNEVIANLALEALGQAKGRYDIVNPMDHVNASQFTNDAYPTGFRLAVYTSIGELLDKLAYLKNTFAAKADEFKDILKMGRTQLQDAVPMTAGQEFQSFQVLLAEEETNLERTRQLLLEVNLGATAIGTGINTPQGYAPLAVQKLSEISGLPCKLTENLIEATSDCGAYVMVHGALKRTAVKLSKICNDLRLLSSGPRAGLKEINLPEMQAGSSIMPAKVNPVIPEVVNQVCFKVIGNDTTITFAAEAGQLHQRDGAGYPQSMFESISLLGNAAITLADKCVRGITVNREICERYVFNSIGLVTYLNPYIGHENGDLVGKICAQTGKTVREVVLERQLLSEAELDRILSPQNLANPHL

SEQ ID NO: 16376 - DNA, 1452 bp, Vibrio parahaemolyticus
  CDS (1)..(1452)
atggctaccctatctgatgctccaaaaacagcaaaccaagccactcgtattgaagaagatctattaggtcaacgtcatgtccctgctgatgcgtactacggcattcataccctacgtgcgatcgaaaacttcaacatctctaacgtaactatttctgacgtacctgagttcgtacgcggcatggtgatgacgaagaaagcagcggcgttggcgaacaaagaacttggcgctattcctaaagaagttgctaactacatcctagaagcgtgtgatttgatcctagaaacaggcaagtgtatggatcagttcccttcagacgtattccaaggcggcgcgggtacttccgttaacatgaacactaacgaagttatcgcgaacgttgcacttgaactaatgggcaaagaaaaaggccaatacgagttcatcaacccgaacgaccacgttaacaagagccaatctactaactgtgcgtacccaactggtttccgtatcgcggtttacaacagcgtacacaaactaatggaagcgattgaatacctaaaaggcgcattcgatcttaaagcaactgaattcaaagacgtattgaagatgggtcgtactcagcttcaagacgcggtaccaatgactgttggtcaagagttccacgcttgggctgtaacgctaaacgaagagattcgtgctctagattacacatctaaactcctactagaaatcaacctaggtgcaaccgcaatcggtactggtcttaacacaccaactggttaccaagctctagcagtaaaacacctagcggaagtaactggccttgacgttgtgcctgcagaagacctaatcgaagcgacttctgactgtggtgcatacgtaatgactcacggcgcgctaaaacgtctagcagtgaaactatcgaagatctgtaacgaccttcgtctactttcttctggtcctcgcgcgggtctaaacgaattgaacctacctgaaatgcaagcaggttcttcaatcatgccagcgaaagtaaacccagttatcccagaagtagtaaaccaagtttgcttcaaagttctaggtaacgacaacacggtttctttcgcagcagaaggcggtcagctacagctaaacgtaatggaaccagttatcgcacaaagcatgtttgagtctatctctctactacacaatgcgtgtgtgaacctacgtgataaatgtatcgacggcatcactgtaaacaaagaaatctgtgagaactacgtttacaactcaatcggtatcgtaacttacctaaacccatacattggccaccacgaaggtgacattgtcggtaagatttgtgcagaaactggtaagagtgttcgtgaagtcgtgcttgagcgcggcctgctaactgcagaagaacttgatgaaatcttaacagttgaaaacttcatgcatcctacttacaaagcgaaacgctacgagtaa

SEQ ID NO: 16377 - protein, 483 aa, Vibrio parahaemolyticus
MATLSDAPKTANQATRIEEDLLGQRHVPADAYYGIHTLRAIENFNISNVTISDVPEFVRGMVMTKKAAALANKELGAIPKEVANYILEACDLILETGKCMDQFPSDVFQGGAGTSVNMNTNEVIANVALELMGKEKGQYEFINPNDHVNKSQSTNCAYPTGFRIAVYNSVHKLMEAIEYLKGAFDLKATEFKDVLKMGRTQLQDAVPMTVGQEFHAWAVTLNEEIRALDYTSKLLLEINLGATAIGTGLNTPTGYQALAVKHLAEVTGLDVVPAEDLIEATSDCGAYVMTHGALKRLAVKLSKICNDLRLLSSGPRAGLNELNLPEMQAGSSIMPAKVNPVIPEVVNQVCFKVLGNDNTVSFAAEGGQLQLNVMEPVIAQSMFESISLLHNACVNLRDKCIDGITVNKEICENYVYNSIGIVTYLNPYIGHHEGDIVGKICAETGKSVREVVLERGLLTAEELDEILTVENFMHPTYKAKRYE

SEQ ID NO: 16378 - DNA, 1425 bp, Pseudomonas syringae pv
  CDS (1)..(1425)
atgtcctcgcctgcatcatcgcgcatcgaaaaagacctgctaggtgttctcgaagtacctgccaacgcttattacggcatccagaccctgcgagcggtgaacaactttcacctttcgggcgtaccgctttcgcactatccgaaactggtagtagcgctggccatggtcaagcaggcggcagccgatgcaaaccatcagcttgggcacctcaacgataccaagcattcagcgatcagcgaggcgtgcgcccggctgatccgcggcgacttccatgaccagttcgtggtcgacatgattcagggcggcgctggcacttcgaccaacatgaatgccaacgaagtcatcgccaacatcgcgctggaaaccatgggtttcgagaagggcgaatacaaacacctgcaccccaacaacgacgtgaacatggcgcagtccaccaacgacgcctacccgaccgcgatccgcctgggtctgctgctgggtcatgacgcccttctcgccagccttgccagcctgatccaggcgttcgccgccaaaggcgaagaattcaaccatgtgctgaagatgggtcgtacccagttgcaggacgccgttccaatgactctgggccaggaattccgcgcctttgccaccacgctgaccgaagacctcaaccgtctgcgcagcctggcacccgaactgttgaccgaagtcaacctgggcggcacggccatcggtaccggcatcaacgccgaccccggctaccagaagcttgctgtcgaccgtttggcgctgatcagcggtcagccgctggtgccggcagccgacctgatcgaagcgacctccgacatgggcgcgttcgtactgttctcgggcatgctcaaacgcaccgcggtcaagctgtcgaagatctgcaacgacctgcgcctgttgtccagcggcccgcgcaccggcatcaacgaaatcaacctgccggcgcgccagccaggcagctctatcatgcccggcaaggtcaacccggtaatcccggaagcggtcaatcaggtggccttcgagatcatcggcaacgacctgtcgctgaccatggcagccgaaggtggccagttgcagctcaacgtcatggagccgctgatcgcctacaagatcttcgactcgatccgcttgctgcagcgcgccatggacatgctgcgcgaacactgcatcgtcggcatcaccgccaacgaacagcgctgccgcgaactggtcgagcactcgatcggtctggtcaccgcactgaacccgtacatcgggtatgaaaactccacccgtatcgcccgtatcgcgctggaaaccggccgtggcgtactggaactggtccgcgaagaaggtctgctcgacgacgccatgctcgacgacattctgcgaccggaaaacatgatcgctccacgtctggcccccttgaaggcctga

SEQ ID NO: 16379 - protein, 474 aa, Pseudomonas syringae pv
MSSPASSRIEKDLLGVLEVPANAYYGIQTLRAVNNFHLSGVPLSHYPKLVVALAMVKQAAADANHQLGHLNDTKHSAISEACARLIRGDFHDQFVVDMIQGGAGTSTNMNANEVIANIALETMGFEKGEYKHLHPNNDVNMAQSTNDAYPTAIRLGLLLGHDALLASLASLIQAFAAKGEEFNHVLKMGRTQLQDAVPMTLGQEFRAFATTLTEDLNRLRSLAPELLTEVNLGGTAIGTGINADPGYQKLAVDRLALISGQPLVPAADLIEATSDMGAFVLFSGMLKRTAVKLSKICNDLRLLSSGPRTGINEINLPARQPGSSIMPGKVNPVIPEAVNQVAFEIIGNDLSLTMAAEGGQLQLNVMEPLIAYKIFDSIRLLQRAMDMLREHCIVGITANEQRCRELVEHSIGLVTALNPYIGYENSTRIARIALETGRGVLELVREEGLLDDAMLDDILRPENMIAPRLAPLKA

SEQ ID NO: 16380 - DNA, 1437 bp, Pseudomonas putida
  CDS (1)..(1437)
atgatatacatcatgtcctctgctgcatcgttccgcgtcgaaaaagacttgttgggtacccttgaagttcctgcagatgcctactacggcatccagaccctgcgcgctgccaacaacttccacctctccggtgttccgctgtcgcactacccgaagctggtcgtggccctggccatggtcaagcaggccgctgccgacgccaaccgtgagctgggtcacctgagcgatgccaagcacgctgccatttccgcagcctgcgcccgcctgatcaaaggcgatttccacgaccagttcgtggtagacatgatccagggcggcgctggtacttctaccaacatgaacgccaacgaagtcattgccaacgttgcgctggaggccatgggccaccagaagggtgagtaccagtacctgcaccctaacaacgacgtgaacatggcgcagtcgaccaacgacgcctacccgaccgcaatccgcctgggcctgctgctgggccacgacgcgctgctggccagccttgatagcctgatccaggccttcgctgccaagggtaaagaattcgaccacgtactgaagatgggccgtacccagctgcaggacgccgtaccgatgaccctgggccaggaattccgcgccttcgccaccaccatgactgaagacctgcagcgcctgcgctcgctggctccggaactgctgaccgaaatcaacctgggcggtaccgccatcggtactggcatcaacgccgaccctggctaccaggccttggccgtacagcgcctggccaccatcagcggccacccgctggtaccggctgccgacctgatcgaagccacctccgacatgggcgccttcgtgctgttctccggcatgctcaagcgcaccgcggtcaagctgtcgaagatctgcaacgacctgcgcctgctgtccagcggcccacgcaccggcatcaacgagatcaacctgccagcgcgtcagccaggcagctcgatcatgccaggcaaggtcaacccggttattccagaagctgtgaaccaggtggccttcgccatcatgggcaacgacctggccctgaccgtcgccgccgaaggtggtcagctgcagctgaacgtgatggagccgctgatcgcctacaagatcttcgactcgatccgcctgctgcaacgcgccatggacatgctgcgcgagcactgcatcgtcggcatcaccgccaacgaacagcgctgccgtgaactggtcgagcactcgatcggcctggttaccgcactgaacccgtacatcggctacgaaaacgccacccgtattgcccgcgttgccctggaaagcggccgcggcgtactggaactggtgcgcgaagagaagctgctggacgacgcgatgctcgacgacatcctgcgtccggaaaacatgatcgctccacgtctggttccgctgaaggcgtaa

SEQ ID NO: 16381 - protein, 478 aa, Pseudomonas putida
MIYIMSSAASFRVEKDLLGTLEVPADAYYGIQTLRAANNFHLSGVPLSHYPKLVVALAMVKQAAADANRELGHLSDAKHAAISAACARLIKGDFHDQFVVDMIQGGAGTSTNMNANEVIANVALEAMGHQKGEYQYLHPNNDVNMAQSTNDAYPTAIRLGLLLGHDALLASLDSLIQAFAAKGKEFDHVLKMGRTQLQDAVPMTLGQEFRAFATTMTEDLQRLRSLAPELLTEINLGGTAIGTGINADPGYQALAVQRLATISGHPLVPAADLIEATSDMGAFVLFSGMLKRTAVKLSKICNDLRLLSSGPRTGINEINLPARQPGSSIMPGKVNPVIPEAVNQVAFAIMGNDLALTVAAEGGQLQLNVMEPLIAYKIFDSIRLLQRAMDMLREHCIVGITANEQRCRELVEHSIGLVTALNPYIGYENATRIARVALESGRGVLELVREEKLLDDAMLDDILRPENMIAPRLVPLKA

SEQ ID NO: 16382 - DNA, 1401 bp, Lactobacillus plantarum WCFS1
  CDS (1)..(1401)
atgcgaattgaagctgattgtattggtaagttagctgttccggatgatgctttgtatggaattcatacgttacgtgccgttcataattttccgattacgacggaattgatgcatccactgatcatgcaaagtcttgttcaaatcaagaaagcggcggccagtgtgaatgcggctgccggaactttgtctaatgataaggcacacgccattattgcggcatgtaatcagttactactggggcgttacgcggataacttcattgtgccagcgattcaggggggtgctgggacctcggctaacatgaacgtcaatgaagtggtggctaatttggctcaccggttgatgccggcagtcgccgttcatcccaatgatgatgttaatcaatcacaatcaaccaatgatacttttccaacggccggtaaaatggcgctttgcatgcaactcccaggactattaacggcactcagccggttggtacaaacgttactggttaaatcgcagcgttatcaagatgccatcaaagttggccgaactcagcttgaagatgcggtaccgacgacgtacgggcgaacctttcatgcttattaccaattattcaagcgtgatttgacccgtgtacggcaggcgggcgaacatctccgaatcgtaaatttgggtgggactgcaatcggtaccggcatcaacgcgactcacacgtatcaacagcagattttagtgaaattaaatcaaaatactgatttagatttagtagccgcaccagacttgatcgatgcaacgcaaaactgcgatttgttcgtggaattctctgcggccatgaagacgttagccgttgacctttccaagtttagcaatgacttaagattgctggcgagcggcccacaagctggctttggtgaattgaatttgcccgcgcagcaagcaggctcttctattatgccaggtaaaatcaatccggttattccggaggttgttaaccaagttgcgtttgaagtgattggtcacgacacgacggtaacaatggcagcggaagcgggccaattggaattaaacgcttttgagccaattatgttacgggcattgctagccagtgagcagcatttacagcaggccttgactacattagtcgatcactgtgtgcggcaattgacggtcaatcgccaacgctgtgcagatcaagtggcacattcggccattacggcaactgttttggcgccataccttggttacgagacgactaccgcgctgattaaagaagcgctcaccactaaccaagcaattcctgaattattacatcgacgtcgcttgcttagcgatgatttggtcgagcagctgttttcaccggccggactaactcagccacgtccagaggttattgaacaactacgagcggttgcaaagtag

SEQ ID NO: 16383 - protein, 466 aa, Lactobacillus plantarum WCFS1
MRIEADCIGKLAVPDDALYGIHTLRAVHNFPITTELMHPLIMQSLVQIKKAAASVNAAAGTLSNDKAHAIIAACNQLLLGRYADNFIVPAIQGGAGTSANMNVNEVVANLAHRLMPAVAVHPNDDVNQSQSTNDTFPTAGKMALCMQLPGLLTALSRLVQTLLVKSQRYQDAIKVGRTQLEDAVPTTYGRTFHAYYQLFKRDLTRVRQAGEHLRIVNLGGTAIGTGINATHTYQQQILVKLNQNTDLDLVAAPDLIDATQNCDLFVEFSAAMKTLAVDLSKFSNDLRLLASGPQAGFGELNLPAQQAGSSIMPGKINPVIPEVVNQVAFEVIGHDTTVTMAAEAGQLELNAFEPIMLRALLASEQHLQQALTTLVDHCVRQLTVNRQRCADQVAHSAITATVLAPYLGYETTTALIKEALTTNQAIPELLHRRRLLSDDLVEQLFSPAGLTQPRPEVIEQLRAVAK

SEQ ID NO: 16384 - DNA, 1413 bp, Clostridium tetani E88
  CDS (1)..(1413)
atgcaatacagattagaaagtgattcagtaggtgaaaaaagaataccaaaggatgcttattatggtgtgcaaagtcttagagcacaagagaattttatgataacaggaaaaaaagtccacacggaaatgataaaagcattagcagaggtaaaaaaagcaacagctatgacaaatatgcaagtggaacttttaagtaaaaaagcaggtaacgccattgtaaaagcttgtgatgaaataattgaaggaaatttacaagaacagtttataactgatcctatacaaggtggcgcaggaacatctatgaacatgaatttaaacgaagtaattgctaatagagcagtagaaatattaggtggggaaaagggagattatagtatagttcatcctaatgatcatgtaaatatgggacaatctactaacgatgttattcctacagggggaaaaatagcaactataagacttttagatagagcattaatgtcattagaaaatttagtagatgcacttacaaataaatctaaggaatttgatcatattataaaaatggggagaactcaaatgcaagatgctgtaccaataagattaggacaagaatttaaggcatattcaaatgctataaaaagggacatagttagaattaagagagcaaaagaagaattatatcatgtaagtattggggctacagctataggtacaggtataaatgctgatgaggagtatgtaaaaaatataacaccaaatttatcaaaagtaacaacacttagcctaattcaatgtgaagatttagtagatggaactcaaaatctagattgttttgcttcagtatcatcaaatttaaaggtttgtgctttaagtttatctaaaatagctaatgatttaagacttatgtcctcaggacctagaaccggttttggagaaataaatcttccagcaaaacaaaatgggtcatctataatgccaggaaaagtaaatccagtaatagctgaagttgtaaaccaagttgcatttagtattgtaggaaatgatgtaactattagcatggctgttgaagcaggacaattagaattaaacgcatttgagccggtgttatattataagttatttgaatctattgaaatattgaaaaatggtgtggatacatttattcataattgtataaatggtataacagcaaatgaggaaagatgtaaaaagttagtggataatagtgttggaataattactgcaatatgtccacatgtaggatataaaaaagcagctaaagtagcaaaaactgctatacagactggagaatctgtaaaggagcttgtattaaaagaaaatttattatcagaaaaagaattggatacaatacttgacccatttggaatgactaaaccaggaatatctgggaaagagctgttaaaaaagtaa

SEQ ID NO: 16385 - protein, 470 aa, Clostridium tetani E88
MQYRLESDSVGEKRIPKDAYYGVQSLRAQENFMITGKKVHTEMIKALAEVKKATAMTNMQVELLSKKAGNAIVKACDEIIEGNLQEQFITDPIQGGAGTSMNMNLNEVIANRAVEILGGEKGDYSIVHPNDHVNMGQSTNDVIPTGGKIATIRLLDRALMSLENLVDALTNKSKEFDHIIKMGRTQMQDAVPIRLGQEFKAYSNAIKRDIVRIKRAKEELYHVSIGATAIGTGINADEEYVKNITPNLSKVTTLSLIQCEDLVDGTQNLDCFASVSSNLKVCALSLSKIANDLRLMSSGPRTGFGEINLPAKQNGSSIMPGKVNPVIAEVVNQVAFSIVGNDVTISMAVEAGQLELNAFEPVLYYKLFESIEILKNGVDTFIHNCINGITANEERCKKLVDNSVGIITAICPHVGYKKAAKVAKTAIQTGESVKELVLKENLLSEKELDTILDPFGMTKPGISGKELLKK

SEQ ID NO: 16386 - DNA, 1461 bp, Bacteroides thetaiotaomicron VPI
  CDS (1)..(1461)
atgtgttattgttataaaacaaccgatatggaacagaaattatcaaaaaaaactcgtacagagagcgacttgataggtagtcgtgaagtgccggaaagtgcattgtatggagtacagacactccgtggtattgaaaactttcgcatcagcaagtttcatttgaatgagtatcccctgtttattcaggcattggccatcactaaaatgggagctgccgttgccaaccgtgaactggatttattgactgaggaacagacggatgccatactgaaggcttgtaaagaaatactggaaggaaaacatcatgaccaattccctgtagatatgatacagggtggagccggaaccaccaccaatatgaatgccaatgaagtgattgccaaccgtgcactggaactgatgggacatgcacgcggagagtatcactactgctcgcctaacgatcacgtcaatcgttcgcaatctaccaatgatgcgtatcctacagccattcacattggtctgtattatacccatcttaaattggtgaaacactttgcaacactgatcgaggctttccgaaagaaaggagcggagtttgcacacatcatcaagatgggacgtacccaactggaagatgccgtaccgatgacactaggacaaacctttaatggattcgcaagtattttggaacatgaactgaagaatctcgattttgccgcacaggattttctgacggtcaacatgggtgcgacagccatcggaaccggaattaccgccgaaccggaatatgcggaaaagtgcattgctgccctgcgcaagattacaggactggatatcaaactggcagatgacctgataggcgctacttcggatacttcctgcatggtaggatattcttcggccatgcggcgtgtagctgtcaagatgaacaagatttgtaatgatctgaggctattggcttccggtcctcgttgcggactgggagaaatcaatctgcctgccatgcagccgggctcttccattatgccgggaaaggtgaatcctgtcattccggaagtcatgaatcaggtctcttataaagtgataggaaacgacctttgtgtggctatgagtggagaggctgcgcagatggaactgaatgcgatggaacctgtcatggcacaatgctgttttgaatctgcggatttgttgatgaacggttttgatacattgcgtaccttatgtattgatggtatcacagccaatgaagaaaaatgccgtcgggatgtacacaacagtatcggagtagtgaccgcactgaatcccgtaattggctataaacattctacaaagatagcgaaggaggctctggaaacgggtaaaggagtgtatgagctggtgctggaacataacattctttccaaagaagacctggatacgatcttgaaaccggaaaatatgattaaaccggtgaaactggatattcatccgaatcattga

SEQ ID NO: 16387 - protein, 486 aa, Bacteroides thetaiotaomicron VPI
MCYCYKTTDMEQKLSKKTRTESDLIGSREVPESALYGVQTLRGIENFRISKFHLNEYPLFIQALAITKMGAAVANRELDLLTEEQTDAILKACKEILEGKHHDQFPVDMIQGGAGTTTNMNANEVIANRALELMGHARGEYHYCSPNDHVNRSQSTNDAYPTAIHIGLYYTHLKLVKHFATLIEAFRKKGAEFAHIIKMGRTQLEDAVPMTLGQTFNGFASILEHELKNLDFAAQDFLTVNMGATAIGTGITAEPEYAEKCIAALRKITGLDIKLADDLIGATSDTSCMVGYSSAMRRVAVKMNKICNDLRLLASGPRCGLGEINLPAMQPGSSIMPGKVNPVIPEVMNQVSYKVIGNDLCVAMSGEAAQMELNAMEPVMAQCCFESADLLMNGFDTLRTLCIDGITANEEKCRRDVHNSIGVVTALNPVIGYKHSTKIAKEALETGKGVYELVLEHNILSKEDLDTILKPENMIKPVKLDIHPNH

SEQ ID NO: 16388 - DNA, 1440 bp, Wigglesworthia glossinidia brevipalpis
  CDS (1)..(1440)
atgttaaattctattcgaatcgaacaagatatgattggaatacgtgaaatttcaaatgaattttattatggcattcatactcttagagctatagaaaatttcaaaattagtaaaaatactattaacgattatcctgaattaatcaagggaatggtgatggtgaaaaaagcatctgctcttgcaaacaaacatttaaaagttttatcagaaaaaaacgcaaaaattatagtaagagcttgtgattgtattttaaaaaaacaaaatatttatcttgatcaatttccagtagacgcttttcaaggaggagctggaacatctgtaaatatgaatgttaatgaagttttgactaatattggattagaaataatgggtaagaaaaaaggagattataagtttcttaatccaaatgatcatttaaatttaagtcaatccacaaacgatgcatatccaactggacttcgtttatcaatatataaatctatatacaaattaattaaatcaatcatattaattgaagatagtttttataaaaaatcaaaagaattttctaaaataataaaaatgggtagaacgcaattacaagatgctgtcccaatgacattgggtcaagaattttatgcttttaaaacatctttaaaaaaagaaagaataaatttaattaatacatctaaattattattagatattaatcttggaggaacagcaataggaactaaattaaatactcctaaaggatatcaaaaagtagttgtaaaacaattatcaattgttagcggaatacagttcaatccagtaaaagatcttatagaatctacatatgattgtggaatatatactattgtgcatggaaatttaaaaaatttagctattagattatctaaaatttgtaatgatttaagattattgtcatctgggccaagagctgggttaaatgaaataaatttacctgaacttcaagctggatcttcgataatgcctgctaaagttaacccagttttaccagaagtagttaatcaggtatgttttaaggtatgtggaaatgatatttgcgtaatgatggcagcagagtcaggtcaattacaattaaatgctatggaaccagtaataagtcaatctatatttgaatcaataaatattctcaaaaatgctattttatctttaaaagaaaaatgtatagatggaatcacagcaaataaaaaaatttgtgaatcttatgtattaaattctataggaatagttgcatatttaaatccttttattggtcatcataacggagatataatcggaaaaatttgttctaaaagcggtagaagtgtaaaagaagttgtattggaaaaaggatttttaacagaaaaagaacttaatgatattttttcatttaataatttaatacatccaaaatataaaaataaaaatagttctgaagatttatcaatctaa

SEQ ID NO: 16389 - protein, 479 aa, Wigglesworthia glossinidia brevipalpis
MLNSIRIEQDMIGIREISNEFYYGIHTLRAIENFKISKNTINDYPELIKGMVMVKKASALANKHLKVLSEKNAKIIVRACDCILKKQNIYLDQFPVDAFQGGAGTSVNMNVNEVLTNIGLEIMGKKKGDYKFLNPNDHLNLSQSTNDAYPTGLRLSIYKSIYKLIKSIILIEDSFYKKSKEFSKIIKMGRTQLQDAVPMTLGQEFYAFKTSLKKERINLINTSKLLLDINLGGTAIGTKLNTPKGYQKVVVKQLSIVSGIQFNPVKDLIESTYDCGIYTIVHGNLKNLAIRLSKICNDLRLLSSGPRAGLNEINLPELQAGSSIMPAKVNPVLPEVVNQVCFKVCGNDICVMMAAESGQLQLNAMEPVISQSIFESINILKNAILSLKEKCIDGITANKKICESYVLNSIGIVAYLNPFIGHHNGDIIGKICSKSGRSVKEVVLEKGFLTEKELNDIFSFNNLIHPKYKNKNSSEDLSI

SEQ ID NO: 16390 - DNA, 1617 bp, Corynebacterium efficiens YS
  CDS (1)..(1617)
atgtcgaacgaggataagaaggtgtccgaggacacgtccagcgagcaggcggagcaggtggaccagacggaccagaccggaaacccggaggattccgcggtggacggggaggccctggtgaccaccacggagaccacctccaccggtgagaagaccgcggcggcgaaggccgcggaaaaccgcaggaagatcaagaggaatttccgtgtggaatccgacctgctgggggagatggagatcccggccgatgcctactacggtgtccacaccctgcgtgccgtggagaacttccagatctcacgcaccaccatcaaccacgtcccggagttcatccgcggcatggtgcaggtgaagaaggccgccgccctggccaaccgccgcctgcacaccctgcccgccgacaaggccaaggcgatcatctgggcctgtgatcagatcctcgtcgagggccgctgcatggaccagttcccgatcgacgtgttccagggcggggcgggcaccagcaccaacatgaacaccaatgaggtggtggccaacctggcgctggagtacatggggtacgagaagggacgctacgacatcctgcaccccatggatgacgtgaacatgtcccagtccaccaatgatgcctatcccacgggtttccgactcggcatctatgctgcgatgaccaacctcatcgcggagatcgaacagctccaggtcgccttccgggagaagggcaatgagttcatcgacatcatcaagatgggccgcacccagctccaggatgcggtgccgatgagcctgggtgaggagttccaggccttcgccgcgaacctggccgaggaacagtccgtgctgcgcgcctccatggaccgtctcctcgaggtcaacctcggtgccaccgccatcggtaccggcgtgaacaccccggccggataccggcaccaggtggtcgcctccctctccgaggtcaccggcctggagatcaaatccgcccgtgatctcatcgaggccacctcggacaccggtgcctacgtcctggcgcattccgcggtcaagcgtgcagccatgaaactgtccaagatctgcaacgatctgcgcctgctgtcctccggcccgcgcgccggactcaacgagatcaacctcccgccgcgtcaggccggatcctccatcatgccggcgaaggtcaacccggtcatccccgaggtggtcaaccaggtctgcttcaaggtcttcggcaatgacctcaccgtggccatggccgccgaggccggtcagctgcagctcaatgtgatggaaccggtcatcggggagtcgctgttccagtcgatccgtatcctgggcaatgcgagcaagaccctgcgggagaagtgcgtggtgggcatcaccgcgaatgcggatgtctgccggtcctatgtggagaactccatcggcatcatcacctacctcaacccgtttttgggccatgacatcggtgatgccatcggtaaggaggccgcggagacgggccggtccgtccgggagctgatcctggagaagaacctcatggatgcggcgaccctggataccgtgttgtccaaggagaacctgatgcacccgatcttccggggcaagctgtacctggatcagtag

SEQ ID NO: 16391 - protein, 538 aa, Corynebacterium efficiens YS
MSNEDKKVSEDTSSEQAEQVDQTDQTGNPEDSAVDGEALVTTTETTSTGEKTAAAKAAENRRKIKRNFRVESDLLGEMEIPADAYYGVHTLRAVENFQISRTTINHVPEFIRGMVQVKKAAALANRRLHTLPADKAKAIIWACDQILVEGRCMDQFPIDVFQGGAGTSTNMNTNEVVANLALEYMGYEKGRYDILHPMDDVNMSQSTNDAYPTGFRLGIYAAMTNLIAEIEQLQVAFREKGNEFIDIIKMGRTQLQDAVPMSLGEEFQAFAANLAEEQSVLRASMDRLLEVNLGATAIGTGVNTPAGYRHQVVASLSEVTGLEIKSARDLIEATSDTGAYVLAHSAVKRAAMKLSKICNDLRLLSSGPRAGLNEINLPPRQAGSSIMPAKVNPVIPEVVNQVCFKVFGNDLTVAMAAEAGQLQLNVMEPVIGESLFQSIRILGNASKTLREKCVVGITANADVCRSYVENSIGIITYLNPFLGHDIGDAIGKEAAETGRSVRELILEKNLMDAATLDTVLSKENLMHPIFRGKLYLDQ

SEQ ID NO: 16392 - DNA, 1473 bp, Bifidobacterium longum
  CDS (1)..(1473)
atgctggcgtttccaacccacgcacaggaagatggaagcatgagcgaaacatcgaacaagacccgtctggaacatgactgcatcggccagatggaggtgccggcgaacgtctactggggtattcacacccagcgcgctatcggcaacttcccggtctccggcatcaccgatagccaacatcccgagctgattcgcgcctatgccacggtcaagcgcgcctgcgccatcgccaatgaggaattaggcctgatcgacccagccaaggccgaggccattcgcgccgcctgcctagaaattgaggccggcaaactggccgatcagttcccggtcgatgtgatgcagggcggtgccggcacctcgtcgaacatgaacatgaacgaggtgatcgccaaccgtgcgttggaaatcgccggccgccagcgcggcgattacacatacatccatccgaacgacgacgtcaacaagtcgcagtccacgaacgacacctacccggccgcctgcaaactcgcgcttatcgacgcgatcgggccgctcgccgagtccaccaagaaactcgccaaggccttccacgatctggccgacaaacatatcaatgacgtgacgattggccgcacgcagctgcaggacgccgtaccaatgacctatggtcaggaatttcatgcgtttgccacgctgttgaagtctgatttggctgcattcgatcgcgtggtgccgctgctggcccagctcaacctcggtgccaccgccatcggtaccggcatttgcgcggatctgcgattccgcaagtccgctatcaagcatctggcgcaaatcaccgggctgccggtcaccgccgcgcccgatccggtggccgccatgacggatatgggcgcgtacgtggccacgtcggctgccatcaagagcctcgccgtgcacctgaagaaggccgccgacgatttgcgactgctcaattccgggccgcgctgcggtttcaacgatctcaacgtgccggctcgccaggccggatcgtcgatcatgccggccaaagtgaaccctgtgatccccgaatgcgtcaaccagtgctgcttcacgattttcggcatggacgtgactgtgaactgggctgtggccgagggacagttgcagctgaacgccttcgacccggtgatggtgcatgagctgctgaccggcatggcgttgctgacgcacgccatggagacgttccgcgtcaactgcgtggaaggcatcgaaatcaatgctgacctggggcgttcatacgctcagtcctcaccgtcgatttccgccgcgctcaaccactacatcggctacgagcacgcggccgacatcgccgccgaagccgtacataccggccgtaccgtgcgcgaggtggccggcgaacgcaccgacctgcccgccgagcagttggacgagattctcgatccgattcgactggcccgaggcctcggccagacctgccgcgagcaccaggagtag

SEQ ID NO: 16393 - protein, 490 aa, Bifidobacterium longum
MLAFPTHAQEDGSMSETSNKTRLEHDCIGQMEVPANVYWGIHTQRAIGNFPVSGITDSQHPELIRAYATVKRACAIANEELGLIDPAKAEAIRAACLEIEAGKLADQFPVDVMQGGAGTSSNMNMNEVIANRALEIAGRQRGDYTYIHPNDDVNKSQSTNDTYPAACKLALIDAIGPLAESTKKLAKAFHDLADKHINDVTIGRTQLQDAVPMTYGQEFHAFATLLKSDLAAFDRVVPLLAQLNLGATAIGTGICADLRFRKSAIKHLAQITGLPVTAAPDPVAAMTDMGAYVATSAAIKSLAVHLKKAADDLRLLNSGPRCGFNDLNVPARQAGSSIMPAKVNPVIPECVNQCCFTIFGMDVTVNWAVAEGQLQLNAFDPVMVHELLTGMALLTHAMETFRVNCVEGIEINADLGRSYAQSSPSISAALNHYIGYEHAADIAAEAVHTGRTVREVAGERTDLPAEQLDEILDPIRLARGLGQTCREHQE

SEQ ID NO: 16394 - DNA, 1410 bp, Cytophaga sp
  CDS (1)..(1410)
atgggatcaacaagaaaagaacatgattttttaggggaattagatattcctaatcatttatattatggtatccaaactttcagagctgtagagaatttcaatattacaggaattccaatttcaaaagagcctttatttataaaagctttgggatatgtaaaaaaagcagcggctttagcgaacaaagattgcggacgacttgaccctaaaattgccgaagcaatctgttacggaagtgatcaggttattgccggtaaatttgatcaggaatttgtaagcgatttgattcagggaggagcaggaacatccgttaatatgaacgccaatgaagtgattgctaatattggtttagaatatctgggacataaaaaaggagattataacttcttgcacccgaataatcatgttaactgttctcaatctacaaacgatgcttatccatcagcttttagaattgcactttaccttaaaatggaaagttttattaaaacactggaaggtttagaagttgcatttgttgctaatggagaagaatttaaaagtgttttgaaaatgggaagaacgcaattgcaagatgcggttcctatgactttagggcaagaattcagatcttacgcaacaactataggcgaggatgtaagaaggttaaaagaagcgcaaagcctggtgttagaaatcaacatgggagcaacagcaattgggacaagagtaaacgcaccggaaggatatcctgaaatttgtgtgaactatttagcaaaagaagttgggattcctttaacgctttcgccggatttaattgaagctactgttgataccggagcttacgttcagattatggggacattgaaaagaactgctgtaaaaatttctaaaatctgtaatgatttaaggttattgagttcaggaccaagaactggtttcaacgaaatcaatttgccggcacgtcagccaggatcttctattatgccgggaaaagtaaatcctgtaattccggaagtcgtaaaccagacttgtttttatgttattggtcaggatttaacagttactatggctgctgaagcgggacaattgcaattgaatgtaatggagcctgtaattgcttttgccatgtttacctcattagattatctttctaatgcaattcagactttaattgataaatgtatcatcggaatcacagctaatgtagatcattgctataatatggtgatgaacagtattggtattgtaacgcaattaaaccctattttaggttacgaaataagtgccagtattgccggtgaagccttaaaaatgaataaaagcgttcacgaaattgttgtggtggaaagaaaattaatcactcaggaaaaatgggatgaaatttattctttagacaacttaataaatcctaagtttatcacgaaataa

SEQ ID NO: 16395 - protein, 469 aa, Cytophaga sp
MGSTRKEHDFLGELDIPNHLYYGIQTFRAVENFNITGIPISKEPLFIKALGYVKKAAALANKDCGRLDPKIAEAICYGSDQVIAGKFDQEFVSDLIQGGAGTSVNMNANEVIANIGLEYLGHKKGDYNFLHPNNHVNCSQSTNDAYPSAFRIALYLKMESFIKTLEGLEVAFVANGEEFKSVLKMGRTQLQDAVPMTLGQEFRSYATTIGEDVRRLKEAQSLVLEINMGATAIGTRVNAPEGYPEICVNYLAKEVGIPLTLSPDLIEATVDTGAYVQIMGTLKRTAVKISKICNDLRLLSSGPRTGFNEINLPARQPGSSIMPGKVNPVIPEVVNQTCFYVIGQDLTVTMAAEAGQLQLNVMEPVIAFAMFTSLDYLSNAIQTLIDKCIIGITANVDHCYNMVMNSIGIVTQLNPILGYEISASIAGEALKMNKSVHEIVVVERKLITQEKWDEIYSLDNLINPKFITK

SEQ ID NO: 16396 - DNA, 1386 bp, Thermoanaerobacter tengcongensis
  CDS (1)..(1386)
atgccgcgtattgaaaaagatttcttgggtgaattaacacttgaagataatgaactttatggaattcatacaaaacgagctttgaaaaacttctctgtatcttcacaaaagattgatatagatcttgtacgagcaattgtgatggtcaaaaaagcatgcgcaattgcaaattttgaggttggaaacctcgatgaaaaaataaaagatgcaattgtctttgcatgtgatgagattttagccggcaaatacaccgagcaatttgtggtagacaaattccaaggcggtgctggaacatctacaaatatgaacgtaaatgaagtaattgccaacatagcactcatttatcttggcaaaaaaccaggagagtatcaatacatccatcctatagaccatgttaatatgtcacaatcgacaaatgatgtctacccaaccgctttgaggattgcaacaatatggaatgtgagagaactttctgaagagtgtgcagaactccaaaaaagcttgcaaaaaaaagagcatgagtttgaaggtgtaattaaggctgggcgcactcaacttcaagatgcccttcccatcaccttagggcaagagtttggggcgtatgcacaggcgatatcacgcgatagatggcgaatatataaaattgaagaaagattaagagtggtaaacttgggcgcaacagctgttggaacaggagtgaatgcaagcttaaaatatatgtttaaagtgatagaacttttgcgcgattttactaaaataggcttggctcggtctgattacctcatggatgcaacacaaaatgcagatgtatttgtggaatgctcgggtcttttaaaagccttggcggtgaatctatcaaaaattgcaaatgacttaaggctcttatcatctggtccaaacacgggtttaaacgagataaacttacctgctgcacaagcaggttcaagcattatgcctggtaaagtaaatcctgtcatacctgaacttataaacaccatatcattccaggttatgtcaaatgatgttgcaataaccttagcagcccaagcaggtcagcttgagctaaatgcattcttgcctttaattgcaaacaatttgcttgaaagcctcaaaattctcaaaaacggaatcaggatattcagaaaacagtgcattgatggaataacagcaaacaaagaaagatgtcttgagtttgccaaaaagactccttctattgccgctgcattgattgataaaatagggtatgacaaggcaagtgaaattgctaaaaaagccattgccgagaataaggaaataattgaggtggtaaaggaattgaagatcttaaatgagaatgaggctgaagcactactaaatccttttgaatttgtaaagtttaaagagtaa

SEQ ID NO: 16397 - protein, 461 aa, Thermoanaerobacter tengcongensis
MPRIEKDFLGELTLEDNELYGIHTKRALKNFSVSSQKIDIDLVRAIVMVKKACAIANFEVGNLDEKIKDAIVFACDEILAGKYTEQFVVDKFQGGAGTSTNMNVNEVIANIALIYLGKKPGEYQYIHPIDHVNMSQSTNDVYPTALRIATIWNVRELSEECAELQKSLQKKEHEFEGVIKAGRTQLQDALPITLGQEFGAYAQAISRDRWRIYKIEERLRVVNLGATAVGTGVNASLKYMFKVIELLRDFTKIGLARSDYLMDATQNADVFVECSGLLKALAVNLSKIANDLRLLSSGPNTGLNEINLPAAQAGSSIMPGKVNPVIPELINTISFQVMSNDVAITLAAQAGQLELNAFLPLIANNLLESLKILKNGIRIFRKQCIDGITANKERCLEFAKKTPSIAAALIDKIGYDKASEIAKKAIAENKEIIEVVKELKILNENEAEALLNPFEFVKFKE

SEQ ID NO: 16398 - DNA, 1419 bp, Pasteurella multocida
  CDS (1)..(1419)
atgacagtaacaagaaaagaagtggatttactcggagaacgtgaagtaccagcagacgcatactggggaattcataccttaagagcggtagaaaattttaatatttcgaatgccgttatctcagatgtgcctgattttgtacgcggtatggtgatggtgaaaaaggcgaccgccttagcaaacggtgaattaggggcgattcctgataaaattgcaaaagcgattgtagctgcttgtgatgaaatcttaaccacaggcaaatgcttagatcaattcccgtcagatatttatcaaggcggtgcaggtacctcagtgaatatgaataccaatgaggttgtggcgaatttggcgttagagttattaggacataagaaaggggaataccaatatttagatccaatggatcatgttaacgctagccaatcaaccaatgacgcctatccaacaggtttccgtattgctgtctataacagtattatgaagctcgtggcaaaagtgctttatttacaacaaggttttgaaaataaagcaaaagaattttcgcacattcttaaaatgggacgcacgcaattacaagatgctgtgccaatgacagtaggacaagaatttaaagccttctctgttttattagatgaagaagttcgcaatttaacacgtacagcagaatacttattagaagttaatttaggtgcgacagcaattggtacgggcttaaatacaccaaaagggtatgcgccattagcggtcaaatacctgtctgaagtcacaggattaccttgtgtattagctgaaaacttaatcgaagctacctcggattgtggggcgtatgtgatggtacacggtgcattaaaacgtactgcggtgaaactatcaaaagtatgtaatgacttacgtctattatcttcaggtccgcgtgcagggttaaatgagattaatttgcctgaattacaagcgggttcatcgattatgccagcaaaagtcaacccagtggtacccgaagtggttaaccaagtttgctataaagtgatggggaacgatactaccattacctttgccgcagaggctggacaattacaattaaatgtcatggagccagtgattgcacaagcgatgtttgagtctattgatattttaaccaatgcttgtgtgaacttacgcgataaatgtattgatggcattacggtgaataaagaaacttgtgaaaactatgtctttaattctatcggtatcgtgacttatttaaatccatttattggacaccataatggtgacttagtcggtaaaatctgtgcgaaaacagggcgcggagtgaaagaggtcgtactcgaaaaaggactcctcacagaagcagaattagatgatattctctcagtggagaacttaatgaatccaacctataaagcgaagttgaataaataa

SEQ ID NO: 16399 - protein, 472 aa, Pasteurella multocida
MTVTRKEVDLLGEREVPADAYWGIHTLRAVENFNISNAVISDVPDFVRGMVMVKKATALANGELGAIPDKIAKAIVAACDEILTTGKCLDQFPSDIYQGGAGTSVNMNTNEVVANLALELLGHKKGEYQYLDPMDHVNASQSTNDAYPTGFRIAVYNSIMKLVAKVLYLQQGFENKAKEFSHILKMGRTQLQDAVPMTVGQEFKAFSVLLDEEVRNLTRTAEYLLEVNLGATAIGTGLNTPKGYAPLAVKYLSEVTGLPCVLAENLIEATSDCGAYVMVHGALKRTAVKLSKVCNDLRLLSSGPRAGLNEINLPELQAGSSIMPAKVNPVVPEVVNQVCYKVMGNDTTITFAAEAGQLQLNVMEPVIAQAMFESIDILTNACVNLRDKCIDGITVNKETCENYVFNSIGIVTYLNPFIGHHNGDLVGKICAKTGRGVKEVVLEKGLLTEAELDDILSVENLMNPTYKAKLNK

SEQ ID NO: 16400 - DNA, 1374 bp, Thermoplasma acidophilum
  CDS (1)..(1374)
atgaggacagaaagggatgttatcggggaggtgcagctgcccgacaatgtattttatggcataaacacggcaagggcaagggagaacttcaggatcaccgggctgaccgctgattctgatcacatcgtatcaattgcgcaggtcaagaaggctgcagcgcttgcaaatgccgacggaggcgcactggataaggagaaggcagattacatttcaaaggcatgcgacgagataatcggcgggaagtaccatgaccagttcgtgatagacgtctaccaggctggcgcaggaacatcctacaacatgaacgcaaatgaggtcatagccaacgttgcgctgacactgatgggcaagaataagggagagtactcggtgatacatccaaacgaccacgtgaacatgagccagtctacgaacgatgtttatccgacgatgatgcgattaacagtctccaagaagatcaggaagctcaaggatgcactcaacgaactcatagagagcttagaggcaaagagcagggaattcagggggatcgcaaagcccgggaggacccatctccaggatgctgcgcctgtaacgcttgggcttgagttcggagcctacgcctacgccatgaagaaggaccgtgatgagataatagatgcctcggactacataatggagctgaacataggggggacagcggttggcacggggataaacactgcgaagaactatcaggaaaacgtggtgaagcacataaacgagataacgaaggagaacttcaggaaaagcacgaatctgctcggcataatgcagttcatgacggatttctccagggtcatgaatgcggtcacgaacctcgccctggatgttgagaagatagcaaacgacataaggctgctttactccggccctggcgcaggcatccatgagataataattccagctgtacagcagggatcatccataatgccgggcaagataaacccgtccatcgccgaggccatgaacatgatctgccactcagtcataggagcgcagcaggcggttaatatgagcgttcaggcagggcagcttgagctgaacgtgatgatgcccaacatcgactacgagctgacgagatccatagacataatgacaaacggcctgaagatgttcaagcagaaactcatagacggcatcaaagctaacgttcctgtatgcagagaacacctggcgaacagcttcggttcagcagcgctccttaacccctatctcggatacgataacgttgcaaagatagtgagagaggccgttgaaactgggaaatcaataaaaagcctagtactcgcaaccggaaaactgacagaagagcagtacatgaagataatggacagtggggttccaaaggactga

SEQ ID NO: 16401 - protein, 457 aa, Thermoplasma acidophilum
MRTERDVIGEVQLPDNVFYGINTARARENFRITGLTADSDHIVSIAQVKKAAALANADGGALDKEKADYISKACDEIIGGKYHDQFVIDVYQAGAGTSYNMNANEVIANVALTLMGKNKGEYSVIHPNDHVNMSQSTNDVYPTMMRLTVSKKIRKLKDALNELIESLEAKSREFRGIAKPGRTHLQDAAPVTLGLEFGAYAYAMKKDRDEIIDASDYIMELNIGGTAVGTGINTAKNYQENVVKHINEITKENFRKSTNLLGIMQFMTDFSRVMNAVTNLALDVEKIANDIRLLYSGPGAGIHEIIIPAVQQGSSIMPGKINPSIAEAMNMICHSVIGAQQAVNMSVQAGQLELNVMMPNIDYELTRSIDIMTNGLKMFKQKLIDGIKANVPVCREHLANSFGSAALLNPYLGYDNVAKIVREAVETGKSIKSLVLATGKLTEEQYMKIMDSGVPKD

SEQ ID NO: 16402 - DNA, 2106 bp, Bacillus sp
  CDS (349)..(1755)
tctacagcaggaatccctgtattcactgtaaataaaccgatggaaccaaaaatggccatactaactgacagtttaatcatagcagatacattcatttgacttccctcaaaactatattaatatcctataattttccgaaaactctgaaataaaacaatatagaatctattaaataacatttatgtgaatttggcaatactattacaaaatattattaggaaacagggctctttttatattttctatgatagaatagtgtaggatttaataaagaaactctaatacaagttcgacaatgtaaacgtttgcttagagcttcgatagaaagaaaaggagattgtttttattatgaataccgatgttcgtattgagaaagactttttaggagaaaaggagattccgaaagacgcttattatggcgtacaaacaattcgggcaacggaaaattttccaattacaggttatcgtattcatccagaattaattaaatcactagggattgtaaaaaaatcagccgcattagcaaacatggaagttggcttactcgataaagaagttgggcaatatatcgtaaaagctgctgacgaagtgattgaaggaaaatggaatgatcaatttattgttgacccaattcaaggcggggcaggaacttccattaatatgaatgcaaatgaagtgattgctaaccgcgcattagaattaatgggagaggaaaaaggaaactattcaaaaattagtccaaactcccatgtaaatatgtctcaatcaacaaacgatgctttccctactgcaacgcatattgctgtgttaagtttattaaatcaattaattgaaactacaaaatacatgcaacaagaattcatgaaaaaagcagatgaattcgctggcgttattaaaatgggaagaacgcacttgcaagacgctgttcctattttattaggacaagagtttgaagcatatgctcgtgtaattgcccgcgatattgaacgtattgccaatacgagaaacaatttatacgacatcaacatgggtgcaacagcagtcggcactggcttaaatgcagatcctgaatatataagcatcgtaacagaacatttagcaaaattcagcggacatccattaagaagtgcacaacatttagtggacgcaactcaaaatacagactgctatacagaagtttcttctgcattaaaagtttgcatgatcaacatgtctaaaattgccaatgatttacgcttaatggcatctggaccacgcgcaggcttatcagaaatcgttcttcctgctcgacaacctggatcttctatcatgcctggtaaagtgaatcctgttatgccagaagtgatgaaccaagtggcattccaagtgttcggtaatgatttaacaattacatctgcttctgaagcaggccaatttgaattaaatgtgatggaacctgtgttattcttcaatttaattcaatcgatttcgattatgactaatgtctttaaatcctttacagaaaactgcttaaaaggtattaaggcaaatgaagaacgcatgaaagaatatgttgagaaaagcattggaatcattactgcaattaacccacatgtaggctatgaaacagctgcaaaattagcacgtgaagcatatcttacaggggaatccatccgtgaactttgcattaagtatggcgtattaacagaagaacagttaaatgaaatcttaaatccatatgaaatgacacatccgggaattgctggaagaaaataatgctacttttttaggcgaagggtactattgaggtgctctttgccttttattttttgagttacaacatgctcatcttgatgaagtgtaatcgaaatctgcaatgttcgataatagccaaaatcgtggagataatagtcaatcaagtaaggataatagtcaaactcgggcagataatagccaatggaagaaaaaggtgcttagcgaaattcgatattagtcaaaatcaagaagataatagtcaaccaagcaaggataatagtcaaacttgggaacataatagccaacggaagaaaaagttgcctcgcccctcggcaagataatagccaatggaagaaaaagttgcctcgcccg

SEQ ID NO: 16403 - protein, 468 aa, Bacillus sp
MNTDVRIEKDFLGEKEIPKDAYYGVQTIRATENFPITGYRIHPELIKSLGIVKKSAALANMEVGLLDKEVGQYIVKAADEVIEGKWNDQFIVDPIQGGAGTSINMNANEVIANRALELMGEEKGNYSKISPNSHVNMSQSTNDAFPTATHIAVLSLLNQLIETTKYMQQEFMKKADEFAGVIKMGRTHLQDAVPILLGQEFEAYARVIARDIERIANTRNNLYDINMGATAVGTGLNADPEYISIVTEHLAKFSGHPLRSAQHLVDATQNTDCYTEVSSALKVCMINMSKIANDLRLMASGPRAGLSEIVLPARQPGSSIMPGKVNPVMPEVMNQVAFQVFGNDLTITSASEAGQFELNVMEPVLFFNLIQSISIMTNVFKSFTENCLKGIKANEERMKEYVEKSIGIITAINPHVGYETAAKLAREAYLTGESIRELCIKYGVLTEEQLNEILNPYEMTHPGIAGRK

SEQ ID NO: 16404 - DNA, 1428 bp, Rhizobium etli
  CDS (1)..(1428)
atgacgacatccgatatgaccactattcgcgttgagcacgacctgatcggcgaccgcgacgtgccggcctcggcctattacggcgtgcatacggtgcgcgcggttgagaattttccaattaccggtcagacgctgaaggaatcggcggatctgatcgcctccctggcggcgatcaagcaggcggcggccgaggtcaatgttagcctcggccttctggatcagcagcgggccgacgccatcgtcgcggcttgcatcgaaatccgcgacggcgcgctgcacgaccagttcgtcgtcgatctgatccagggcggggcgggaacctcgaccaacatgaacgccaatgaggtgatcgcgaacagggcgctggaaatactggggcaccgccgcggcgagtaccagcacctgcatccgaacgagcacgtcaatctctcgcaatccaccaacgacgtctatccgacggcactgaagctcgccgcatggatcggcgttcaccgcctcgtcgacgccatggcgatcctgcgtcgcgcattcgcggccaaggcggtcgagtttgccgacgtgctgaagatgggccgcacccagttgcaggatgccgtgccgatgacgctcggccaggaattcggaacctacgcgctgatgctggcggaggacgaggcgcgcctcttggaagcggtctccttgatccgtgagatcaatctcggcgcgaccgcgatcggcaccggcatcaccgcccatcctcattatgccgcgctggtgcgcgagcgtctttcggccattgttggcatcgatctggtgacgtcacctgacctggtggaggcgacgcaggattgcggctccttcgtgcagctttcgggggttctcaagcgcgtggcggtcaagctttccaagacctgcaacgatctgcggctgctatcctccggcccgcgcgccggcttgaatgagatcaatctgccggcgcgccaggccggctcctcaatcatgcctggaaaggtaaaccctgttatccccgaggtcgtcaaccaggtcgccttcgaagtgatcggcaatgacgtgacgatcaccatggccgccgaggcaggccaactgcagctgaacgccttcgagccggtgatcttctacagcctctatcgcagtctcagccacctgaccaatgcctgcctgacgctagaggcgaattgcattcgagggattaccgccaaccgcgaccggctgcggcagacggtcgagcaatcgatcggcatcgtaacagcgctcaacccctatatcggctaccgcaacgccacagaggttgcgctggaagcgcatcattcgggacggggggtctatgaaatccttctcgagcgcggcctgatgcagaaggagcatctcgatgcggtgctgcgcccggaaacgctgacccggccgagcgagaagctgtccttctcgtaa

SEQ ID NO: 16405 - protein, 475 aa, Rhizobium etli
MTTSDMTTIRVEHDLIGDRDVPASAYYGVHTVRAVENFPITGQTLKESADLIASLAAIKQAAAEVNVSLGLLDQQRADAIVAACIEIRDGALHDQFVVDLIQGGAGTSTNMNANEVIANRALEILGHRRGEYQHLHPNEHVNLSQSTNDVYPTALKLAAWIGVHRLVDAMAILRRAFAAKAVEFADVLKMGRTQLQDAVPMTLGQEFGTYALMLAEDEARLLEAVSLIREINLGATAIGTGITAHPHYAALVRERLSAIVGIDLVTSPDLVEATQDCGSFVQLSGVLKRVAVKLSKTCNDLRLLSSGPRAGLNEINLPARQAGSSIMPGKVNPVIPEVVNQVAFEVIGNDVTITMAAEAGQLQLNAFEPVIFYSLYRSLSHLTNACLTLEANCIRGITANRDRLRQTVEQSIGIVTALNPYIGYRNATEVALEAHHSGRGVYEILLERGLMQKEHLDAVLRPETLTRPSEKLSFS

SEQ ID NO: 16406 - DNA, 1581 bp, Corynebacterium glutamicum
  CDS (1)..(1581)
atgtctaagacgagcaacaagtcttcagcagactcaaagaatgacgcaaaagccgaagacattgtgaacggcgagaaccaaatcgccacgaatgagtcgcagtcttcagacagcgctgcagtttcggaacgtgtcgtcgaaccaaaaaccacggttcagaaaaagttccgaatcgaatcggatctgcttggtgaacttcagatcccatcccacgcatattacggggtgcacacccttcgtgcggtggacaacttccaaatctcacgaaccaccatcaaccacgtcccagatttcattcgcggcatggtccaggtgaaaaaggccgcagctttagcaaaccgccgactgcacacacttccagcacaaaaagcagaagcaattgtctgggcttgtgatcagatcctcattgaggaacgctgtatggatcagttccccatcgatgtgttccagggtggcgcaggtacctcactgaacatgaacaccaacgaggttgttgccaaccttgcacttgagttcttaggccatgaaaagggcgagtaccacatcctgcaccccatggatgatgtgaacatgtcccagtccaccaacgattcctacccaactggtttccgcctgggcatttacgctggactgcagaccctcatcgctgaaattgatgagcttcaggttgcgttccgccacaagggcaatgagtttgtcgacatcatcaagatgggccgcacccagttgcaggatgctgttcccatgagcttgggcgaagagttccgagcattcgcgcacaacctcgcagaagagcagaccgtgctgcgtgaagctgccaaccgtctcctcgaggtcaatcttggtgcaaccgcaatcggtactggtgtgaacactccagcaggctaccgccaccaggttgtcgctgctctgtctgaggtcaccggactggaactaaagtccgcacgtgatctcatcgaggctacctctgacaccggtgcatatgttcatgcgcactccgcaatcaagcgtgcagccatgaaactgtccaagatctgtaacgatctacgtctgctgtcttctggtcctcgtgctggcttgaacgaaatcaacctgccaccacgccaggctggttcctccatcatgccagccaaggtcaacccagtgatcccagaagtggtcaaccaggtctgcttcaaggtcttcggtaacgatctcaccgtcaccatggctgcggaagctggccagttgcagctcaacgtcatggagccagtcattggcgaatccctcttccagtcactgcgcatcctgggcaatgcagccaagactttgcgtgagaagtgcgtcgtaggaatcaccgccaacgctgatgtttgccgtgcttacgttgataactccatcgggattatcacttacctgaacccattcctgggccacgacattggagatcagatcggtaaggaagcagccgaaactggtcgaccagtgcgtgaactcatcctggaaaagaagctcatggatgaaaagacgctcgaggcagtcctgtccaaggagaacctcatgcacccaatgttccgcggaaggctctacttggagaactaa

SEQ ID NO: 16407 - protein, 526 aa, Corynebacterium glutamicum
MSKTSNKSSADSKNDAKAEDIVNGENQIATNESQSSDSAAVSERVVEPKTTVQKKFRIESDLLGELQIPSHAYYGVHTLRAVDNFQISRTTINHVPDFIRGMVQVKKAAALANRRLHTLPAQKAEAIVWACDQILIEERCMDQFPIDVFQGGAGTSLNMNTNEVVANLALEFLGHEKGEYHILHPMDDVNMSQSTNDSYPTGFRLGIYAGLQTLIAEIDELQVAFRHKGNEFVDIIKMGRTQLQDAVPMSLGEEFRAFAHNLAEEQTVLREAANRLLEVNLGATAIGTGVNTPAGYRHQVVAALSEVTGLELKSARDLIEATSDTGAYVHAHSAIKRAAMKLSKICNDLRLLSSGPRAGLNEINLPPRQAGSSIMPAKVNPVIPEVVNQVCFKVFGNDLTVTMAAEAGQLQLNVMEPVIGESLFQSLRILGNAAKTLREKCVVGITANADVCRAYVDNSIGIITYLNPFLGHDIGDQIGKEAAETGRPVRELILEKKLMDEKTLEAVLSKENLMHPMFRGRLYLEN

SEQ ID NO: 16408 - DNA, 26 bp, Primer
atgtgtttaaagcaaatcattggcag

SEQ ID NO: 16409 - DNA, 25 bp, Primer
ttactgttcgctttcatcagtatag

SEQ ID NO: 16410 - DNA, 1413 bp, Escherichia coli K12
  CDS (1)..(1413)
atgaaaaagaccaaaattgtttgcaccatcggaccgaaaaccgaatctgaagagatgttagctaaaatgctggacgctggcatgaacgttatgcgtctgaacttctctcatggtgactatgcagaacacggtcagcgcattcagaatctgcgcaacgtgatgagcaaaactggtaaaaccgccgctatcctgcttgataccaaaggtccggaaatccgcaccatgaaactggaaggcggtaacgacgtttctctgaaagctggtcagacctttactttcaccactgataaatctgttatcggcaacagcgaaatggttgcggtaacgtatgaaggtttcactactgacctgtctgttggcaacaccgtactggttgacgatggtctgatcggtatggaagttaccgccattgaaggtaacaaagttatctgtaaagtgctgaacaacggtgacctgggcgaaaacaaaggtgtgaacctgcctggcgtttccattgctctgccagcactggctgaaaaagacaaacaggacctgatctttggttgcgaacaaggcgtagactttgttgctgcttcctttattcgtaagcgttctgacgttatcgaaatccgtgagcacctgaaagcgcacggcggcgaaaacatccacatcatctccaaaatcgaaaaccaggaaggcctcaacaacttcgacgaaatcctcgaagcctctgacggcatcatggttgcgcgtggcgacctgggtgtagaaatcccggtagaagaagttatcttcgcccagaagatgatgatcgaaaaatgtatccgtgcacgtaaagtcgttatcactgcgacccagatgctggattccatgatcaaaaacccacgcccgactcgcgcagaagccggtgacgttgcaaacgccatcctcgacggtactgacgcagtgatgctgtctggtgaatccgcaaaaggtaaatacccgctggaagcggtttctatcatggcgaccatctgcgaacgtaccgaccgcgtgatgaacagccgtctcgagttcaacaatgacaaccgtaaactgcgcattaccgaagcggtatgccgtggtgccgttgaaactgctgaaaaactggatgctccgctgatcgtggttgctactcagggcggtaaatctgctcgcgcagtacgtaaatacttcccggatgccaccatcctggcactgaccaccaacgaaaaaacggctcatcagttggtactgagcaaaggcgttgtgccgcagcttgttaaagagatcacttctactgatgatttctaccgtctgggtaaagaactggctctgcagagcggtctggcacacaaaggtgacgttgtagttatggtttctggtgcactggtaccgagcggcactactaacaccgcatctgttcacgtcctgtaa

SEQ ID NO: 16411 - protein, 470 aa, Escherichia coli K12
MKKTKIVCTIGPKTESEEMLAKMLDAGMNVMRLNFSHGDYAEHGQRIQNLRNVMSKTGKTAAILLDTKGPEIRTMKLEGGNDVSLKAGQTFTFTTDKSVIGNSEMVAVTYEGFTTDLSVGNTVLVDDGLIGMEVTAIEGNKVICKVLNNGDLGENKGVNLPGVSIALPALAEKDKQDLIFGCEQGVDFVAASFIRKRSDVIEIREHLKAHGGENIHIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLEFNNDNRKLRITEAVCRGAVETAEKLDAPLIVVATQGGKSARAVRKYFPDATILALTTNEKTAHQLVLSKGVVPQLVKEITSTDDFYRLGKELALQSGLAHKGDVVVMVSGALVPSGTTNTASVHVL

SEQ ID NO: 16412 - DNA, 1584 bp, Arabidopsis thaliana
  CDS (1)..(1584)
atgcattcaagtcatctccttctcgaggaaccgatcaggatgacttcaatcctcgaaccttctaaatcaagtttcttcccggctttgactaagattgttgggactctaggtccgaaatctcgatccgtcgaggtgattgctggttgtctcaaagctggaatgtccgtggctcgattcgatttctcttggtgcgatgctgattatcaccaggagacgctggagaatctgaagatagctgtgaagagcactaagaagctttgtgctgttatgctagacactgtaggacctgagttgcaagttattaacaagactgagaaagctatttctcttaaagctgatggccttgtaactttgactccgagtcaagatcaagaagcctcctctgaagtccttcccattaattttgatgggttagcgaaggcggttaagaaaggagacactatctttgttggacaatacctcttcactggtagtgaaacaacttcagtttggcttgaggttgaagaagttaaaggagatgatgtcatttgtatttcaaggaatgctgctactctgggtggtccgttattcacattgcacgtctctcaagttcacattgatatgccaaccctaactgagaaggataaggaggttataagtacatggggagttcagaataagatcgactttctctcattatcttattgtcgacatgcagaagatgttcgccaggcccgtgagttgcttaacagttgtggtgacctctctcaaacacaaatatttgcgaagattgagaatgaagagggactaacccactttgacgaaattctacaagaagcagatggcattattctttctcgtgggaatttgggtatcgatctacctccggaaaaggtgtttttgttccaaaaggctgctctttacaagtgtaacatggctggaaagcctgccgttcttactcgtgttgtagacagtatgacagacaatctgcggccaactcgtgcagaggcaactgatgttgctaatgctgttttagatggaagtgatgcaattcttcttggtgctgagactcttcgtggattgtaccctgttgaaaccatatcaactgttggtagaatctgttgtgaggcagagaaagttttcaaccaagatttgttctttaagaagactgtcaagtatgttggagaaccaatgactcacttggaatctattgcttcttctgctgtacgggcagcaatcaaggttaaggcatccgtaattatatgcttcacctcgtctggcagagcagcaaggttgattgccaaataccgtccaactatgcccgttctctctgttgtcattccccgacttacgacaaatcagctgaagtggagctttagcggagcctttgaggcaaggcagtcacttattgtcagaggtcttttccccatgcttgctgatcctcgtcaccctgcggaatcaacaagtgcaacaaatgagtcggttcttaaagtggctctagaccatgggaagcaagccggagtgatcaagtcacatgacagagttgtggtctgtcagaaagtgggagatgcgtccgtggtcaaaatcatcgagctagaggattag

SEQ ID NO: 16413 - protein, 527 aa, Arabidopsis thaliana
MHSSHLLLEEPIRMTSILEPSKSSFFPALTKIVGTLGPKSRSVEVIAGCLKAGMSVARFDFSWCDADYHQETLENLKIAVKSTKKLCAVMLDTVGPELQVINKTEKAISLKADGLVTLTPSQDQEASSEVLPINFDGLAKAVKKGDTIFVGQYLFTGSETTSVWLEVEEVKGDDVICISRNAATLGGPLFTLHVSQVHIDMPTLTEKDKEVISTWGVQNKIDFLSLSYCRHAEDVRQARELLNSCGDLSQTQIFAKIENEEGLTHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICCEAEKVFNQDLFFKKTVKYVGEPMTHLESIASSAVRAAIKVKASVIICFTSSGRAARLIAKYRPTMPVLSVVIPRLTTNQLKWSFSGAFEARQSLIVRGLFPMLADPRHPAESTSATNESVLKVALDHGKQAGVIKSHDRVVVCQKVGDASVVKIIELED

SEQ ID NO: 16414 - DNA, 1908 bp, Arabidopsis thaliana
  CDS (44)..(1759)
gtctctcctctgcatctcctctgttcctcaggtttctctgctcatggctgcttatggtcaaatctcctcgggaatgactgtagatcctcaggttctctcttcctccagaaacattggagtttccctatcacctctccggagaacactaatcggcgccggagttaggtctactagtatctctctccgtcaatgttctctctccgttagatcgattaaaatctccgaagatagccgcaaacctaaagcttatgcagagaacggtgcttttgatgtgggagttttggattcttcatcatatagattggctgattcaagaacaagtagtaatgattcaaggaggaagactaagattgtgtgtacgattggaccgtcttcgagttctagggaaatgatttggaaactcgcggaagctggaatgaatgtggctcgtttgaatatgtctcatggtgatcatgcttctcatcagataactattgatttagttaaggagtataattctttgtttgttgacaaagctattgctattatgttggatacaaagggtcctgaggttcgaagcggggatgtaccgcagccgatatttcttgaagagggtcaagagtttaactttactatcaagagaggtgtttcgcttaaagacactgttagtgtaaattatgatgattttgtgaacgatgttgaagttggggatatacttttggtggatggtggaatgatgtcgttagctgttaaatcaaagacgagtgatttggtgaagtgtgtggttattgatggtggagagcttcaatctagacgtcacttgaatgttcgaggaaagagtgcgactcttccatccattacagacaaagattgggaagacataaaatttggagtggacaaccaagtcgatttctacgccgtctcctttgttaaggatgctaaagttgtccatgagttgaagaactatctcaaaacctgcagtgcagacatatcggtgattgtgaaaattgaaagtgcagactctataaagaatcttccttctatcatatctgcttgtgatggggcaatggttgctcgtggagatcttggagctgaacttcccattgaagaggtcccgttgttacaggaagaaataatcagaaggtgtagaagcattcataaaccagtgattgttgccacaaacatgctagagagtatgattaatcatccaacgcctacaagagctgaagtctctgacattgcaattgcagtacgtgaaggcgcagatgctatcatgctttctggtgaaaccgcacatggaaagtttccgctgaaagctgttaacgtaatgcatactgtggcgttgagaaccgaggcaagtctacctgtcagaacctcggcatcccgtaccactgcttacaagggtcacatgggccaaatgtttgcttttcatgcttctataatggcaaatacactgagctcaccgctaattgtatttacgagaaccggatccatggcagtgcttctaagccactaccgcccatctgcaacaattttcgccttcacaaaccagagaagaataatgcaaaggcttgctctttatcaaggtgtcatgcctatatatatggagttctcggatgatgcagaagatacatatgcccggtctctcaaactcttacaggacgagaatatgctcaaggaaggacaacatgtaactcttgtccaaagtggctcgcaacccatttggcgtgaagaatcaacacatctcatacaagtccgtaagataaagataggtggatgatgtttttacttcttgagctacacaacatcttgcttttactcagctttctttctcttacacagttcgatccatatttttttgaatcactcacagtgaatcaaacaaccatataaaattttaagttattgaagctttttttctggttatag

SEQ ID NO: 16415 - protein, 571 aa, Arabidopsis thaliana
MAAYGQISSGMTVDPQVLSSSRNIGVSLSPLRRTLIGAGVRSTSISLRQCSLSVRSIKISEDSRKPKAYAENGAFDVGVLDSSSYRLADSRTSSNDSRRKTKIVCTIGPSSSSREMIWKLAEAGMNVARLNMSHGDHASHQITIDLVKEYNSLFVDKAIAIMLDTKGPEVRSGDVPQPIFLEEGQEFNFTIKRGVSLKDTVSVNYDDFVNDVEVGDILLVDGGMMSLAVKSKTSDLVKCVVIDGGELQSRRHLNVRGKSATLPSITDKDWEDIKFGVDNQVDFYAVSFVKDAKVVHELKNYLKTCSADISVIVKIESADSIKNLPSIISACDGAMVARGDLGAELPIEEVPLLQEEIIRRCRSIHKPVIVATNMLESMINHPTPTRAEVSDIAIAVREGADAIMLSGETAHGKFPLKAVNVMHTVALRTEASLPVRTSASRTTAYKGHMGQMFAFHASIMANTLSSPLIVFTRTGSMAVLLSHYRPSATIFAFTNQRRIMQRLALYQGVMPIYMEFSDDAEDTYARSLKLLQDENMLKEGQHVTLVQSGSQPIWREESTHLIQVRKIKIGG

SEQ ID NO: 16416 - DNA, 1740 bp, Arabidopsis thaliana
  CDS (1)..(1740)
atggctcaagtggttgctaccaggtcaattcaaggctcgatgttatctcccaacggtggatctgtgtctacaagatccgagaagctattgaaaccagcgagttttgcagtgaaggttcttggcaacgaagcaaagagaagtggaagagtctctgtaagaagcagaagagtggttgatactactgtgagatccgctcgtgttgagactgaagtcattcctgtttctcctgaagatgtgcctaacagagaggagcagcttgagaggttgttggaaatgcagcagtttggtgatacatcggtagggatgtggtcgaagccgacagtgaggaggaagacaaagattgtttgcaccgttggtccgtcgaccaacacacgagaaatgatatggaaattggctgaagctgggatgaatgttgctaggatgaatatgtctcatggagatcatgcttcacataagaaggttattgatttggttaaagaatacaatgcacaaactaaagacaacactattgctatcatgcttgacaccaagggtccggaagttaggagtggagatttacctcagccaattatgttagatcctggtcaagagtttacctttacaattgagagaggagtcagcacaccaagttgtgtcagtgttaactatgatgatttcgttaatgacgtggaagcgggtgacatgcttcttgttgatggtggtatgatgtcgtttatggtgaagtcaaagaccaaagactctgtcaaatgtgaagttgttgatggtggagaacttaagtcaaggagacacctgaatgtccgaggaaagagtgcaactttaccttcaatcactgagaaggactgggaggatattaaatttggagtggagaacaaagttgacttttatgcagtttcctttgtcaaagatgctcaagttgtacacgagttgaagaaataccttcaaaatagtggtgctgatatacacgtgatagtgaaaattgagagtgcagactccatacctaacttgcactccattatcacagcaccagatggggcaatggttgcaagaggtgatcttggtgcagagcttccaattgaagaagtccccattcttcaggaggagatcattaacctgtgccgtagtatgggaaaagctgttattgttgcgactaacatgcttgagagtatgatagttcatccaactccaacccgggcagaggtctcagacattgctatcgctgttagagaaggtgctgatgcggtaatgctttcaggagaaactgctcacggaaagttcccattgaaagctgctggagtgatgcacactgttgcattgcgaacagaagcaaccattactagcggtgaaatgccacctaatcttggtcaagccttcaagaaccatatgagtgagatgtttgcataccatgcaaccatgatgtcaaacacacttggaacttcaactgttgtcttcaccagaaccggtttcatggccatattgttaagtcactatcgtccttccggcacaatctatgccttcacaaatgagaaaaaaatacaacaaagattagctttgtatcaaggtgtatgccccatatatatggagttcacagatgatgcagaagaaacttttgctaatgctttggctacattactgaaacaaggaatggtgaagaagggagaggaaatagcaatcgtacagagcggtacacagccaatctggcgatctcaatcgacacataacatccaagtccgcaaggtttaa

SEQ ID NO: 16417 - protein, 579 aa, Arabidopsis thaliana
MAQVVATRSIQGSMLSPNGGSVSTRSEKLLKPASFAVKVLGNEAKRSGRVSVRSRRVVDTTVRSARVETEVIPVSPEDVPNREEQLERLLEMQQFGDTSVGMWSKPTVRRKTKIVCTVGPSTNTREMIWKLAEAGMNVARMNMSHGDHASHKKVIDLVKEYNAQTKDNTIAIMLDTKGPEVRSGDLPQPIMLDPGQEFTFTIERGVSTPSCVSVNYDDFVNDVEAGDMLLVDGGMMSFMVKSKTKDSVKCEVVDGGELKSRRHLNVRGKSATLPSITEKDWEDIKFGVENKVDFYAVSFVKDAQVVHELKKYLQNSGADIHVIVKIESADSIPNLHSIITAPDGAMVARGDLGAELPIEEVPILQEEIINLCRSMGKAVIVATNMLESMIVHPTPTRAEVSDIAIAVREGADAVMLSGETAHGKFPLKAAGVMHTVALRTEATITSGEMPPNLGQAFKNHMSEMFAYHATMMSNTLGTSTVVFTRTGFMAILLSHYRPSGTIYAFTNEKKIQQRLALYQGVCPIYMEFTDDAEETFANALATLLKQGMVKKGEEIAIVQSGTQPIWRSQSTHNIQVRKV

SEQ ID NO: 16418 - DNA, 2164 bp, Arabidopsis thaliana
  CDS (1)..(2133)
atggtaggacttgattcaagccacttgttgagagacaagatcctttgcttctccagcaggtctcacataaacaaccaacataagaagacaagttatgcattatcacttaatcacatgaaacttcctattcagagaaccttagcttttgccttagctcgcgggaaaggcgaagctgaaagtttcagcagattggaagccacctttggtgataatacctccacagaatgtacctggagttttgactttccagattctaaagatgctatgtctcatctcaagtcagaagcagacctctctggaagcaatggggccaataatgtggctagtgttatcgaaaaactgaatgctcttcggtcacatctcttagcagcagagaaatggaatgcttctcaactacacttatgtgacagtaagtatctggaatgtgcaacaaacttagttcattatatggctttgagatctctggacattgagcagctcaacagtcatctagcttctcttggtctgtcaagtttagacaacaacaatctggatgttctcgcccaccttaacgcctctattaatcttttgatgaacgatcaaaacgctgtgacggagtcttggactaatgtatatcccaagggaaaaagtactaagaagaatgataaagggagggtattatcatacaaagagtcattacttggtaaacttcgtgagggaagaagtactcatatcatggtaactattggtgaagaagcaactttgagtgaaacatttataactgatattcttaaagctggaacatctgttatccgtataaactgtgcacatggagatccaagtatttggggtgagatcatcaaaagagtaagaagaacttctcagatgttagagatgccatgtcgcgttcatatggatttagcaggaccaaaactcagaactggtaccttaaaacctggtccgtgtgtgatgaaaatttcaccaaagaaagatgcttatggaaatgttgtttctcctgctttggtatggctctgcctcacaggaacagaacctcctgctcatgtttcccctgatgctactatatcggtccaaggccaagattttcttgctggtctccaaattggtgattctataagactatgtgacgctagagggagaaagaggagacttaaaatctcaaaagagtttcatgttttcaacagtaccgggtttgtggctgaatgtttcgacactgcttacatagaaagtggaactgagttaagtgttaagggaaagaaagggagacgtttagttggacgagtagtagatgttcctcccaaagaatcttttgtaaggctaaaagttggagatttactagtcataacccgagaaggatcgctcgatgaaccatctgtaactgttccaggagctcataggttaacttgtccttccggttatttgtttgattcagtcaagcctggtgaaaccattggttttgatgatggaaaaatatggggagtcataaaaggaacaagtccttcagaggtaattgtctccataactcatgcacgtccaaaaggtacaaaactaggatcagagaagtccattaacataccgcagagcgatatccatttcaaaggcttaacatcaaaagatattaaagatcttgattatgtagcttcacatgctgatatggttggtatttctttcatacgtgatgtccatgatataaccgttcttcgacaagagttgaagaaaagaaaactagatgatcttggtattgttttaaagattgaaacgaaaagtggattcaagaatttgtctttgattcttttagaagcaatgaagtgttcgaatcctttaggaattatgatagctagaggtgatcttgcagtggaatgtggatgggagagattggctaatatgcaggaggagattatagctatttgtaaagctgctcgtgtaccggtgattatggcaactcaggttcttgaatcacttgtgaaatccggagttccaactagagctgagattactgatgctgcaaatgcaaaaagggcgagctgtgtgatgttaaacaaaggcaagaatatcgttgaagctgtttcaatgttggatactattcttcataccaagcttatctacaagaaatcggactctgaaaatctccattgatctgcttgtagtttgcttggccatttatatt

SEQ ID NO: 16419 - protein, 710 aa, Arabidopsis thaliana
MVGLDSSHLLRDKILCFSSRSHINNQHKKTSYALSLNHMKLPIQRTLAFALARGKGEAESFSRLEATFGDNTSTECTWSFDFPDSKDAMSHLKSEADLSGSNGANNVASVIEKLNALRSHLLAAEKWNASQLHLCDSKYLECATNLVHYMALRSLDIEQLNSHLASLGLSSLDNNNLDVLAHLNASINLLMNDQNAVTESWTNVYPKGKSTKKNDKGRVLSYKESLLGKLREGRSTHIMVTIGEEATLSETFITDILKAGTSVIRINCAHGDPSIWGEIIKRVRRTSQMLEMPCRVHMDLAGPKLRTGTLKPGPCVMKISPKKDAYGNVVSPALVWLCLTGTEPPAHVSPDATISVQGQDFLAGLQIGDSIRLCDARGRKRRLKISKEFHVFNSTGFVAECFDTAYIESGTELSVKGKKGRRLVGRVVDVPPKESFVRLKVGDLLVITREGSLDEPSVTVPGAHRLTCPSGYLFDSVKPGETIGFDDGKIWGVIKGTSPSEVIVSITHARPKGTKLGSEKSINIPQSDIHFKGLTSKDIKDLDYVASHADMVGISFIRDVHDITVLRQELKKRKLDDLGIVLKIETKSGFKNLSLILLEAMKCSNPLGIMIARGDLAVECGWERLANMQEEIIAICKAARVPVIMATQVLESLVKSGVPTRAEITDAANAKRASCVMLNKGKNIVEAVSMLDTILHTKLIYKKSDSENLH

SEQ ID NO: 16420 - DNA, 2118 bp, Arabidopsis thaliana
  CDS (131)..(1921)
aaaaaaaagaaaaatcaaaatccaattcaacactctcacacttcgatatctccgccttcattcttctcagagccaattgtcctgagatttcgatttctccaatctctcttcctccgtcgccggcgaaactatgtctcagtctatccaattctccagtccttcacacactcctcaccttctccatctccctcactcacaattcaaccgtcctctctcctctatctccttccgtcgcttccctctaacaaccatcaaatacacttccatcagagcctcctcgtcaccatctccttcaccggatctcgattcatcgtcctcatcatcatcctcgcaagtacttctctcacctaacggtactggtgctgtgaagtctgatgagagatccgttgttgctacggcggttacgacggatacgtctgggattgaggttgatactgtgacggaagcggagcttaaggagaatggatttagaagtacgaggaggacgaagctgatctgtacgatcggaccggcgacttgtggatttgagcagcttgaggcgcttgctgtgggaggtatgaatgtggcgaggcttaatatgtgtcacggtacgcgtgattggcatcgcggtgtgattcgtagtgttcggaggcttaatgaggagaaaggctttgcggttgctattatgatggatactgaaggtagtgagattcatatgggagatcttggtggtgaagcttcagctaaagcagaggatggtgaggtttggactttcactgttagagcttttgattcttctcgtcctgaacgtaccattagtgttagctacgatggtttcgctgaagatgtaagagttggtgatgaacttctggttgatggtgggatggtgagatttgaagtgattgagaagattggtcctgatgttaagtgtctatgtaccgatcctggattgttgcttcctcgagctaacttgacgttttggagagatggaagtctagtacgagaacgtaatgccatgcttccaacaatttcttccaaggactggctggatattgattttggaattgctgaaggtgtagatttcattgctgtatcgtttgtcaagtcggctgaagtcattaatcatcttaaaagttatcttgctgctcgttcccgtggaggggaaattggagtgattgcaaagatcgagagtatcgattcattgaccaatttggaagaaattattctagcatcagatggagccatggttgcaagaggagatctgggagctcagatacctcttgagcaagttccagcagctcaacagagaatcgtgcaagtctgcagagcgctgaacaaacccgtcattgtcgcttctcagctacttgagtccatgattgagtacccaactccaaccagagcagaagtagccgacgtgtctgaagcagtaagacaaagatcagatgcattgatgctctctggagaatcagctatgggacaattcccagacaaggcgctcacggttctaaggacagtcagtttaagaatcgagagatggtggagagaagagaaacgtcatgagtctgtgccgcttcaagccataggctcttcattttcagacaaaatctcagaagagatctgtaactcagctgctaaaatggctaacaatcttggagtggacgcggttttcgtttacacaacgagcggacacatggcatcactggtctcccgatgtcgcccggactgcccgatctttgctttcacaaccacaacctcagtgagaagacgcttaaacctacaatggggacttatcccattccgtctcagcttctcagacgacatggaaagcaacttgaacaaaacattctcgttactgaaatcaagaggtatgatcaaatctggtgacctcgtgatcgcagtctcggacatgctgcaatcaatccaggtaatgaacgtcccgtaattctctctctttatacaatttcgcaatcccgcaaaagagtgttttgtttcctacttttgttactgtttttagactactcttacattagattccagaggcatcatcatcttcggtttgttaacaacagtaatgtgtaagctttgtttgtagtgtgtactgtttgtttttggttttcaataatatcagtaatcttatcc

SEQ ID NO: 16421 - protein, 596 aa, Arabidopsis thaliana
MSQSIQFSSPSHTPHLLHLPHSQFNRPLSSISFRRFPLTTIKYTSIRASSSPSPSPDLDSSSSSSSSQVLLSPNGTGAVKSDERSVVATAVTTDTSGIEVDTVTEAELKENGFRSTRRTKLICTIGPATCGFEQLEALAVGGMNVARLNMCHGTRDWHRGVIRSVRRLNEEKGFAVAIMMDTEGSEIHMGDLGGEASAKAEDGEVWTFTVRAFDSSRPERTISVSYDGFAEDVRVGDELLVDGGMVRFEVIEKIGPDVKCLCTDPGLLLPRANLTFWRDGSLVRERNAMLPTISSKDWLDIDFGIAEGVDFIAVSFVKSAEVINHLKSYLAARSRGGEIGVIAKIESIDSLTNLEEIILASDGAMVARGDLGAQIPLEQVPAAQQRIVQVCRALNKPVIVASQLLESMIEYPTPTRAEVADVSEAVRQRSDALMLSGESAMGQFPDKALTVLRTVSLRIERWWREEKRHESVPLQAIGSSFSDKISEEICNSAAKMANNLGVDAVFVYTTSGHMASLVSRCRPDCPIFAFTTTTSVRRRLNLQWGLIPFRLSFSDDMESNLNKTFSLLKSRGMIKSGDLVIAVSDMLQSIQVMNVP

SEQ ID NO: 16422 - DNA, 1584 bp, Arabidopsis thaliana
  CDS (1)..(1584)
atgcattccagtcatcttcttctcgaggagccgatcaggatggcttcaatcctcgagccttccaaatctagtttcttcccggcattgactaagatcgtcggaactctaggtcctaaatcccgatccgtcgaggctctctccggctgtctcaaagccggcatgtctgtggctcgatttgatttctcgtggggagatgctgattatcaccaggagacacttgataatttgaaagttgctgtgaggagcactaagaagctttgtgctgttatgcttgatactgttggacctgagctacaagttattaacaaatctgagaaagctattactttgaaagctgatggccttgtaactttgacaccgaatcaagatcaagaagcttcttctgaagttcttcccattaatttcaatggacttgccaaggcagtgaagaaaggagacaccatcttcgttgggcaatacctattcactggtagtgaaacaacttcagtttggctcgaggttgatgaagttaaaggagatgatgtcatttgcctttcaaggaatgctgctactctggctggttctttgttcactttacactcctctcaagttcacattgatctcccaacgcttacagagaaggataaggaggttataagcacatggggagttcaaaataaaatcgattttctctcattgtcttattgtcgtcatgctgaggatgttcgccagacccgtgaaatgcttaaaaagttgggcgacctctctcaaacacaaatatttgctaagattgagaacgtagagggactaacccacttcgatgagattctacaagaagctgatggcattattctttctcgtgggaatttgggtatagatttacccccggaaaaggtgtttttgtttcaaaaggctgctctttacaagtgcaacatggctggaaagccagctgttcttacccgtgttgttgacagtatgactgacaacttgcgaccaactcgtgctgaggccacggatgttgctaatgctgttttagatggaagtgatgcaattcttcttggtgctgagacccttcgtggattgtaccctgttgagacaatatcaactgttggtaggatctgtgctgaggcagaaaaggttttcaatcaagatttgtactttaagaagactgtcaagtatgttggagaaccaatgactcacttggaatcgattgcttcttcagctgtacgggcagccattaaggttaaggcatccgtaattatatgcttcacctcttctggaagagcagccagattgattgccaaatacaggccaacgatgccggttatttctgttgtcattccccgggttaagacaaatcaactgaaatggagctttagtggagcttttgaggcgaggcagtcacttattgtcagaggcctcttccctatgcttgctgaccctcgtcaccctgcggaatctacaagtgcgacaaacgagtcagtcctgaaggttgctctagaccatgggaagcatgctggagtaatcaagtcgcatgacagagtagtggtgtgtcagaaagttggtgatgcatctgtggttaagatcattgagcttgaggattaa

SEQ ID NO: 16423 - protein, 527 aa, Arabidopsis thaliana
MHSSHLLLEEPIRMASILEPSKSSFFPALTKIVGTLGPKSRSVEALSGCLKAGMSVARFDFSWGDADYHQETLDNLKVAVRSTKKLCAVMLDTVGPELQVINKSEKAITLKADGLVTLTPNQDQEASSEVLPINFNGLAKAVKKGDTIFVGQYLFTGSETTSVWLEVDEVKGDDVICLSRNAATLAGSLFTLHSSQVHIDLPTLTEKDKEVISTWGVQNKIDFLSLSYCRHAEDVRQTREMLKKLGDLSQTQIFAKIENVEGLTHFDEILQEADGIILSRGNLGIDLPPEKVFLFQKAALYKCNMAGKPAVLTRVVDSMTDNLRPTRAEATDVANAVLDGSDAILLGAETLRGLYPVETISTVGRICAEAEKVFNQDLYFKKTVKYVGEPMTHLESIASSAVRAAIKVKASVIICFTSSGRAARLIAKYRPTMPVISVVIPRVKTNQLKWSFSGAFEARQSLIVRGLFPMLADPRHPAESTSATNESVLKVALDHGKHAGVIKSHDRVVVCQKVGDASVVKIIELED

SEQ ID NO: 16424 - DNA, 2234 bp, Nicotiana tabacum
  CDS (59)..(1840)
cgttgctgtcgaccgaaaatttcctaaaaaatctcaaaatttctgctgaggaaaaacgatgtcgcaagctcttaacttcttcgtttcctcgtcttcacgttctccggcgactttcacaatctcaaggccgtcggttttcccgtcaaccggtagtttacggttactggtgaagaaatcgttgcggacgttagttgtggaagcgtcgtcggcggcggcgtcagatctcgacgagccgcagtcgtccccggtgttagtatcggagaatggttcaggaggggtattatcgagtgcgacgcaggagtacggtcgtaatgctgcaccggggaccgattcgagttcgattgaagtggatacagtaacggaggcggagttaaaggagaacgggtttaggagtacacgtagaacaaagttgatttgcacgattggacctgccacgtgtgggtttgagcagctggaacgattagctgagggaggaatgaatgtagctaggataaatatgtgccatggaacacgcgagtggcatcgtatggtgattgagagactgaggaggttgaatgaggagaaagggtttgctgtagctatcatgatggatactgaaggtagtgaaattcatatgggagatcttggtggcgcttcttctgctaaagctgaggatggtgaaatttggaatttcactgttcgttcatttgatccaccactcccagaacgcaccgttactgttaactatgatggctttgctgaagatgtgaaagtgggtgatgagctactagtagatggtggaatggtgagatttgaagtgattgagaaaattggcccagatgttaagtgtctttgcacagatcctggacttcttctacctcgggctaatctgacattttggcgggatggtaaactagtaagggaacgcaatgccatgcttccaacaatttcctcaaaggattggctagacatagactttggtattgctgagggtgttgattttattgctgtatcatttgtcaagtctgctgaagtcattaagcatcttaagagctacattcaagcccgggctcgggatagtgatatttctgtaattgcaaaaatagagagcattgactcattgaagaacttagaagagataatccaggcatcagatggtgctatggtcgcgagaggagatcttggtgctcaaattccattagaacaggttccatcagagcagcaaaagattgttcagatatgcaggcagctgaataggcctgttatagtagcctcccagctgctggaatctatgattgaataccctattccaactagagctgaagttgctgatgtttctgaagcagttaggcaaaggggggatgctttgatgctttctggtgagtcggccatgggacagtttcctgagaaggcattgactgtactaagaagtgttagcttgagaattgaaagaatgtggagggaacagaaacgccatgaagttattgaattgccatccatagcatcttcattttcagatagtatttcagaagagatctgcaactctgccgccaagatggcaaacaatttggaagttgatgctctttttgtttacaccaagaatgggcacatggcatctctcttgtcacgctgccgtcctgactgcccaatatttgcatttacaacgacaacatctgtacgcagacgcctgaacctgcaatggggtctaatgcctttccgcttgagtttctccgatgatatggaaagcaacctcaacaagacattctccttactaaaagctcggggcatgatcaagtcaggtgacctcatcattgctgtttccgacatgctgcagtccattcaagttatgaatgttccatgagtgcacaaattagttctgtgttttgagttttgagctaggcaaccccaattatatgccaattaaaccaattatgaagttcaacagttggttctgctagggagtaaaacaacgacgagcaatccttcctcagtgtgtcctcgtttcaggtgctggacttcaatgacatttggtgtaactcaactgtcgcttgtagtcaacacagatatgttgcaatgtataccccctgttttcctaggatttggatgtatcttctgcttgagttattgatctagaaatgagccttagaaatgatcgtgataattatggatttgttcttagaattgctattagcgtgctgtctttggtgtttttttaatgatctatcggtttgaattaccttttggaaaaaaaaaaa

SEQ ID NO: 16425 - protein, 593 aa, Nicotiana tabacum
MSQALNFFVSSSSRSPATFTISRPSVFPSTGSLRLLVKKSLRTLVVEASSAAASDLDEPQSSPVLVSENGSGGVLSSATQEYGRNAAPGTDSSSIEVDTVTEAELKENGFRSTRRTKLICTIGPATCGFEQLERLAEGGMNVARINMCHGTREWHRMVIERLRRLNEEKGFAVAIMMDTEGSEIHMGDLGGASSAKAEDGEIWNFTVRSFDPPLPERTVTVNYDGFAEDVKVGDELLVDGGMVRFEVIEKIGPDVKCLCTDPGLLLPRANLTFWRDGKLVRERNAMLPTISSKDWLDIDFGIAEGVDFIAVSFVKSAEVIKHLKSYIQARARDSDISVIAKIESIDSLKNLEEIIQASDGAMVARGDLGAQIPLEQVPSEQQKIVQICRQLNRPVIVASQLLESMIEYPIPTRAEVADVSEAVRQRGDALMLSGESAMGQFPEKALTVLRSVSLRIERMWREQKRHEVIELPSIASSFSDSISEEICNSAAKMANNLEVDALFVYTKNGHMASLLSRCRPDCPIFAFTTTTSVRRRLNLQWGLMPFRLSFSDDMESNLNKTFSLLKARGMIKSGDLIIAVSDMLQSIQVMNVP

SEQ ID NO: 16426 - DNA, 1479 bp, Arabidopsis thaliana
  CDS (1)..(1479)
atggagatgttacttggtggccgagcaaccaatggagctctccgttcaaagacgaagatagtttgtactcttggaccggtttcaagatcggtggagatgattgagaagcttctcaaggctgaaactctcgataatctccgaactgccatgaacaacactggtatcctctgcgccgtcatgctcgatacaaagggtcctgagatacgaaccggttttctcaaagaaggcaaaccgatacagctaaaccaaggtcaagagatcaccatctcaattgattacaagatagaaggagattcaaacattatctccatgagctacaagaaacttgcagaggacgtcaaacctggtgatgtgattctctgttcagacggcacaatctctttaactgtcttgtcctgtgacaagtctttcggtcttgttcgttgccgttgcgagaactctacaattctaggagaaagaaaaaacgttaatcttcctggaattgtagttgatctcccaacacttactgagaaagataaagaagatatcatccaatggggagttccgaacaaaatcgacatcatcgctctttcttttgttcgtaaaggatctgacctaactgaagttaggaagttacttggagaacactcaaagaacatcatgctcatgtcaaaggtggagaatcaagaaggggtcatgaattgtgaaaagattctggagaattctgatgctttcatggtggctagaggagatcttggaatggagattcagatcgaaaagatgttccttgctcagaaaacaatgatcaagatggctaatgctcttgggaaaccagttgtcacagccacacagatgcttgaatccatgacagtatctcctcgtccgactagagctgaagccactgacgttgcaaacgctgttcttgacgggacagattgcgttatgcttagtggagaaaccgctgcaggagctcaccctgaggctgccgtgctaacaatgtcaaggatctgtaaagaagcagaggatttcatcgattacgacattctccacaagaaaaccctaggaatgctttcgttaccgttatctccgatcgagagcttagctgcttcagttgtttcgacggcacagagtgtttttgcgtcggctatcgtcgttctcaccaaaggcggttacacggcggagcttgtggctaaatacaggccgagcgttccgattttgtcggtgattgtgcctgagattgctcaagggaatgatatagagatgtcgtgctcggactcggtggctcatgtggcgagacgtggtttgatttaccgtgggattattccggtggtggcgacgggatcatcggctagggattcaaacaaagatgcaacggaggagatgattaatttggctatcggattcgcgaagacgaagggaatttgcaagaatggagattcgattgtggcgttgcacaagattgatggttcctctgttgtgaagatagtgagcgttgagtaa

SEQ ID NO: 16427 - protein, 492 aa, Arabidopsis thaliana
MEMLLGGRATNGALRSKTKIVCTLGPVSRSVEMIEKLLKAETLDNLRTAMNNTGILCAVMLDTKGPEIRTGFLKEGKPIQLNQGQEITISIDYKIEGDSNIISMSYKKLAEDVKPGDVILCSDGTISLTVLSCDKSFGLVRCRCENSTILGERKNVNLPGIVVDLPTLTEKDKEDIIQWGVPNKIDIIALSFVRKGSDLTEVRKLLGEHSKNIMLMSKVENQEGVMNCEKILENSDAFMVARGDLGMEIQIEKMFLAQKTMIKMANALGKPVVTATQMLESMTVSPRPTRAEATDVANAVLDGTDCVMLSGETAAGAHPEAAVLTMSRICKEAEDFIDYDILHKKTLGMLSLPLSPIESLAASVVSTAQSVFASAIVVLTKGGYTAELVAKYRPSVPILSVIVPEIAQGNDIEMSCSDSVAHVARRGLIYRGIIPVVATGSSARDSNKDATEEMINLAIGFAKTKGICKNGDSIVALHKIDGSSVVKIVSVE

SEQ ID NO: 16428 - DNA, 1596 bp, Rattus norvegicus (Norway rat)
  CDS (1)..(1596)
atgcccaagccagacagcgaagcagggactgccttcattcagacccagcagctccatgcagccatggctgacaccttcctggaacacatgtgccgcctggacattgactccgcacccatcacggcccgcaacactgggatcatctgtaccattggccctgcttcccgatctgtggagatgctgaaggagatgattaagtctgggatgaatgtggctcggctgaatttctctcatggaacccatgagtaccatgcagagactatcaagaatgtccgtgcagccacagaaagctttgcatctgatcccattctctaccgacctgttgcggtggctctggatacaaagggacctgagatccggactggactcatcaagggcagcggcaccgcagaggtggagctgaagaagggagccacactgaagatcaccctggacaacgcctacatggagaagtgcgacgagaacatcctgtggctggactataagaacatctgcaaggtggtggaggtgggcagcaagatctacgtggacgatgggctcatctccctgcaggtgaaggagaaaggtgctgactacctggtgacagaagtggaaaatggtggctccttgggcagcaagaagggcgtgaacctgcctggtgctgctgtggacctccctgctgtgtcagaaaaggacatccaggacctgaagtttggggtggagcaggacgtggacatggtgtttgcgtctttcatccgcaaggcggctgacgtgcatgaggttaggaaggtcctgggagagaagggcaagaacatcaagatcatcagcaaaatcgagaaccatgaaggtgtccgcaggtttgatgagattttggaggccagcgatggaatcatggtagctcgtggtgacctgggcattgagattccggcagagaaggtcttcctagctcagaagatgatgattggacgatgcaaccgagctgggaagccagtcatctgcgccacccagatgctggagagcatgatcaagaagccacgccccacccgtgctgaaggcagtgacgtggccaatgcagtcctagatggagctgactgcatcatgctgtccggagaaacagccaaaggggactaccctctggaggctgttcgcatgcagcacctgattgcccgagaggcagaggctgccatctaccacttgcagttattcgaggaactccgccgcctggcgcccattaccagcgaccccacagaagctgccgccgtgggtgccgtggaggcctccttcaagtgctgcagtggggccattatcgtgctcaccaagtctggcaggagtgctcaccaagtggcccggtaccgcccaagggctcctatcattgctgtgacacgcaatccccagacagcccgccaggcccatctgtaccgtggcatcttccctgtgctgtgtaaggatgccgtactggatgcctgggctgaggacgttgatcttcgtgtgaacttggccatgaatgttggcaaggcccgaggcttcttcaagaagggagatgtggtcattgtgctgactggatggcgccctggctctggcttcaccaacaccatgcgtgtagtgcctgtaccatga

SEQ ID NO: 16429 - protein, 531 aa, Rattus norvegicus (Norway rat)
MPKPDSEAGTAFIQTQQLHAAMADTFLEHMCRLDIDSAPITARNTGIICTIGPASRSVEMLKEMIKSGMNVARLNFSHGTHEYHAETIKNVRAATESFASDPILYRPVAVALDTKGPEIRTGLIKGSGTAEVELKKGATLKITLDNAYMEKCDENILWLDYKNICKVVEVGSKIYVDDGLISLQVKEKGADYLVTEVENGGSLGSKKGVNLPGAAVDLPAVSEKDIQDLKFGVEQDVDMVFASFIRKAADVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAIYHLQLFEELRRLAPITSDPTEAAAVGAVEASFKCCSGAIIVLTKSGRSAHQVARYRPRAPIIAVTRNPQTARQAHLYRGIFPVLCKDAVLDAWAEDVDLRVNLAMNVGKARGFFKKGDVVIVLTGWRPGSGFTNTMRVVPVP

SEQ ID NO: 16430 - DNA, 1455 bp, Chlamydophila pneumoniae, Chlamydia pneumoniae
  CDS (1)..(1455)
atgatcacacgcactaaaattatttgcactatagggccagcaacgaatagtccagagatgttagcaaaacttctagatgctgggatgaacgtagcaagattaaatttcagtcatgggagtcacgaaactcatggacaggctattggatttctcaaggagttaagggagcagaagcgggttcctttagcaattatgctagatactaaggggcctgaaattcgtttagggaatattcctcagccaatttcggtttctcagggacaaaagcttcgtctggtaagtagtgatatcgatgggagtgctgaagggggagtgtctctctatcctaaggggatatttccctttgttcctgagggtgctgatgttttaatagatgatggctacattcatgctgttgttgtctcttcagaggctgattctttagaattagagtttatgaacagtggccttctcaagtctcataaatctttgagtatccgaggtgttgatgttgctcttccctttatgacagagaaagatattgcggatcttaagtttggggtagagcagaatatggatgtggttgctgcatcttttgtgcgctacggtgaagatattgaaactatgcgcaagtgtttagcagacttaggcaatcctaagatgcccatcattgcaaaaatagaaaatcgtttaggggtagaaaatttctctaagattgccaagcttgcggatggaattatgattgctagaggagatttaggaatcgagctttctgtcgttgaagtcccaaatttgcaaaagatgatggctaaggtttctagagaaacaggtcacttctgtgtgactgcaacgcagatgctagaatctatgattcgcaatgtcttacctacacgagctgaagtctctgatattgccaatgcaatttatgatggttcttcagcagtgatgttgtcaggggaaactgcatctggagcccatcccgtggctgccgtgaaaatcatgcgttctgtgattttagaaacagaaaagaatctctcccatgattcattcttaaaattagacgatagcaatagcgctcttcaggtgtccccctatctctcagccattggattggcaggcattcagattgcagaaagggcagacgccaaagctcttattgtttatacagaatcaggaagttctccgatgtttctctctaaatatcgtccgaaattccctatcattgccgtgactccaagcacttctgtttactatcgcctagctttggaatggggggtctatcctatgcttacccaggaaagtgatcgcgctgtatggagacatcaggcctgtatttatggcatagaacagggcattctctctaattatgatcggattcttgtgcttagcagaggagcctgtatggaagaaacaaataatcttaccctgacaatagtgaatgatattttgactgggtcggaatttcctgaaacctag

SEQ ID NO: 16431 - protein, 484 aa, Chlamydophila pneumoniae, Chlamydia pneumoniae
MITRTKIICTIGPATNSPEMLAKLLDAGMNVARLNFSHGSHETHGQAIGFLKELREQKRVPLAIMLDTKGPEIRLGNIPQPISVSQGQKLRLVSSDIDGSAEGGVSLYPKGIFPFVPEGADVLIDDGYIHAVVVSSEADSLELEFMNSGLLKSHKSLSIRGVDVALPFMTEKDIADLKFGVEQNMDVVAASFVRYGEDIETMRKCLADLGNPKMPIIAKIENRLGVENFSKIAKLADGIMIARGDLGIELSVVEVPNLQKMMAKVSRETGHFCVTATQMLESMIRNVLPTRAEVSDIANAIYDGSSAVMLSGETASGAHPVAAVKIMRSVILETEKNLSHDSFLKLDDSNSALQVSPYLSAIGLAGIQIAERADAKALIVYTESGSSPMFLSKYRPKFPIIAVTPSTSVYYRLALEWGVYPMLTQESDRAVWRHQACIYGIEQGILSNYDRILVLSRGACMEETNNLTLTIVNDILTGSEFPET

SEQ ID NO: 16432 - DNA, 1419 bp, Clostridium acetobutylicum
  CDS (1)..(1419)
atgcaaaaaacaaaaatgatttttacaatagggccctctagtgattcagaggagaaattaaaagaattaatgaatgctggaatgaatgctgcaaggttaaatttttcacatggcactcatgaagatcacaaagaaaaaatagatattataaaaaaacttagaaaagaactgaacaaaaatgttgcaattgtagttgacatcaaaggaccaaaaattagaactcataattttgaaaatgacaaagctgaaataaaaaaaggtcaaaccttcacagtaatgtgtggaagcgaaattttgggaaattcagagaaatgctccgtttcttatgatgatctttataaagatgtaaaaaaaggtggattactccttgtcgatgatggtcttttagaatttgaaataactgatgtacaagacaaaaacattatttgtaaggcaaaaaataatggtattatttcaaatcataaaggtgtaaatgtacctggtgtttctataggtcttcctgctgtaactgaaaaagatgtattagatttaaaatttgcatgtaaaatgcaagctgatttagtagctgcttcttttataagaaaagcagaagatgtatctgtcgttagaaaggttcttaaagaaaatggtggagaagatataagagttatctctaagatagaaactcaagaaggtgttgataacatcgataagattctcgaactatctgatggaatcatggtagcaagaggagatatgggtgttgaaattccaatagaggatgttccttcaatacagaaaatgataataagaaaatgtaatgatgcaggcaaaatagttataacagctactcaaatgcttgattcaatgataagaaacccaagacctacaagagctgaggcatcagatgttgccaatgcaatatatgacggaacagatgctataatgctaagtggagaaagtgcaagtggtttatatccaattgaagctgctgaaactatggcaaagatagcacaaaaaacagaatctcaaatagactatactaaagctcttaatgaaagaaaaggtgaaattataacaaaaatttcagacgctataagtcttgctgcatgctcaactgctgctgaacttaaagctgctgctataataacagctactcaaagcggtataactgcaagaatggtatctaaattcagaccaacttgccctataatagctgttacacctcatgatgatgttgcaagaagacttgctctaaactttggtataacacctattacatctgaaaaagttgtttcaacagatgaacttatatctgtttcaataaaaagagcacttaacgagaatttaattaaaaaaggtgacttagttgttgtagttgcaggtgttcctgtaggcgaatctggaactactaatatgttaaaaattcaatacacataa

SEQ ID NO: 16433 - protein, 472 aa, Clostridium acetobutylicum
MQKTKMIFTIGPSSDSEEKLKELMNAGMNAARLNFSHGTHEDHKEKIDIIKKLRKELNKNVAIVVDIKGPKIRTHNFENDKAEIKKGQTFTVMCGSEILGNSEKCSVSYDDLYKDVKKGGLLLVDDGLLEFEITDVQDKNIICKAKNNGIISNHKGVNVPGVSIGLPAVTEKDVLDLKFACKMQADLVAASFIRKAEDVSVVRKVLKENGGEDIRVISKIETQEGVDNIDKILELSDGIMVARGDMGVEIPIEDVPSIQKMIIRKCNDAGKIVITATQMLDSMIRNPRPTRAEASDVANAIYDGTDAIMLSGESASGLYPIEAAETMAKIAQKTESQIDYTKALNERKGEIITKISDAISLAACSTAAELKAAAIITATQSGITARMVSKFRPTCPIIAVTPHDDVARRLALNFGITPITSEKVVSTDELISVSIKRALNENLIKKGDLVVVVAGVPVGESGTTNMLKIQYT

SEQ ID NO: 16434 - DNA, 1413 bp, Yersinia pestis
  CDS (1)..(1413)
atgaaaaagactaaaattgtttgtactatcggtccaaaaaccgaatccgaagaaatgctgacaaacctgctgaatgctggcatgaacgttatgcgtttaaacttctctcacggtgactatgcagagcacggtcaacgtatcaaaaacctccgggctgtaatggcaaaaacaggcaaaaaagccgcgattttgctggatactaaaggccctgaaatccggaccatgaaactggaaggcggcaaagatgctgcgctggttgcaggtcagaccttcacgttcacgactgatcaaagcgttgtcggtaacgacaaaattgttgcagtcacctacccaggcttcgccgctgacctgaaaattggtaacactgttctggttgacgatggcttgatcggtatggaagtcattgaagtcactgaacacaccgttgtctgtaaagtcttgaacagtggtgatttgggtgaaaacaaaggcgttaacctgccaggcgtgtcgatccaactgcccgcattagcagaaaaagataaaggcgacctgatcttcggttgcgaacaaggcgttgatttcgttgccgcctcctttatccgtaaacgttctgatgtactggaaattcgtgaacacctgaaagcacacggtggcgaacatatccagatcatctctaaaatcgaaaatcaggaaggtctgaataacttcgacgaaatcctggaagcctctgacggtatcatggttgcccgtggtgacttaggtgttgagatccctgtcgaagaagtcatcttcgcgcagaagatgatgatcgagaaatgtaaccgcgcacgtaaagttgttattactgcaactcaaatgctcgattccatgatcaaaaacccacgtcctacccgcgcagaagccggtgacgttgcaaacgccatccttgacggtaccgacgcggtcatgctgtccggcgaaagtgctaagggtaagtacccattagagtctgtcaccatcatggcgaccatctgtgagcgtacagaccgtgttatgcctagccgcattgagtcactgaacgacaaccgtaaaatgcgaatcactgaagccgtttgccgtggtgctgttgaaaccgcagaaaaactggaagccaaagtgattgtggtcgcaaccggggggggtaaatctgcaaaatctgtccgtaaatacttccctactgcgaccattctggcactgacgaccaatgaaatgacagcccatcagttaattctgactaaaggcgtaatcactcagttggtagacgaaatcgcctcaaccgatgatttctaccgtctcggtaaagaagcggctctggcgagcggcctggcacagaaaggcgacgtggtcatcatggtttcaggtgccttggtaccaagcggtacgaccaatacctcttcagtacacgtgttataa

SEQ ID NO: 16435 - protein, 470 aa, Yersinia pestis
MKKTKIVCTIGPKTESEEMLTNLLNAGMNVMRLNFSHGDYAEHGQRIKNLRAVMAKTGKKAAILLDTKGPEIRTMKLEGGKDAALVAGQTFTFTTDQSVVGNDKIVAVTYPGFAADLKIGNTVLVDDGLIGMEVIEVTEHTVVCKVLNSGDLGENKGVNLPGVSIQLPALAEKDKGDLIFGCEQGVDFVAASFIRKRSDVLEIREHLKAHGGEHIQIISKIENQEGLNNFDEILEASDGIMVARGDLGVEIPVEEVIFAQKMMIEKCNRARKVVITATQMLDSMIKNPRPTRAEAGDVANAILDGTDAVMLSGESAKGKYPLESVTIMATICERTDRVMPSRIESLNDNRKMRITEAVCRGAVETAEKLEAKVIVVATGGGKSAKSVRKYFPTATILALTTNEMTAHQLILTKGVITQLVDEIASTDDFYRLGKEAALASGLAQKGDVVIMVSGALVPSGTTNTSSVHVL

SEQ ID NO: 16436 - DNA, 1431 bp, Nostoc sp. PCC 7120
  CDS (1)..(1431)
atgcgtcgaactaaaattatctgtactgtaggcccggctacatctgcaccagaacgtttagaagcgttggtagaagctgggatgaatgtagcacggctgaatttttctcatggagcttatgacttccatgcccaaactgctcagtatttgcggcaaatcagtgctgacagacaaaagcctgtggcgattatgcaagacctatgcgggccgaagattcgcttgggaactttaccaccagaagggttaatggtagaggctggtcaggaagtgacttttgtcttgcaagaaaagggtagtagtcttgatgaattgcctttacctttgccgaccttgttcgcaatggtacgacctggggaaccaatcttaattaatgatggtcgtgtcaagttgattgtgacagatcgcgatgccgatcgcattcgggctattgccaaaatcgggggtcttctttctacccgtaagggtgttaacctgccagcgactcgtttacctgtcagttccatcaccgaaaaggacttgcaggatttgcgttttggcatcgatttgagtgtagattgggtggcggtgtcttttgtgcgatcgccttatgacctcgaaccagcgcaacggatgattgaagcggcggggaaaactattcgggtaatcgccaaaattgaacgtccagaagccgttgagcaaattgattctatcatcgacgttgctgatgcgattatgattgctcgtggtgacttgggtgtggaaatgcctatccatgaagtcccattgattcaaaaggacatcattcgccgttgcaaccaagctggtaagcccgtgattacagcaacgcaaatgctagagtcgatgattagcgctcccgatcccacccgtgcggaggctacagacgttgctaactctattctcgatggtacagatgccgtcatgctctctggggaaacggctgtaggacaatatcccgtcgccgccgtccaggttatgcacgatatcgccgtgactacagaaaagtctttgcaagagggtagtaaacattgcttatcccatgaagcaggtggtctgagtgtcaccgaatctgtagctgaagcggtctgtcgtatcgcctacgaaacaggcgcaaaagcgattctttgcaacaccacatcagggagtacagcaaagctcgtgtcgaaatatcgtccgactacacccatttttgcgttgacccccgacgaaaccgcctaccatcagttagcactttcttggggtgtggaacctttattaaccccaccagtccacaatgcggaagaaatgtttatgaatctcatcaacaccgccgtgagaacgggtttggtgcatgacggtgacaaggtagttattacttctggagtgccaattggtaaatcaggcacaactagtttaattaaagtgcattctattggacaaccaatcaccgcctaa

SEQ ID NO: 16437 - protein, 476 aa, Nostoc sp. PCC 7120
MRRTKIICTVGPATSAPERLEALVEAGMNVARLNFSHGAYDFHAQTAQYLRQISADRQKPVAIMQDLCGPKIRLGTLPPEGLMVEAGQEVTFVLQEKGSSLDELPLPLPTLFAMVRPGEPILINDGRVKLIVTDRDADRIRAIAKIGGLLSTRKGVNLPATRLPVSSITEKDLQDLRFGIDLSVDWVAVSFVRSPYDLEPAQRMIEAAGKTIRVIAKIERPEAVEQIDSIIDVADAIMIARGDLGVEMPIHEVPLIQKDIIRRCNQAGKPVITATQMLESMISAPDPTRAEATDVANSILDGTDAVMLSGETAVGQYPVAAVQVMHDIAVTTEKSLQEGSKHCLSHEAGGLSVTESVAEAVCRIAYETGAKAILCNTTSGSTAKLVSKYRPTTPIFALTPDETAYHQLALSWGVEPLLTPPVHNAEEMFMNLINTAVRTGLVHDGDKVVITSGVPIGKSGTTSLIKVHSIGQPITA

SEQ ID NO: 16438 - DNA, 1437 bp, Brucella melitensis
  CDS (1)..(1437)
atgaagcgcaaccgcaaggtcaagattctcgccacgctaggtccagcctctggcgaggaagccgtcatccgcaagctctttgaagcaggagcggatgtcttccgcatcaatatgagtcacgccgaccatgacctgatgcgaaccttggtcaagcgcattcgcaatgtggaaaaggaactgggacgccccatcggcattctggccgatcttcaggggccgaagctgcgcgtcggcaagttcaaggatggcaaggtcgatctcgttcccggccagaccttcaccctcgacaataacgaggcgctgggcgatgaaacccgcgttttcctgccgcatcctgaaattctggaagctgtcgagccgggccatcgcctgttgatcgatgacggaaagctgcatctggtggctgaagcctgcgacggcaagtcgatccgctgcaaggttgtttccggcacccgcatttccgaccgcaagggggtcagccttcccgacacgacgctcggcgttggcgcgctgacggagaaagaccgctgcgatcttgatgccgtgctgaaggaagagatcgattgggtggcgctttcctttatccagcgcccggaagatctggccgaagtgcgcaaggtttcgcgcggcaaggtcggcctcatgtccaagatcgaaaagccgcaggctgttacccgtcttgatgaaattatcgagctttccgacgccttgatggttgcccgcggcgatctcggtgttgaagtgccgcttgaaaacgttcccggcattcaaaagcagattacccgcaaggcgcgtcgcgccggcaagccggtcgttgtcgcaacccagatgctggaatcgatgattaccgcgccggtgcccacccgcgctgaagtgtccgacgtggcgactgcggtgtttgaaggtgcggatgcaatcatgctttcggcggaatctgcttccggccaatatccggtcgaagctgttgcaaccatgaaccgcatcgccgagcaggtggagcgcgagccgacctattcgaccatcattgacgcacagcgcgccatgccggagccgactggcgccgacgctatctcgctcgccgcgcgtcagattgctgaaacgttgaaactctcggccatcgtgacctatacggcttccggcacgaccggcctgcgcgctgcccgcgagcgtccgcgcacacccattatcgcgctgtcgcccgttgttgataccgcccgtaaactgtccctcgtatggggcctgcattgcgtcatcacagatgatgcccatgatcttgaagacatggtcaatcatgcctgcgaaatcgtgttccatgaggaattcggcaaagctggcgatcgcgtcatcatcacggcaggcgtacccttcggaacgccgggtgcaaccaatatgctgcgtatcgcctatataggcgctgacggaaaatccggcatttag

SEQ ID NO: 16439 - protein, 478 aa, Brucella melitensis
MKRNRKVKILATLGPASGEEAVIRKLFEAGADVFRINMSHADHDLMRTLVKRIRNVEKELGRPIGILADLQGPKLRVGKFKDGKVDLVPGQTFTLDNNEALGDETRVFLPHPEILEAVEPGHRLLIDDGKLHLVAEACDGKSIRCKVVSGTRISDRKGVSLPDTTLGVGALTEKDRCDLDAVLKEEIDWVALSFIQRPEDLAEVRKVSRGKVGLMSKIEKPQAVTRLDEIIELSDALMVARGDLGVEVPLENVPGIQKQITRKARRAGKPVVVATQMLESMITAPVPTRAEVSDVATAVFEGADAIMLSAESASGQYPVEAVATMNRIAEQVEREPTYSTIIDAQRAMPEPTGADAISLAARQIAETLKLSAIVTYTASGTTGLRAARERPRTPIIALSPVVDTARKLSLVWGLHCVITDDAHDLEDMVNHACEIVFHEEFGKAGDRVIITAGVPFGTPGATNMLRIAYIGADGKSGI

SEQ ID NO: 16440 - DNA, 1443 bp, Yersinia pestis
  CDS (1)..(1443)
atgtccagacggctcagaaggaccaagattgttactacactggggccggctactgaccgcgacaataatctggaaaagattattgctgcaggtgcgaacgtagtccgcctgaatttttcccatggtagcgctgaagatcatgaattacgggccaataaagtccgtgaaatcgctgccagactggggcgtcatgtagctattcttggtgatttgcaaggtcctaaaatccgggtatcgacgtttaaagaaggtaaagttttccttaatataaacgataaattcctgctggatgccaatatggcaaaaggcgaaggtgataaaaacaaagtgggtatcgattacaaaggcctgccagctgatgtggttcccggtgatattttattgcttgatgatggccgcgtgcagttaaaagtggttgaagttcagggcatgaaagtcttcaccgaagtgaccgtcggtggcccgctctctaacaataaaggcatcaacaagttaggtggcgggttatcagccgaagccctaaccgaaaaagataaagccgatattgttaccgctgcaaaaattggtgtggacttcctggcggtctctttcccacgtactggtgaagatttgcattatgcacgccgcctggcccgtgatgctggctgcaatgcacagatcgtcgcaaaggttgagcgcgctgaagcggtcgccactgatgaggcgatggatgatatcattctggcctctgacgtcgtcatggtcgctcgtggtgatttgggtgttgaaattggcgacccagaacttgttggtatccaaaagaaactgatccgccgtgcccgccagctaaaccgtgccgtgatcacggcgactcagatgatggagtcaatgatcaccaacccgatgccaacccgagcagaggtgatggatgttgccaacgcagtgctggatggtaccgatgcggtcatgttgtcagcagaaacagcagcaggccagtacccggcagaaaccgtagcggcaatggcgcgtgtctgtctaggcgcggaaaaaatcccaagcatcaatgtgtcaaaacaccgtctagatgtgcaattcgataacgtcgaagaagctatcgcgatgtcgaccatgtatgcggcaaaccacctcaaaggtatcaccgcgattatcgccatgactgaatcaggccgcacggctttgatgatgtcgcgtatcagttccggtttacctattttcgccatgtcgcgccatgatcatactttaaacctaaccgccatctatcgtggcgtgacgccggtctattgtgatccccatactgacggtgttcttgccgccacagaagcagtaaaacgcttgcaagataaagggttcttggtgtcaggtgatttggttatcgttactcagggcgatgtgatgggcaccattggtacgaccaataccagtcgtatcatccgcgtcgaataa

SEQ ID NO: 16441 - protein, 480 aa, Yersinia pestis
MSRRLRRTKIVTTLGPATDRDNNLEKIIAAGANVVRLNFSHGSAEDHELRANKVREIAARLGRHVAILGDLQGPKIRVSTFKEGKVFLNINDKFLLDANMAKGEGDKNKVGIDYKGLPADVVPGDILLLDDGRVQLKVVEVQGMKVFTEVTVGGPLSNNKGINKLGGGLSAEALTEKDKADIVTAAKIGVDFLAVSFPRTGEDLHYARRLARDAGCNAQIVAKVERAEAVATDEAMDDIILASDVVMVARGDLGVEIGDPELVGIQKKLIRRARQLNRAVITATQMMESMITNPMPTRAEVMDVANAVLDGTDAVMLSAETAAGQYPAETVAAMARVCLGAEKIPSINVSKHRLDVQFDNVEEAIAMSTMYAANHLKGITAIIAMTESGRTALMMSRISSGLPIFAMSRHDHTLNLTAIYRGVTPVYCDPHTDGVLAATEAVKRLQDKGFLVSGDLVIVTQGDVMGTIGTTNTSRIIRVE

SEQ ID NO: 16442 - DNA, 1770 bp, Nostoc sp. PCC 7120
  CDS (1)..(1770)
atgcaattaagagattctgtacgccggacaaaaatcgtcgctacaattggccctgccactagtagccccgaaatgctgaaagccatcattgaagcgggtgcaacaacgctgcgactcaacttttcccacggttcccacgccgaccatcagcgtagtattcgcctaattcggcaaaccgcttttgaactaaatcagccagtggcaattctccaagatttgcaagggccaaaaattcgcttgggaaagtttgaaaacgggtctatagttttagctaaaggcgatcgcttcaccttaacaaatcgcccagttgttggtagtcaagaaattagctgtgtcacctacgattatttggcagatgaggtccctgtaggtgcaaaaatcctcctggatgatggccgtgtagaaatggtggtagaggatatcaaccgcgacaaaggggatttgaactgtcgggtgactgtagcaggtaagttatctaataacaaaggtgttaactttcctggcgtttatctctcaattaaagccatgaccgacaaagatcgtgaggatctgatgtttggtctagatcagggtgttgattgggtagccctttcctttgtccgcaatccgcaagacatcattgaaattaaagagctaatttccagcactggtaaacaagtgccggtagttgccaaaatagaaaagcatgaagcgatcgaacaaatggaagcagttctcgctttatgtgatggcgtaatggtggctagaggcgatttaggtgtagaactaccagcagaagatgtccccgtactacaaaagcgcttaattgccacagcaaaccgcttggggattcccatcatcactgctactcaaatgttagatagcatggtgagcaatccccgtcccacccgcgcggaagtgtccgatgtagccaatgccattcttgatggtacagatgcggtcatgctctccaatgaaacggctgtgggtagctacccagtggaagcagtggcgacaatggcaagaattgccgaacgcatcgagcaggaagaagctatggctagtaaattacgccaaatgcgagataaccgccgttctattcccaacgccatcagccaagctgtaggtcaaattgctgaacagttgggagcagcagcaattatgactctcacccaaacaggggcgactgcacgcaacgtttccaaattccgcccccaaacaccaatcttggcagtaacaccccacgttaacgtagctcgtcaactacaaatggtgtggggcgtaaaacctttgttggtcttagaattaccttccactggtcaaactttccaagccgccattaacgtcgcccaagagcatagtttactgtttgaaggtgatttagtcgtgatgacagccgggacgttacaaggggtatctggctcaacggacttgattaaagttgaagtggtaacggcagttctaggacagggaattggtctaggacagggtttggtaagcggttgtgctagggttgctcacaccgggatggatgtggggaactttaacgctggtgatattttggttgcaccccgcacaggtgcagattttgtcgaggcgattcgcaaagccggcgggattattacagaggatgaaagtttaactagtcatgcggcggtgattggtttacgcctgggtgtgccggtgattgtaggtgtgaagaaagccacgcaagttatccgtgatggagcaattttgactctggatttgcaacgaggtttagtttattccggagcagtaggaactccttaa

SEQ ID NO: 16443 - protein, 589 aa, Nostoc sp. PCC 7120
MQLRDSVRRTKIVATIGPATSSPEMLKAIIEAGATTLRLNFSHGSHADHQRSIRLIRQTAFELNQPVAILQDLQGPKIRLGKFENGSIVLAKGDRFTLTNRPVVGSQEISCVTYDYLADEVPVGAKILLDDGRVEMVVEDINRDKGDLNCRVTVAGKLSNNKGVNFPGVYLSIKAMTDKDREDLMFGLDQGVDWVALSFVRNPQDIIEIKELISSTGKQVPVVAKIEKHEAIEQMEAVLALCDGVMVARGDLGVELPAEDVPVLQKRLIATANRLGIPIITATQMLDSMVSNPRPTRAEVSDVANAILDGTDAVMLSNETAVGSYPVEAVATMARIAERIEQEEAMASKLRQMRDNRRSIPNAISQAVGQIAEQLGAAAIMTLTQTGATARNVSKFRPQTPILAVTPHVNVARQLQMVWGVKPLLVLELPSTGQTFQAAINVAQEHSLLFEGDLVVMTAGTLQGVSGSTDLIKVEVVTAVLGQGIGLGQGLVSGCARVAHTGMDVGNFNAGDILVAPRTGADFVEAIRKAGGIITEDESLTSHAAVIGLRLGVPVIVGVKKATQVIRDGAILTLDLQRGLVYSGAVGTP

SEQ ID NO: 16444 - DNA, 1973 bp, Rattus norvegicus (Norway rat)
  CDS (85)..(1680)
cggcagcgacccgtcctaagtcgacagacgtcctctttaggtattgcaacaggatctgaagtacgcccgaggatctcagaaaccatgcccaagccagacagcgaagcagggactgccttcattcagacccagcagctccatgcagccatggctgacaccttcctggaacacatgtgccgcctggacattgactccgcacccatcacggcccgcaacactgggatcatctgtaccattggccctgcttcccgatctgtggagatgctgaaggagatgattaagtctgggatgaatgtggctcggctgaatttctctcatggaacccatgagtaccatgcagagactatcaagaatgtccgtgcagccacagaaagctttgcatctgatcccattctctaccgacctgttgcggtggctctggatacaaagggacctgagatccggactggactcatcaagggcagcggcaccgcagaggtggagctgaagaagggagccacactgaagatcaccctggacaacgcctacatggagaagtgcgatgagaacatcctgtggctggactataagaacatctgcaaggtggtggaggtgggcagcaagatctacgtggacgatgggctcatctccctgcaggtgaaggagaaaggtgctgactacctggtgacagaagtggaaaatggtggctccttgggcagcaagaagggcgtgaacctgcctggtgctgctgtggacctccctgctgtgtcagaaaaggacatccaggacctgaagtttggggtggagcaggacgtggacatggtgtttgcgtctttcatccgcaaggcggctgacgtgcatgaggttaggaaggtcctgggagagaagggcaagaacatcaagatcatcagcaaaatcgagaaccatgaaggtgtccgcaggtttgatgagattttggaggccagcgatggaatcatggtagctcgtggtgacctgggcattgagattccggcagagaaggtcttcctagctcagaagatgatgattggacgatgcaaccgagctgggaagccagtcatctgcgccacccagatgctggagagcatgatcaagaagccacgccccacccgtgctgaaggcagtgacgtggccaatgcagtcctagatggagctgactgcatcatgctgtccggagaaacagccaaaggggactaccctctggaggctgttcgcatgcagcacctgatagctcgagaggctgaggcagccgtgttccaccgcctgctgtttgaagagcttgcgcgagcctccagtcaatccacagaccccctggaggccatggccatgggcagcgtggaggcctcttataaatgtttagcagcagctttgatagttctgacggagtccggcaggagtgctcaccaagtggcccggtaccgcccaagggctcctatcattgctgtgacacgcaatccccagacagcccgccaggcccatctgtaccgtggcatcttccctgtgctgtgtaaggatgccgtactggatgcctgggctgaggacgttgatcttcgtgtgaacttggccatgaatgttggcaaggcccgaggcttcttcaagaagggagatgtggtcattgtgctgactggatggcgccctggctctggcttcaccaacaccatgcgtgtagtgcctgtaccatgatgatcctctggagcttctcttctagcccctgtcccttcccctcccctatcctatccattaggccagcaacgcttgtagtgctcactctgggccatagtgtggcgctggtgggctgggacaccaggaaaaattaatgcctctgaaacatgcaatagagcccagctatttttcatggccctacttgagccaggggtgaaggaggaatgcaggattggaaaccctctgactttatcacagaagggcagcattatctctgtgttctttgctcctgtagaaagttttccagagaattc

SEQ ID NO: 16445 - protein, 531 aa, Rattus norvegicus (Norway rat)
MPKPDSEAGTAFIQTQQLHAAMADTFLEHMCRLDIDSAPITARNTGIICTIGPASRSVEMLKEMIKSGMNVARLNFSHGTHEYHAETIKNVRAATESFASDPILYRPVAVALDTKGPEIRTGLIKGSGTAEVELKKGATLKITLDNAYMEKCDENILWLDYKNICKVVEVGSKIYVDDGLISLQVKEKGADYLVTEVENGGSLGSKKGVNLPGAAVDLPAVSEKDIQDLKFGVEQDVDMVFASFIRKAADVHEVRKVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHLIAREAEAAVFHRLLFEELARASSQSTDPLEAMAMGSVEASYKCLAAALIVLTESGRSAHQVARYRPRAPIIAVTRNPQTARQAHLYRGIFPVLCKDAVLDAWAEDVDLRVNLAMNVGKARGFFKKGDVVIVLTGWRPGSGFTNTMRVVPVP

SEQ ID NO: 16446 - DNA, 1509 bp, Lactococcus lactis subsp. lactis
  CDS (1)..(1509)
atgaataaacgtgtaaaaatcgtctcaactcttggacctgctgtcgaaattcgtggtggcaaaaaatttggtgaaagcggctattggggagaatctcttgacgtcgaagcatcagcaaaaaacattgcagctttgattgaagaaggcgctaatgtcttccgtttcaacttctcacacggtgaccatcctgaacaaggtgctcgtatggcaactgttcaccgcgctgaagaaatcgctggtcacaaagtaggtttcttgcttgatactaaaggtcctgaaatgcgtacagaactcttcactgacggtgctgattcaatcagcgttgttactggagataaattccgtgttgcaactaaacaaggtcttaaatcaactcctgaattgattgccttgaacgtagctggcggacttgacatctttgatgatgttgaaatcggtcaaactatcttgattgatgatggtaaacttggtttgtcattgactggtaaagatgcagcaactcgtgaattcgaagttgaagcacaaaatgatggtgttatcggtaaacaaaaaggtgttaacattcctaacactaaaattcctttcccagcccttgctgaacgtgacgatgcagatatccgtttcggtctttcacaacctggtggaattaactttatcgctatctcattcgtacgtactgcaaatgacgttaaagaagtacgtcgtatttgtgaagaaactggtaatccacacgtacaacttttggctaaaattgaaaaccaacaagggattgaaaaccttgatgaaatcatcgaagcagctgatggtatcatgattgctcgtggtgacatgggtatcgaagttccatttgaaatggttccagtttaccaaaaattgattatcagcaaagttaacaaagcaggtaaaattgttgtaactgcaacaaacatgcttgaatcaatgacttacaacccacgtgctacacgttcagaaatttcagacgtatttaacgctgttattgacggaactgatgctacaatgctttcaggtgagtctgctaatggtaaatacccacgcgaatcagttcgtacaatggctactgttaacaaaaatgctcaaacaatgttgaaagaatacggacgtcttcacccagaacgttacgacaaatcaactgtaacagaagttgttgctgcatcagttaaaaatgctgcagaagctatggatgttaaattgattgttgctttgactgaatctggtaacacagctcgtttgatttctaaacaccgtccagatgctgatatcttggctatcacatttgacgaaaaagttgaacgtggattgatgatcaactggggtgttatcccaatgatgactgaaaaacctgcatctactgatgacatgtttgaagttgctgaaaaagttgcattggcttctggtttggttgaagctggcgacaatatcatcatcgttgctggtgttccagttggtactggtcgcactaatacaatgcgtatccgcactgttaaataa

SEQ ID NO: 16447 - protein, 502 aa, Lactococcus lactis subsp. lactis
MNKRVKIVSTLGPAVEIRGGKKFGESGYWGESLDVEASAKNIAALIEEGANVFRFNFSHGDHPEQGARMATVHRAEEIAGHKVGFLLDTKGPEMRTELFTDGADSISVVTGDKFRVATKQGLKSTPELIALNVAGGLDIFDDVEIGQTILIDDGKLGLSLTGKDAATREFEVEAQNDGVIGKQKGVNIPNTKIPFPALAERDDADIRFGLSQPGGINFIAISFVRTANDVKEVRRICEETGNPHVQLLAKIENQQGIENLDEIIEAADGIMIARGDMGIEVPFEMVPVYQKLIISKVNKAGKIVVTATNMLESMTYNPRATRSEISDVFNAVIDGTDATMLSGESANGKYPRESVRTMATVNKNAQTMLKEYGRLHPERYDKSTVTEVVAASVKNAAEAMDVKLIVALTESGNTARLISKHRPDADILAITFDEKVERGLMINWGVIPMMTEKPASTDDMFEVAEKVALASGLVEAGDNIIIVAGVPVGTGRTNTMRIRTVK

SEQ ID NO: 16448 - DNA, 1401 bp, Thermotoga maritima
  CDS (1)..(1401)
atgcgaagtacaaagatcgtatgtacggtcggaccaagaacagacagctatgaaatgatagaaaagatgatagaccttggagtgaacgtcttcagaataaacacctcacatggtgactggaacgagcaggaacagaaaatactcaaaataaaagatctgagagagaaaaagaaaaaacccgtagccattctgatcgatcttgcggggccgaagatcagaaccggatacctcgaaaaagagtttgtggaattaaaagaaggccagatcttcactctcaccacaaaggaaatacttggaaacgaacacatagtctcggtgaatctcagctctcttccaaaggacgtgaagaaaggagacaccattctgctgagcgatggagagatagtgcttgaggtaattgaaacaaccgatacagaagtgaaaacagtggtgaaagtcggtggaaagatcacacacaggagaggtgtgaacgtaccgacggccgatctttcggtggaatccataacggacagagacagagaattcataaaactcggaacgttgcatgacgttgaatttttcgctctttcttttgtgagaaagccagaggacgtgctcaaggcaaaagaagagatcagaaaacacggaaaggaaatacctgtaatctccaaaatagaaacgaaaaaggctctggagcgtctcgaggagataataaaggtgagcgatggaatcatggtcgcacgcggtgacctgggagtggagatacccatagaagaagtccccatcgttcagaaagaaatcatcaaactctccaagtactactccaaaccagtcatagtcgcaactcagatactcgaatcgatgatagaaaatccgttccccacgagggcagaggtcaccgacatagccaacgccatcttcgatggagcggacgccctgctcctcacagcggaaacagcggttggaaaacatcccctggaagccataaaggtgctgagtaaagtagcaaaagaagccgaaaaaaaactggaatttttcagaacgatagaatacgataccagcgacatatctgaggctatatcacacgcctgctggcagctctctgaatctctgaacgcgaagctgatcatcacacctaccatatccgggagtaccgctgttcgtgtttcaaagtacaacgtttctcaacccattgtggccctgacaccagaagagaaaacctactacagactttctctcgtgaggaaggtgatacccgttctcgctgaaaaatgttcccaggaattagagtttatcgaaaaagggctgaagaaagtagaagaaatgggtttggcagaaaaaggggatctggtggttctcacttccggcgttccaggaaaggtgggaacgacaaacaccataagggtgttgaaggtggattga

SEQ ID NO: 16449 - protein, 466 aa, Thermotoga maritima
MRSTKIVCTVGPRTDSYEMIEKMIDLGVNVFRINTSHGDWNEQEQKILKIKDLREKKKKPVAILIDLAGPKIRTGYLEKEFVELKEGQIFTLTTKEILGNEHIVSVNLSSLPKDVKKGDTILLSDGEIVLEVIETTDTEVKTVVKVGGKITHRRGVNVPTADLSVESITDRDREFIKLGTLHDVEFFALSFVRKPEDVLKAKEEIRKHGKEIPVISKIETKKALERLEEIIKVSDGIMVARGDLGVEIPIEEVPIVQKEIIKLSKYYSKPVIVATQILESMIENPFPTRAEVTDIANAIFDGADALLLTAETAVGKHPLEAIKVLSKVAKEAEKKLEFFRTIEYDTSDISEAISHACWQLSESLNAKLIITPTISGSTAVRVSKYNVSQPIVALTPEEKTYYRLSLVRKVIPVLAEKCSQELEFIEKGLKKVEEMGLAEKGDLVVLTSGVPGKVGTTNTIRVLKVD

SEQ ID NO: 16450 - DNA, 1449 bp, Deinococcus radiodurans
  CDS (1)..(1449)
atgaaacactttgaccgtgccaccaaaatcgtggcgactgtcggccccgccagccgcagcaccgaagttctcgggcgcatgatcgacgttggcctgaacgtggtccgcctcaacttcagccacggcgacctcgaagaccaccgtcagacggtgcagatggtgcgtgacctcgccgtgagcaagggcgtgaccatcggtatcctgcaagacctgcaaggccccaagattcgggtgggccgctttgccgaaggttcggtgaccctgaatcccgggcagaagttcgtcatcacgatggacgaggtggagggcaatgccgagcgcgtgggcagcacctacaagggcctcgccggtgacgtgacccccggcatgacgctgctgctcgacgacggcaacatgagcctgcgggtggaccacgtgcgcggcaacgacattcagacgactgtcctgatcggcggcacgttgaaaaacaacaagggcatcaacgtgcccgaagccgacctgaccgtgcccgcactgtcggaaaaagatgtgcaggacatggaatttggcgcgagcctcggcgtggactgggtggccttgagcttcgtgcgctcgcgcgatgacctgctgctcgcccggcattacctcgcccgcttcggcagccgcgccaagctgatggccaaaatcgagaagccgcaggcggtggaccgcttcgccgacatcctcaaggaagtggacggcgtgatggtggcgcgcggcgacctcggtgtggaaatgcgccccgagcaggtgccgaccatccagaaacgcatcatccgcatgtgccgtgaggcgggcaagccggtcattacggccacccagatgctcgaaagcatgatcaacctgccgcgccccacccgcgccgaggcgtcggacgtggcgaacgctatttatgacggcaccgacgcggtgatgctttccgccgaatcggcggcgggccagtacccggtcgagtcggtcgctatgatggaccgtattgcccgcgaggccgaagcgagcgagctttaccagttgatgcagcgtcaggtcgtgatggacaccgagcaggcgcaggacgccattgcgctcgccgcctgcaacatcggggctaagctcgaagcgcccgccatcgtgacctttaccagcacgggcggggcggccacccgcatttccaagaaccgtccgccgctcgccatcgtcgcgctgacccccaacgagatcacccgcaaccagctcgcgctttcctggggcgtctaccccatgctcagcgaagaccccgaggacaccgatgacatggtacgcatcgccaacgacgagctgaaaaagagcggcctggccgacgtgggcgaccgctacgtgattacggcgggcgtgcccttcggcgtgcgcggcaccaccaatatgctgcgcgtggaaaagttgaaggccgaggacttgtcggaccgcgtttaa

SEQ ID NO: 16451 - protein, 482 aa, Deinococcus radiodurans
MKHFDRATKIVATVGPASRSTEVLGRMIDVGLNVVRLNFSHGDLEDHRQTVQMVRDLAVSKGVTIGILQDLQGPKIRVGRFAEGSVTLNPGQKFVITMDEVEGNAERVGSTYKGLAGDVTPGMTLLLDDGNMSLRVDHVRGNDIQTTVLIGGTLKNNKGINVPEADLTVPALSEKDVQDMEFGASLGVDWVALSFVRSRDDLLLARHYLARFGSRAKLMAKIEKPQAVDRFADILKEVDGVMVARGDLGVEMRPEQVPTIQKRIIRMCREAGKPVITATQMLESMINLPRPTRAEASDVANAIYDGTDAVMLSAESAAGQYPVESVAMMDRIAREAEASELYQLMQRQVVMDTEQAQDAIALAACNIGAKLEAPAIVTFTSTGGAATRISKNRPPLAIVALTPNEITRNQLALSWGVYPMLSEDPEDTDDMVRIANDELKKSGLADVGDRYVITAGVPFGVRGTTNMLRVEKLKAEDLSDRV

SEQ ID NO: 16452 - DNA, 1446 bp, Vibrio cholerae
  CDS (1)..(1446)
atgagctcaactttgcgtagaacaaaaatcgtcgccaccttaggtccttccacagaaagccctgaaattctcgaagccattatccgagccggagccaatgtcgttcggatgaatttttcacacggcaccgcggaagaccataaaaaccgtgcgcagaaagttcgcgaaattgccgccaaactcggtcgccacgtcgccttattaggtgatttacaaggtccaaaaattcgtgtttctactttcaaagaaggcaaaattatccttaatgaaggggaacacttcattcttgatgcggaattagccaaaggggaaggtacgcaagaaagcgtggggattgattacaaaaagctaccgcaagatgtttgtaacgacgatattttgctgcttgatgatggccgtgtgcagttacaagttatgcgagttgaaggcaataaaatccacaccaaagtcttggtcggcggtcctctctccaacaataaagggattaacaaaaaaggcggcggtttgtcggcagatgctttgactgagaaagacaaaaatgacattcgacttgcggcagaaattcaagttgagtacctcgcggtgtctttccctcgcaatggtgaagacatgaaattcgcgcgccgccttgcccaagaatctgggctttatgcgcgtatggtcgccaaagttgaacgcgcagaaaccgtctcttgtgatgaaaacattgatgatattgttcgtgcctcggatgtcatcatggtcgcacggggtgatctcggggtggaaatcggtgaccccgaactcatcgccgtacagaaaaagctgatttcacgcgcgaaaaaactcaaccgtgtggtgattaccgcaacgcaaatgatggaatcgatgatcagtaaccctatgccaacccgcgccgaagtcatggatgtggcgaatgcggtgctcgatggcactgacgctgtgatgctgtcgggagaaacggctgcgggcaaatatccggttgaaaccgtcaaagcgatggctgaagtctgcattggtgcagaaaagatgattgagtcgaatgagcaaaactatcgcattaaaagtgtgttccgcacggaagaagaagcgattgctatgtcgactatctatgcagccaaccacttagaaggcgttaaagccatggtcacgctcaccgaatcaggacgcaccgcattaatgacctcaaggctcaattccgtattcccgatttttgcgatgtctgccaaccaagcaaccctcaatcgctgcgcgttattgcgcggggtgatccctttctacttcgataccaaacaagccagcggtctggaagcagccattgcagcattagatgccctcaaagagcgaaacctactcgaagaaggggatctcgtgatcattacccaaggcgatattatgggagtcgaaggctccaccaactgtatgcgcatcttacctgtctattag

SEQ ID NO: 16453 - protein, 481 aa, Vibrio cholerae
MSSTLRRTKIVATLGPSTESPEILEAIIRAGANVVRMNFSHGTAEDHKNRAQKVREIAAKLGRHVALLGDLQGPKIRVSTFKEGKIILNEGEHFILDAELAKGEGTQESVGIDYKKLPQDVCNDDILLLDDGRVQLQVMRVEGNKIHTKVLVGGPLSNNKGINKKGGGLSADALTEKDKNDIRLAAEIQVEYLAVSFPRNGEDMKFARRLAQESGLYARMVAKVERAETVSCDENIDDIVRASDVIMVARGDLGVEIGDPELIAVQKKLISRAKKLNRVVITATQMMESMISNPMPTRAEVMDVANAVLDGTDAVMLSGETAAGKYPVETVKAMAEVCIGAEKMIESNEQNYRIKSVFRTEEEAIAMSTIYAANHLEGVKAMVTLTESGRTALMTSRLNSVFPIFAMSANQATLNRCALLRGVIPFYFDTKQASGLEAAIAALDALKERNLLEEGDLVIITQGDIMGVEGSTNCMRILPVY

SEQ ID NO: 16454 - DNA, 1740 bp, Halobacterium sp. NRC-1
  CDS (1)..(1740)
atgagaaacgcgaagatcgtctgtacgctcggccccgcgaccaacgacgacgcgtcggtgcgggcgctcgcggacgccggcatgacggtagcacggatcaacgccagccacggcgacgcggccgcgcgccgggagctcatcgagaccacgcgggccgtcgacgcccagaccgacaagccgcttgcggtgatgctcgacacccaaggcccggaggtcaggaccgcaccgatcgacgacgacggcaccatccacatcgaaaccggcagcgacgtggcgttcgtcgagggcgacaccgcgacccccgatcggatcgggatctccaccagcatcgcggccgccgaacccggtgacacggtgttgctcgacgacggccgcatcgaggccgacgtcgaccgcgtcgccggcgacacggtgcacgccaccgtggtgtccggcgggagcctcggcagccggaagggcgtcaacgtgccgggcgtcgagctggacgtggacgtcgtcaccgagaaggaccgccgcgatctggcgttggccgccgagctggacgtcgattacgtggcggcgagcttcgtccgggacgccgacgacgtgttggccgtcaaccgcgtcctggagtcccacggtgccgacatccccatcgtggcgaagatcgagcgggcgggtgccgtggagaacctggacggcatcatcgacgccgcccagggcgtgatggtggcgcgcggcgatctcggcgtggagtgtccgatggaggacgtgccgatgatccaaaagcgcatcatcgcgcagtgccgggacgcgggggtgccggtgatcaccgcgaccgagatgctggactcgatggtgcacgcccggcgtccgacgcgcgcggaggccagcgacgtggccaacgcggtcctggacggcaccgacggcgtgatgttgtccgcggagaccgcggtgggggacaaccccacgcgggttgtcgagacgatggaccgcatcgtgcgggaggtcgaaggcagcgcggagtacagcgagcgccaggagcaggcggtgccgacggccgacgggacggcgaagacggacgcgctggcgcggtcggcgcggtatctggcccgcgacatcgacgccagcgcggtggtggtggcctccgagtcggggtacaccgcccggaaggccgcgaagttccggcccagcgtcccggtggtctgtgcgacgccgtcccacgacgtgcgccggcagctcgcgctcaactggggggtccacgccaactacgcggcggtcgcggagggcgacgcgacgacggtcgtcgagcgcgcggtgcaggcggccgtcgactccggcgtggtggcgagcggcgacaccgtggtggtgctcgtgggcatgatgacggagcttgagggcgcatcgacgacgaacacgctgaaagtgcacgtggccgcggagacgctctcgaccgggcgggcggtcgtcgacgggcggacgaccggccggacgtaccgtgccgacagcggggatctcagcgacgccccggagaacgcggtggtgctgttggcgcacgggttcgacggcgagttcgacggcgatctctcgaagatcggggcgatcgtgagcgcggacgccgggctgaccgggtatccggcggtgatcgcgcgcgaactcgacgtgccgatggtcggcgatgtcgacgtggacgcggtgccggctggcgatctggtgaccgtggacggcgagcgcggcgtcgtctacgaggccgatcagtga

SEQ ID NO: 16455 - protein, 579 aa, Halobacterium sp. NRC-1
MRNAKIVCTLGPATNDDASVRALADAGMTVARINASHGDAAARRELIETTRAVDAQTDKPLAVMLDTQGPEVRTAPIDDDGTIHIETGSDVAFVEGDTATPDRIGISTSIAAAEPGDTVLLDDGRIEADVDRVAGDTVHATVVSGGSLGSRKGVNVPGVELDVDVVTEKDRRDLALAAELDVDYVAASFVRDADDVLAVNRVLESHGADIPIVAKIERAGAVENLDGIIDAAQGVMVARGDLGVECPMEDVPMIQKRIIAQCRDAGVPVITATEMLDSMVHARRPTRAEASDVANAVLDGTDGVMLSAETAVGDNPTRVVETMDRIVREVEGSAEYSERQEQAVPTADGTAKTDALARSARYLARDIDASAVVVASESGYTARKAAKFRPSVPVVCATPSHDVRRQLALNWGVHANYAAVAEGDATTVVERAVQAAVDSGVVASGDTVVVLVGMMTELEGASTTNTLKVHVAAETLSTGRAVVDGRTTGRTYRADSGDLSDAPENAVVLLAHGFDGEFDGDLSKIGAIVSADAGLTGYPAVIARELDVPMVGDVDVDAVPAGDLVTVDGERGVVYEADQ

SEQ ID NO: 16456 - DNA, 1434 bp, Borrelia burgdorferi (Lyme disease spirochete)
  CDS (1)..(1434)
atgatttcaaagttaacaaaaattgtagcaacaatatctgatcttagatgcgaaccagaacatataaaagatttacacgatgcaggggtaaatgttataagactaaatactgctcatcaatcacacgaagatacaataaaagtaatagacaatgttagaaaaatttcaaataaaatagctttaatgattgatacaaaaggaccagaagttagaacagcaaatattgaaaatcctattattgtaaaaactggagacaaggtaatcatttcaacctcgcctattaatgagcctaataactttcaaaccaattatgatggatttgttaaagaagtaccccaaggatctaaagtgctaattgatgacggtgaacttgaaatgactgttgttgccaaattgcctgacagattaatttgtgaaattaaaaatgacggccaaattaaaaataaaaaatcaatcaatacccccggaatttctcttaagctacaatcagtaaccgaaaaagacaaaggatttattgagcttgcagcaaaatataatgttgattttattgcccattcgtttgtaagacattccaaagacgttcaagatgttcaagaaattttaactgcctctggaaatcctgatgtaaaaattatatccaaaatcgaaaatcaagagggaattgacaacattgaagaaattgcaaaagcttcttacggaataatggttgcaaggggagacatgggagttgaaattcctgcagaagatgtacccattgctcaacttaaaataacacaaacctgtataaagtatggaatacccgtgattacagcaactcaaatgcttcatacaatgattgaaaatccaagacctactagagcagaagtgtctgacatcgctaacgctattttaaacggcacagacgcaattatgttatccggagaaaccgcctacgggaaatatccaattgaagctgtaaaaatgatgacaagcattgctaaaaaagttgaaaaacacagaaaaatgaccttatataaggatgaacttttttacgataaaagtatcacaagaaactatattatcaaatgtgcaattgatgccacaaaacttatggacataaaagcaattattgtagattctctaaaaggcaaaaccgcaagaataatggcaacctacagagcaagtgttccattattcattacaacaaatagcgaaagactagcaagagaattagcattatcttacggggtttattctaatcttgtagacaataatttcaaaagaactaccgaatttgtagtaacttctcttaaaatgttaaaagaacaaggtgttgttaatgacaaagatactgtaataattatttctggaaatccaaatagaaatattgaaaaaggaacagaatttatggaaataaacacagtagaagatgcaatcaaaggacgaaatatataa

SEQ ID NO: 16457 - protein, 477 aa, Borrelia burgdorferi (Lyme disease spirochete)
MISKLTKIVATISDLRCEPEHIKDLHDAGVNVIRLNTAHQSHEDTIKVIDNVRKISNKIALMIDTKGPEVRTANIENPIIVKTGDKVIISTSPINEPNNFQTNYDGFVKEVPQGSKVLIDDGELEMTVVAKLPDRLICEIKNDGQIKNKKSINTPGISLKLQSVTEKDKGFIELAAKYNVDFIAHSFVRHSKDVQDVQEILTASGNPDVKIISKIENQEGIDNIEEIAKASYGIMVARGDMGVEIPAEDVPIAQLKITQTCIKYGIPVITATQMLHTMIENPRPTRAEVSDIANAILNGTDAIMLSGETAYGKYPIEAVKMMTSIAKKVEKHRKMTLYKDELFYDKSITRNYIIKCAIDATKLMDIKAIIVDSLKGKTARIMATYRASVPLFITTNSERLARELALSYGVYSNLVDNNFKRTTEFVVTSLKMLKEQGVVNDKDTVIIISGNPNRNIEKGTEFMEINTVEDAIKGRNI

SEQ ID NO: 16458 - DNA, 1413 bp, Vibrio cholerae
  CDS (1)..(1413)
atgaaaaagaccaaaatcgtatgtacgattggcccaaaaactgagtctgtagagaaactgactgagcttgtaaacgctggcatgaatgttatgcgtctcaacttctctcacggtgactacgttgaacacggcactcgtatcactaacttccgtaaagtgatggaagtgaccggtaaacaactggcgatcctactggatactaaaggtccagagatccgtactatcaagctggaaaacggtgacgatgtggatctggtcgctggccaagagttcactttcacaactgacacgaaagttgttggtaacaaagagcgcgtagcagtcacttactctggttttgcaaaagacctgaacgtgggcaaccgtattctggttgacgacggtcttatagagatggaagtactggcgaccactgacactgaagtgaagtgtaaagttctgaacaacggcgctctgggtgaaaacaaaggtgttaacctgccaggcgtttctgtcaatctgccagcgctgtctgaaaaagacaaaaacgacctgaaatttggttgtgagcaaggcgttgatttcgttgctgcctctttcatccgtaaaggttctgacgtgaaagaaatccgtgaagtattagcttctcacggcggtcaaaacattcaaatcatctctaaaatcgaaaaccaagaaggcttggacaacttcgatgagatccttgagctgtctgacggcatcatggttgcacgtggcgacctaggtgtagaaatcccagcagaagaagttatcttcgctcaaaagatgatgatcgagaaatgtaaccgtgcacgtaaagtggttatcacggcgacgcaaatgctggattcaatgatcaagaacccacgtccaactcgcgcagaagcgggcgacgttgcgaacgcgatcatggatggtactgatgctgtaatgctttctggcgaaacagcaaaaggtaagtacccagttgaagcggtgaagatcatggcgcaaattgctgagcgtactgaccctgtactgaaagcagaactgggttcacgcctagacagcccacgtctacgtatcactgaagccgtatgtaaaggtgcagtagacaccgcagagaaactggcagcgccactgatcatcgtagcaactgaagcgggtaaatctgctcgttcagttcgtaagtacttcccaacggctaacattattgcagtcaccaccaacaagaaaacagcagctcagttagtgctttctaaaggtgtaacgccagttgtggttgacgcgattgacaacactgacgctttctaccacctaggtaaagagattgcgctgcaatctggccttggcaagaaaggcgacatcgtagtgatggtttcaggcgcactggttgcttctggcacaacgaacactgcatcagtacacgtactgtaa

SEQ ID NO: 16459 - protein, 470 aa, Vibrio cholerae
MKKTKIVCTIGPKTESVEKLTELVNAGMNVMRLNFSHGDYVEHGTRITNFRKVMEVTGKQLAILLDTKGPEIRTIKLENGDDVDLVAGQEFTFTTDTKVVGNKERVAVTYSGFAKDLNVGNRILVDDGLIEMEVLATTDTEVKCKVLNNGALGENKGVNLPGVSVNLPALSEKDKNDLKFGCEQGVDFVAASFIRKGSDVKEIREVLASHGGQNIQIISKIENQEGLDNFDEILELSDGIMVARGDLGVEIPAEEVIFAQKMMIEKCNRARKVVITATQMLDSMIKNPRPTRAEAGDVANAIMDGTDAVMLSGETAKGKYPVEAVKIMAQIAERTDPVLKAELGSRLDSPRLRITEAVCKGAVDTAEKLAAPLIIVATEAGKSARSVRKYFPTANIIAVTTNKKTAAQLVLSKGVTPVVVDAIDNTDAFYHLGKEIALQSGLGKKGDIVVMVSGALVASGTTNTASVHVL

SEQ ID NO: 16460 - DNA, 1755 bp, Bacillus halodurans
  CDS (1)..(1755)
atgcgaaagacaaaaatcgtttgtacgatcggtccggcgagtgaaagtgtagaaaagttagaacaattaatggaagcaggcatgaatgttgcgcggttaaatttttcccatggggactttgaagagcacggtgcacgaatcaaaaacattcgagaagcagcgaaacgtatcggaaaaacagttgcaattttacttgatacaaaaggaccggaaattcgtacccaaacccttgaagggggcgtggccgaattaaaggcagggcaagagcttgtcatctctatgaaggaggttgtaggtacgagtgagcgtatttctgtcacatatccgggcctagttcatgatgttgtaccaggtgcaaaaattttattagatgatgggttaattgggctagaagtcgttgaggttcgcgatcaagagattttgacaaaagtcttgaacagcggcacattgaaaaataaaaaaggtgtcaatgtcccgaacgtaagcgtcaacctgcctggaatcacagaaaaagacgcagcggatatcaagtttgggatagagcaaggcgtcgatttcattgcagcttcattcgttcgcagagcgcaagatgtactagaaattcgcgaattgcttgagcagcacggggcagagcatattaaaatcatccctaagatcgagaatcaagaaggcgttgataacatcgaggaaattcttgaagtatcagacggtttgatggtggcccgcggagatctaggggtagagattcctgctgaggaagttccacttgtgcaaaagtcgcttattaagaaatgcaaccttgtagctaaacctgttattacagcgacacagatgcttgactcgatgcagcgtaacccacgtccaactcgagccgaagctagtgatgtagcgaatgcgatttttgatggaacggatgcgatcatgctttccggtgaaaccgcagctggggattatccagtcgaggcggttcagacgatgagccgaattgcagagcgtgcagagcaagccctaaactatcaagaaatcttgtccaagcatacaaaagaagcgagaacgacgattacgagtgctattagtcaatcggttggccacacagcattcaacttgaatgcaagtgcaatcttgacggcgactgaaagcggccatacagctcgcgtagtagcgaaataccgcccgaaatcaccaattgtagcagttacaagtaacgaaacagttgttcgtcaactcgctctcgtttggggagtgtattcaatccttggagaagaggcagagacgacggatgatatgcttcaagtgaccgttgagacagcgttaaagtcccaattggtgaaacaaggggatcttgtcgtcatcacggcaggtgttccagtgggagagacaggaacgacgaacattatgaaagttcacgtcattggtgaagtggtcgcgaaaggtcaaggcattggacgcgacacggtgaacggcaaagtcgtcattgctgctaatgcagaggaagcaaatgcaaaggttgaagaagggtcgattttagttactttcagcacggataaggatatgatgccagcctttgaaaaagcagccgccgtcattaccgaagaaggtgggattacatcccatgccgcagttgttggtctaagtcttaatacacctgtgatcgtcggtgtacaaaatgcgtctgcgctctttaaagatggggaagaaataacggtcgatacgagccgcggtgacatttacagagggcaagcaagtgtactataa

SEQ ID NO: 16461 - protein, 584 aa, Bacillus halodurans
MRKTKIVCTIGPASESVEKLEQLMEAGMNVARLNFSHGDFEEHGARIKNIREAAKRIGKTVAILLDTKGPEIRTQTLEGGVAELKAGQELVISMKEVVGTSERISVTYPGLVHDVVPGAKILLDDGLIGLEVVEVRDQEILTKVLNSGTLKNKKGVNVPNVSVNLPGITEKDAADIKFGIEQGVDFIAASFVRRAQDVLEIRELLEQHGAEHIKIIPKIENQEGVDNIEEILEVSDGLMVARGDLGVEIPAEEVPLVQKSLIKKCNLVAKPVITATQMLDSMQRNPRPTRAEASDVANAIFDGTDAIMLSGETAAGDYPVEAVQTMSRIAERAEQALNYQEILSKHTKEARTTITSAISQSVGHTAFNLNASAILTATESGHTARVVAKYRPKSPIVAVTSNETVVRQLALVWGVYSILGEEAETTDDMLQVTVETALKSQLVKQGDLVVITAGVPVGETGTTNIMKVHVIGEVVAKGQGIGRDTVNGKVVIAANAEEANAKVEEGSILVTFSTDKDMMPAFEKAAAVITEEGGITSHAAVVGLSLNTPVIVGVQNASALFKDGEEITVDTSRGDIYRGQASVL

SEQ ID NO: 16462 - DNA, 1443 bp, Buchnera sp
  CDS (1)..(1443)
atgttaaatcgattaagaagaacaaaaatcgtagctactttaggaccttctacagacattaataataatttagaaaaaataattcgttctggagtaaatgttcttcgatttaatttctctcatggttcaaaagatgaacataaatccagagcaaatcaagctcgagaaataatgactcgtttaaattttcacattgcattgcttggcgatttacaaggtcctaaaattcgcatttctaaatttataaaaaataatatttttttgaatgttggtgatttttttatattagatgcgaatttagatcaaaataatggaaatcaagaacgggtaggaattgattataaacagttaccatatgatctaaaagtaggtgatgtattattattagatgatggaagaatacaattaaaggttataaaatcaactggtcatgaaatattaacaaaagttgttatcggcggaatactttctaacaataaaggcattaataaactaggtggtggtttatctgcagatgcgttaactgaaaaagacaagaaggatataatcctagcaactgaaattaatgtagactatttagcaatatctttcccacgatgcagtaatgacttgaaacaagcaagaaaattagctaaagaatttggtagcaatgctaaaattatcgctaaaatagaacgtgctgaagctgtattaaatcaaaatactatcgaagatataattttagcatcagatgcaattatgatagctagaggcgatttaggtgtggaaattggagattctgaattagcaggtattcaaaaaaaattaatacgaactgctaggcaattaaatagaatagtaattactgctacacagatgatggaatctatgattactaacccattacctactcgtgcagaagttatggatgtagctaatgctgttttagatggcagtgatgcagttatgctttcggctgaaacagcatcaggcgaatatccagctgaaactgttataaaaatggcaaaaatttgcaaaggtgcagaaaaagttcctagtattaatgtatctagacatcgtattcatgcaaaatttgatgatattgaagaagcaattgctatgtccgcaatgtatgttgctaatcatttgaaaggtattacagcaattataacgatgacagaatcaggtaagactgcactaatgacatcgaggattacatctggattgcctatttttgctttatcaaaaaataaagaaactttaaatttagcaagtctttatagaggtgtgactcctatatattttaatagtaaaaataataattttaaagctgcgaatgaagcaattgttcttttacgtaaacgaggttttttatgtcgtggcgagttagttattataactcaaggtgatattatgggaaaaatcggaaaaactaatactagtagaattttaaaagtagtatga

SEQ ID NO: 16463 - protein, 480 aa, Buchnera sp
MLNRLRRTKIVATLGPSTDINNNLEKIIRSGVNVLRFNFSHGSKDEHKSRANQAREIMTRLNFHIALLGDLQGPKIRISKFIKNNIFLNVGDFFILDANLDQNNGNQERVGIDYKQLPYDLKVGDVLLLDDGRIQLKVIKSTGHEILTKVVIGGILSNNKGINKLGGGLSADALTEKDKKDIILATEINVDYLAISFPRCSNDLKQARKLAKEFGSNAKIIAKIERAEAVLNQNTIEDIILASDAIMIARGDLGVEIGDSELAGIQKKLIRTARQLNRIVITATQMMESMITNPLPTRAEVMDVANAVLDGSDAVMLSAETASGEYPAETVIKMAKICKGAEKVPSINVSRHRIHAKFDDIEEAIAMSAMYVANHLKGITAIITMTESGKTALMTSRITSGLPIFALSKNKETLNLASLYRGVTPIYFNSKNNNFKAANEAIVLLRKRGFLCRGELVIITQGDIMGKIGKTNTSRILKVV

SEQ ID NO: 16464 - DNA, 1434 bp, Pseudomonas aeruginosa
  CDS (1)..(1434)
atgacagccgacaagaaagccaagatcctcgccaccctcggcccggccacccgcagccgcgacgatatccgtgccctggtggaggccggcgccaacctgctccgcctgaacttcagccacggcgactatgccgatcacgcgcagcgcttcgcctgggtgcgcgaggtggaagcggagctgaactacccgatcggcgtgctcatggacctgcagggtccgaagctgcgggtcggccgcttcgccgccggtgccgtgcaattgcagcgtgggcagaccttcaccctcgacctcagcgacgcccccggcgacgagcggcgggtcaacctgccgcatccggagatcatccatgccctggaaccgggcatgagcctgctgctggacgacggcaagatccgcctggaagtggtcaactgccacagcgacgccatcgagacccgcgtggcggtgggtggcgagctgtccgatcgcaagggcgtcaacgtgccggaagcggtgctgcaactcagcccgctgaccgacaaggaccgccgcgatctggccttcggcctggaactgggggtcgactgggtggcgctgtccttcgtgcaacgcccggaggacatcgacgaggcccgtgggctgatcggcgacaaggccttcctcatggccaagatcgagaagcccagcgcggtgagcgccatcgaggcgatcgccgagcgcgccgacgcgatcatggtggcgcgcggcgacctcggcgtagaggtgccggcggagagcgtgccaggcatccagaaacgcatcgtccaggtctgccgccagctcggcaagccggtggtggtggccacccagatgctcgagtcgatgcgcttctcccccgccccgacccgcgccgaggtgaccgacgtagccaccgcggtgggcgccggcgccgacgcggtgatgctctcggcggaaaccgcttccggacaataccctcgcgaggcggtagagatgatggcgaagatcgtccgccaggtggaggccgagccggactaccacgtccagctcgaggtcaaccgtccgcagcccgacgctaccgtctccgatgcgatcagctgcgcgatccgccgggtcagccggatcctcccggtggcggtgctggtgaactacaccgagtcgggcaactcgaccctgcgcgccgcccgcgagcggcccaaggcgccgatcctcagcctgaccccgaacctgcgtaccgcgcggcgactgaccgtggcctggggcgtgtattcggtggtcaacgagcaactggcgcacgtcgacgagatctgctcgaccgccctcgacatcgccctggcccagcgcatggcgcgccgcggcgacaccgtggtggtcaccgccggcgtaccgttcggtcgccccggctcgaccaacatgctgcgcatcgagaccgtggcgccgccgctgggagatctctga

SEQ ID NO: 16465 - protein, 477 aa, Pseudomonas aeruginosa
MTADKKAKILATLGPATRSRDDIRALVEAGANLLRLNFSHGDYADHAQRFAWVREVEAELNYPIGVLMDLQGPKLRVGRFAAGAVQLQRGQTFTLDLSDAPGDERRVNLPHPEIIHALEPGMSLLLDDGKIRLEVVNCHSDAIETRVAVGGELSDRKGVNVPEAVLQLSPLTDKDRRDLAFGLELGVDWVALSFVQRPEDIDEARGLIGDKAFLMAKIEKPSAVSAIEAIAERADAIMVARGDLGVEVPAESVPGIQKRIVQVCRQLGKPVVVATQMLESMRFSPAPTRAEVTDVATAVGAGADAVMLSAETASGQYPREAVEMMAKIVRQVEAEPDYHVQLEVNRPQPDATVSDAISCAIRRVSRILPVAVLVNYTESGNSTLRAARERPKAPILSLTPNLRTARRLTVAWGVYSVVNEQLAHVDEICSTALDIALAQRMARRGDTVVVTAGVPFGRPGSTNMLRIETVAPPLGDL

SEQ ID NO: 16466 - DNA, 1506 bp, Xylella fastidiosa
  CDS (1)..(1506)
atgttactttggctagcttctgtgaaagaggctttctttatgtctgaacgccagcgccgtaccaggattcttgccactctcgggccagcgacagatccgcccggtgtgcttgatgcgctgtttaaggcgggagttaatgtggtgaggctgaatttcagccatggcgatgcttcggatcaggccaggcgtgctgctgaagtgcgtgcggcggcggcgcatgtgggcgttgagattggcattcttgcggatctacccggtccgaagatccgtattggacgttttaccgaggggaaagtgcggcttgtggctgatgcgcgctttgatctgcttgccgatagcaatgcaccgctgggggatgcgactcaagttggggtcagttatctggggttgccgcaggatgtcgccgccggagacgtgttgttactggatgatggcctcatgcaattgcaggtggtgcaagtgcagggcgcacggattgtgacgacggtgcttaacgatggtgtgttgtcggaccgtaaggggttgaataagcaaggcggcggtttgtcgctgggtgcgctgacggatcgtgatcgcgaactgattggcatcgtttccaggatgggggtcgactttattgcagtttcgttttgtcgtcatgctgaagagatgcatgaggcgcgtcgcattgctcgggagtgcggctgtgatgctgcgctggtgtctaagatcgagcgtgctgaggctatcgtgaatcttgccgagattgttgcggcttcggatgtggtgatggttgcgcgtggtgatttaggtgtggagattggtgacgctcaattgccgggcttgcaaaaaaagatcatcaaagaagcgttgctacagaacaaggtggtgattactgccacgcagatgctgcaatcaatggttgaaagtccgatgccgactcgtgctgaggtgctggatgtggccaatgcggtgattgatgggaccgatgcggtgatgctgtcggctgaaacggcgacaggtgattatccagtcaaggcagtagaggcgatggcgcgtatctgtctgggagcggaacaccagtttgagtttgatactgattatgagatggcgcagcgtaatttgcagcgtgcagatcatgcgattgcaatggcaacgatgttcttatctgagcacatttgccttggtggtgtggttgcattgacggagtccggtacgacgccacggtttctctcgcggttccggtcgcacgtcccgatctatgcgtttacgcgtcacgaggatgtgcggcggcgcatggtgctgatgcgtggtgtatttccgatgcgttttgacagccgtggtttgacgccgcgtgaggcagccagggcgacaatccgtcttttggtggaatgtggttgtatgagtccgggggatcgtgtggtgttcacgagcggcgagcatatggaaacgcttggcgcaaccaatacgctgcgtttacttgaagtaggcgctgatgggggtgtcagtggtctgtgggaactctaa

SEQ ID NO: 16467 - protein, 501 aa, Xylella fastidiosa
MLLWLASVKEAFFMSERQRRTRILATLGPATDPPGVLDALFKAGVNVVRLNFSHGDASDQARRAAEVRAAAAHVGVEIGILADLPGPKIRIGRFTEGKVRLVADARFDLLADSNAPLGDATQVGVSYLGLPQDVAAGDVLLLDDGLMQLQVVQVQGARIVTTVLNDGVLSDRKGLNKQGGGLSLGALTDRDRELIGIVSRMGVDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPMPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGGVSGLWEL

SEQ ID NO: 16468 - DNA, 1452 bp, Pseudomonas aeruginosa
  CDS (1)..(1452)
atgtccgttcgccgcaccaaaatcgtcgccaccctcggcccagccagcaattccccggaagtgctggagcaactgatcctggccgggatcgacgtcgcccgcctcaacttctcccacggcacccccgatgaacaccgcgcccgcgccaggctggtgcgcgaactggcggccaagcacggccgcttcgtcgccctgctcggcgacctgcaaggaccgaagatccgcatcgccaagttcgccaacaagcgcatcgaattgcaggtcggcgacaagttccgcttctccaccagccacgcccgcgacgccggtacccaggaagtggtcggcatcgactacccggacctggtgaaggactgcggggtcggcgatgaactgctgctggacgacggccgggtggtgatggtggtcgaggaagtcgccgccgacgaactgcgctgccgggtgctgatcggcggcccgctgtccgaccacaagggcatcaaccgccgcggcggcggtctcaccgcgccggcgctgaccgacaaggacaaggccgacatcaagctggccgcggacatggacctggactacgtggccgtttccttcccgcgcgacgccaaggacatggaatacgcccgccgcctgctcaccgaggccggtggcaaagcctggctggtagccaagatcgagcgcgccgaggcggtcgccgacgacgacgcactcgacggcctgattcgtgccagcgacgcggtaatggtggcccgtggcgacctcggcgtggaaatcggcgatgccgagctggtcggcatccagaagaagatcatcctgcacgcccgccgcaacaataaagtggtgatcaccgcgacccagatgatggagtcgatgatccacagcccgatgccgacccgcgcggaagtctccgacgtggccaacgctgtgctcgactacaccgacgcggtgatgctctcggcggaaagcgccgccggcgagtacccggtggaagcggtgaaagccatggcccgcgtctgccagggcgccgagaagcacccgaccagccagaaatccagccaccgcctcggccagactttcgaccgctgcgacgagagcatcgccctggcgtcgatgtacacggccaaccacttcccggggatcaaggcgatcatctgcctgaccgaaagcggcttcaccccgctgatcatgtcgcgcatccgctcgtcggtaccgatctacgcctactccccgcaccgcgagacccaggctcgcgtggcgatgttccgcggcgtagaaaccatccccttcgacccggcggcgctgccggcggagaaggtcagccaggccgcggtcgacgagttgctcaagcgcggcgtggtgaccaagggcgactgggttatcctgaccaagggcgacagctacaccgcccagggcggcaccaacaccatgaaggtgctgcacgtcggcgacctgctggtataa

SEQ ID NO: 16469 - protein, 483 aa, Pseudomonas aeruginosa
MSVRRTKIVATLGPASNSPEVLEQLILAGIDVARLNFSHGTPDEHRARARLVRELAAKHGRFVALLGDLQGPKIRIAKFANKRIELQVGDKFRFSTSHARDAGTQEVVGIDYPDLVKDCGVGDELLLDDGRVVMVVEEVAADELRCRVLIGGPLSDHKGINRRGGGLTAPALTDKDKADIKLAADMDLDYVAVSFPRDAKDMEYARRLLTEAGGKAWLVAKIERAEAVADDDALDGLIRASDAVMVARGDLGVEIGDAELVGIQKKIILHARRNNKVVITATQMMESMIHSPMPTRAEVSDVANAVLDYTDAVMLSAESAAGEYPVEAVKAMARVCQGAEKHPTSQKSSHRLGQTFDRCDESIALASMYTANHFPGIKAIICLTESGFTPLIMSRIRSSVPIYAYSPHRETQARVAMFRGVETIPFDPAALPAEKVSQAAVDELLKRGVVTKGDWVILTKGDSYTAQGGTNTMKVLHVGDLLV

SEQ ID NO: 16470 - DNA, 1443 bp, Campylobacter jejuni
  CDS (1)..(1443)
atgcttaaaaaaacaaaaattgtagccacagtaggtccagcaagtgaaaaggaagaaattctacgccaaatgattatcaatggtgtaaatgttttccgtttaaacttttctcatggaacacatgagtatcataaaaaaaacttagataccataagaagagtagctaaagaattgcatactcgtattggaattttacaagacattagtggtcctaaaattcgtacaggtgaacttaaagaaccatttgaattaaaaaagggtgatagacttgatttttatcgtgaaacaattttaggggagaagattgctcaaaatcattataaaatcagtatcaatcaaaaatccattttagatatgttaaaaattgatgaatatatttatctgtatgatggatcaattcgtgctaaagtagtaaatatagataatcaaaaaattgaaaccattatagaaaatgatggttttttaaactcaaataaaggtattaattttccgaatactaaaatcaatattgatgttattacacaaaaagataaaaatgatttactttggggtataaaaaatgaagtagattttttagcaatatctttcgtacaaaatgcgcacgatattgatgaagttcgtgaaattttagcacaaaataacgcaaaaatatctatttttgcaaaaattgaaaaatttgatgcagtagaaaatattgatgagattattaaatctagcgatggtataatggttgcaagaggagacttaggtattgaggtaccttattataaagttcctaatatccaaaaagaaattatacaaaaagcaaacaatgcctctaagcctgttattactgcgactcagatgcttttttcattagccaaaagcaaaaccgccacaagagctgaaatttcagatgttgcaaatgctgttttagatggaacagatgcagtaatgctaagtgaagaaagtgccgttggtatagatcctgcaaacgctgttgatataatgtgccaaactataatagaaacagaaaaacgctatccatataacaaatttaatgattttaatgatttagacaatacagataaaatcatgcgttcttcagctcatcttgcaacagatcttaacgctgatgctattttttctttaacaagtagcggaaaatctgctattaagattgcgagatatcgtccaaatatagaaatcatagcagtagggcattctgaaaaaaccttaaactctttaagtatagtttggggagttaatcctgcaatcttggttaacaaaagtaatgaacttacagaattattaaaagactctgtaagatcaagtgttgaaaaaggttttatggatgaagataaatgctatcttctaactgcaggctttccaacaggagtagaaggtactagcaatcttatccgcattctcaataaagagcaaattgcttattatctacaataa

SEQ ID NO: 16471 - protein, 480 aa, Campylobacter jejuni
MLKKTKIVATVGPASEKEEILRQMIINGVNVFRLNFSHGTHEYHKKNLDTIRRVAKELHTRIGILQDISGPKIRTGELKEPFELKKGDRLDFYRETILGEKIAQNHYKISINQKSILDMLKIDEYIYLYDGSIRAKVVNIDNQKIETIIENDGFLNSNKGINFPNTKINIDVITQKDKNDLLWGIKNEVDFLAISFVQNAHDIDEVREILAQNNAKISIFAKIEKFDAVENIDEIIKSSDGIMVARGDLGIEVPYYKVPNIQKEIIQKANNASKPVITATQMLFSLAKSKTATRAEISDVANAVLDGTDAVMLSEESAVGIDPANAVDIMCQTIIETEKRYPYNKFNDFNDLDNTDKIMRSSAHLATDLNADAIFSLTSSGKSAIKIARYRPNIEIIAVGHSEKTLNSLSIVWGVNPAILVNKSNELTELLKDSVRSSVEKGFMDEDKCYLLTAGFPTGVEGTSNLIRILNKEQIAYYLQ

SEQ ID NO: 16472 - DNA, 1446 bp, Chlamydia muridarum, Chlamydia trachomatis MoPn
  CDS (1)..(1446)
atgatcgctagaacaaaaattatttgtacaataggccctgcaacaaacaccccagaaatgcttgaaaaacttcttgatgcggggatgaatgtagcgcgtcttaacttcagtcatggtacccacgaaagccacggccggaccattgctattcttaaggaactacgcgaaaagcgccaagtccctttagctattatgttggatacaaaaggaccagaaattcgtttaggccaagtagaatctcctataaaagtgaagccaggagaccgtctcactttaaccagtaaagaaattttgggatccaaagaagctggagtcactctttatcctagctgcgtgttccctttcgttcgcgaacgcgctcccgtcctgattgatgatggatatatccaagccgtagttgtcaatgctcaagagcatctcattgagatagaatttcagaattcaggagaaatcaagtctaataaatcacttagcatcaaagatatagacgtagccctccccttcatgacagagaaggatatcacggatctaaaattcggggtcgaacaagaacttgaccttatcgcagcatcttttgtccgatgtaacgaagacatcgatagcatgcgtaaagttttagaaaacttcggccggccaaatatgccgatcattgccaaaatagaaaatcatttaggggtacaaaatttccaagaaatagccaaagcttctgatggaattatgatcgcacgaggagatctcggcatcgaattatctatcgttgaagtccctgccttacaaaaatttatggctcgtgtgtccagagaaacaggccgtttttgtatcaccgcaacacaaatgctcgagtcaatgattcgcaatccccttcctacacgagccgaagtttccgatgtagctaatgctatccacgatggaacttccgctgtgatgttatcaggagaaactgcttcaggaacttatcctatagaagctgtaaaaactatgcgctcgatcatccaagaaacggaaaaatcctttgattaccaagcctttttccaactcaatgacaaaaatagcgctctcaaagtctctccttatcttgaagcaataggcgcttcagggatccaaatcgctgagaaagcttctgctaaagcgattattgtatacacccaaactgggggatctcccatgtttctttctaaatatcgtccctatctccccattattgccgttaccccaaaccgcaatgtatactatcgcttagcagtagaatggggcgtataccctatgctaacctcagaatctaaccgaacagtttggcgccaccaagcttgtgtctatggagtagagaaaggaatcctttcaaactatgataaaattcttgtttttagccgaggagcagggatgcaggacacgaataaccttactctgactactgtaaacgatgttttatctccttctcttgaatga

SEQ ID NO: 16473 - protein, 481 aa, Chlamydia muridarum, Chlamydia trachomatis MoPn
MIARTKIICTIGPATNTPEMLEKLLDAGMNVARLNFSHGTHESHGRTIAILKELREKRQVPLAIMLDTKGPEIRLGQVESPIKVKPGDRLTLTSKEILGSKEAGVTLYPSCVFPFVRERAPVLIDDGYIQAVVVNAQEHLIEIEFQNSGEIKSNKSLSIKDIDVALPFMTEKDITDLKFGVEQELDLIAASFVRCNEDIDSMRKVLENFGRPNMPIIAKIENHLGVQNFQEIAKASDGIMIARGDLGIELSIVEVPALQKFMARVSRETGRFCITATQMLESMIRNPLPTRAEVSDVANAIHDGTSAVMLSGETASGTYPIEAVKTMRSIIQETEKSFDYQAFFQLNDKNSALKVSPYLEAIGASGIQIAEKASAKAIIVYTQTGGSPMFLSKYRPYLPIIAVTPNRNVYYRLAVEWGVYPMLTSESNRTVWRHQACVYGVEKGILSNYDKILVFSRGAGMQDTNNLTLTTVNDVLSPSLE

SEQ ID NO: 16474 - DNA, 1758 bp, Bacillus subtilis
  CDS (1)..(1758)
atgagaaaaactaaaattgtttgtaccatcggtccggcaagtgaaagtattgaaatgcttacgaaattaatggagtcaggaatgaacgtggctcgattaaacttttctcacggagattttgaggagcacggtgcaagaattaaaaatatccgcgaagcaagtaaaaaacttggcaagaacgttggaattctgcttgatacaaaaggtcctgaaatccgcacacatacaatggaaaacggcggtattgagcttgaaacaggcaaagagctcattatttcaatggacgaggttgtaggaacaacagataaaatttcagtgacatatgaaggtttagtccatgacgttgaacaaggttcaacgattctgttagatgacggccttatcggtcttgaggtacttgatgtagatgccgctaaacgcgaaatcaaaacaaaagtattaaacaacggaacactcaaaaataaaaaaggtgttaacgtaccgggcgtaagtgtcaatcttccggggattactgaaaaggatgcgcgagacatcgttttcggtattgagcaaggagtagacttcatcgcaccatctttcattcgacgttctacggatgtgctcgaaatccgtgagcttcttgaagagcacaacgctcaggatattcaaatcatccctaaaatcgaaaaccaagagggcgttgacaacatcgatgcgattctcgaagtgtctgacggcttaatggttgcacgcggagacttaggtgtggaaattccagctgaagaagtgccgcttgtgcaaaaagaactgatcaaaaaatgcaacgcgctgggcaaacctgttattacagcgacacaaatgcttgacagcatgcagcgcaacccgcgtccgactcgtgcggaagcaagtgacgttgcaaacgcgatcttcgacggaacagatgcgatcatgctttctggtgaaactgctgccggaagttacccggttgaagcagttcaaacaatgcataacatcgcgtcccgttctgaagaagcattaaattataaagaaattctctcaaaacgcagagaccaagtgggcatgacaattacagacgcaattggacaatctgtcgcacatacggcgattaacctgaatgctgctgcgatcgtaacgccgacagaaagcggccatacagcacgtatgattgcaaaataccgtccgcaggctccgattgttgcggttactgtaaatgactctatttccagaaagcttgccctcgtatctggcgtattcgcggaaagcggccaaaatgcgagctcaacagatgagatgcttgaggatgctgtccaaaaatcattgaacagcggaattgtaaaacacggcgatcttatcgttattacagctggcactgtcggtgagtccggcactacgaacttaatgaaggttcatactgtcggcgatatcatcgctaaaggccaaggcattggacgcaaatcagcttacggtccggttgtcgttgcacaaaatgcaaaagaagctgagcaaaaaatgactgacggtgcggtacttgttaccaaaagcactgaccgtgatatgattgcatcccttgaaaaagcgtctgctcttattacagaagaaggcggtttgactagccatgctgcggtagtcggattaagccttggcatcccggttatcgtgggtctggaaaatgcgacatctattttgacagatggccaggatattacagttgacgcttccagaggcgcagtctatcaaggccgtgcgagcgttctttaa

SEQ ID NO: 16475 - protein, 585 aa, Bacillus subtilis
MRKTKIVCTIGPASESIEMLTKLMESGMNVARLNFSHGDFEEHGARIKNIREASKKLGKNVGILLDTKGPEIRTHTMENGGIELETGKELIISMDEVVGTTDKISVTYEGLVHDVEQGSTILLDDGLIGLEVLDVDAAKREIKTKVLNNGTLKNKKGVNVPGVSVNLPGITEKDARDIVFGIEQGVDFIAPSFIRRSTDVLEIRELLEEHNAQDIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGSYPVEAVQTMHNIASRSEEALNYKEILSKRRDQVGMTITDAIGQSVAHTAINLNAAAIVTPTESGHTARMIAKYRPQAPIVAVTVNDSISRKLALVSGVFAESGQNASSTDEMLEDAVQKSLNSGIVKHGDLIVITAGTVGESGTTNLMKVHTVGDIIAKGQGIGRKSAYGPVVVAQNAKEAEQKMTDGAVLVTKSTDRDMIASLEKASALITEEGGLTSHAAVVGLSLGIPVIVGLENATSILTDGQDITVDASRGAVYQGRASVL

SEQ ID NO: 16476 - DNA, 1458 bp, Chlamydia trachomatis
  CDS (1)..(1458)
atgatcgctagaacgaaaattatttgtacgataggccctgcaacgaatacccctgagatgctggaaaagcttcttgatgcagggatgaatgtagctcgccttaattttagccacgggacccatgaaagccatggccggaccatcgctattcttaaagaactacgagagaagcgccaagttcctttagctattatgctagatacaaaaggtcccgaaattcgtttaggccaagtagaatctcctataaaagtacagcctggggatcgtcttactctcgttagcaaagaaattttaggatccaaagaaagcggcgttactctttatccaagttgtgtattcccttatgttagagaacgagctcctgttctcattgatgatgggtatatccaagcagtggtggtcaatgctcaagagcatatggtggaaatagagtttcaaaattcaggagaaataaaatccaacaaatctcttagcatcaaagatatcgatgttgctcttcctttcatgacagagaaggatattgcagacttaaaatttggggtagaacaagaactcgatcttatcgctgcttcgttcgtcagatgtaatgaagatattgacagcatgcgtaaagttttggaaagctttggtcgtcctaatatgcccatcattgctaaaatagaaaatcatttaggagtacaaaatttccaagagatcgctagagctgctgatggtatcatgattgcacgcggggatcttggtattgaattgtctattgttgaagttcctggactacaaaaatttatggcccgagcatcgagggaaacgggtcggttttgtatcactgcaacgcaaatgctcgagtcaatgattcgcaacccccttcctacacgagccgaagtctctgacgttgccaacgccatttacgatggaacctctgcagtcatgttgtctggagaaactgccttaggagcccatcctgtacatgcagtaaaaacaatgcgttccattatccaagagactgagaagactttcgattaccacgcttttttccagctgaacgacaaaaacagcgctctcaaagtttctccttatcttgaagccattgggttttctggaatccaaattgcagaaaaagcatctgccaaagccattattgtgtatacccagacgggaggatctccgatgtttttatccaaatatcgaccttatctccctattattgctgttacccctaaccgcaatgtgtactatcgtttagctgtagaatggggagtatatcctatgctaaccctagaatcgaaccgtacagtctggcgtcaccaagcttgtgtatatggagtagaaaaaggaattctttctaactatgataaaattcttgtcttcagccgcggagctgggatgcaagacaccaacaatctcaccttgacaactgtgcatgatgtgctatccccctctcttgacgagatagttccataa

SEQ ID NO: 16477 - protein, 485 aa, Chlamydia trachomatis
MIARTKIICTIGPATNTPEMLEKLLDAGMNVARLNFSHGTHESHGRTIAILKELREKRQVPLAIMLDTKGPEIRLGQVESPIKVQPGDRLTLVSKEILGSKESGVTLYPSCVFPYVRERAPVLIDDGYIQAVVVNAQEHMVEIEFQNSGEIKSNKSLSIKDIDVALPFMTEKDIADLKFGVEQELDLIAASFVRCNEDIDSMRKVLESFGRPNMPIIAKIENHLGVQNFQEIARAADGIMIARGDLGIELSIVEVPGLQKFMARASRETGRFCITATQMLESMIRNPLPTRAEVSDVANAIYDGTSAVMLSGETALGAHPVHAVKTMRSIIQETEKTFDYHAFFQLNDKNSALKVSPYLEAIGFSGIQIAEKASAKAIIVYTQTGGSPMFLSKYRPYLPIIAVTPNRNVYYRLAVEWGVYPMLTLESNRTVWRHQACVYGVEKGILSNYDKILVFSRGAGMQDTNNLTLTTVHDVLSPSLDEIVP

SEQ ID NO: 16478 - DNA, 1437 bp, Pyrococcus abyssi
  CDS (1)..(1437)
atgattgccatgaggcttcctgatcacaagacaaagatagttgcaacaatagggcccgccacaagctctaggaatatgataaagaagctaatagaaaacggtgtgagcgttgtgaggctcaacttctctcacggtagctttgaggagcatgcaaaggtcatagagaaagtcagggatatatcacaaaagcttgacagaagggttgcaatattggccgacctcccaggattgaagattagagtgggcgagataaagggagggtacgtagagcttaagagaggtgagaaggtagttttgactacgagagatgttgttggggatgaaactacgattcccgtagagtacaaggacttcccaagattagtctccaagggcgacgtcatatacctaagtgacggttacatcgttcttagggttgaagaggtaaggggtcaagacgttgaggcagttgtcgtctctggtggaaaactgttctcaagaaagggaataaacattccaaaggcctacctaccagtggaggcagtaactcccagggacatggagataataaagttcgccatcgagcagggagttgatgcaataggcttaagctttgttggaagcgtttatgacgttctcaaggttaaaagtttcctcgagaagaatgatgccgaggacgtcttcgttatttcaaagatagaaagaccggacgcagtcaggaacttcgatgaaatcctgaaggcttcagatggcatcatgatagctagaggtgatcttggggttgagatgccgatagaaagattgccaatacttcagaaggagcttataagaaaggcaaacacggagggtaagccagtaataacagctactcagatgttagtttcaatgacggccgaaaaggttccaaccagagctgaagttacggacgttgccaacgcgatacttgacggaacagacgcggtcatgctctctgaggagaccgcgattggaaaattcccaatcgatgccgtcaagatgatggcaaagatagccaaggtcaccgaggagtacagggagagctttggaatgtcgaggctcagggaactcgtggaggatgggacaagggggacaataaaggaggcaatagcgagaagcataatagatgcgctctgcaccctaaacataaagtacatactaacccccactagaacgggcaggacggcaaggctcatctcgaggtttaagccaaagcagtggatatttgggttctccactaacgaaagggtttgcaacaacttgatgttcagctatggagtttatgcgttctgtctcgaggagggcttcgatgagagggacataataaggctaattaagggacttggactggttgagagtgacgacatagtgctgatgaccgagggtaagccaatagagaagaccatgggaacgaactccatcaagatattccagatagcgtga

SEQ ID NO: 16479 - protein, 478 aa, Pyrococcus abyssi
MIAMRLPDHKTKIVATIGPATSSRNMIKKLIENGVSVVRLNFSHGSFEEHAKVIEKVRDISQKLDRRVAILADLPGLKIRVGEIKGGYVELKRGEKVVLTTRDVVGDETTIPVEYKDFPRLVSKGDVIYLSDGYIVLRVEEVRGQDVEAVVVSGGKLFSRKGINIPKAYLPVEAVTPRDMEIIKFAIEQGVDAIGLSFVGSVYDVLKVKSFLEKNDAEDVFVISKIERPDAVRNFDEILKASDGIMIARGDLGVEMPIERLPILQKELIRKANTEGKPVITATQMLVSMTAEKVPTRAEVTDVANAILDGTDAVMLSEETAIGKFPIDAVKMMAKIAKVTEEYRESFGMSRLRELVEDGTRGTIKEAIARSIIDALCTLNIKYILTPTRTGRTARLISRFKPKQWIFGFSTNERVCNNLMFSYGVYAFCLEEGFDERDIIRLIKGLGLVESDDIVLMTEGKPIEKTMGTNSIKIFQIA

SEQ ID NO: 16480 - DNA, 1473 bp, Neisseria meningitidis
  CDS (1)..(1473)
atgaaccagacaagccgcgatctgacccgcatcagccacaacactaaaatcgtcgccacccttgggccgggcagcaacaacgtcgaactgttggaagacatgatccgcgtcggcggtctgaacgtcgtccgcttcaacttcagccacggcacgcccgaattccatcaggaaaacgcccgcatcgtgcgcgaggcggcaaaacgcaccggacaggaaatcgccatcattgccgacctgcagggcccgaaaatccgcgtgggcaaaatcgccggcggcggcatcgaattgaacaaaggcgaaacgctgggactggatgccgcgctcgaaggcgaaggcacgcgcgaggcggtcggtttggactaccgcgacctgcccgacgacgttgccgcaggcgatgtcttgtggctggacgacggcctgctgaccctgaccgtggaatccgtcgaaggcagcaggattatcacaagggtggaaaacagccacgtcctgaaaagcaacaagggcatcaacaaacgcggcggcggtctgtccgcaggcgcgttgaccgaaaaagacttccgcgacctgaaaaccgcgattgccatcggttgcgactatctcgccatcagctttgtgaaatccgccgaagatttgcacatcgcgcgcgccaaagtcgaagaagaaatgaaaggcagtacggccgtgcgccccggtttggtttccaaaatcgaacgcgtagaagcgattgaaaaccttgatgaaatcatcctcgccggcgacggcattatggttgcacgcggcgacttggcggtcgaagtcggacacgccgccgtccccgccctgcaaaaacggatgatccgccgcgcccgcgagttgcgccgcttcagcattacggcgacgcaaatgatggaatcgatgattaccaaccccgtgccgacccgcgcggaagtcagcgatgtggcaaacgcggtattggacggcaccgatgcggtgatgtgttccgccgaaaccgccgtcggcgcgtatccgtttgaaaccgtcagccaaatggcgattatctgcgcggctgcggaaaaagagcaggattcgctcaacggcgttgccgaacaggtcgagtatcccgaagcggtcagcaccaacctggcggttgccggcggtgcggtcagcgtggcgcgcgcggttcacgccaaagccatcgtcgccctgaccgaaagcggttcgaccgcctttgaaatcagccgccacaacatcaccctgccgattttcgcgctgaccccgagcgtttccgcccaacgccgtatggcgatgtaccggggcgtgcgcccgctgattttggcaaccagcaccgaccacgacacggcgttaaacgaagtcgaaaccatgctggtggaacacaacatcctgcattccggcgaccaatacatcattaccagcggctcgcaaatgcgcgaatccggttcgaccaatacgctggaagtgctgcgcgtcaaataa

SEQ ID NO: 16481 - protein, 490 aa, Neisseria meningitidis
MNQTSRDLTRISHNTKIVATLGPGSNNVELLEDMIRVGGLNVVRFNFSHGTPEFHQENARIVREAAKRTGQEIAIIADLQGPKIRVGKIAGGGIELNKGETLGLDAALEGEGTREAVGLDYRDLPDDVAAGDVLWLDDGLLTLTVESVEGSRIITRVENSHVLKSNKGINKRGGGLSAGALTEKDFRDLKTAIAIGCDYLAISFVKSAEDLHIARAKVEEEMKGSTAVRPGLVSKIERVEAIENLDEIILAGDGIMVARGDLAVEVGHAAVPALQKRMIRRARELRRFSITATQMMESMITNPVPTRAEVSDVANAVLDGTDAVMCSAETAVGAYPFETVSQMAIICAAAEKEQDSLNGVAEQVEYPEAVSTNLAVAGGAVSVARAVHAKAIVALTESGSTAFEISRHNITLPIFALTPSVSAQRRMAMYRGVRPLILATSTDHDTALNEVETMLVEHNILHSGDQYIITSGSQMRESGSTNTLEVLRVK

SEQ ID NO: 16482 - DNA, 1419 bp, Mycobacterium leprae
  CDS (1)..(1419)
atgacgagacgcgggaagatcgtctgtacccttggccctgcaacacaatcggacgagttaatccgggcgctggttgaagccggaatggacgttgcccgcatgaacttcagtcacggcgattactccgatcacaaggctgtttacgatcgggtgcgcgtcgcatctgatgcaaccggacgcgcggtcggcgtgctcgctgacctgcagggcccaaagatcaggctgggacgctttgccacggggtccacctactgggctgacggtgaaacggtaaggatcactgtggccgactgccacggtagccacgaccgggtatcaaccacctacaagaatttggccagggatgcggtggtcggtgaccgggttctggtcgacgacggcaaggtcggactggtggtctcggccatcgatggcgacgacgtggtctgtactgtcactgaaggcggcccggttagcaacaacaagggcatgtcgttgcccgggatgcacgtgtctgctccggctttgtcggacaaggacatcgaggacctcacgttcgcgctgaatctcggcgccgatctggtcgcgctgtcgtttgtgcgctcgccgtctgacgttgagctggtccacaaggcgatggatcgcgtcgggcggcgtgtaccggtgatcgccaagctggagaagccagaagccgtcgataacctcgaagctattgtgttggcattcgatgccatcatggtggctcgcggcgacctgggtgtcgagctgccacttgaagaggtcccactggtgcagaagcgggcaatccagatggcaagggagaatgcgaaacccgtcatcgtggctacccagatgctagactcgatgatcgaaaactcccggccgacccgagctgaggcctccgacgtcgctaatgcggtgctcgacggcgccgacgcgctcatgttgtctgaggaaacgtcggtggggaagtacccattggcagccgtgaagacgatgtcgcgcattgtgtgtgcggttgaggagaattccacggccgcgccgccgttgacacacgtacctcgcacgaagcggggggtgatctcgtacgctgcccgcgatatcggtgaaagactcgacgctaaggccttggttgcgttcactcaatccggtgacacggtgcggcgactggcgcgtctacataccccgctgccgctgcttgccttcaccgcgtggccagaggtgcgcagccaactcgctatgacttggggcaccgagacatttctcgtaccaaagatgctgtccactgacggtatgatacgccaggtggacaagtcactgctcgaacttggtcgctacaagcgtggtgacttggtggtgatcgtcgctggcacgccacctggcacagtaggatcgaccaacttgatccatgtgcaccggattggggaggacgacgtatag

SEQ ID NO: 16483 - protein, 472 aa, Mycobacterium leprae
MTRRGKIVCTLGPATQSDELIRALVEAGMDVARMNFSHGDYSDHKAVYDRVRVASDATGRAVGVLADLQGPKIRLGRFATGSTYWADGETVRITVADCHGSHDRVSTTYKNLARDAVVGDRVLVDDGKVGLVVSAIDGDDVVCTVTEGGPVSNNKGMSLPGMHVSAPALSDKDIEDLTFALNLGADLVALSFVRSPSDVELVHKAMDRVGRRVPVIAKLEKPEAVDNLEAIVLAFDAIMVARGDLGVELPLEEVPLVQKRAIQMARENAKPVIVATQMLDSMIENSRPTRAEASDVANAVLDGADALMLSEETSVGKYPLAAVKTMSRIVCAVEENSTAAPPLTHVPRTKRGVISYAARDIGERLDAKALVAFTQSGDTVRRLARLHTPLPLLAFTAWPEVRSQLAMTWGTETFLVPKMLSTDGMIRQVDKSLLELGRYKRGDLVVIVAGTPPGTVGSTNLIHVHRIGEDDV

SEQ ID NO: 16484 - DNA, 1506 bp, Streptococcus pneumoniae
  CDS (1)..(1506)
atgaacaaacgtgtaaaaatcgttgcaactttgggtcctgcggtagaaatccgtggtggtaaaaaattcggtgaggacggatactggggtgaaaaacttgatgttgaagcttcagctaaaaacattgctaaattgattgaagctggtgctaacacattccgattcaacttctcacacggcgaccatcaagaacaaggtgagcgtatggcaactgttaaacttgcggaaaaaattgcaggtaaaaaagttggtttccttcttgatacaaaaggacctgaaatccgtacagaattgttcgaaggtgaagctaaagaatattcatacaaaactggtgaaaaaattcgtgttgcaactaaacaaggaatcaaatcaactcgtgaagtgattgcgttgaacgttgctggtgctcttgatatctatgatgatgttgaagttggtcgtcaagttttggttgacgatggtaaacttggtcttcgtgtggttgctaaagatgatgcaactcgtgaatttgaagttgaagttgaaaacgatggtatcatcgctaaacaaaaaggtgtgaacatccctaacactaaaattcctttcccagctcttgctgaacgcgataacgacgatatccgtttcggtcttgaacaaggtatcaacttcatcgcaatttcattcgtacgtactgcaaaagatgtgaacgaagttcgtgcaatctgtgaagaaactggaaacggacatgttcaattgttcgctaaaatcgaaaaccaacaaggtatcgataacttagatgaaatcatcgaagcagctgatggtattatgattgctcgtggtgatatgggtatcgaagtaccgttcgaaatggttccagtttatcaaaaaatgattatcaagaaagtcaatgctgcaggtaaagttgttatcactgcaacaaacatgcttgaaacaatgactgaaaaaccacgtgcaactcgttcagaagtatcagacgtattcaacgctgttatcgacggaactgacgctacaatgctgtcaggcgagtctgcaaacggtaaatacccactcgagtcagtaactacaatggctacaatcgacaagaacgctcaagctcttcttaatgaatacggacgtcttgattcagattcatttgagcgtaactctaagacagaagtaatggcttctgctgttaaagatgctactagctcaatggatatcaaattggttgtaactcttactaagacaggtcatactgcacgtttgatttctaaataccgtccaaatgctgacatcttagcattgacatttgacgaattgacagaacgtggcttgatgttgaactggggtgttatcccaatgttgacagatgctccatcttcaactgacgatatgttcgaaatcgctgaacgtaaagcggtagaagcaggtctcgttgagtcaggcgatgatatcgttatcgttgctggtgtgccagtaggagaagctgttcgcacaaacacaatgcgtatccgcacagtacgttaa

SEQ ID NO: 16485 - protein, 501 aa, Streptococcus pneumoniae
MNKRVKIVATLGPAVEIRGGKKFGEDGYWGEKLDVEASAKNIAKLIEAGANTFRFNFSHGDHQEQGERMATVKLAEKIAGKKVGFLLDTKGPEIRTELFEGEAKEYSYKTGEKIRVATKQGIKSTREVIALNVAGALDIYDDVEVGRQVLVDDGKLGLRVVAKDDATREFEVEVENDGIIAKQKGVNIPNTKIPFPALAERDNDDIRFGLEQGINFIAISFVRTAKDVNEVRAICEETGNGHVQLFAKIENQQGIDNLDEIIEAADGIMIARGDMGIEVPFEMVPVYQKMIIKKVNAAGKVVITATNMLETMTEKPRATRSEVSDVFNAVIDGTDATMLSGESANGKYPLESVTTMATIDKNAQALLNEYGRLDSDSFERNSKTEVMASAVKDATSSMDIKLVVTLTKTGHTARLISKYRPNADILALTFDELTERGLMLNWGVIPMLTDAPSSTDDMFEIAERKAVEAGLVESGDDIVIVAGVPVGEAVRTNTMRIRTVR

SEQ ID NO: 16486 - DNA, 1422 bp, Clostridium acetobutylicum
  CDS (1)..(1422)
atgcaaaaaactaaaatgatttttacagttggaccagcaagtgagacagaggagattgtaacagctttcataaaagctggaatgaatgcttcaagacataacttttcacacggtgatcatgcagagcacggtggaagaatagctttagtaaaaaaggttagagcaaagcttaataagcctgtagctatatgccttgatactaaaggaccagaaataagaactggagatttcaatccttcaaagcttgaacttcaaaaaggttcaaaatttactatcgtttgtggcgaagaaatagttggagatgctacaaaatgttcaatatcatataaagatttatacaaagatgtaaaaccaggaaacactatattaatagatgatggtttagttggacttacagtagaagctatagaaggaacaaatgtaatttgtactgtagcaaatacaggattagttggaagccataaaggagtaaatgttccaaacgtttcaatacaacttcctgcaatgacagaaaaagataagagcgatttaatattcggatgtaaagaagaaatagatatggtaagtgcatcattcataagaaaacctgaagatgtacttgcaataagaaaagtattaaatgagaatggcggagaaaacattcaaatattctctaaaattgaaaatcaagaaggcgtggacaacatagatgctattatagaagtttctgacggaataatggtagctagaggagatatgggagttgaaattcctatacaaagagttccattaatccaaaaaatgataatcaaaaaatgtaatgcagtaggaaaacctgttataacagcaactcaaatgcttgattcaatgatgagaaatccaagacctacaagagcagaagcttcagatatagcaaatgctatatttgatggaacagatgctataatgttaagtggagaaagcgctaatggatcatatccaatagaagctgtaactacaatggcaaaaatagcacaagaggcagaaaatgaaatcaattatgataaattcctagcagaaagaaaaggaaatgaaaagaaaaatacttctgatgtaataagtcttggaacttgcacagcagcagcagacttagaagcttcagcaataataactgcaactcaaacaggaagcacagcaagaacagtttcaaaatatagaccaaaagcacctgtaatagcagttactccatctgaaaaagtagcaagaaaacttgcaatgagctggggagtacaccctataatatctgataaatttggttcaactgatgaacttatctctacttcagtagataaagcccttgaagcaggatatgtacaaaaaggagatcttgtagttgtagctgcaggtgtaccaacaaatgtatcaggtactacaaacatgcttaaagttcaagttgttgagtaa

SEQ ID NO: 16487 - protein, 473 aa, Clostridium acetobutylicum
MQKTKMIFTVGPASETEEIVTAFIKAGMNASRHNFSHGDHAEHGGRIALVKKVRAKLNKPVAICLDTKGPEIRTGDFNPSKLELQKGSKFTIVCGEEIVGDATKCSISYKDLYKDVKPGNTILIDDGLVGLTVEAIEGTNVICTVANTGLVGSHKGVNVPNVSIQLPAMTEKDKSDLIFGCKEEIDMVSASFIRKPEDVLAIRKVLNENGGENIQIFSKIENQEGVDNIDAIIEVSDGIMVARGDMGVEIPIQRVPLIQKMIIKKCNAVGKPVITATQMLDSMMRNPRPTRAEASDIANAIFDGTDAIMLSGESANGSYPIEAVTTMAKIAQEAENEINYDKFLAERKGNEKKNTSDVISLGTCTAAADLEASAIITATQTGSTARTVSKYRPKAPVIAVTPSEKVARKLAMSWGVHPIISDKFGSTDELISTSVDKALEAGYVQKGDLVVVAAGVPTNVSGTTNMLKVQVVE

SEQ ID NO: 16488 - DNA, 1428 bp, Mycoplasma pulmonis
  CDS (1)..(1428)
atgtattcgataaaaaagaaatcaaaactaattgctacaattggaccttcttctgataactatgaagttttaaaagagttagtagaaaatggagtaacttgtgtaagggctaatttttcacatggagactatcaagaacaaaaaagaaaatttgatcttgccaaaaaagtaagccatgatttaaacacccccctttcattaatgttagatactaaaggacctgaaattagaattgggaaaatgaaagatggagttcaaaaaattgaggccaatcaaagtttaaaaatttgagtctcagaagaaaaatataaaaatttattaggaacctcagaagatattagcgtttcttataatatgtctcaagatttaaaaaagggcaatcaagttcttcttgatgatggaaaattagatactattgtagaaaaagtaacccctgagtatgttcaagtaagagcacttaattctcataatttaaaaacaaacaaaagaattaatcttcccggagtggctttttcacttccttttctaagtgaaaaagataaaaaagatatagcctttggagttgaaaatgatattaactatgttgcagcttcatttgttaattccaaagaaaatgtattagaacttagagctattttaaaatcactaaacgcagagcatgttcaaattatttcaaaaattgaatcaactttaggaattgaaaacattgatgaaataattgaacactcagatggaattatgatagcaagaggagatttaggtcttgagattccttattatgaagttccttattgacaaaaaacaattattagaaaatgtagaaatgtaggcaaagttgtaatagttgcaactcaaatgcttgatagtatggaacacaatactaatccaacaagagccgaagtcactgatgtttattttgcaactgagctaggcgctgatacaacaatgctctcaggagagacagctcaaggatcttttccagttgaagctgttaaggttatgtcaaaaattaaccaaagagctgaaaaagagttttatagcaaactttactataacgctcaacttgaatcaaatgcaaaattagccactaccaaaagagctaaaattgcctatgaagttgcaaaacagactcaatctggagattttaaatatacagtagtgctttcagctagtggtaatttattaaaaaaagtagctaactttagacctaatacttcaattatcggctttgttgaagacaaaaaactaattaatgcttttggaattgtctcttcagtgtttgtctctcttgagtctgttcaaaaatattttgaactaaaaaataatcctttagctgcaattagcacccttaaaaactatgatgctaggccaggggatagattcttaattgttcataatgaaaaaattacccaacacgttgttgagtaa

SEQ ID NO: 16489 - protein, 475 aa, Mycoplasma pulmonis
MYSIKKKSKLIATIGPSSDNYEVLKELVENGVTCVRANFSHGDYQEQKRKFDLAKKVSHDLNTPLSLMLDTKGPEIRIGKMKDGVQKIEANQSLKIWVSEEKYKNLLGTSEDISVSYNMSQDLKKGNQVLLDDGKLDTIVEKVTPEYVQVRALNSHNLKTNKRINLPGVAFSLPFLSEKDKKDIAFGVENDINYVAASFVNSKENVLELRAILKSLNAEHVQIISKIESTLGIENIDEIIEHSDGIMIARGDLGLEIPYYEVPYWQKTIIRKCRNVGKVVIVATQMLDSMEHNTNPTRAEVTDVYFATELGADTTMLSGETAQGSFPVEAVKVMSKINQRAEKEFYSKLYYNAQLESNAKLATTKRAKIAYEVAKQTQSGDFKYTVVLSASGNLLKKVANFRPNTSIIGFVEDKKLINAFGIVSSVFVSLESVQKYFELKNNPLAAISTLKNYDARPGDRFLIVHNEKITQHVVE

SEQ ID NO: 16490 - DNA, 2083 bp, Bacillus psychrophilus
  CDS (271)..(2031)
gcatgcgaaatcatgtggtggtagactatgagttgacagatgttttcgaacaatcaaatggtttggatatggaaatgtacaagctgtccaacgaattgtctatttaactttatgtagcaaaaattccctgcctttatacgtgggaagacaaacgcgaacgaagtcagtaattcagagggcatcaaaatgtcggctgaatcgagcgagcactatttaaaatctgggtgcaattaattgggttgttaaaaaaactaaaagaggcgatatttgatgagaaaaacgaaaatagtatgtacgattggccctgcaagtgaatcaccggaattattggaacaacttattgaggctggtatgaatgtagcgaggctgaatttttcccatggtaatcatgcggaacataaagcccgtatcgattccattagaaaagtcgcacgtgaaaaaggcaaagttgttgggattctattagatacgaaaggaccagaaattcggacgcattctatgatgaatggaaagttggaacttgtaacaggacaaaaaattgatatttccatgacgcaagtcgaaggaaacaatgatgtattttcagtaagttacgataaacttattgaagatgtaaacgagggttctgttattcttttagacgatggtctaatccaattagaagttactggtaaagacgtagcacgagggttaattcatacactaattattaattcggggtcattaagcaataataagggcgttaacataccgggtgtttcagtacaacttcctggaatgacggaaaaagatgcagaagatatcctgtttggtattagggaaggtgtcgacttcatagctgcctcattcgtaagacgggcttccgatgttatggaaatccgtgcccttcttgagaacaacaacggctcgaacctgcaaattattccgaagatagaaaaccaagaaggcgtcgacaatatcgatgaaattttgaatgtttcagatggtcttatggtagcacgtggtgatctgggtgtagaaataccaccagaagaagtaccacttgtccagaaaaatttgattgagaagtgtaaccaggcgggtaaaccggttatcacggcaacacaaatgcttgattcgatgcagcgtaacccgcgtcctacacgtgcagaagcgagcgatgtagcgaatgcgatttttgacggtaccgatgcaattatgctgtcaggagagacggcagcaggaatttatccagtcgaatcagtccaaacgatggatcgaattgcgcttactacggaagctgccatcgattatcgctctgtagtgtcgacacgtcgacgagaaaaacatggtaatatgactgaagcgattggacaagctgcagcatacacggctatcaacttgaaagtgaaggctgtccttgccccaacagaaagtggtcacacagctaaaatgattgccaaatatcgtccaggttgcccagttattgcggtaacgtcatctgaaatgtgttcaagaaaactatcacttatctggggcgtctacccgatagttggaaaaaaagcttcttcgattgatgaaatcttgcaagagtctgtagaagagagtgttaaacatcaatatgtcggacatggtgatgtggttatcattacagcaggtgttccagttggtgaagcgggaacgacgaacttgatgaaaatacatgtcataggtgatttgcttgcacgaggacaaggaattggcaaagatgtagcttatggtcgaactgttgtagccaaaaatgcagctgaagcattggcgtatgatacagaaggagctattcttgtaacgaacgcatctgatcgtgatatgatgcctgccatcgagaaatgcgcaggactcattacggaagaaggcggattgacgagtcatggtgcaattgtcggactcagtttaggtataccgataattgtcggagttgaaaatgctaccgagcttatccaacatggcaaggaaattacgatggatgctgaatctggcgttatctataatggacacgcgagcgttctataaagttaatcttcaatcagagtgggggttcttcatcccccactgattgtttaaa

SEQ ID NO: 16491 - protein, 586 aa, Bacillus psychrophilus
MRKTKIVCTIGPASESPELLEQLIEAGMNVARLNFSHGNHAEHKARIDSIRKVAREKGKVVGILLDTKGPEIRTHSMMNGKLELVTGQKIDISMTQVEGNNDVFSVSYDKLIEDVNEGSVILLDDGLIQLEVTGKDVARGLIHTLIINSGSLSNNKGVNIPGVSVQLPGMTEKDAEDILFGIREGVDFIAASFVRRASDVMEIRALLENNNGSNLQIIPKIENQEGVDNIDEILNVSDGLMVARGDLGVEIPPEEVPLVQKNLIEKCNQAGKPVITATQMLDSMQRNPRPTRAEASDVANAIFDGTDAIMLSGETAAGIYPVESVQTMDRIALTTEAAIDYRSVVSTRRREKHGNMTEAIGQAAAYTAINLKVKAVLAPTESGHTAKMIAKYRPGCPVIAVTSSEMCSRKLSLIWGVYPIVGKKASSIDEILQESVEESVKHQYVGHGDVVIITAGVPVGEAGTTNLMKIHVIGDLLARGQGIGKDVAYGRTVVAKNAAEALAYDTEGAILVTNASDRDMMPAIEKCAGLITEEGGLTSHGAIVGLSLGIPIIVGVENATELIQHGKEITMDAESGVIYNGHASVL

SEQ ID NO: 16492 - DNA, 2054 bp, Bacillus licheniformis
  CDS (132)..(1889)
gaattcaaaataaccagttggtgcatcatgatatcattgaaatactcgagcaaaaacatacaattgatcaaagcatgtaccgcttgtctcaagaactgtcaatctagtgtaaaacccgaggaggaagcaatatgagaaagactaaaatagtttgtacaattggaccggccagcgaaagtgttgaaaagctcacccagctgatggaagccggaatgaacgtggcgcgcctgaacttttcccatggagatttcgaagagcacggcgcaagaattaaaaacattcgtgaagcagccggcaagctgggaaaagatatcggcatccttcttgacacgaaagggcctgaaatccgcacgcacacaatggaaaacggttcgatcgaactggcagcgggttctcagctgatcgtttcaatggacgaagtcatcggtacgcctgataaaatctcagttacatatgatgggttgattcacgatgtgtcagtcggttcaacgattttgcttgacgatggattggtcggacttgaagtcactgacataaacaaggacaagcgtgaaatcgtcacgaaagtgatgaacagcggaacgttgaaaaacaaaaaaggcgtgaatgtgccgggcgtcagcgtcaatcttccgggaattacggaaaaagatgcaaacgacatcgtattcggcatcgagcagggcgttgatttcatcgcggcatcctttgtgcgccgtccgtcggatgtccttgaaatccgcgaacttcttgaagagcacaatgcggcagatattcaaatcattccaaaaatcgaaaaccaggaaggcgttgacaacatcgatgccattcttgaagtatcagacggtctgatggttgcgcgtggagacctgggtgtagaaatccctgccgaagaagtgccgctcgttcaaaaagaactgatcaaaaaatgcaatgcgcttggcaagcctgtcatcacggctacccaaatgctcgacagcatgcagcgcaatccgcgcccgacacgcgcggaagcgagcgacgttgccaatgcgatctttgacggaactgacgcaatcatgctttcaggtgaaacggcagcgggaaattatcctgttgaagccgttcagacgatgcacaatatcgcttcccgttcagaagaagcgctcaaccataaaaagatcctttccgcacgaagcaagcaagtcagcatgtcaattacggatgcgatcggccaatctgtggcgcatacggcaatcaaccttgatgtgaatgccatcgtcacaccgacggaaagcggccatacggcgagaatgatttccaaatatcgcccgcaggcgccgattgtcgcagttacggtaaacgatgcggtgtcaagaaagctgtcacttgtgttcggggttttcgcaacaagcggacaaaaccacagctccactgacgaaatgcttgaaaaagcggtgcaaaaatctctcgatacaggcatcgtacgccacggcgacttgatcgttatcacggccggagctgtcggtgaagccggtacaacaaacttgatgaaagtgtatgttgtcggagacgtggtcgcaaaaggccagggcatcggacgcaaatccgcatttggtgaagtggtcatcgctcaaaacgcacaagaagcggccaaaaaaatgaaagatggcgccgttttagttacaaaaagcacggatcgtgacatgatggcatcccttgaaaaagcggctgcgctgattacggaagaaggcggcttaacaagccacgcggcagtcgtaggcttaagcctcggcatccctgtcatcgtcggaatggaaaatgcgacttccattctgaaagagggagaagacatcacggtcgactccgcccgcggagctgtatacaaaggacgtgcaagcgtgctttaatcgcttattgaagaagaagggaagctttccccttcttttagatttatgacaaaatcctaaaacgtttttcagttttaggattttgtcatccttcaattcagcgtgattgaaaacccttgcagtctaggaaggccgagcatcggagcggagcgaatgttggaattc

SEQ ID NO: 16493 - protein, 585 aa, Bacillus licheniformis
MRKTKIVCTIGPASESVEKLTQLMEAGMNVARLNFSHGDFEEHGARIKNIREAAGKLGKDIGILLDTKGPEIRTHTMENGSIELAAGSQLIVSMDEVIGTPDKISVTYDGLIHDVSVGSTILLDDGLVGLEVTDINKDKREIVTKVMNSGTLKNKKGVNVPGVSVNLPGITEKDANDIVFGIEQGVDFIAASFVRRPSDVLEIRELLEEHNAADIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGNYPVEAVQTMHNIASRSEEALNHKKILSARSKQVSMSITDAIGQSVAHTAINLDVNAIVTPTESGHTARMISKYRPQAPIVAVTVNDAVSRKLSLVFGVFATSGQNHSSTDEMLEKAVQKSLDTGIVRHGDLIVITAGAVGEAGTTNLMKVYVVGDVVAKGQGIGRKSAFGEVVIAQNAQEAAKKMKDGAVLVTKSTDRDMMASLEKAAALITEEGGLTSHAAVVGLSLGIPVIVGMENATSILKEGEDITVDSARGAVYKGRASVL

SEQ ID NO: 16494 - DNA, 1617 bp, Trichoderma reesei
  CDS (1)..(1617)
atgtcccagatctcccgcacgcagagcatcatggctaccacggcccaggagcacctggaaaccggcggccgcatcaattggctggcctcgctcaacacggcctttacgcctgcccgcaactttcgccgcacctccatcatctgcaccatcggccccaagaccaactcggtcgaggccctcaacaagctgcgtgatgccggcctcaacgtcgcccgcatgaacttctcccacggcagctacgagtaccaccagtccgtcatcgacaatgtgcgcgcctctgtcgccgcccaccctggccggcccgtcgccattgccctcgacaccaagggccccgagattcgaactggcaacacggccggcgacgtggacattcccatcagcgccggcaccgtcatgaacttcaccaccgacgagaagtacgcgacggcctgcgacactcagaacatgtacgtcgactacaagaacatcaccaaggtgatccagcctggccgtgtcatctacgtcgacgacggtgtcctcgcctttgacgtcctcagcatcaaggacgaccagaccgtcgaggtccgcgcccgcaacaacggcttcatctcctcccggaagggtgtcaacctgcccaacaccgatgtcgacctgcctgctctctccgagaaggacaaggccgatctccggtttggtgtcaagaacaatgtcgacatggtctttgcctcatttatccgccgtgcgcaggatatcaaggatatccgcgacgtgctgggccccgagggcaagcagatccagatcattgccaagatcgagaaccgacagggtctcaacaactttgccgagatccttgaggagaccgacggtgtcatggtcgcccgtggtgacctgggtattgagatccccgccgccgaggtgttcgccgcccagaagaagatgattgccatgtgcaacattgccggcaagcccgtcatctgcgctacccagatgctcgagtccatgatcaagaaccctcgacctacgcgtgccgagatcagcgatgtcggcaacgccgtcactgatggcgccgactgtgttatgctatctggcgagactgccaagggtaactaccctgccgagtccattcatgagatgcacgaggccagtctcaaggctgaaaacaccatcccctacgtctcccactttgaggagatgtgcactctggtcaagcgccccgtctcgaccgtcgagtcttgcgccatggctgccgtccgcgcctctctcgacctcggcgccggtggcatcattgtcctgtccacctctggcgactctgcccgcctgctgtccaagtaccgccccgtctgccccatcttcatggtgacccgaaaccccaccacctctcgattcagccacctgtaccgcggtgtctaccccttcctgtatcccgagcagaagcccgactttgatactgtcaactggcaggaggacgtcgacaagcgcatcaagtgggccgtcacccgcgccattgagctcaagacgctcactgccggcgacaccgttgtcgtcgtccagggctggaagggcggcatgggcaacacaaacaccctgcgcattgtccgcgctgaccccgaccacctgggcattggacagatggagtag

SEQ ID NO: 16495 - protein, 538 aa, Trichoderma reesei
MSQISRTQSIMATTAQEHLETGGRINWLASLNTAFTPARNFRRTSIICTIGPKTNSVEALNKLRDAGLNVARMNFSHGSYEYHQSVIDNVRASVAAHPGRPVAIALDTKGPEIRTGNTAGDVDIPISAGTVMNFTTDEKYATACDTQNMYVDYKNITKVIQPGRVIYVDDGVLAFDVLSIKDDQTVEVRARNNGFISSRKGVNLPNTDVDLPALSEKDKADLRFGVKNNVDMVFASFIRRAQDIKDIRDVLGPEGKQIQIIAKIENRQGLNNFAEILEETDGVMVARGDLGIEIPAAEVFAAQKKMIAMCNIAGKPVICATQMLESMIKNPRPTRAEISDVGNAVTDGADCVMLSGETAKGNYPAESIHEMHEASLKAENTIPYVSHFEEMCTLVKRPVSTVESCAMAAVRASLDLGAGGIIVLSTSGDSARLLSKYRPVCPIFMVTRNPTTSRFSHLYRGVYPFLYPEQKPDFDTVNWQEDVDKRIKWAVTRAIELKTLTAGDTVVVVQGWKGGMGNTNTLRIVRADPDHLGIGQME

SEQ ID NO: 16496 - DNA, 1791 bp, Saccharomyces cerevisiae
  CDS (2)..(1504)
aatgtctagattagaaagattgacctcattaaacgttgttgctggttctgacttgagaagaacctccatcattggtaccatcggtccaaagaccaacaacccagaaaccttggttgctttgagaaaggctggtttgaacattgtccgtatgaacttctctcacggttcttacgaataccacaagtctgtcattgacaacgccagaaagtccgaagaattgtacccaggtagaccattggccattgctttggacaccaagggtccagaaatcagaactggtaccaccaccaacgatgttgactacccaatcccaccaaaccacgaaatgatcttcaccaccgatgacaagtacgctaaggcttgtgacgacaagatcatgtacgttgactacaagaacatcaccaaggtcatctccgctggtagaatcatctacgttgatgatggtgttttgtctttccaagttttggaagtcgttgacgacaagactttgaaggtcaaggctttgaacgccggtaagatctgttcccacaagggtgtcaacttaccaggtaccgatgtcgatttgccagctttgtctgaaaaggacaaggaagatttgagattcggtgtcaagaacggtgtccacatggtcttcgcttctttcatcagaaccgccaacgatgttttgaccatcagagaagtcttgggtgaacaaggtaaggacgtcaagatcattgtcaagattgaaaaccaacaaggtgttaacaacttcgacgaaatcttgaaggtcactgacggtgttatggttgccagaggtgacttgggtattgaaatcccagccccagaagtcttggctgtccaaaagaaattgattgctaagtctaacttggctggtaagccagttatctgtgctacccaaatgttggaatccatgacttacaacccaagaccaaccagagctgaagtttccgatgtcggtaacgctatcttggatggtgctgactgtgttatgttgtctggtgaaaccgccaagggtaactacccaatcaacgccgttaccactatggctgaaaccgctgtcattgctgaacaagctatcgcttacttgccaaactacgatgacatgagaaactgtactccaaagccaacctccaccaccgaaaccgtcgctgcctccgctgtcgctgctgttttcgaacaaaaggccaaggctatcattgtcttgtccacttccggtaccaccccaagattggtttccaagtacagaccaaactgtccaatcatcttggttaccagatgcccaagagctgctagattctctcacttgtacagaggtgtcttcccattcgttttcgaaaaggaacctgtctctgactggactgatgatgttgaagcccgtatcaacttcggtattgaaaaggctaaggaattcggtatcttgaagaagggtgacacttacgtttccatccaaggtttcaaggccggtgctggtcactccaacactttgcaagtctctaccgtttaaaaaaagaatcatgattgaatgaagatattatttttttgaattatattttttaaattttatataaagacatggtttttcttttcaactcaaataaagatttataagttacttaaataacatacattttataaggtattctataaaaagataacttatgttattgttaacctttttgtctccaattgtcgtcataacgatgaggtgttcgatttttggaaacgagattgacatagagtcaaaatttgctaaatttgatccctcccatcgcaagataatcttccctcaag

SEQ ID NO: 16497 - protein, 500 aa, Saccharomyces cerevisiae
MSRLERLTSLNVVAGSDLRRTSIIGTIGPKTNNPETLVALRKAGLNIVRMNFSHGSYEYHKSVIDNARKSEELYPGRPLAIALDTKGPEIRTGTTTNDVDYPIPPNHEMIFTTDDKYAKACDDKIMYVDYKNITKVISAGRIIYVDDGVLSFQVLEVVDDKTLKVKALNAGKICSHKGVNLPGTDVDLPALSEKDKEDLRFGVKNGVHMVFASFIRTANDVLTIREVLGEQGKDVKIIVKIENQQGVNNFDEILKVTDGVMVARGDLGIEIPAPEVLAVQKKLIAKSNLAGKPVICATQMLESMTYNPRPTRAEVSDVGNAILDGADCVMLSGETAKGNYPINAVTTMAETAVIAEQAIAYLPNYDDMRNCTPKPTSTTETVAASAVAAVFEQKAKAIIVLSTSGTTPRLVSKYRPNCPIILVTRCPRAARFSHLYRGVFPFVFEKEPVSDWTDDVEARINFGIEKAKEFGILKKGDTYVSIQGFKAGAGHSNTLQVSTV

SEQ ID NO: 16498 - DNA, 1596 bp, Trypanosoma brucei
  CDS (59)..(1558)
ctaattatcacctaataaaggaacaattcagacaaaacagatttattccgacgagtccatgtcgcagctagagcacaacattgggctctccatttttgagccggtggccaaacaccgtgccaaccgcattgtgtgcaccatcggacccagcacacagagcgttgaagccctgaaaaacctaatgaagagtggtatgtctgttgcccgtatgaacttttcccatggatcccatgaataccaccagacgacaataaacaacgttcgcgcagctgctgctgaacttggccttcatattggtattgcgctggacacgaaaggtcctgaaatccgtacaggcctcttcaaggatggtgaggtgacgttcgcccctggtgacatcgtgtgtgtcactaccgatcccgcctatgagaaggttggcacaaaggaaaagttctatatcgactacccacaactgacgaaggcagtgcccgtgggtggttccatttatgtcgacgacggtgtgatgactctccgcgtcttaagcaaagaggacgatcggacgctgaagtgccacgtgaacaatcaccaccgcctgaccgaccgcaggggtatcaacctcccaggttgtgaggtggatctgcccgccgtttccgagaaggaccgcaaggacttggagttcggtgtggcacaaggtgttgatatgatttttgcctcgttcatccgcacggctgagcaggttcgtgaggtgcgcgccgccctcggtgagaagggaaaagacatccttatcatttccaagattgaaaaccaccagggtgtgcagaacattgactccatcattgaagcgagcaatggcattatggttgctcgtggtgatcttggcgtcgagatccccgccgagaaggtgtgtgtggcgcagatgtgcatcatcagcaagtgcaacgtggtgggcaaacctgtcatctgtgccacgcaaatgctcgagagcatgacgtcaaacccccgccccacacgtgccgaagtatccgatgttgccaatgctgttctcaacggagccgactgtgtcatgctttccggtgaaacggccaaagggaagtaccccaacgaagtggtacagtacatggctcgcatctgtgtcgaggcgcagagcgcaacgcacgatactgttatgttcaacagcattaagaacctgcagaaaatccccatgtgccccgaagaggccgtttgcagcagcgccgtcgcctctgcatttgaggtacaagccaaggcaatgctcgtgctaagcaacacgggccgaagtgctcgcctcatcagcaagtaccgcccgaactgccccatcatttgtgtcaccacacgtctgcaaacgtgccgtcaactcaacgtgacgcgctccgtcgtgagtgttttctacgacgccgcaaagagtggtgaggacaaggataaggaaaagcgcgtgaaactcggtttggattttgcgaagaaggagaaatatgccagcactggagacgtggtggttgtcgtgcatgccgaccactctgtgaaggggtacccgaaccaaactcgcctcatctatcttccttaagcattggtgggtgggtgagcaatgtaatgaggggttaa

SEQ ID NO: 16499 - protein, 499 aa, Trypanosoma brucei
MSQLEHNIGLSIFEPVAKHRANRIVCTIGPSTQSVEALKNLMKSGMSVARMNFSHGSHEYHQTTINNVRAAAAELGLHIGIALDTKGPEIRTGLFKDGEVTFAPGDIVCVTTDPAYEKVGTKEKFYIDYPQLTKAVPVGGSIYVDDGVMTLRVLSKEDDRTLKCHVNNHHRLTDRRGINLPGCEVDLPAVSEKDRKDLEFGVAQGVDMIFASFIRTAEQVREVRAALGEKGKDILIISKIENHQGVQNIDSIIEASNGIMVARGDLGVEIPAEKVCVAQMCIISKCNVVGKPVICATQMLESMTSNPRPTRAEVSDVANAVLNGADCVMLSGETAKGKYPNEVVQYMARICVEAQSATHDTVMFNSIKNLQKIPMCPEEAVCSSAVASAFEVQAKAMLVLSNTGRSARLISKYRPNCPIICVTTRLQTCRQLNVTRSVVSVFYDAAKSGEDKDKEKRVKLGLDFAKKEKYASTGDVVVVVHADHSVKGYPNQTRLIYLP

SEQ ID NO: 16500 - DNA, 1636 bp, Bacillus stearothermophilus
  CDS (114)..(1598)
gtcgaccatgacatcgcggaggcgctagccaacaaacatacgattgatcagcggatgtacgcattgtcgaaagaattgtccatttaagtcccgaggggaaaggagaagacaagatgaagcggaaaacgaaaatcgtctgcacgatcgggccggcaagcgagagcgtagacaagctcgtgcaactgatggaagcgggaatgaacgtggcgcgcctaaacttttcgcacggcgatcatgaagagcacgggcggcgcatcgccaatattcgcgaagcggcgaagcgaacgggccgaacggtcgccattttgcttgacacgaaagggccggaaatccggacgcacaatatggaaaacggcgccattgagctgaaggaagggtcaaagctcgtcatttcgatgagcgaagtgctcggcacgccggaaaaaatttcggtcacctatcccagcttaatcgatgatgtgtccgtcggcgcgaaaattttgcttgatgacgggctcatcagcctggaagtcaacgcggtcgacaagcaagcgggagaaatcgtcacgaccgtgttaaacggcggcgtgctgaaaaacaaaaaaggagtcaatgtgccgggtgtcaaagtcaacttgccaggcatcaccgagaaagatcgggctgacattttgtttggcattcgccaagggatcgatttcatcgccgcctcgtttgtgcgccgggcgtccgatgtgctggagatccgcgagctgcttgaggcgcatgacgccctccatatccaaattatcgccaaaattgaaaatgaagaaggcgtcgccaacattgacgaaattttagaagccgccgacggcctgatggtggcgcgcggcgatttgggcgtggaaattccggctgaggaagtgccgctcattcaaaaactgctcattaaaaagtgcaacatgctcggcaagccggtcattacggcgacgcaaatgctcgattcgatgcagcgcaatccgcgtccgacgcgggcggaggcgagcgacgtcgccaacgccatttttgacggcaccgacgccgtcatgctttccggggaaacggcggccggccagtatccggtcgaagcggtgaaaacgatgcaccaaatcgcgctccgcaccgaacaggcgcttgagcaccgcgacattttgtcccaacgcacaaaagaaagccaaacgacgatcaccgacgccatcgggcagtcggtcgcccacaccgcgctcaacttggatgtggcggcgatcgtgacgccgaccgtgagcggaaaaacgccgcaaatggtggcgaagtatcgcccgaaggcgccgattattgccgtgacgtcaaatgaagcggtatcgcgccggctggcgcttgtgtggggcgtgtatacgaaagaagcgccgcatgtgaacacgacggacgaaatgctcgatgtcgccgtcgatgcggcggtgcgctccgggttggtgaagcacggtgacttggtcgtcatcacggctggcgtgccggtcggcgaaacgggttcgacgaacttaatgaaggtgcacgttatcagcgatcttctcgccaaagggcaaggcatcggcgcaagtcggcgttcggcaaggccgttgtagcgaaaacagcggaagaagcgcggcaaaaaatggtcgac

SEQ ID NO: 16501 - protein, 494 aa, Bacillus stearothermophilus
MKRKTKIVCTIGPASESVDKLVQLMEAGMNVARLNFSHGDHEEHGRRIANIREAAKRTGRTVAILLDTKGPEIRTHNMENGAIELKEGSKLVISMSEVLGTPEKISVTYPSLIDDVSVGAKILLDDGLISLEVNAVDKQAGEIVTTVLNGGVLKNKKGVNVPGVKVNLPGITEKDRADILFGIRQGIDFIAASFVRRASDVLEIRELLEAHDALHIQIIAKIENEEGVANIDEILEAADGLMVARGDLGVEIPAEEVPLIQKLLIKKCNMLGKPVITATQMLDSMQRNPRPTRAEASDVANAIFDGTDAVMLSGETAAGQYPVEAVKTMHQIALRTEQALEHRDILSQRTKESQTTITDAIGQSVAHTALNLDVAAIVTPTVSGKTPQMVAKYRPKAPIIAVTSNEAVSRRLALVWGVYTKEAPHVNTTDEMLDVAVDAAVRSGLVKHGDLVVITAGVPVGETGSTNLMKVHVISDLLAKGQGIGASRRSARPL

SEQ ID NO: 16502 - DNA, 1581 bp, Emericella nidulans, Aspergillus nidulans
  CDS (1)..(1581)
atggccgcaagctcttccctcgaccacttgtccaaccgtatgaagctggagtggcactccaagctgaatactgagatggtgccggcgaagaacttccgccgtacatccatcatctgtaccatcggtcccaagacaaactccgttgagaaaatcaatgccctccgcagagccggtctcaatgtcgttcgcatgaacttttctcacggttcatacgagtaccaccaatcagttatcgaccacgctcgggaagccgaaaagcaggcagctggccgccccgttgccattgctctggacaccaaaggacccgagatccgtaccggaaacaccgtaggtgacaaggacatcccaatcaaggctggccatgagatgaacatcagcaccgatgagcaatatgccaccgcatccgacgaccagaacatgtatgtcgattacaagaacatcaccaaggtgatttctgccggcaagctcatctatgtcgatgacggtatcctttcatttgaggttcttgaagttgtagatgacaagaccctgcgcgtccgatgccttaacaacggcaacatctcttcccgcaagggtgtcaaccttcccggtaccgacgtagacttgcccgctctttcagagaaggacatcagcgatctgaagtttggtgtcaagaacaaggtcgacatggttttcgcttccttcatccgtcgtggcagcgacatccgccacatccgtgaggtgttgggtgaagagggccgagagattcagatcatcgccaagattgagaaccaacaaggtgtcaacaatttcgacgagattctggaagagaccgacggtgtcatggtcgcccgtggtgaccttggtatcgagatccccgctcccaaggtgttcatcgcccagaagatgatgatcgccaagtgtaacatcaagggcaagcccgtcatttgtgccactcagatgcttgagtccatgacatataaccctcgtcccactcgtgctgaggtgtccgatgtggccaacgctgttctcgacggtgccgactgtgtcatgctttctggagagactgccaagggtaactacccttgcgaggctgtcacgatgatgtctgagacctgcctcctcgccgaggttgccattcctcacttcaacgtcttcgacgagctgcgaaacctggcccctcgtcccaccgacactgttgaatccatcgccatggctgctgtgagtgccagtcttgaactgaacgccggcgccattgtggtcctcaccactagtggaaacactgcccgtatgatctccaagtaccgccccgtttgccccatcatcatggtttctcgcaaccctgctgctacaaggtactcccacctgtaccgtggtgtctggcccttctacttccccgagaagaagcccgacttcaacgtcaagatctggcaggaggatgtcgaccgtcgcctcaagtggggtatcaaccacggtctcaagctcggtatcatcaacaagggcgacaacatcgtctgtgttcagggctggcgcggcggtatgggccacactaacactgtccgtgtggtccctgctgaggagaacctcggactttctgagtaa

SEQ ID NO: 16503 - protein, 526 aa, Emericella nidulans, Aspergillus nidulans
MAASSSLDHLSNRMKLEWHSKLNTEMVPAKNFRRTSIICTIGPKTNSVEKINALRRAGLNVVRMNFSHGSYEYHQSVIDHAREAEKQAAGRPVAIALDTKGPEIRTGNTVGDKDIPIKAGHEMNISTDEQYATASDDQNMYVDYKNITKVISAGKLIYVDDGILSFEVLEVVDDKTLRVRCLNNGNISSRKGVNLPGTDVDLPALSEKDISDLKFGVKNKVDMVFASFIRRGSDIRHIREVLGEEGREIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGNYPCEAVTMMSETCLLAEVAIPHFNVFDELRNLAPRPTDTVESIAMAAVSASLELNAGAIVVLTTSGNTARMISKYRPVCPIIMVSRNPAATRYSHLYRGVWPFYFPEKKPDFNVKIWQEDVDRRLKWGINHGLKLGIINKGDNIVCVQGWRGGMGHTNTVRVVPAEENLGLSE

SEQ ID NO: 16504 - DNA, 1847 bp, Nicotiana tabacum (common tobacco)
  CDS (45)..(1571)
gttgctgtcgcttttcgtttgaaaaaaaactaaaattctctgctatggcgattgagaataacaacaatggagtgaatttttgtacggtgaagaggccgaagacgaagatagtatgtactttggggccagcatctcgatcggtgccgatgatcgagaagcttctacgggcaggcatgaacgtggcccgattcaacttttctcatggatctcacgactatcatcaggagactattgacaatctccgtcaagctatggagagtaccggtattctctgtgccgttatgcttgacaccaagggtccagaaattcgaacagggtttttaaaagatgctaagcctgttcaacttaaacagggtcaggagatcacaatctcaactgattacagcattaaaggtgatgagagtatgatatgcatgagctacaaaaagttagcagaggacgtaaagccacaaagtgtgatcctctgtgcagatggccaaatcacctttacagttttgtcttgtgacaaagagaacggtttggatcgatgccgctgtgagaacactgctgttcttggtgaaagaaagaatgtcaatctcccgggagtaattgtggatctgccaacattgacagataaagacaaggatgacattttaaactggggagttccgaatcatattgacatgattgcgttatcttttgttcgtaagggttcagatctcgtggaggttcggaagctgctaggtgaacatgcaaagaacattcttctgatgtctaaggttgaaaaccaggaaggtgtagcgaattttgatgacattcttctcaactctgatgcatttatggtggcaagaggtgacctgggaatggaaattccaattgagaagatatttttggctcaaaaggtaatgatttacaagtgcaacatccaagggaagcctgttgtcacagcaacacagatgttggagtccatgatcaaatctccaaggccaactcgtgcagaagcaacagatgttgccaatgctgttcttgatggcacagactgtgtcatgcttagtggtgaaacagctgctggagcttaccctgatcttgcagtgggtaccatggctaagatttgtattgaagcagaaagcacaattgattatccagatgttttcaaaagaattatgtcaaatgccccagttcccatgagcccattggagagccttgcatcttctgctgttcgaaccgctaactctgcaaaagctgctcttatcctagtgttaaccaggggaggaagtactgcaaaattggtggccaagtacagacctggaatgcctatattgtcggtggttgtccccgagatcaaaactgattcttttgattggacttgcagtgacgagtctccagcaaggcatagccttatattcaggggattggttcccgttctccatgcaggatctgctagggcttctcatgaagagtctacagaagaagcactggactttgctcttcaacatgccaaaacaaaagggttatgcaagcaaggagactccgttgtagccctacaccgtgttggaactgcatctgtgatcaagattgttacagtcaagtgatagatgaactttgacgcgtgctttttgggtttctgttgttgcaaaagggtaactgataaatgtttttgcttgtttcactgaatcattttctgccttctagagaaggaacttatgactataccttatattatgtctctatataacgcctggctgttttttgctttggctggagtttcatacccttttatctttttatgcaatttgtctacagacacagatatgatgcgaaataaattccttgtgccttcaatttatctgtctaaaaaaaaaaaaaaa

SEQ ID NO: 16505 - protein, 508 aa, Nicotiana tabacum (common tobacco)
MAIENNNNGVNFCTVKRPKTKIVCTLGPASRSVPMIEKLLRAGMNVARFNFSHGSHDYHQETIDNLRQAMESTGILCAVMLDTKGPEIRTGFLKDAKPVQLKQGQEITISTDYSIKGDESMICMSYKKLAEDVKPQSVILCADGQITFTVLSCDKENGLDRCRCENTAVLGERKNVNLPGVIVDLPTLTDKDKDDILNWGVPNHIDMIALSFVRKGSDLVEVRKLLGEHAKNILLMSKVENQEGVANFDDILLNSDAFMVARGDLGMEIPIEKIFLAQKVMIYKCNIQGKPVVTATQMLESMIKSPRPTRAEATDVANAVLDGTDCVMLSGETAAGAYPDLAVGTMAKICIEAESTIDYPDVFKRIMSNAPVPMSPLESLASSAVRTANSAKAALILVLTRGGSTAKLVAKYRPGMPILSVVVPEIKTDSFDWTCSDESPARHSLIFRGLVPVLHAGSARASHEESTEEALDFALQHAKTKGLCKQGDSVVALHRVGTASVIKIVTVK

SEQ ID NO: 16506 - DNA, 2243 bp, Nicotiana tabacum (common tobacco)
  CDS (318)..(2006)
cgttgctgtcgagcaaacgtgcggtgcgtgggagaagcgcgagtttggttggacagtagggcagatgagaagaaaatagaaaatgtcttagtccccaagagtctcaaaatcctctgagcctctgcagacagccgctcttttcggaactcaacttctctttgttttctccctttcttcctcacattcaccacacacatacacacacacactttctccaagttttttcttctcgttttctccgtagctaccacaactctatatctttctttctctctttcttctattcttcatcttctacttcttctgttacttgttcaatggccacaatgaatctacctacaggactacatgtcgcggctaaaccggcgtcattggatcggctttcctcggccaagaacgtcggtgatttgttcttctccgattctcgtcacaggaaacgagtgaatacttcgaatcaaatcatggccgttcaatcacttgagcatattcatggcgttaataacaatgtttatgccaattatgttaatttcaatgtaccctcttccggttacagtctggggcaagaaagtgtgtatctgaattctccaagaaaaaccaagatagtttgcaccattggtccctccacaagctcacgggagatgatctggaaattggcagaggctggaatgaacgtggcccgtctgaatatgtcacatggggaccacgcatcgcatcagagaacgattgaccttgttaaagaatacaatgctcaatttgaggacaaggttattgcaataatgttggacactaagggacctgaggtaataagtggagatgtgcccaaaccaattctccttaaggagggtcaagaattcaactttagcattaaaagaggagtcagcacagaagacaccgttagtgtaaattatgatgatttcataaatgatgtggaggccggagacatactactcgttgatggtgggatgatgtcattagctgtgaaatcgaaaaccagcgatatagtgaaatgtgaagttattgatggaggagaactgaaatcgagacggcatctaaatgtaagaggaaaaagtgccaccctgccttcaataacagaaaaagactgggatgatattaagtttggtgtgaacaatcaagtcgacttctatgccgtttcttttgtgaaggatgctaaggtggtccatgaattgaaagattacctgaaaagctgtaatgcagatattcatgttattgtaaagattgaaagtgcagactccattccaaatctccactcgatcatttccgcttccgatggggcaatggtggcccgtggtgatcttggagctgaacttccaattgaggaagtgccgttgcttcaggaagacattattagaaggtgtcagagcatgcaaaaacctgtaatagtagcaacgaacatgctcgaaagcatgattgatcacccaaccccaacaagggcagaagtttcagacatttccattgcagtacgtgaaggcgctgatgctgtaatgctttcaggcgaaaccgctcatgggaagtatccactgaaggcagttaaggtgatgcatattgtggcattaaggaccgagtctagcctacaaaaaagcactagttctcctagtcaatctgccgcctataagagccatatgggtgaaatgtttgccttccactcttcctcaatggctaatacccttagcactcccatcattgtcttcacaagaactgggtccatggcaataattttaagtcataatcggccttcatcaacagtttttgccttcacaaacaatgaaagggtgaagcagcgtctggctctgtatcatggtgtcgtgcctatatatatggagttttcaagtgacgcagaggagaccttttctcgagctatcaagcttttgttgagcaaaagcttggtgaaggatgggcaatatgtaactctcgtccaaagtggagcccaaccaatctggcgtagacattctactcaccacatacaagtccgtaaggtccaaagttgatacgtgtagcaaccatttattttggtgtaatcacgtcgattggtaggcattaggatgcaatttttcaaagtttcttatatacagttgctttttttttcttcttctgaagttattccttgtatgatgaaactggagaaatcttcttaaaacttaaaattctaggcacagatgtttctgtaattgtgaactttctggcagatggaagcttaagttttgataaaaaaaaaaaaaaaaaaa

SEQ ID NO: 16507 - protein, 562 aa, Nicotiana tabacum (common tobacco)
MATMNLPTGLHVAAKPASLDRLSSAKNVGDLFFSDSRHRKRVNTSNQIMAVQSLEHIHGVNNNVYANYVNFNVPSSGYSLGQESVYLNSPRKTKIVCTIGPSTSSREMIWKLAEAGMNVARLNMSHGDHASHQRTIDLVKEYNAQFEDKVIAIMLDTKGPEVISGDVPKPILLKEGQEFNFSIKRGVSTEDTVSVNYDDFINDVEAGDILLVDGGMMSLAVKSKTSDIVKCEVIDGGELKSRRHLNVRGKSATLPSITEKDWDDIKFGVNNQVDFYAVSFVKDAKVVHELKDYLKSCNADIHVIVKIESADSIPNLHSIISASDGAMVARGDLGAELPIEEVPLLQEDIIRRCQSMQKPVIVATNMLESMIDHPTPTRAEVSDISIAVREGADAVMLSGETAHGKYPLKAVKVMHIVALRTESSLQKSTSSPSQSAAYKSHMGEMFAFHSSSMANTLSTPIIVFTRTGSMAIILSHNRPSSTVFAFTNNERVKQRLALYHGVVPIYMEFSSDAEETFSRAIKLLLSKSLVKDGQYVTLVQSGAQPIWRRHSTHHIQVRKVQS

SEQ ID NO: 16508 - DNA, 2044 bp, Xenopus sp. (clawed frog)
  CDS (29)..(1612)
ttacgtagattccatacagtaggtcaacatgtctgaggcaggtagtgctttcattcagacccagcagctgcatgctgccatggcagacaccttcttggaacacatgtgccgtctagacatagactctgagccaattgtagcacgtaacacaggcatcatctgcactattggccctgcttcacgttctgtggaaatgctaaaggagatgataaaatctggaatgaatattgctcgtctgaacttttcccatggaacacacgagtatcatgctggcaccattaaaaatgtccgtgaagcaaccgagagcttagcttccaatcccattcactaccggcctgtggcagtggccctggacacaaagggaccagaaatccgcactggtctcattaaaggaagtggcacagcagaagtggagctaaaaaagggagcaactatgcgtatcactcttgatgatgcattccaggaaaactgtgatgagaatgtactgtgggtagattacaaaaaccttacaaaagtggtgaaacctggcagcaagatctatgtggatgatgggcttatttccttgctcgttaaggaaattggtccagacttctgcgtgactgagattgagaatgggggaatgttaggaagtaagaaaggagtgaacctccctggggcagctgtggatttgcctgctgtatcttcaaaagatatccaagacctgcaatttggtgtggagcaagatgtcgacatggtttttgcttcttttatcagaaaggcagcagatgtacatgaagtgagggaagttcttggagagaaaggcaaaaacatcaagattatcagcaaaattgaaaaccacgagggtgttcgcaggtttgatgagattctagaagcaagtgatggtataatggtggcacgtggtgatcttggtattgagatccctgccgaaaaagtcttccttgctcaaaagatgatgattggacgctgcaatcgtgctggcaaacctgtgatctgcgccactcagatgctggaaagcatgatcaaaaagcctcgcccaacacgtgccgaaggtagtgatgtggccaatgctgttctggatggggctgactgtataatgttgtcaggggagactgcaaagggagattacccattggaggctgtacgcatgcagcatgctattgcacgagaggcagaagcggccattttccatcggcagttgtttgaggaactgagacgcgtgtccccactgacccgtgatcccacagaagcgactgctgttggagcagtagaggcatcattcaaatgctccagtggagccatcatcgtgcttactaaatctggcaggtctgcgcatttactgtctcgttaccgcccacgcgcacccatcatctctgttactcgtaatgggcagacagcacgtcaggcacatctctatcgtggcatctttcctgtactctatagagaagctgtgcacgaggcatgggctgaggatgttgatagcagggtcaactttgcaatggacattggcaaggcccgtggctttttcaagagtggggatgttgtgatcgtactcactggctggcggccaggctctggtttcaccaacacaatgcgtgttgttccagtgccttaatctgcaaacccgataaaactataatctgttgtccattttttttctgcactctccacccagcagacgtaaactctgtagaccagattataaaccctttatttgtggcattgggagagacattagtgtgtttgtgcgcagcacggaattccattgttccgttgcttattacgatccctgtgttagtcggttattgcaagtgctgcccacatatacatgagatgtgtagaaatatctgtaattacactcctttctcagcccttcacttgtgcaagaaattgccttggatgtgcaataagtttgctcttcatctctagtctgagcagctacgtagttttttttgcttgtggttaggggaaggctttgtgttgtcctcatcctgtctgagatgcactgagtttagtgttaataaatcgatgcttatgcagcctcaca

SEQ ID NO: 16509 - protein, 527 aa, Xenopus sp. (clawed frog)
MSEAGSAFIQTQQLHAAMADTFLEHMCRLDIDSEPIVARNTGIICTIGPASRSVEMLKEMIKSGMNIARLNFSHGTHEYHAGTIKNVREATESLASNPIHYRPVAVALDTKGPEIRTGLIKGSGTAEVELKKGATMRITLDDAFQENCDENVLWVDYKNLTKVVKPGSKIYVDDGLISLLVKEIGPDFCVTEIENGGMLGSKKGVNLPGAAVDLPAVSSKDIQDLQFGVEQDVDMVFASFIRKAADVHEVREVLGEKGKNIKIISKIENHEGVRRFDEILEASDGIMVARGDLGIEIPAEKVFLAQKMMIGRCNRAGKPVICATQMLESMIKKPRPTRAEGSDVANAVLDGADCIMLSGETAKGDYPLEAVRMQHAIAREAEAAIFHRQLFEELRRVSPLTRDPTEATAVGAVEASFKCSSGAIIVLTKSGRSAHLLSRYRPRAPIISVTRNGQTARQAHLYRGIFPVLYREAVHEAWAEDVDSRVNFAMDIGKARGFFKSGDVVIVLTGWRPGSGFTNTMRVVPVP

SEQ ID NO: 16510 - DNA, 1521 bp, Saccharomyces cerevisiae
  CDS (1)..(1521)
atgccagagtccagattgcagagactagctaatttgaaaataggaactccgcagcagctcagacgcacctccataataggtaccattgggcccaagacaaatagctgcgaggccattactgctctgagaaaagctggtttgaacatcattcgattgaacttttcccatggctcctacgaattccatcaatcagtaatcgaaaatgctgtgaaatcggaacagcaattccctggcaggccgctcgccattgccctggataccaagggtcccgagatcagaacaggtcgcacgttaaatgaccaagatctttatatccccgtagaccaccaaatgatctttaccactgacgcaagttttgcaaacacctccaatgataaaatcatgtatatagactatgctaacctgacaaaagttatcgttccggggagatttatatacgtggacgacgggattctctcttttaaagtgctccaaatcattgacgaatctaatttaagggtgcaagcggtaaactcgggttatatcgcatctcataaaggtgttaatctgcctaataccgacgttgatttgccccccttgtccgccaaagacatgaaggacttgcaattcggagtccgcaatggcattcacatcgtatttgcctctttcataagaacttcagaagatgtgttgtctatcagaaaagcgttgggttctgaagggcaagatatcaagattatatccaagatagaaaaccagcaagggttggataattttgacgaaatcctggaagtcacggatggtgttatgatagcgagaggcgatttaggaattgaaatcctggcacctgaagtattagccattcaaaaaaagctgattgcaaaatgtaatttggcgggcaaacctgtcatttgcgcgactcagatgctggattcaatgacacacaatccgagaccgacaagggctgaagtatcggatgtgggtaacgctgtgttggatggtgctgattgtgttatgctttctggagaaacggcgaagggtgattatccggtgaatgcagttaatattatggcggcgaccgctctgattgctgaaagtactatcgctcatttggctctttatgacgatctcagagacgccactcccaaacctacttccactacggaaactgtagcagctgcagctaccgcagcaatcttggagcaagatggtaaggccatcgttgtattatctactacagggaacacggcaaggctactgtcgaagtatagaccaagctgccctatcatattagtaacaagacacgcaagaacggcaagaattgcgcatttgtatagaggtgttttcccatttctgtatgaaccgaaacgcctagacgactggggtgaggatgttcataggcgcctaaagtttggtgttgaaatggcgaggtctttcggaatggtggacaacggtgatactgttgtttccattcaaggattcaaaggaggagtcggccattccaataccttacgcatttctactgttggtcaagaattctag

SEQ ID NO: 16511 - protein, 506 aa, Saccharomyces cerevisiae
MPESRLQRLANLKIGTPQQLRRTSIIGTIGPKTNSCEAITALRKAGLNIIRLNFSHGSYEFHQSVIENAVKSEQQFPGRPLAIALDTKGPEIRTGRTLNDQDLYIPVDHQMIFTTDASFANTSNDKIMYIDYANLTKVIVPGRFIYVDDGILSFKVLQIIDESNLRVQAVNSGYIASHKGVNLPNTDVDLPPLSAKDMKDLQFGVRNGIHIVFASFIRTSEDVLSIRKALGSEGQDIKIISKIENQQGLDNFDEILEVTDGVMIARGDLGIEILAPEVLAIQKKLIAKCNLAGKPVICATQMLDSMTHNPRPTRAEVSDVGNAVLDGADCVMLSGETAKGDYPVNAVNIMAATALIAESTIAHLALYDDLRDATPKPTSTTETVAAAATAAILEQDGKAIVVLSTTGNTARLLSKYRPSCPIILVTRHARTARIAHLYRGVFPFLYEPKRLDDWGEDVHRRLKFGVEMARSFGMVDNGDTVVSIQGFKGGVGHSNTLRISTVGQEF

SEQ ID NO: 16512 - DNA, 1452 bp, Synechocystis sp
  CDS (1)..(1452)
atgccagccctgattaacccggtgaagtttatgagacccctaagtcatcgcaccaaaattgtggccaccattggccccgccagtagttcggtagaggtgatacgtcagatggtggatgcgggcatgaatgtggcccggctgaatttttcccacggtagttatgaggaccatgccaccatggttcgcctactacggtcagtggagcaggaaatggacacccccattacccttttgcaagatttacaggggcccaaaattcggattggtcagttgccggggggagaaaagcaactgcgggaaggggaaaaagtttctttggtgccggtggaaattggcgatcgccatcctggagcggtgggcattgactatccccatttggcgacggaggcaaaagtaggggaaagaattttattggacgatggtttactggaaatgaaagttgtgtccattcaagatccagaggtaatttgtgaagtggtgaccgggggcatcctcaaaagtcgcaaaggggtcaatctaccgggtttagtcctaaccctaccttccatgacgaccaaagacaagcaagacttagaatttggtttgagccaaggcattgactgggtttcccttagttttgtccgcaaaggggaagatatccacacccttaaacaatttctcgctgaacggggccatcctgatctgccggtcattgccaaaattgaaaaaccccaggcgatcgataatctagaagaaatcgtggcagtttccaacggcattatggtggccaggggggatctgggggtggaagtaaacccagaaaaggttccccgtttgcaaaaggaaattattcggcgctgtaacgtgcgggccattccggtcatcaccgctacccaaatgctagatagcatgattcaaaattcccgacccaccagggcggaagccagtgacgtggccaacgctattttggacggcaccgatgcggtgatgttatcgggggaatcggcagtgggacaatatcccgttaaatcagtgcaaatgttgcgaaaaattgccgaagagacggaagtgggtctacatcttgttaataatcccccaatagaaaatacggaaacccatgccctaagtgaagcgttagtggtaattgacggaattctagatttaaaatacattgtcacgttcaccacctcaggttttacttctctcctcgcttccaaccaaagaccgtcggtgccggtgattgctttcactccctcagaaaaggtttaccatagcctcaacttagtttggggtattattccctttttaattaacgaagaatttgacacctttgaggatttaatccaacaggcggaggtactactgcgggatagaaaaatggtggaaaagggcgatcagttgctaatcatggcgggaattcccactaaaatacccaggggcactaatttcctcaagattcaccgtatttcttaa

SEQ ID NO: 16513 - protein, 483 aa, Synechocystis sp
MPALINPVKFMRPLSHRTKIVATIGPASSSVEVIRQMVDAGMNVARLNFSHGSYEDHATMVRLLRSVEQEMDTPITLLQDLQGPKIRIGQLPGGEKQLREGEKVSLVPVEIGDRHPGAVGIDYPHLATEAKVGERILLDDGLLEMKVVSIQDPEVICEVVTGGILKSRKGVNLPGLVLTLPSMTTKDKQDLEFGLSQGIDWVSLSFVRKGEDIHTLKQFLAERGHPDLPVIAKIEKPQAIDNLEEIVAVSNGIMVARGDLGVEVNPEKVPRLQKEIIRRCNVRAIPVITATQMLDSMIQNSRPTRAEASDVANAILDGTDAVMLSGESAVGQYPVKSVQMLRKIAEETEVGLHLVNNPPIENTETHALSEALVVIDGILDLKYIVTFTTSGFTSLLASNQRPSVPVIAFTPSEKVYHSLNLVWGIIPFLINEEFDTFEDLIQQAEVLLRDRKMVEKGDQLLIMAGIPTKIPRGTNFLKIHRIS

SEQ ID NO: 16514 - DNA, 1776 bp, Synechocystis sp
  CDS (1)..(1776)
atgcaaacgtctccccttccccgtcgtaccaaaatcgtcgctaccattggccccgcgacccaaagcaaggaagtgctgagacaactgatccaagccggtgctaccactttccgcctcaatttttcccacggagaccacgcttaccaccaacaaagtatccgtttgattcgccagattgcctttgaactgaaccaaccagtgggcattctccaggatttacaggggccaaagattcgggtgggcaaatttctcaatgatgccggctctgtgcaactcaaaaacggtgatccctataccctcaccagtcgcccggtggaatgtacggaaaccattagttccattagctacgaatatttagccgacgaagtaccttctggggcaagaattttgctcgacgacggcaaactggaaatgttggtggaggaagtggacactgttgcccgggatctccactgtcgggtgattgtggggggaaccctttccagcaataaaggggttaattttcccggggtctgcctttccgttaaggccatgaccgataaagataaggaagatttgatgttcgggctggaccaaggggtggactgggtggccctgagttttgttcgtaatccccaggatattgatgagattaaggggttaattgcggcggcagggaaatccgtgccggtaatcgccaaaattgagaagcacgaagcgattaaggatatgcaggcggtgctggaaaaatgtgacggtgtcatggtggcccggggggacttgggggtagaactacccgcagaagatgtacctattttgcaaaagaaactcattgccactgctaaccggttgggcattcctgtcattactgctacccaaatgttggacagtatggtcaacagcccccgacctactagggctgaagtgtccgacgtggccaatgccatcctcgatggtaccgatgcggtgatgctctccaacgaaacggcgatcggtaaatttcccgtggaagcagtggctattatggccaaaattgcggagcgcattgaacaggaagatatcaatccttcccaagcggaagccagtcgcacttctattcccaatgctatttccagcgccgttagccagattgcggaaaccctcaacgcggcggctattatgtctttgactaagaccggatccaccgcccgccatgtgtcaaagttccgccccaaaacccccattctggccgttacgccccatgtggatgtgtcccgtcagttgcagttggtgtggggagttaagcccctgttggtattggatttaccttccaccagccaaacgttccaagccgccattaacgtggcccaggaaaaccattttctccgggatggagatttggtggtgatgaccgccgggacattgcagggagttgccggttcgacggatttaatcaaagtggaagtggtcaaggccattcttggtcggggtgtaggtattggccaaggagctgtaagtggccgggccagggttgccagtcgtccccaggcgatcgcccaatttacccagggagaaattttagtagttccctctaccaacgctgattgtgtggacatgatgcgacgggcggcgggcattatcaccgaagaagaaagcctgactagccatgcggccattattggtttgcggctgggggtgccggtcattgtgggttttaaaggcgctacccaaaagattcgagatggagccattgtcaccatcgatgcccaaaaaggactgatttattccggtgcattacccccggtgtccaaaggatag

SEQ ID NO: 16515 - protein, 591 aa, Synechocystis sp
MQTSPLPRRTKIVATIGPATQSKEVLRQLIQAGATTFRLNFSHGDHAYHQQSIRLIRQIAFELNQPVGILQDLQGPKIRVGKFLNDAGSVQLKNGDPYTLTSRPVECTETISSISYEYLADEVPSGARILLDDGKLEMLVEEVDTVARDLHCRVIVGGTLSSNKGVNFPGVCLSVKAMTDKDKEDLMFGLDQGVDWVALSFVRNPQDIDEIKGLIAAAGKSVPVIAKIEKHEAIKDMQAVLEKCDGVMVARGDLGVELPAEDVPILQKKLIATANRLGIPVITATQMLDSMVNSPRPTRAEVSDVANAILDGTDAVMLSNETAIGKFPVEAVAIMAKIAERIEQEDINPSQAEASRTSIPNAISSAVSQIAETLNAAAIMSLTKTGSTARHVSKFRPKTPILAVTPHVDVSRQLQLVWGVKPLLVLDLPSTSQTFQAAINVAQENHFLRDGDLVVMTAGTLQGVAGSTDLIKVEVVKAILGRGVGIGQGAVSGRARVASRPQAIAQFTQGEILVVPSTNADCVDMMRRAAGIITEEESLTSHAAIIGLRLGVPVIVGFKGATQKIRDGAIVTIDAQKGLIYSGALPPVSKG

SEQ ID NO: 16516 - DNA, 1494 bp, Arabidopsis thaliana (mouse-ear cress)
  CDS (1)..(1494)
atggctatggaacagaggcctaagacgaagatcgtgtgcacactcgggccggcgtccagatctgtcccaatggtcgagaagcttcttatggcggggatgagcgtggctcgcttcaacttttctcatggatcttacgaatatcaccaggagactctcgacaatcttcgtcaggccatgcttaacactggcatgctatgtgctgtcatgctcgacaccaagggaccagagattcgaaccgggttcttaaaggatgggaaacctatccagctcaaacaaggccaagaaatcaccatttcaactgactatgacttgaagggtgatgagaaaactatttgcatgagctacaagaagttggcgcaagatgtgaatccaggcatggtcatactctgtgccgatggtaccatctcgttaaaggtcctttcttgtgacaaagaaaagggcactgtccgttgtcgttgtgagaacacttcaatgcttggtgaaagaaagaacgttaatctccctggtgttgtggttgatctcccaactctaactgaaaaagacaagcaagacattcttgaatggggagttcccaatcaaatcgacatgattgctctgtcttttgtcagaaaaggttcggacttggtacaagttaggaagctacttggaaaacatgctaaaaccatacttctcatgtcaaaggttgaaaaccaagaaggtgtagcgaattttgatgatatcttgataaactcggatgcgtttatgatcgcaagaggtgaccttggaatggagattccaattgagaagatattcttagctcagaaagtgatgatctacaagtgcaatttcatggggaagccagtggttacagcgactcagatgcttgagtctatgatcaaatccccacgaccaacaagagcagaagctactgatgttgcaaatgctgtcctcgatggcacagactgtgtcatgcttagtggtgaaaccgcagctggagcatacccagagcttgctgttcgtacaatggccaagatatgtgtggaagcagagagcacacttgactatggagacatcttcaagaggataatgcttcacgctgcggtccctatgagcccgatggagtcacttgcttcatctgcggtcagaaccgctacttcctcaagagccactcttatgatggtcttgaccagaggaggcagcacggcgaggctggtggctaagtatagaccagggatacccattttgtccgtggtggttcctgaaatcacgtctgactcttttgattgggcgtgtagcaacgaggcaccggcaagacacagtctcatctaccgtggtttagtcccggtgctgtatgctggatcggctagagcctcgatcgacgagtcaacagaagaaactctcgagttcgcgtcagagtatggtaaaaagaagcaactctgcaagaccggagactctgttgtggctctcttccgtacaggtaacgctattgttatcaagatcttgaccgtcaagtga

SEQ ID NO: 16517 - protein, 497 aa, Arabidopsis thaliana (mouse-ear cress)
MAMEQRPKTKIVCTLGPASRSVPMVEKLLMAGMSVARFNFSHGSYEYHQETLDNLRQAMLNTGMLCAVMLDTKGPEIRTGFLKDGKPIQLKQGQEITISTDYDLKGDEKTICMSYKKLAQDVNPGMVILCADGTISLKVLSCDKEKGTVRCRCENTSMLGERKNVNLPGVVVDLPTLTEKDKQDILEWGVPNQIDMIALSFVRKGSDLVQVRKLLGKHAKTILLMSKVENQEGVANFDDILINSDAFMIARGDLGMEIPIEKIFLAQKVMIYKCNFMGKPVVTATQMLESMIKSPRPTRAEATDVANAVLDGTDCVMLSGETAAGAYPELAVRTMAKICVEAESTLDYGDIFKRIMLHAAVPMSPMESLASSAVRTATSSRATLMMVLTRGGSTARLVAKYRPGIPILSVVVPEITSDSFDWACSNEAPARHSLIYRGLVPVLYAGSARASIDESTEETLEFASEYGKKKQLCKTGDSVVALFRTGNAIVIKILTVK

SEQ ID NO: 16518 - DNA, 1795 bp, Glycine max (soybean)
  CDS (62)..(1597)
tgagactgaggttgggtttggaaggcaagggcttgtgttgtcacaatccaagagagaagtaatggcgaacatagacatcgaagggatcttgaagcagcagcagccttatgatgggcgcgttccgaagacgaagatagtgtgtactttgggccctgcttctcgatccgtagaaatgaccgagaagcttctgagggcagggatgaacgttgctcgtttcaatttctctcatggcacccacgactatcaccaggaaaccctcaacaatctcaagactgccatgcacaacactggcatactctgtgccgtcatgcttgacactaagggacctgagattcggactggttttctgaaagatggaaaacctattcaacttaaagaagggcaagaagtcaccataactactgattatgacattaagggggatccggagatgatatccatgagttacaagaagctgcctgtccacttgaagcctggaaataccatactgtgctctgacgggacgattactctcactgtcttgtcttgtgaccctgatgctggtactgttagatgtcgttgtgaaaacactgcaacgttgggtgagagaaaaaatgttaaccttcctggtgttgtggtggatctacccacacttactgagaaggataaggaagacattcttggatggggtgtacccaacaagattgacatgattgctctttcatttgttcgtaaaggctcggatcttgttaatgtccgcaaggttctggggccacatgcaaagaatattcagttgatgtcaaaggttgagaatcaggagggagtcctgaattttgacgaaatcctgcgggagactgatgcattcatggtggcacgtggtgatcttggaatggagatcccagtagaaaagattttcctggcacagaagatgatgatatacaagtgtaatcttgttgggaagccagtggtgactgctacccaaatgcttgaatcaatgataaagtctcccaggccaacccgagctgaagcaactgatgtagctaatgcagttcttgatggaacagattgtgtgatgcttagtggtgaaagtgctgctggggcatacccagaacttgctgtgaaaatcatggctcgcatttgcattgaagcagaatcatcccttgactatggtgccatcttcaaagagatgataaggtctaccccattgcctatgagtccattggagagccttgcatcatctgctgtccgcacagcaaacaaggccaaagcaaaactcattgttgtgctgacacgtggcgggtctacagccaagttagttgccaagtataggccagcggttccaatattgtcggtggtggttccagtgttgagcacggactcatttgattggacctgcagtgatgagacgccagcaaggcacagcctgatatacaggggcttgattcctatactgggcgagggatctgcaaaggctaccgatgcagaatccacagaggtcattctcgaagctgctcttaagtccgcaacagaaagggccctttgtaagcctggtgatgcagttgttgccctgcatcgtattggagctgcctctgtcataaagatctgcatagtcaaataatgcatgctcaactcaacgtgccgccaactaatgcagggttatgttttgccttttatttctttctttctgctgtttatccgtatcataaaatggaggatttagttactagctgtagatcgagtgttttttggtatactctgtttatattgcggagtacttctaaatcagattatcatggaaataatactcttacctttt

SEQ ID NO: 16519 - protein, 511 aa, Glycine max (soybean)
MANIDIEGILKQQQPYDGRVPKTKIVCTLGPASRSVEMTEKLLRAGMNVARFNFSHGTHDYHQETLNNLKTAMHNTGILCAVMLDTKGPEIRTGFLKDGKPIQLKEGQEVTITTDYDIKGDPEMISMSYKKLPVHLKPGNTILCSDGTITLTVLSCDPDAGTVRCRCENTATLGERKNVNLPGVVVDLPTLTEKDKEDILGWGVPNKIDMIALSFVRKGSDLVNVRKVLGPHAKNIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATERALCKPGDAVVALHRIGAASVIKICIVK

SEQ ID NO: 16520 - DNA, 2022 bp, Ricinus communis (castor bean)
  CDS (46)..(1527)
cgggtgggtatggtaccacaagtggttatggtcccactgcaggatatggcggtggtggtaaaggatttggaagaagcagtgagagtggtagttttggcagtgttaagggatatggaagtggtggtggtgctggtaacggcagtcatgggagtagtaggggatatgaatgtagcgagaattaatatgtgtcatggaacacgtgagtggcacaagagtgtaattgaacgtgttaggagattgaatgaagagaaaggttttgctgttgctattatgatggatactgaaggtagtgaaattcatatgggtgatttaggtggtgcttcttctgctaaagctgaggatggtgaaatctggacttttagtgtcagagcctatgattctcctcgcccagagcgcaccatcaatgttaactatgacggttttgctgaggatgtgaaagttggggatgagctacttgtggatggtggaatggttaggtttgaggtgattgagaaaattggcccagatgtcaagtgccgatgtactgatcctggactgttattaccacgagctaatttgactttctggagggatgggagtcttgttagagaacgtaatgcaatgcttccaacaatttcctctaaggattggttagatattgactttggtatcgcagagggtgttgattttattgcaatatcttttgtcaagtctgctgaagtgattaatcatcttaaaagctacattgctgcaaggtctcgtgacagtgatatagctgtcattgctaagatagagagtattgactcattgaagaacttagaagagatcattcgagcatcagatggagctatggtagcaagaggagatctgggtgctcagataccattggaacaggttccatcagcccagcaaaacattgttcaggtctgcaggcagctaaataagccagtcattgttgcttctcagttacttgaatcaatgattgaataccctacacccaccagagcagaagtggctgatgtttctgaagctgttaggcaacgggctgatgctttgatgctctctggtgagtcagccatgggccagtaccccgagaaggcattggctgttctcagaagtgtcagtgtgagaattgagaagtggtggagagaagagaagcaccatgaagcaatggaactcccagcaattggatccacttattccgactctatttcagaggagatttgcaactctgctgccaagatggcgaacaacttgggggtggatgcactttttgtgtatacaaaagatggtcacatggcatctctcttgtctcgttgccggcctgactgcccaatctttgcttttacaactaccacatctgtacggagacgcctgaatttacagtggggcctgatacccttccgcctgagctttgctgatgatatggaaagcaaccttaacaaaaccttctctttgctcaaggctagaggaatgatcaaatcgggtgatcttgttatagctgtttcagacatgttacagtccatccaagttatgaatgttccttagaatttattttagatcgctgacgccatttcaacccttcatctagactgccttatctattatttgctatgtccatcgttactagttctgcaatttggttactgctggaaagatttgctggaaaggaaacggagagtaactgtgagttcatcatgttttcacctggctttatgcttgttatttcaaggagagcctcctatttttcaaaatggttggttgggattattccatttttggcaggtaatcacaattttacccagtgacttcactttgcttaggttgagagtgatttattggttaatgtaccaaagaagatagagctgtaattacaaacagtatgctgtgactagtatgctatttaccagcttgaattaatggttcaacaaatgcttagactaagcatgatcaacataaaaaaatgtcagcagattctttttaagctgccatgttgctacatggtactttgttcttcattctactaaaacaatgagtatgata

SEQ ID NO: 16521 - protein, 493 aa, Ricinus communis (castor bean)
MAVVVKDLEEAVRVVVLAVLRDMEVVVVLVTAVMGVVGDMNVARINMCHGTREWHKSVIERVRRLNEEKGFAVAIMMDTEGSEIHMGDLGGASSAKAEDGEIWTFSVRAYDSPRPERTINVNYDGFAEDVKVGDELLVDGGMVRFEVIEKIGPDVKCRCTDPGLLLPRANLTFWRDGSLVRERNAMLPTISSKDWLDIDFGIAEGVDFIAISFVKSAEVINHLKSYIAARSRDSDIAVIAKIESIDSLKNLEEIIRASDGAMVARGDLGAQIPLEQVPSAQQNIVQVCRQLNKPVIVASQLLESMIEYPTPTRAEVADVSEAVRQRADALMLSGESAMGQYPEKALAVLRSVSVRIEKWWREEKHHEAMELPAIGSTYSDSISEEICNSAAKMANNLGVDALFVYTKDGHMASLLSRCRPDCPIFAFTTTTSVRRRLNLQWGLIPFRLSFADDMESNLNKTFSLLKARGMIKSGDLVIAVSDMLQSIQVMNVP

SEQ ID NO: 16522 - DNA, 1689 bp, Caenorhabditis elegans
  CDS (1)..(1689)
atggcatcatctcaggtacaagacgtcgagctcgccgaagccggagacaccatcaatgaggtaaaggccagcagtgccagcggaagaggtcgtcttgctcgccgaatgaccatcgaagaggagcatgctggtgattatttcaagcaagagcagaagctcgctgctgttccagccactacccatatggagcatttgtgtcgtttggacattcgtgaggctccacatctcgttcgtcagaccggaattatttgcacaattggaccagcttgtgccagtgttgaaatgcttcaaaaattgattctcaatggaatgaacattgctcgtctcaacttttcccatggatctcatgagtaccatgccggaaccatcgccaacgttcgtgaagctgccgattcattctctgacaagcgtgtcattggaattgctttggacacgaagggacctgaaatccgtactggacttcttgccggcggtgcttctgctgaaattgagcttgcacgaggagcatcaatccgtttgactactgatccacacttttctgaatcaggaactgctgtcaatctttttgttgattacaagaacattgccaaagttctttcggttggatcccgtgtctacattgatgacggacttatctcattgattgtcgaagaattgcaaactgacgctgtcatttgctctgttgaaaatggtggaatgttgggaagcagaaagggagtcaatcttccaggaactatcgttgatttgccagctgtttccgagaaggactgtaaggatttgcagtttggtgtggaacaaggtgttgatatcatctttgcttcattcatccgaaacgctgaaggaattcgtacgattcgtaaagttctcggagagaaaggaaagaagattaagattattgcaaagattgagaatcaagaaggagttgataatgctgatgaaattatctctgaatctgatggagttatggttgctcgtggagatctcggtatcgaaattccagccgagaaggtgttccttgcacaaaagatgctcatctccaagtgtaatcgtgctggaaaacctgtcatttgtgcaactcagatgcttgaatcgatggttcacaagccacgtccaaccagagctgaaggatcagatgttgccaatgctgtgcttgacggagctgattgtgtgatgctttctggagagactgctaaaggagaatatccagttgatgcactcaagatcatgcattatatatgcaaagaagccgaagcagcagtttatcatcgtcgtctcttcgatgaacttcttcaaaacacacaaaaaccaactgacatgtctcatactattgctatcgctgccacatctgcagctgcatcgtgccatgcttcagcaattcttctcattaccaccactggacgctcggcaatccaatgctctcgctacaagccagccgtcccaattctgacaatctcgagagacgttgctgtgtgccgtcagcttcatctttacagaggagttttcccagttcattatccagctgaacgtgctgccgattggccaactgatgttgataacagaatcaaccatgctatcgccatcggaaaggatcgtggattcattcacaagggtgacttcttggttgttgtcactggatggagacagggagccggagctaccaacactcttcgtatcatcaccgccgaataa

SEQ ID NO: 16523 - protein, 562 aa, Caenorhabditis elegans
MASSQVQDVELAEAGDTINEVKASSASGRGRLARRMTIEEEHAGDYFKQEQKLAAVPATTHMEHLCRLDIREAPHLVRQTGIICTIGPACASVEMLQKLILNGMNIARLNFSHGSHEYHAGTIANVREAADSFSDKRVIGIALDTKGPEIRTGLLAGGASAEIELARGASIRLTTDPHFSESGTAVNLFVDYKNIAKVLSVGSRVYIDDGLISLIVEELQTDAVICSVENGGMLGSRKGVNLPGTIVDLPAVSEKDCKDLQFGVEQGVDIIFASFIRNAEGIRTIRKVLGEKGKKIKIIAKIENQEGVDNADEIISESDGVMVARGDLGIEIPAEKVFLAQKMLISKCNRAGKPVICATQMLESMVHKPRPTRAEGSDVANAVLDGADCVMLSGETAKGEYPVDALKIMHYICKEAEAAVYHRRLFDELLQNTQKPTDMSHTIAIAATSAAASCHASAILLITTTGRSAIQCSRYKPAVPILTISRDVAVCRQLHLYRGVFPVHYPAERAADWPTDVDNRINHAIAIGKDRGFIHKGDFLVVVTGWRQGAGATNTLRIITAE

SEQ ID NO: 16524 - DNA, 1548 bp, Caenorhabditis elegans
  CDS (1)..(1548)
atgtatcaggacgatcatatcggttcagagcattcatctgctactactaatatttctcatttatgcggacttcggatctcggagagacctcaaaaaacaagaaaaactggtgttatttgcactatcggaccagcgtgtagtgatgtagagacactgagaaaaatgataaacactggaatgaatattgccagattgaatttctcacatggaactcacgaggcacatgctgcaacaatcaagacaatccgtgaagctgctgaaaatgctccattcccggtcgcaattgctcttgacaccaaaggacctgaaattcgtaccggaatgtttgccaataatatgaaagaagttcaattggaaaatgggaaaagtgttcgagtttccacagatccatctatggaatttgctgcaacatcttctcatatttatgctgactacagaaatcttccaaaagttgttcaacctggttcaagaatctatattgatgacggattgatttctttaatcgtcgaaagttgtgaagaaacagcagttatatgtacaattgaaaatggaggagctcttggaacacggaaaggtgttaatcttcctggaactattgttgatcttcctgcagtcacatcaaaagatatcgaagatttattatttggagttgagcaaggtgttgatattatttttgcatcattcatcagaaatgccgacggaattcataaaattcgacaagttcttggagaaaaaggaaagcatatttacataattgcaaaaatcgaatcagaagatggagtcactaattgcgatgaaatcatcgaagcatccgatggagtaatggttgcaagaggagatcttggaattgaaattcctgcggagaaagtattcctcgcccagaaaatgctcattgccaaatgtaatctggcgggaaaacctgtgatatgtgcaacccagatgctcgagagcatgatcaccaaacctcgtccgactagagcagaatgcagtgacgtggcaaacgctgtcttggatggagttgactgtgtgatgttgagtggagaaactgcaaaaggagattatccagttgaagcattggcgattatgcataatatctgcaaagaagcagaatctgcattcttccatatgaaacattttgaagagcttattcttcataccaagaaaccaactggaatgactcatacaactgcaattgcagctgtttctgcaacaatcacatgccgtgctgtcgctattattctcatcacaacaacgggaaaaaccgcccgtctatgttcccgataccgtccaccagttccaattattactgtttctcgtgatgaacgaatctctcgtcaacttcatcttcacagaggaatctttcctgtttactatccaaagggacgtattgatgaatgggatgttgatgttgaggaacgtgtgcaatacggagtaaatcttggtaagacacgtggattcattcatcttggagatccacttattgtgatcactggatggaagcaaggagctggattcacaaacaccatgagaattgtagttgccacctaa

SEQ ID NO: 16525 - protein, 515 aa, Caenorhabditis elegans
MYQDDHIGSEHSSATTNISHLCGLRISERPQKTRKTGVICTIGPACSDVETLRKMINTGMNIARLNFSHGTHEAHAATIKTIREAAENAPFPVAIALDTKGPEIRTGMFANNMKEVQLENGKSVRVSTDPSMEFAATSSHIYADYRNLPKVVQPGSRIYIDDGLISLIVESCEETAVICTIENGGALGTRKGVNLPGTIVDLPAVTSKDIEDLLFGVEQGVDIIFASFIRNADGIHKIRQVLGEKGKHIYIIAKIESEDGVTNCDEIIEASDGVMVARGDLGIEIPAEKVFLAQKMLIAKCNLAGKPVICATQMLESMITKPRPTRAECSDVANAVLDGVDCVMLSGETAKGDYPVEALAIMHNICKEAESAFFHMKHFEELILHTKKPTGMTHTTAIAAVSATITCRAVAIILITTTGKTARLCSRYRPPVPIITVSRDERISRQLHLHRGIFPVYYPKGRIDEWDVDVEERVQYGVNLGKTRGFIHLGDPLIVITGWKQGAGFTNTMRIVVAT

SEQ ID NO: 16526 - DNA, 1437 bp, Streptomyces coelicolor
  CDS (1)..(1437)
atgcgccgagcaaagatcgtctgcactcttgggcccgccaccgactcgtacgaccagatcaaggacctggtcgacgccggaatggacatcgcccgcttcaatttcagccacggcacccacgccgaacacgaagagcgctaccaccgtgtccgcaaggcgtccgacgagaccggccgcagcgtcggtgccctcgccgaccttcagggcccgaagatccgcctcggccacttcggtgaagggcccgtactccttgaacgcggcgacagcttcaccatcaccgtcgaggagggcgtcgagggcgaccgctacatctgcggcaccacctacgcgggcctggccgaggacgtcacccccggtgagcgcgtcctcgtcgacgacggcaaggtctgcctggaggtgaccggggtcgacgggacccgggtgcggacgcgggtgatcgagggcggcatggtctccgaccacaagggcctcaacctgcccggcgtcgcggtgtccgtgcccgccctgtcgaagaaggacgaggacgacctgcgctgggcgctgcgggccggcttcgacgtggtcgccctctccttcgtccgcagcggacgcgacatcctcgacgtgcaccgcatcatggacgaggagggccgccgcctccccgtcatcgccaaggtcgagaagccgcaggccgtggagaacatcgaggacatcgtcgcggccttcgacggcatcatggtcgcccggggcgacctcggcgtcgagatgcccctggaacaggtgccgaccgtccagaagcgcgcggtgaagctggccaagcgcaacgccaagccggtcatcgtcgccacccagatgctcgactcgatgatcgacaacgcccgccccacccgcgcggaggcctccgacgtcgccaacgccgtcatcgacggcaccgacgccgtgatgctctccggcgagaccagcgtcggcaagcaccccaccgacaccgtgcgcacgatggcccggatcgtcgaagcggccgaggaggacatcctcgccaagggactccccccgctgaccgaacggaacaagccccgcacccagggcggtgcggtcgcccgcgccgccgccgagatgggcgacttcctcggcgccaagttcctggtcgccttcacccagtccggcgacacggtccgccgcctctcccgctaccgctcgcccattccgctgctcgccttcaccccggaaccggcgacccgctcccagctgagcctgacctggggtgtggagaccttcctcggtccgcacgccgactccacggacgcgatggtcgaccaggtggacgagcttctcacccgctacggacgctgcgaaaagggcgacgtcgtggtcatcacggccggctcaccgccgggggtgtccggcacgacgaacctggtgcgtgtgcaccacatcggggaggacgacattcccaagtga

SEQ ID NO: 16527 - protein, 478 aa, Streptomyces coelicolor
MRRAKIVCTLGPATDSYDQIKDLVDAGMDIARFNFSHGTHAEHEERYHRVRKASDETGRSVGALADLQGPKIRLGHFGEGPVLLERGDSFTITVEEGVEGDRYICGTTYAGLAEDVTPGERVLVDDGKVCLEVTGVDGTRVRTRVIEGGMVSDHKGLNLPGVAVSVPALSKKDEDDLRWALRAGFDVVALSFVRSGRDILDVHRIMDEEGRRLPVIAKVEKPQAVENIEDIVAAFDGIMVARGDLGVEMPLEQVPTVQKRAVKLAKRNAKPVIVATQMLDSMIDNARPTRAEASDVANAVIDGTDAVMLSGETSVGKHPTDTVRTMARIVEAAEEDILAKGLPPLTERNKPRTQGGAVARAAAEMGDFLGAKFLVAFTQSGDTVRRLSRYRSPIPLLAFTPEPATRSQLSLTWGVETFLGPHADSTDAMVDQVDELLTRYGRCEKGDVVVITAGSPPGVSGTTNLVRVHHIGEDDIPK

SEQ ID NO: 16528 - DNA, 1530 bp, Schizosaccharomyces pombe
  CDS (1)..(1530)
atgtcctcttctgctgtctctcctaagcaatgggtcgccggcctcaacagcgagcttgatatccccgctgtcaaccgtcgtacctccatcatttgcaccattggtcccaagtccaacaacgttgagaccttgtgcaagctccgtgatgctggtatgaacattgttcgtatgaacttctctcacggttcctacgaataccaccaatccgtcattgacaatgcccgtaaggcctctgccaccaaccctctcttccccttggccattgccttggatactaagggacctgagattcgtactggtctcaccgttggcggtactgactaccccatctcctctggtcacgagatgatcttcaccaccgacgatgcttatgccgagaagtgtaacgacaaggtcatgtacattgactacaagaacatcaccaaggtcattcaacctggccgtatcatctacgttgatgatggtatcctttccttcactgtcatcgagaaggttgatgacaagaatttgaaggtccgtgtcaacaacaacggtaagatctcttccaagaagggtgtcaacttgcctaagactgatgtcgatttgcccgctttgtccgagaaggacaaggccgatctccgcttcggtgtcaagaacggtgtcgacatgatctttgcttccttcatccgtcgtgctgaggacgttatccacatccgtgaagttttgggtgaggagggtaagaacatcaagatcatctgcaagatcgagaaccaacaaggtgttaacaactttgactctatccttgacgttaccgacggtatcatggttgcccgtggtgacttgggtattgaaatccctgcctctcaagttttcgtcgcccaaaagatgatgattgccaagtgcaacatcgctggtaagcccgttgcttgtgccactcaaatgcttgagtccatgacctacaaccctcgtcctactcgtgccgaggtttccgatgttggtaacgccgttctcgatggtgctgacttggtcatgctttccggtgagactaccaagggttcttaccccgttgaagccgttacctacatggctgagactgcccgtgttgctgaggcttccatcccttacggcagcctttaccaagagatgttcggcctcgtccgtcgtcctcttgagtgtgctaccgagaccactgctgtcgctgccatcggtgcctccattgagagtgatgccaaggccatcgttgtcttgtccaccagcggtaacactgctcgtctctgctccaagtaccgtccttctatccccattgttatggttactcgttgccctcaaagagctcgtcaatctcacctcaaccgtggtgtctaccccgtcatctacgagaaggagcctctttctgactggcaaaaggatgttgacgctcgtgttgcctacggttgccaacaagcttacaagatgaacatcctcaagaagggtgacaagatcattgtccttcaaggtgccgttggtggtaagggtcacacctccatcttccgtcttaccgttgccgagtaa

SEQ ID NO: 16529 - protein, 509 aa, Schizosaccharomyces pombe
MSSSAVSPKQWVAGLNSELDIPAVNRRTSIICTIGPKSNNVETLCKLRDAGMNIVRMNFSHGSYEYHQSVIDNARKASATNPLFPLAIALDTKGPEIRTGLTVGGTDYPISSGHEMIFTTDDAYAEKCNDKVMYIDYKNITKVIQPGRIIYVDDGILSFTVIEKVDDKNLKVRVNNNGKISSKKGVNLPKTDVDLPALSEKDKADLRFGVKNGVDMIFASFIRRAEDVIHIREVLGEEGKNIKIICKIENQQGVNNFDSILDVTDGIMVARGDLGIEIPASQVFVAQKMMIAKCNIAGKPVACATQMLESMTYNPRPTRAEVSDVGNAVLDGADLVMLSGETTKGSYPVEAVTYMAETARVAEASIPYGSLYQEMFGLVRRPLECATETTAVAAIGASIESDAKAIVVLSTSGNTARLCSKYRPSIPIVMVTRCPQRARQSHLNRGVYPVIYEKEPLSDWQKDVDARVAYGCQQAYKMNILKKGDKIIVLQGAVGGKGHTSIFRLTVAE

SEQ ID NO: 16530 - DNA, 1533 bp, Arabidopsis thaliana (mouse-ear cress)
  CDS (1)..(1533)
atggagatgttacttggtggacaagcaaccaatggagctcttcgttcaaagacgaagataatttgtactcttggaccggtttcaagatcggtggagatgattgagaagcttctcaaggctggtatgaacgtagcccggttcaatttctctcatggttctcactcttaccatcaagaaactctcgataatctccgaaccgccatggacaacactggtattctctccgccgtcatgctcgacacaaagggtcctgagatacgaaccgggtttctcaaagaaggcaaaccgatacagctaaaccaaggtcaagagatcaccatctcaattgattacatgatagaaggagattcaaacgttatctccatgagctacaagaaacttgcagaagacgtcaaacctggtgatgtgattctctgttcagacggcacaatctctttaactgtcttgtcctgtgacaagtctttcggtcttgttcgttgccgttgcgagaactctgcaattctaggagaaagaaaaaacgttaatcttcctggaattgtagttgatctcccaacacttactgagaaagataaagaagatatcatccaatggggagttccgaacaaaatcgacatcatcgctctttcttttgttcgtaaaggatctgacctaactgaagttaggaggttacttggagaacactcaaagaacatcatgctcatgtcaaaggtggagaatcaagaaggggtcatgaattgtgaaaagattctggagaattctgatgctttcatggtggctagaggagatcttggaatggagattccgatcgaaaagatgttccttgctcagaaaacaatgatcaagatggctaatgctcttgggaaaccagttgtcacagccacacagatgcttgaatccatgacagtatctcctcgtccgactagagctgaagccactgacgttgcaaacgctgttcttgacgggacagactgcgttatgcttagtggagaaaccgctgctggagctcaccctgaggctgccgtgctaacaatgtcaaggatctgtaaagaagcagaggatttcatcgattacgacattctccacaagaaaaccctaggaatggtttcgttaccgttatctccgatcgagagcttagctgcttcagttgtttcgacggcacagagtgtttttgcgtcggcgatcgttgttctcaccaaaggcggttacacggcggagcttgtggctaaatacaggccgagcgttccgattttgtcagtgattgtgccagagattgctcaagggaatgatatggagatgtcgtgctcagactcggtggctcatgcggcgagacgtggtttgatttaccgtaggattattccggtggtggcgacgggatcttcggctagggattcaaacaaagatgcaacggaggagatgattaatttggctatcggattcgcgaagacgaagggaatttgcaagaatggagattcgattgtggcgttgcacaagattgatggttcctctgttgttaagatagtgaccgtggagtaa

SEQ ID NO: 16531 - protein, 510 aa, Arabidopsis thaliana (mouse-ear cress)
MEMLLGGQATNGALRSKTKIICTLGPVSRSVEMIEKLLKAGMNVARFNFSHGSHSYHQETLDNLRTAMDNTGILSAVMLDTKGPEIRTGFLKEGKPIQLNQGQEITISIDYMIEGDSNVISMSYKKLAEDVKPGDVILCSDGTISLTVLSCDKSFGLVRCRCENSAILGERKNVNLPGIVVDLPTLTEKDKEDIIQWGVPNKIDIIALSFVRKGSDLTEVRRLLGEHSKNIMLMSKVENQEGVMNCEKILENSDAFMVARGDLGMEIPIEKMFLAQKTMIKMANALGKPVVTATQMLESMTVSPRPTRAEATDVANAVLDGTDCVMLSGETAAGAHPEAAVLTMSRICKEAEDFIDYDILHKKTLGMVSLPLSPIESLAASVVSTAQSVFASAIVVLTKGGYTAELVAKYRPSVPILSVIVPEIAQGNDMEMSCSDSVAHAARRGLIYRRIIPVVATGSSARDSNKDATEEMINLAIGFAKTKGICKNGDSIVALHKIDGSSVVKIVTVE

SEQ ID NO: 16532 - DNA, 2139 bp, Arabidopsis thaliana
  CDS (135)..(1925)
agaaaaaaaaaaaaaaatccaaattcaacactctcacacttcgatatctccgccttcattctcctcagagccaactgtcctgagatttcgatttcgatttctccgatctctcttcctccgtcgccggcgaaaccatgtctcagtctattcaattctccactccttcacacactcctcaccttctccatctccctcactcacaattcaaccgtcctctctcctctatctccttccgtcgcttccctctaacaaccatcaaatacacttccatcagagcctcctcgtcatcatctccttcaccggatctcgattcatcgtcctcatcatcatcctcgcaagtacttctctcacctaacggtactggtgctgtgaagtctgatgagagatccgttgtcgctacggcggttacgactgatacgtctgggattgaggttgatactgtgacggaagctgagcttaaggagaatggatttagaagtacgaggaggacgaagctgatctgtacgatcggaccggcgacttgtggatttgagcagcttgaggcgcttgctgtgggaggtatgaatgtggcaaggcttaatatgtgtcacggtacgcgtgattggcaccgcggtgtgattcgtagtgttcggaggcttaatgaggagaaaggctttgcggttgctattatgatggatactgaaggtagtgagattcatatgggagatcttggtggtgaagcttcagctaaagcagaggatggtgaggtttggactttcactgttagagcttttgattcttctcgtcctgaacgtaccattagtgttagctacgatggtttcgctgaagatgtaagagttggggatgaacttttggttgatggtgggatggtgagatttgaagtgattgagaagattggtcctgatgttaagtgtctatgtaccgatcctggattgttgcttcctcgagctaacttgacgttttggagagatggaagtcttgtacgagagcgtaatgccatgcttccaacaatttcttccaaggactggttggatattgattttggaattgctgaaggtgtggatttcattgctgtatcgtttgtcaagtcggctgaagtcattaatcaccttaaaagttatcttgctgctcgttcccgtggaggggaaattggagtgattgcaaagatcgagagtatcgattcactgaccaatttggaagaaattattctagcatcagatggggccatggttgcaagaggagatctgggagctcagatacctcttgagcaagttccagcagctcaacagagaatcgtccaagtatgcagagctcttaacaaacccgtcattgtcgcttcacagctattggagtccatgattgagtacccaactccaaccagagcagaagttgccgacgtgtctgaagcagtaagacaaagatcagatgcattgatgctctctggagaatcagctatgggacaattcccagacaaggcgctcacggttctaaggactgtcagtttaagaatcgagagatggtggagggaagagaaacgccatgagtctgtaccgcttcaagccataggctcttcattttcagacaaaatctcagaagagatctgtaactcagctgctaaaatggctaacaatcttggagtggacgcggttttcgtttacacaacgagcggacacatggcatcactggtctcccgatgtcgcccggactgcccgatctttgctttcacaaccacaacctcagtgagaagacgcttaaacctacaatggggacttatcccattccgtctcagcttctcagacgacatggaaagcaacttgaacaaaacattctcgttactgaaatcaagaggtatgatcaaatctggtgacctcgtgatcgcagtctcggacatgctgcaatcaatccaggtaatgaacgtcccgtaattctctctctttatacaatttcgcaatcccgcaaaagagtgttttgtttcctacttttgttactgtttttagactactcttacattagattccagaggcatcatcatcttcggtttgttaacaacagtaatgtgtaagctttgtttgtagtgtgtactgtttgtttttggttttcaataatatcagtaatcttattcaaatattcgattctatc

SEQ ID NO: 16533 - protein, 596 aa, Arabidopsis thaliana
MSQSIQFSTPSHTPHLLHLPHSQFNRPLSSISFRRFPLTTIKYTSIRASSSSSPSPDLDSSSSSSSSQVLLSPNGTGAVKSDERSVVATAVTTDTSGIEVDTVTEAELKENGFRSTRRTKLICTIGPATCGFEQLEALAVGGMNVARLNMCHGTRDWHRGVIRSVRRLNEEKGFAVAIMMDTEGSEIHMGDLGGEASAKAEDGEVWTFTVRAFDSSRPERTISVSYDGFAEDVRVGDELLVDGGMVRFEVIEKIGPDVKCLCTDPGLLLPRANLTFWRDGSLVRERNAMLPTISSKDWLDIDFGIAEGVDFIAVSFVKSAEVINHLKSYLAARSRGGEIGVIAKIESIDSLTNLEEIILASDGAMVARGDLGAQIPLEQVPAAQQRIVQVCRALNKPVIVASQLLESMIEYPTPTRAEVADVSEAVRQRSDALMLSGESAMGQFPDKALTVLRTVSLRIERWWREEKRHESVPLQAIGSSFSDKISEEICNSAAKMANNLGVDAVFVYTTSGHMASLVSRCRPDCPIFAFTTTTSVRRRLNLQWGLIPFRLSFSDDMESNLNKTFSLLKSRGMIKSGDLVIAVSDMLQSIQVMNVP

SEQ ID NO: 16534 - DNA, 1572 bp, synthetic construct
  CDS (1)..(1572)
atggccgccagctcttccctcgaccacctgagcaaccgcatgaagttggagtggcactccaagctcaacactgagatggtgccctccaagaacttccgccgcacctccatcatcggaaccatcggccccaagaccaactccgtggagaagatcaactctctccgcactgccggtcttaacgttgttcgcatgaccttctcccacggttcttatgaggaccaccaatctgttatcgacaacgcccgcgaggccgccaagacccaggtcggacgtcctctcgccattgctcaaggacccgagatccgtaccggaaacacccccgatgataaggatatccctatcaagcagggccacgagctcaacatcaccaccgacgagcaatatgccaccgcctccgacgacaagaacatgtacctcgactacaagaacatcaccaaggtgatctctcctggcaagctcatctatgttgatgacggtatcctttccttcgaggtcctcgaagtcgtagatgacaagaccatccgcgtccggtgcttgaacaacggcaacatctcttcccgcaagggtgttaacttgcccggcactgacgttgacctccccgccctttccgagaaggacattgccgatctcaagttcggtgttaggaacaaggtcgacatggtcttcgcttctttcatccgccgcggtagcgacattcgccacatccgtgaggttctgggtgaggagggcaaggagatccagatcattgccaagattgagaaccagcagggtgtcaacaacttcgacgagatcctcgaagagactgacggtgtcatggttgcccgtggtgaccttggtatcgagatccccgcccccaaggtcttcatcgcccagaagatgatgatcgccaagtgtaacatcaagggtaagcccgtcatctgtgccactcagatgctcgagtccatgacatacaaccctcgtcctactcgtgccgaggtgtccgatgttgccaacgccgtccttgacggtgccgactgtgtcatgctgtcgggagagaccgccaagggtaactaccccaacgaggccgtcaagatgatgtccgagacctgcctgctcgccgaggttgccatcccccacttcaatgtgttcgatgagctccgcaaccttgctcctcgccccaccgacactgtcgagtccatcgccatggctgccgttagcgccagtctggaactcaacgctggtgccattgtcgtcttgactaccaggggtaaaactgctcgctacctttccaagtaccgccccgtctcgcccattgtcatggttacccgtaaccccgctgcctcccgggactctcacctgtaccgtggtgtctggcccttcctcttccccgagaagaagcccgacttcaacgtcaaggtctggcaggaggatgttgaccgccgtctcaagtggggtatcaaccacgctcttaagctcggcatcatcaacaagggtgacaacatcgtctgtgtccagggatggcgcggcggtatgggccacaccaacaccgtccgtgtggtccctgctgaggagaaccttggcctggctgagtaa

SEQ ID NO: 16535 - protein, 523 aa, synthetic construct
MAASSSLDHLSNRMKLEWHSKLNTEMVPSKNFRRTSIIGTIGPKTNSVEKINSLRTAGLNVVRMTFSHGSYEDHQSVIDNAREAAKTQVGRPLAIAQGPEIRTGNTPDDKDIPIKQGHELNITTDEQYATASDDKNMYLDYKNITKVISPGKLIYVDDGILSFEVLEVVDDKTIRVRCLNNGNISSRKGVNLPGTDVDLPALSEKDIADLKFGVRNKVDMVFASFIRRGSDIRHIREVLGEEGKEIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGNYPNEAVKMMSETCLLAEVAIPHFNVFDELRNLAPRPTDTVESIAMAAVSASLELNAGAIVVLTTRGKTARYLSKYRPVSPIVMVTRNPAASRDSHLYRGVWPFLFPEKKPDFNVKVWQEDVDRRLKWGINHALKLGIINKGDNIVCVQGWRGGMGHTNTVRVVPAEENLGLAE

SEQ ID NO: 16536 - DNA, 1554 bp, Corynebacterium glutamicum
  CDS (101)..(1534)
cagaggcgtagaacattgtctgttcacactctgggtcgcaagattcatcgagaattaatggtagtacctgtggcttgagggggaatgacgtactaggcttatgggcgtggatagacgaactaagattgtatgtaccctaggcccagcggtggctagtgcagatggaattctgcgtttggtagaagacggcatggatgttgctcgcctcaacttctcccatggtgaccacccagatcatgagcaaaactacaagtgggtccgcgaggcggcggagaagactggccgtgcagtcggtattctcgcagacctccaaggaccgaagatccgtcttggccgtttcactgacggcgcaaccgtgtgggaaaacggcgagaccattcggatcaccgttgacgatgtagagggaacgcacgatcgtgtgtccaccacctacaagaatctggcaaaagacgcgaagccaggcgaccgcctgctcgttgatgacggcaaggttggcctcgtctgcgtttccgtcgaaggtaacgacgtcatctgtgaggttgttgagggcggaccagtctccaacaacaagggtgtttccctgccaggtatggatatttccgtacctgcactgtccgaaaaggatatccgtgacctgcgcttcgccctgaagctcggcgtggactttattgcactgtccttcgtacgttccccagcagatgctgaactcgttcacaagatcatggacgaagaaggtcgtcgtgttcctgtgatcgccaagctggaaaagccagaggctgtcacctccctcgagccaatcgtgttggcattcgacgccgtcatggttgctcgtggtgacctcggcgttgaggttcctctggaggaggttccactggttcagaagcgcgcaatccagattgcccgtgagaacgcaaagccagttatcgtggcaacccagatgctggattccatgattgagaactcccgcccaacccgtgcggaagcttctgacgtggcaaacgctgtgctcgatggcgcagatgctgtcatgctttctggtgaaacttcagtgggcaaagatccgcacaacgttgtgcgcaccatgtctcgcattgttcgcttcgctgaaaccgacggtcgcgtcccagacctgacccacatccctcgcactaagcgtggcgttatttcctactctgcacgtgatatcgccgagcgcctcaacgctcgtgcattggttgcgttcaccacctctggtgataccgcaaagcgtgtggctcgtctgcacagccacctgccactgctcgtgttcactccaaatgaggcagttcgctctgagctggcgctgacctggggtgcaaccaccttcctgtgtccacctgtcagcgataccgatgacatgatgcgcgaagtcgaccgtgctcttttagcaatgcctgagtacaacaagggtgacatgatggttgttgttgcaggttcccctcctggtgttaccggtaacaccaacatgattcacgtccaccttcttggtgacgacacaaggattgcaaagctctaatcgcttaaatctttcaaaaa

SEQ ID NO: 16537 - protein, 477 aa, Corynebacterium glutamicum
MGVDRRTKIVCTLGPAVASADGILRLVEDGMDVARLNFSHGDHPDHEQNYKWVREAAEKTGRAVGILADLQGPKIRLGRFTDGATVWENGETIRITVDDVEGTHDRVSTTYKNLAKDAKPGDRLLVDDGKVGLVCVSVEGNDVICEVVEGGPVSNNKGVSLPGMDISVPALSEKDIRDLRFALKLGVDFIALSFVRSPADAELVHKIMDEEGRRVPVIAKLEKPEAVTSLEPIVLAFDAVMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRVARLHSHLPLLVFTPNEAVRSELALTWGATTFLCPPVSDTDDMMREVDRALLAMPEYNKGDMMVVVAGSPPGVTGNTNMIHVHLLGDDTRIAKL

SEQ ID NO: 16538 - DNA, 2264 bp, Bacillus subtilis
  CDS (258)..(2012)
ttgggccatatccagcgcggaggttctccgagtgctgctgaccgtgtgttagcaagccgttctcgcgcatatgcagttgaactgctgcttgaaggaaaaggcggaccgtgtgtaggtatacaaaacaataagcttgtagaccatgatattatagaaatacttgagacaaaacacacagttgagcaaaacatgtatcagctttcaaaagaactgtctatctaatgtgcagctgaagatttcagaaggaagtgaaccaaatgagaaaaactaaaattgtttgtaccatcggtccggcaagtgaaagtattgaaatgcttacgaaattaatggagtcaggaatgaacgtggctcgattaaacttttctcacggagattttcaggagcacggtgcaagaattaaaaatatccgcgaggcagctgaaaaacttggcaagaacgttggaattctgcttgatacaaagggtcctgaaatccgcacacatacaatggaaaacggttccatagagctgaacgcaggaagcaaactcgtaataagcatgacggaggtgataggaacaccagataaaatttcagtgacatatgaaggtttagtccatgacgttaacaaaggttcaacgattctgttagatgacggccttatcggtcttgaggtacttgatgtagatgccgtaaaacgcgaaatcaaaacaaaagtattaaacaacggaacactcaaaaataaaaaaggtgttaacgtacccgggcgtaagtgtcaatcttccgggattactgaaaaggatgcgcgagacatcgttttcggtattgagcaaggagtagacttcatcgcaccatctttcattcgacgttctacggatgtgctcgaaatccgtgagcttcttgaagagcacaacgctcaggatattcaaatcatccctaaaatcgaaaaccaagagggcgttgacaacatcgatgcgattctcgaagtgtctgacggcttaatggttgcacgcggagacttaggtgtggaaattccagctgaagaagtgccgcttgtgcaaaaagaactgatcaaaaaatgcaacgcgctgggcaaacctgttattacagcgacacaaatgcttgacagcatgcagcgcaacccgcgtccgactcgtgcggaagcaagtgacgttgcaaacgcgatcttcgacggaacagatgcgatcatgctatctggtgaaactgctgccggaagctatccggttgaagcagttcaaacaatgcataacatcgcgtcccgttctgaagaagctttaaattataaagaaattctctcaaaacgcagagatcaagtgggcatgacaattacagacgcaattggacaatctgtcgcgcatacggcgattaacctgaatgctgcgatcgtaacgccgacagaaagcggccatacagcacgtatgattgcaaaataccgtccgcaggctccgattgttgcggttactgtaaatgactctatttccagaaagcttgccctcgtatctggcgtattcgcggaaagcggccaaaatgcgagctcaacagatgagatgcttgaggatgctgtccaaaaatcattgaacagcggaattgtaaaacacggcgatcttatcgttattacagcaggcactgtcggtgagtccggcactacgaatttgatgaaggttcatactgtcggtgatatcatcgctaaaggccaaggcattggacgcaaatcagcttacggtccggtcgtcgttgcacaaaatgcaaaagaagctgagcaaaaaatgactgacggtgcggtacttgttaccaaaagcactgaccgtgatatgattacatcccttgaaaaagcgtctgctcttattacagaagaaggcggtttgactagccatgcggcggtagtcggattaagccttggcatcccggttatcgtgggtctggaaaatgcgacatctattttgacagatggccaggatattacagttgacgcttccagaggtgcagtctatcaaggccgtgcgagcgttctttaattacaggtgaaaacggaaggggaatcccttccttttctctttatcatgccttttgttgaacagaacgtgttacacgtgtggggggcttggatatgagatttttgtttttgctttttattgtgtttccggcaatagaaatcgggatattcctatttttaggcaagctgattggcattttaccgacagttctattcatgattctgacgggcattatcggcgcagcagctgcaaaaaaacaaggaaccgaagtgt

SEQ ID NO: 16539 - protein, 584 aa, Bacillus subtilis
MRKTKIVCTIGPASESIEMLTKLMESGMNVARLNFSHGDFQEHGARIKNIREAAEKLGKNVGILLDTKGPEIRTHTMENGSIELNAGSKLVISMTEVIGTPDKISVTYEGLVHDVNKGSTILLDDGLIGLEVLDVDAVKREIKTKVLNNGTLKNKKGVNVPGRKCQSSGITEKDARDIVFGIEQGVDFIAPSFIRRSTDVLEIRELLEEHNAQDIQIIPKIENQEGVDNIDAILEVSDGLMVARGDLGVEIPAEEVPLVQKELIKKCNALGKPVITATQMLDSMQRNPRPTRAEASDVANAIFDGTDAIMLSGETAAGSYPVEAVQTMHNIASRSEEALNYKEILSKRRDQVGMTITDAIGQSVAHTAINLNAAIVTPTESGHTARMIAKYRPQAPIVAVTVNDSISRKLALVSGVFAESGQNASSTDEMLEDAVQKSLNSGIVKHGDLIVITAGTVGESGTTNLMKVHTVGDIIAKGQGIGRKSAYGPVVVAQNAKEAEQKMTDGAVLVTKSTDRDMITSLEKASALITEEGGLTSHAAVVGLSLGIPVIVGLENATSILTDGQDITVDASRGAVYQGRASVL

SEQ ID NO: 16540 - DNA, 1800 bp, Homo sapiens
  CDS (1)..(1800)
atgtcgatccaggagaacatatcatccctgcagcttcggtcatgggtctctaagtcccaaagagacttagcaaagtccatcctgattggggctccaggagtgcctctgacaacccaacagtgtggagcagacccacagagagggagacccagagaggtgtgcagtggcatggaagggccagcggggtatctgcggcgggccagtgtggcccaactgacccaggagctgggcactgccttcttccagcagcagcagctgccagctgctatggcagacaccttcctggaacacctctgcctactggacattgactccgagcccgtggctgctcgcagtaccagcatcattgccaccatcgggccagcatctcgctccgtggagcgcctcaaggagatgatcaaggccgggatgaacattgcgcgactcaacttctcccacggctcccacgagtaccatgctgagtccatcgccaacgtccgggaggcggtggagagctttgcaggttccccactcagctaccggcccgtggccatcgccctggacaccaagggaccggagatccgcactgggatcctgcaggggggtccagagtcggaagtggagctggtgaagggctcccaggtgctggtgactgtggaccccgcgttccggacgcgggggaacgcgaacaccgtgtgggtggactaccccaatattgtccgggtcgtgccggtggggggccgcatctacattgacgacgggctcatctccctagtggtccagaaaatcggcccagagggactggtgacccaagtggagaacggcggcgtcctgggcagccggaagggcgtgaacttgccaggggcccaggtggacttgcccgggctgtccgagcaggacgtccgagacctgcgcttcggggtggagcatggggtggacatcgtctttgcctcctttgtgcggaaagccagcgacgtggctgccgtcagggctgctctgggtccggaaggacacggcatcaagatcatcagcaaaattgagaaccacgaaggcgtgaagaggtttgatgaaatcctggaggtgagcgacggcatcatggtggcacggggggacctaggcatcgagatcccagcagagaaggttttcctggctcagaagatgatgattgggcgctgcaacttggcgggcaagcctgttgtctgtgccacacagatgctggagagcatgattaccaaggcccggccaacgagggcagagacaagcgatgtcgccaatgctgtgctggatggggctgactgcatcatgctgtcaggggagactgccaagggcaacttccctgtggaagcggtgaagatgcagcatgcgattgcccgggaggcagaggccgcagtgtaccaccggcagctgtttgaggagctacgtcgggcagcgccactaagccgtgatcccactgaggtcaccgccattggtgctgtggaggctgccttcaagtgctgtgctgctgccatcattgtactgaccacaactggccgctcagcccagcttctgtctcggtaccgacctcgggcagcagtcattgctgtcacccgctctgcccaggctgcccgccaggtccacttatgccgaggagtcttccccttgctttaccgtgaacctccagaagccatctgggcagatgatgtagatcgccgggtgcaatttggcattgaaagtggaaagctccgtggcttcctccgtgttggagacctggtgattgtggtgacaggctggcgacctggctccggctacaccaacatcatgagggtgctaagcatatcctga

SEQ ID NO: 16541 - protein, 599 aa, Homo sapiens [sequence omitted]

SEQ ID NO: 16542 - DNA, 1428 bp, Zymomonas mobilis
  CDS (1)..(1428)
atgactgaaggacttttcccacgcggccgcaaggtacgtgttgtttctacgctgggtcctgccagctcgacggcagaacagattcgtgatcgtttcttggctggtgcggatgtattccgtatcaacatgagccatggtacccatgacgaaaagaaggtcatcgttgacaacattcgtgcgcttgaaaaagaattcaaccgcccgaccacgatccttttcgatcttcagggtccgaagctccgcgttggtgacttcaaagaaggcaaggttcagttgaaagaaggccagaccttcactttcgatcaggacccaactctcggtgacgaaacccgcgtcaacctgccgcatcctgaaatcttcaaggctttagacaaaggtcatcgcctgcttttggatgatggtaagatcgttgttcgttgcgtcgaatcttccccgaccaaaatcgttacccgcgtcgaagttccgggtccgctttccgaccataaaggtttcaacgttcctgacgttgtgattccgctggccgctctgaccccgaaagatcgcaaagatctcgactttgctcttaaggaaaaagctgactgggttgctcttagctttgtgcagcgcgtcgaagacgtcatcgaagccaaagaactcatcaaaggtcgcgcaccgcttctcgttaaactcgaaaagccagctgccattgaaaacctcgaatccatcttggctgcaaccgatgctgtcatggttgctcgtggtgacctcggtgttgaatgcttgccggaatccgttcccccgacgcagaagcgtatcgttgaacgctcccgccagctgggtaagccggttgttgttgcaaccgctatgctcgaatccatgatcaaagctccggctccgacccgcgctgaagtaagtgacgttgcaaacgccatttacgaaggtgctgatggtatcatgctttctgcagaatccgccgccggtgattggccgcatgaagctgtcaacatgatgcatcgtattgcttcttatgttgaaaatgctccgggttacatcgaacgcgttcgcttcaccccgactccggcagaaccgacgacggttgacgctctggctgaaaacgccagcaaaaccgctgaaacggttggcgcaaaagcgatcatcgtcttcaccgaaaccggtaagaccgcacagcgcgtttcccgcgcccgtccggttgctccgatcctgtctctgaccccggatgccgaagttgctcgtcgtcttggtttggtctggggcgcacagccggttcaggtttccacggttaagaccctcgacgaagccaagaagctggctgctgaaaccgctaaaaaatacggtttcgccaaagccggtgacaagctggttgttgttgcaggtgaacctttcggtaaagctggaaccaccaacattgttgatgttatcgaagcctaa

SEQ ID NO: 16543 - protein, 475 aa, Zymomonas mobilis
MTEGLFPRGRKVRVVSTLGPASSTAEQIRDRFLAGADVFRINMSHGTHDEKKVIVDNIRALEKEFNRPTTILFDLQGPKLRVGDFKEGKVQLKEGQTFTFDQDPTLGDETRVNLPHPEIFKALDKGHRLLLDDGKIVVRCVESSPTKIVTRVEVPGPLSDHKGFNVPDVVIPLAALTPKDRKDLDFALKEKADWVALSFVQRVEDVIEAKELIKGRAPLLVKLEKPAAIENLESILAATDAVMVARGDLGVECLPESVPPTQKRIVERSRQLGKPVVVATAMLESMIKAPAPTRAEVSDVANAIYEGADGIMLSAESAAGDWPHEAVNMMHRIASYVENAPGYIERVRFTPTPAEPTTVDALAENASKTAETVGAKAIIVFTETGKTAQRVSRARPVAPILSLTPDAEVARRLGLVWGAQPVQVSTVKTLDEAKKLAAETAKKYGFAKAGDKLVVVAGEPFGKAGTTNIVDVIEA

SEQ ID NO: 16544 - DNA, 1506 bp, Candida glabrata
  CDS (1)..(1506)
atggactctagattggctagattgactaccttgcaaacctctgccggtgaggaattgagaagaacctctatcatcggtaccattggtccaaagaccaacaacccagaaaccttggttgctctaagaaaggctggtttgaacattgtccgtatgaacttctcccacggttcttacgaataccacaagtctgtcattgacaatgccagaaagtccgaagagctatacccaggtagaccattggctatcgctttggacaccaagggtccagaaatcagaactggtaccaccactaacgaagtcgactacccaatcccaccaaaccacgaaatgatcttcaccaccgatgacaagtacgctaaggcttgtgacgacaagatcatgtacttggactacaagaacatcaccaaggtcatctccgctggtagaatcatctacgtcgatgacggtgttttgtctttcgaagtcttgcaagtcgttgacgacaagaccttgaaggtcaagtccttgaacgctggtaagatctgctcccacaagggtgttaacttgccaggtaccgatgtcgacttgccagctttgtctgaaaaggacaaggctgacttgagattcggtgttgaaaacggtgtccacatgatcttcgcttctttcatcagaaccgctcaagatgttttgaccatcagagaagttttgggtgaagacggtaaggacatcaagatcgtcgtcaagattgaaaaccaacaaggtgttaacaacttcgacgaaatcttgaaggtcactgacgctgtcatggttgccagaggtgacttgggtatcgaaatcccagccccagaagtcttggctgtccaaaagaagttgatcgctaagtctaacttggccggtaagccagttatctgtgctacccaaatgttggaatctatgacctacaacccaagaccaaccagagctgaagtttccgatgtcggtaacgctgttttggacggtgctgactgtgtcatgttgtccggtgaaaccgctaagggtaactacccaattaacgctgttaccactatggctgaaactgctttgatcgctgaacaagctattgcttacttgccaaactacgatgacatcagaaactgcactccaaagccaacttctaccactgaaactgttgctgcttccgccgtcgctgctgtcttcgaacaaaaggctaaggctatcatcgttttgtctacctctggtaccaccgctagattggtttccaagtacagaccaaactgcccaatcatcttggtcaccagaaacgccagaactgctagattctctcacttgtacagaggtgttttcccattcgtttacgagaaggaatctgtctctgactggactgaagatgttgaagctagattgaacttcggtatcgaacaagctatcgaattcggtatcttgaagaagggtgacacttacgtttccatccaaggtttcaaggctggtgtcggtcactccaacactttgcaagtctccactgcttaa

SEQ ID NO: 16545 - protein, 501 aa, Candida glabrata
MDSRLARLTTLQTSAGEELRRTSIIGTIGPKTNNPETLVALRKAGLNIVRMNFSHGSYEYHKSVIDNARKSEELYPGRPLAIALDTKGPEIRTGTTTNEVDYPIPPNHEMIFTTDDKYAKACDDKIMYLDYKNITKVISAGRIIYVDDGVLSFEVLQVVDDKTLKVKSLNAGKICSHKGVNLPGTDVDLPALSEKDKADLRFGVENGVHMIFASFIRTAQDVLTIREVLGEDGKDIKIVVKIENQQGVNNFDEILKVTDAVMVARGDLGIEIPAPEVLAVQKKLIAKSNLAGKPVICATQMLESMTYNPRPTRAEVSDVGNAVLDGADCVMLSGETAKGNYPINAVTTMAETALIAEQAIAYLPNYDDIRNCTPKPTSTTETVAASAVAAVFEQKAKAIIVLSTSGTTARLVSKYRPNCPIILVTRNARTARFSHLYRGVFPFVYEKESVSDWTEDVEARLNFGIEQAIEFGILKKGDTYVSIQGFKAGVGHSNTLQVSTA

SEQ ID NO: 16546 - DNA, 1527 bp, Candida glabrata
  CDS (1)..(1527)
atggactccaggttgcatagattgattaacttagaagtcactccaggtaaggatgtcagaaagactgccattattggtaccattggtcccaagactaacaatgttgacacattagttgctttgagaaaggctggtttgaatattgtccgtatgaacttctctcatggttcttacgaataccaccaatctgtgattgataacgccagaaagtcagaacaggtttatcctggtagaccattggccattgccttggacaccaagggtccagagattagaacaggtaccaatgttgacgatgttgactacccaattccaccaaatcatgagatgatcttcactactgatgataaatatgccaaggcatgtgatgacaagatcatgtatgttgattataagaacatcaccaaagtgattcaaccaggtaaagtcatctatgttgatgacggtgttttgtcttttgaagtcttagaagtcgtcgacgataagaccttgaaggtcaaatccttaaatgcaggtaaaatttcttctcataaaggtgttaacttgccaggaactgatgtcgacttaccagctttatctgaaaaggacaaagaagatttgagattcggtgtcaaaaatggtgttcatatgatctttgcctcttttatcagaactgcacaagatgtcttgactatcagagaagtactgggcgaggaaggtaaagacataaaagtcattgttaagatagaaaaccagcaaggtgtcaataactttgatgagattttggaagtggcccatggtgttatggttgccagaggtgacttgggtatcgaaattccggcaccacaggtcttggccgttcaaaagaaacttatagctaaatgtaacttggctggtaagccagtcatttgtgctactcaaatgctagagtccatgacattcaacccaagaccaaccagagctgaagtttctgatgttggtaacgctatattggatggtgctgattgtgtcatgttgtctggagaaactgctaaaggtaattaccccatcaatgctgtcacaacaatggcagaaactgccattatcgctgaacgagccattgcttatatgccattgtatgatgatttgagaaattgtactccaaaaccaacatcgacaacagagactgttgctgcctcggcagttgcagctgttcaagagcaaggtgccaaacttattttggtactatctacttctggtaacactgcaagattagtctccaagtatagacctcaatgcccaatcgttttggttacaagaaacccaagaactgctagattttctcatttattcagaggtgtgttcccatttgtttatgaaaaagaaccactagatgactggagtgaggatacccacgctcgtttgagatttggtgtcgatatggccaaagaatatggctttgttaagaatggtgatgcagttatttccattcaaggtttcaagggtggtgttggtcactctaatactatgcgtgtttccattgtaggtggagaaaaggaggatatctga

SEQ ID NO: 16547 - protein, 508 aa, Candida glabrata
MDSRLHRLINLEVTPGKDVRKTAIIGTIGPKTNNVDTLVALRKAGLNIVRMNFSHGSYEYHQSVIDNARKSEQVYPGRPLAIALDTKGPEIRTGTNVDDVDYPIPPNHEMIFTTDDKYAKACDDKIMYVDYKNITKVIQPGKVIYVDDGVLSFEVLEVVDDKTLKVKSLNAGKISSHKGVNLPGTDVDLPALSEKDKEDLRFGVKNGVHMIFASFIRTAQDVLTIREVLGEEGKDIKVIVKIENQQGVNNFDEILEVAHGVMVARGDLGIEIPAPQVLAVQKKLIAKCNLAGKPVICATQMLESMTFNPRPTRAEVSDVGNAILDGADCVMLSGETAKGNYPINAVTTMAETAIIAERAIAYMPLYDDLRNCTPKPTSTTETVAASAVAAVQEQGAKLILVLSTSGNTARLVSKYRPQCPIVLVTRNPRTARFSHLFRGVFPFVYEKEPLDDWSEDTHARLRFGVDMAKEYGFVKNGDAVISIQGFKGGVGHSNTMRVSIVGGEKEDI

SEQ ID NO: 16548 - DNA, 1758 bp, Staphylococcus aureus subsp
  CDS (1)..(1758)
atgagaaaaactaaaattgtatgtacaattggaccagcttcagaatcagaagaaatgattgagaaattaatcaatgctggtatgaacgttgcacgattaaacttttcacatggtagtcatgaagagcataaaggtagaattgatacaattcgtaaagtagctaaaagattagacaaaattgtagcaattttattagatacgaaaggtccagaaattcgtacgcataatatgaaagacggtatcattgaacttgaacgtggtaacgaagttattgttagcatgaatgaagttgaaggaacacctgaaaagttctctgtaacttatgaaaacttaattaacgatgttcaagtaggttcatacattttacttgatgatggcttaattgaattacaagttaaagatattgaccatgctaaaaaagaagttaaatgtgatattttaaactctggtgagcttaaaaacaaaaaaggtgttaacttacctggtgtaagagttagtttacctggtattacagaaaaagatgctgaagatatccgtttcggtattaaagaaaatgttgacttcattgcagcaagtttcgtacgtcgtcctagtgatgttttagaaattcgtgaaattttagaagaacaaaaagctaacatttcagtattccctaaaattgaaaaccaagaaggtattgataatattgaggaaattcttgaagtgtctgatggtttaatggttgcacgtggtgacatgggtgttgaaatcccacctgaaaaagtaccaatggttcaaaaagatttaatcagacaatgtaacaaattaggtaaaccagttattacagctacacaaatgttagattctatgcaacgtaacccacgtgctacacgtgcagaagctagtgacgttgccaacgcaatctatgatggtacagatgcagtaatgttatctggtgaaactgctgctggtttatatcctgaagaagctgttaaaacaatgagaaatattgctgtatcagctgaagcagcccaagattacaaaaagttattgtcagatcgtactaaattagttgaaacttcattagtgaatgctatcggtatttcggttgcacatacagctttaaacttaaatgttaaagcaattgtagctgctactgaaagtggttcaacggcacgtactatctctaaatatcgtccgcattcagacattattgcagtgactccaagtgaagaaactgcacgtcaatgttcaattgtttggggtgttcaacctgtagttaaaaaaggacgtaagagtacagatgcattgttaaacaatgcagttgcaacagctgttgaaactggtagagtaactaatggtgatttaatcattattactgctggtgtaccaactggtgaaactggaactactaatatgatgaaaatccacctagttggtgacgaaattgctaatggtcaaggtattggacgtggatcagttgttggtactacgttagttgctgaaactgttaaagatttagaaggtaaagatttatctgacaaagttatcgttacaaactcaatcgatgaaacgtttgtaccttatgtagaaaaagcgttaggcttaattacagaagaaaatggaattacatcaccaagtgcaattgttggtttagaaaaaggtattccaacagttgtaggtgtagaaaaagctgttaaaaacataagcaataacgtgttagttacgattgatgctgctcaaggtaaaatctttgaaggatatgcaaacgtactataa

SEQ ID NO: 16549 - protein, 585 aa, Staphylococcus aureus subsp
MRKTKIVCTIGPASESEEMIEKLINAGMNVARLNFSHGSHEEHKGRIDTIRKVAKRLDKIVAILLDTKGPEIRTHNMKDGIIELERGNEVIVSMNEVEGTPEKFSVTYENLINDVQVGSYILLDDGLIELQVKDIDHAKKEVKCDILNSGELKNKKGVNLPGVRVSLPGITEKDAEDIRFGIKENVDFIAASFVRRPSDVLEIREILEEQKANISVFPKIENQEGIDNIEEILEVSDGLMVARGDMGVEIPPEKVPMVQKDLIRQCNKLGKPVITATQMLDSMQRNPRATRAEASDVANAIYDGTDAVMLSGETAAGLYPEEAVKTMRNIAVSAEAAQDYKKLLSDRTKLVETSLVNAIGISVAHTALNLNVKAIVAATESGSTARTISKYRPHSDIIAVTPSEETARQCSIVWGVQPVVKKGRKSTDALLNNAVATAVETGRVTNGDLIIITAGVPTGETGTTNMMKIHLVGDEIANGQGIGRGSVVGTTLVAETVKDLEGKDLSDKVIVTNSIDETFVPYVEKALGLITEENGITSPSAIVGLEKGIPTVVGVEKAVKNISNNVLVTIDAAQGKIFEGYANVL

SEQ ID NO: 16550 - DNA, 1960 bp, Zea mays
  CDS (144)..(1673)
gcacgagcgcacgagcgacgccgcccccattcattcttggagggcaagaagaacgcgcagtccaaaagcgaaacaaggggaaggggcgaggcagccaaacgaatcccagcacctgcctctcctttgcttgcgcagatctagcgatggcggcgggcggtgagttggcgtggggggaggagcccgtggcgcggcgccggcctaagaccaagatcgtctgcacgctcggcccggcgtcgcgatccgtcgagatgatctcgcgcctgctgcgcgccgggatgtgcgtcgcgcgcttcaacttctcccatggctcccacgagtaccaccaggagacgctcgacaacctgcacgccgccatggagctcaccgggatcctctgcgccgttatgctcgacaccaagggtccagagattagaactggatttttgaaagatgggaagcctattcaattgataaaaggccaagaaatcacaatttctacagactatagcattcagggtgatgagaaaatgatatcaatgagctacaagaagcttgctgttgatctgaagccaggcagtgtcatattgtgtgctgatggtaccatcactcttactgttcttcactgtgataaagaacaaggcttggttcgctgccgctgtgagaacactttcaagcttggcgagaggaagaatgttaatcttccaggagttattgttgatctccccacactcacagacaaggacaaggaggacatccttaaatggggtgttccaaacaagattgacatgattgccttgtcatttgttcggaagggttcggatcttgtggaggttaggaaggtacttggtgagcatgccaagtccataatgctgatgtcaaaggttgagaatcaagagggagtagctaactttgatgatatcctggcaaactctgatgcttttatggtggcaagaggtgatttaggaatggaaattcctatagagaagattttctttgcacagaaggtgatgattttcaagtgcaatattcaaggcaagcctgttgtgactgcaacccagatgttggaatctatgatcaagtctcctcgccctactcgggcagaagcaacggatgttgcaaacgcagttcttgatggcacagactgtgttatgctcagtggtgagactgctgctggggcctatccagagttggcggtgcagactatggctaagatctgcctgcaagcagagtcttgcgtagaccatgctgctatttttaaatcaatcatggcttcagctccaattccaatgagtccattggagagccttggatcatcagctgttcgcacagcaaactctgccagggcagcacttatcttggtcctgaccaggggaggaactactgctaggcttgtagccaagtataggccatccatgccgattctgtccgttgtggttcctgagctgaagacagactcgttcgactgggcctgcagtgacgagggtccggcaaggcacagcctcattgtgaggggtgtcatcccaatgctgagtgccgccactgccaaggcctttgacaacgaagccactgacgaagctattggttttgccattgaaaatgcgaagacgatggggctatgcaacaccggtcaatccgttgtggccctgcaccgcatcgggatttcatccgtcatcaagcttcttactgtgaagtaggggtccaagggtgagggacaccattttgcttggtgaatttttgtgaggctgcttacgcacatcagcgtatccacagcttttctgttgccaaagatacagactttgcgttctggtacaccttggtgttacaaggttgtgggaatttgtcgtttagatattagcgatttaaacagtttatcaactgctatagctaattaatttgcagctgtgctgcaactttatcgcacaaaaaaaaaaaaaaaaaaaaaaaaaaaaaaaaaaaaaaaaaaaaaaaaaaaaaaaaaaaa

SEQ ID NO: 16551 - protein, 509 aa, Zea mays
MAAGGELAWGEEPVARRRPKTKIVCTLGPASRSVEMISRLLRAGMCVARFNFSHGSHEYHQETLDNLHAAMELTGILCAVMLDTKGPEIRTGFLKDGKPIQLIKGQEITISTDYSIQGDEKMISMSYKKLAVDLKPGSVILCADGTITLTVLHCDKEQGLVRCRCENTFKLGERKNVNLPGVIVDLPTLTDKDKEDILKWGVPNKIDMIALSFVRKGSDLVEVRKVLGEHAKSIMLMSKVENQEGVANFDDILANSDAFMVARGDLGMEIPIEKIFFAQKVMIFKCNIQGKPVVTATQMLESMIKSPRPTRAEATDVANAVLDGTDCVMLSGETAAGAYPELAVQTMAKICLQAESCVDHAAIFKSIMASAPIPMSPLESLGSSAVRTANSARAALILVLTRGGTTARLVAKYRPSMPILSVVVPELKTDSFDWACSDEGPARHSLIVRGVIPMLSAATAKAFDNEATDEAIGFAIENAKTMGLCNTGQSVVALHRIGISSVIKLLTVK

SEQ ID NO: 16552 - DNA, 1536 bp, Plasmodium falciparum
  CDS (1)..(1536)
atgagttcatttaagtacaaaaactccgccgcaggtgccagtatgcaaagtgctgctaacataaccttgagacaaattttagaacccaataatgtgaatttacgttctaagaaaacacacattgtatgtaccttaggtccagcatgtaaatctgttgaaacacttgttaaattgattgatgcaggtatggatatttgccgttttaacttttctcacggtagccatgaagatcacaaggaaatgtttaacaacgtgttaaaagcccaagaattgaggccaaattgcttattaggaatgttgttagatactaaagggccagaaatcaggacagggtttttaaaaaataaagaagttcacttaaaagaaggtagtaaattaaaattagtaaccgattatgaatttttaggtgatgaaacttgtatagcatgttcatataagaaattaccacaaagtgtgaagccaggaaatattatattaatagctgatggatcagtaagttgtaaagttttagaaacacatgaagatcatgttattacagaagtattaaattcagctgttattggtgaaaggaaaaatatgaatttaccaaacgttaaggttgatttaccaattattagcgaaaaggataaaaatgatatactaaattttgctataccaatgggttgtaattttattgctgcctcatttattcaatcagccgatgatgtccgtttaattagaaacttattaggaccaagaggaagacatattaaaattattcccaaaatcgaaaacattgaaggtattattcatttcgataaaattttagctgaatctgatggtatcatgattgcaagaggagatttaggaatggaaatttctccagaaaaagttttcttggcacaaaaattgatgatatcaaaatgcaatttacaaggtaaaccaattatcactgccactcaaatgttagaatccatgaccaagaacccaagaccaacaagagcagaagttacagatgtagctaatgctgttttagatggtactgattgtgttatgctttcaggagaaactgcaggtggtaaatttccagtggaagctgttaccattatgtccaaaatctgtttagaagcagaagcatgcattgattataaattattatatcaatcattagtaaatgcaattgaaacaccaattagtgttcaagaagctgtggctagatcagctgtagaaacagcagaatctattcaagcttctttaattatagctttaacagaaacaggttatacggctagattaattgccaaatataaaccaagttgtaccatcttagcccttagtgcttctgattcaactgttaaatgtttgaacgtacacagaggtgttacatgcattaaagtaggttcattccaaggaacagatattgttattagaaatgctattgaaatcgcaaaacaaagaaatatggcaaaagttggtgatagcgttattgctattcacggaattaaagaagaagtatctggaggtaccaacttaatgaaagttgtacaaattgaataa

SEQ ID NO: 16553 - protein, 511 aa, Plasmodium falciparum
MSSFKYKNSAAGASMQSAANITLRQILEPNNVNLRSKKTHIVCTLGPACKSVETLVKLIDAGMDICRFNFSHGSHEDHKEMFNNVLKAQELRPNCLLGMLLDTKGPEIRTGFLKNKEVHLKEGSKLKLVTDYEFLGDETCIACSYKKLPQSVKPGNIILIADGSVSCKVLETHEDHVITEVLNSAVIGERKNMNLPNVKVDLPIISEKDKNDILNFAIPMGCNFIAASFIQSADDVRLIRNLLGPRGRHIKIIPKIENIEGIIHFDKILAESDGIMIARGDLGMEISPEKVFLAQKLMISKCNLQGKPIITATQMLESMTKNPRPTRAEVTDVANAVLDGTDCVMLSGETAGGKFPVEAVTIMSKICLEAEACIDYKLLYQSLVNAIETPISVQEAVARSAVETAESIQASLIIALTETGYTARLIAKYKPSCTILALSASDSTVKCLNVHRGVTCIKVGSFQGTDIVIRNAIEIAKQRNMAKVGDSVIAIHGIKEEVSGGTNLMKVVQIE

SEQ ID NO: 16554 - DNA, 1458 bp, Photobacterium profundum
  CDS (1)..(1458)
atggagtttcaaatgtctgaacaactaagacgtaccaaaatcgtaactacacttggtcctgctactgaccgcgataacaaccttgaaaaaattatcgccgctggagctaacgtagttcgaatgaacttctctcacggtagccctgaagatcatattcaacgtacaaaaatggtacgtgaaattgcagcaaagctaggtaagcatattgctattcttggcgaccttcaaggtccgaaaattcgagtttctacttttaaagacggtaaaatacaattggctatcggtgataagttcacgctagatagtgaccttccaaaaggtgaaggccatcaagatgctgtcggtcttgactataaagagctacccaatgatgttgtgactggcgatcttttacttctagatgatggtcgagttcagttaaaagtaacagcagtgagtggtaataaagtacataccgaagtcaccgttggtggtccgttatctaataacaaaggcatcaataaaaaaggcggtgggctttcagctgaagcactaacagagaaagacaaagccgacattattactgcagcccaaatgggtgtggactaccttgcagtgtcattcccacgtaacggcgaagacatgaagtatgctcgaagcttggcattagatgctggtcttgaagctaagttagtcgctaaagttgagcgtgcagaagccgtagcaacaacagaagcaatggatgacatcatcatggcatctgatgtggtaatggttgctcgtggtgaccttggggttgaaattggtgaccctgagctggttggtgttcagaagaaattaattcgtcgtgctcgtagccttaaccgtaccgtcattactgcaactcaaatgatggagtcaatgattactagcccaatgccaacacgtgcagaagtcatggacgttgctaacgccgtattggatggtacagatgctgtaatgctttcagcagaaacagcagctggtgatttcccagttgaaaccgttcaagcaatgtcgagtgtttgtgtgggtgctgaaaaagagcctagcatcaatgtatccaatcaccgcttaactcgcacatttgcttcgcctgaagaaactatcgcaatgtctaccatgtatgctgcaaaccatatggaaggcgtaaaagcgatggtagcaatgaccgaatctggtcgtacagcattaatgatgtctcgtatctcatctggtttacctattttcgctatgtcacgtaacgaaagtacattgaatcgttcttcactataccgcggtgtaacacctgtctatttcgaccgtgatagcgacgcaggtcttgaagcggctaaacacgcactggttgtgcttaaagagcatggttacttagcaacgggtgatcttgtcattatcacccaaggtgacgtaatggatacgattggttctaccaacaatatgcgtattcttactgttgaataa

SEQ ID NO: 16555 - protein, 485 aa, Photobacterium profundum
MEFQMSEQLRRTKIVTTLGPATDRDNNLEKIIAAGANVVRMNFSHGSPEDHIQRTKMVREIAAKLGKHIAILGDLQGPKIRVSTFKDGKIQLAIGDKFTLDSDLPKGEGHQDAVGLDYKELPNDVVTGDLLLLDDGRVQLKVTAVSGNKVHTEVTVGGPLSNNKGINKKGGGLSAEALTEKDKADIITAAQMGVDYLAVSFPRNGEDMKYARSLALDAGLEAKLVAKVERAEAVATTEAMDDIIMASDVVMVARGDLGVEIGDPELVGVQKKLIRRARSLNRTVITATQMMESMITSPMPTRAEVMDVANAVLDGTDAVMLSAETAAGDFPVETVQAMSSVCVGAEKEPSINVSNHRLTRTFASPEETIAMSTMYAANHMEGVKAMVAMTESGRTALMMSRISSGLPIFAMSRNESTLNRSSLYRGVTPVYFDRDSDAGLEAAKHALVVLKEHGYLATGDLVIITQGDVMDTIGSTNNMRILTVE

SEQ ID NO: 16556 - DNA, 1413 bp, Photobacterium profundum
  CDS (1)..(1413)
atgaaaaagaccaagatcgtatgtacgattggaccaaaaactgaatctgtagaaatgctgactaaactagctaacgctggtatgaacgtaatgcgtttaaacttctctcacggtaacttcgaagaacacggtcaacgtatcgtaaacctacgtgaagtaatggctacatctgctcagcctctagctatcttgctagatactaaaggtcctgaaattcgtactatcaaactagaaaatggcgaagatttcgctctagttgctggtcaagaattcacattcacaactgatattacagttgttggcaaccaagaccgcgttgcagtaacttacccaggtttcgctaaagaccttactaaaggtaacatcatccttgttgatgatggtcttatcgaaatggaagtactagaaacaactgaaactgaagttaagtgtaaagtacttaacaacggtgaccttggtgaaaacaaaggtgttaacctacctggtgtttctgtaaagcttcctgctctttctgaaaaagataaagcagacctagtattcggttgtgagcaaggcgttgatttcgttgctgcatctttcattcgtaaagaagatgatgttaaagaaatccgtgctctacttgctgctaacggtggcgagaagattcaaatcatctctaaaatcgaaaaccaggaaggcgttgataactttgactctatcctagaagcttctgacggtatcatggttgctcgtggcgaccttggtgttgaaatcccagtagaagaagttatctttgctcagaagatgatgatcgagaaatgtaatcgcgcacgtaaagttgttatcactgcaactcaaatgcttgattctatgattaagaacccacgtccgactcgcgcagaagcgggtgacgttgcaaacgcaatcatggatggtactgatgcagtcatgctatctggtgaatcagctaagggtaaatacccaattgaagctgtaactatcatggctcaaatctgtaaccgtacagattcagcgttaaaagcagaattaggttctcgcctagacagctctcgtctacgtattactgaagctgtatgtaaaggcgcagtagacacttcagagaagctaaatgctcctctaattgttgttgctactgaagcgggtaaatctgctcgctctatccgtaagtacttcccaacagcgaaaattattgctgtaactacaaaccagaaaacagctgctcagctttgtctaacgaaaggtgttacacctatcgttgttgatgctatcgacaacactgatgcattctacagtcgcggtaaagaaatcgcgctagaaactggtcttggcgctaaaggcgatatcgttgttatggtatctggcgcactagttccttctggtacaactaacacagcttctgtacacgtactttaa

SEQ ID NO: 16557 - protein, 470 aa, Photobacterium profundum
MKKTKIVCTIGPKTESVEMLTKLANAGMNVMRLNFSHGNFEEHGQRIVNLREVMATSAQPLAILLDTKGPEIRTIKLENGEDFALVAGQEFTFTTDITVVGNQDRVAVTYPGFAKDLTKGNIILVDDGLIEMEVLETTETEVKCKVLNNGDLGENKGVNLPGVSVKLPALSEKDKADLVFGCEQGVDFVAASFIRKEDDVKEIRALLAANGGEKIQIISKIENQEGVDNFDSILEASDGIMVARGDLGVEIPVEEVIFAQKMMIEKCNRARKVVITATQMLDSMIKNPRPTRAEAGDVANAIMDGTDAVMLSGESAKGKYPIEAVTIMAQICNRTDSALKAELGSRLDSSRLRITEAVCKGAVDTSEKLNAPLIVVATEAGKSARSIRKYFPTAKIIAVTTNQKTAAQLCLTKGVTPIVVDAIDNTDAFYSRGKEIALETGLGAKGDIVVMVSGALVPSGTTNTASVHVL

SEQ ID NO: 16558 - DNA, 1797 bp, Parachlamydia sp
  CDS (1)..(1797)
atggcattaattagaacaaaaattgtttgtacaataggacctgcttgcaattccttagagaaaattattgagttaataaacgtaggaatgaacgttgcaaggttgaattttagtcatggaactcaagaagaacatttaaggacaattaatcttttaaaagaagcgagatgtcaacttaacttacctttagccatcatgttagatacaaaagggccagaaatacggctaggaaaaattcgagatggacaaatttttttaacggtaggtcaaaaatggcggttagtgaaaaaggaggttttaggagatgaaagtcaggtttctatttttcctctcaatattttagatcaacttcctgttgggacaacaattttatttgatgatgggtatattgcctcacgcgtgattgaaaattcatccgaaggtgtgcttgttgaaattaataacagcgggatgattcgttcaagtaaaggagttaatattcccaatacaagcctaaatttgcctgctgtcaccgaaaaagacattgacgatattcgttttggatgtagccaggatattgacttgattgctgcttcctttgttcgttctgcagaacatgtcttggagattaagcgtttattagctgatgaaaaaaaaactgatattctagttattgcaaaaattgaaaatagtgaaggggtgcaaaattttgatagcattgtccaagcagcagacggaatcatgatagcaagaggagatttaggggttgaagttcctttaagccatgttcctagattgcagaaaatgatgatccgtaaaagttatttggcaggcaagccagttgtgacagcaacgcagatgttagaatcaatgatcaataatcctagaccaactcgtgcagaaacatctgatgtagcaaatgcgatttatgatagtacatctgctatcatgctttcaggagaaacagcaattggtcgttatcctgttgagacggttaatgtgatgcgaagtatcgtagaagaggctgaagctgatttcaactacagtactttttttgatcaacatgcccctttagtttatcatgatgttccctctgctgtgactttagctactgtaaaaacagcttacagttctagcgctaaagctatttttgcttttactaaagcaggaacaacggcacgacttttatcaagacttaggcctaaaatgcctattattgcgatgacagcaaaagaaaaaatttttcatcagttggcatttaattggggagttattccttttttaagtgaaccttgtaactctttagataaaagtttaaaaaaaatcagtgatttcgcccttggaagtcaacacgtcagctatggagatttggttgtgattactgcaggaactccttttggattttcaggaacgaccaatatgatgatcgttgaaaatattggagatgttttggtaagagggcactctggatatggtatacgtgtgcatgggaacgtagtaatagttcttgctcctcagtctaaagctccttatgcggtcaaagatcaggtacttgtgattgccaaatgcgatgagagttatttatctttaatgaaggaagcttctgctattattttacagaaccatatcaatgattttgcgtctgaaaaatacgcgaagaagattgctctgagtttaggtaagcctattcttcttcgagctgatgcggcatgtcaaattttaaaagaaggacagcttgttactctcgatcctgaaaaagcccttgtttacaaaggagttgttttggaccaattgttggcgagtggagaattttcatga

SEQ ID NO: 16559 - protein, 598 aa, Parachlamydia sp
MALIRTKIVCTIGPACNSLEKIIELINVGMNVARLNFSHGTQEEHLRTINLLKEARCQLNLPLAIMLDTKGPEIRLGKIRDGQIFLTVGQKWRLVKKEVLGDESQVSIFPLNILDQLPVGTTILFDDGYIASRVIENSSEGVLVEINNSGMIRSSKGVNIPNTSLNLPAVTEKDIDDIRFGCSQDIDLIAASFVRSAEHVLEIKRLLADEKKTDILVIAKIENSEGVQNFDSIVQAADGIMIARGDLGVEVPLSHVPRLQKMMIRKSYLAGKPVVTATQMLESMINNPRPTRAETSDVANAIYDSTSAIMLSGETAIGRYPVETVNVMRSIVEEAEADFNYSTFFDQHAPLVYHDVPSAVTLATVKTAYSSSAKAIFAFTKAGTTARLLSRLRPKMPIIAMTAKEKIFHQLAFNWGVIPFLSEPCNSLDKSLKKISDFALGSQHVSYGDLVVITAGTPFGFSGTTNMMIVENIGDVLVRGHSGYGIRVHGNVVIVLAPQSKAPYAVKDQVLVIAKCDESYLSLMKEASAIILQNHINDFASEKYAKKIALSLGKPILLRADAACQILKEGQLVTLDPEKALVYKGVVLDQLLASGEFS

SEQ ID NO: 16560 - DNA, 1488 bp, Bdellovibrio bacteriovorus
  CDS (1)..(1488)
atgttagcagatcgtcgagcgaagattgtggccactattgggccagcgacacgtgatgagaaaaatctggaaaaagcaataaaggcgggcatgaacgtggctcgccttaacttttcgcacggaagtcatgaagaccacctgaaggtggttcattccctgcgcaagctctctaaagagcttcaggctccggtggcgattcttcaagatcttcaggggccgaagatccgcgttggtaagtttgaaaatggctccatcgaaattaaacctggcgaaaaactggtggtaacgacggcaaaagttctggggaaaccaggattggttccgtccgacttccaagagctgcctttggcctgcgtgccgggcacgcgcatccttctggatgacggcctgatggaagtgaaggttttgcaggttcgcggtgaggaaatcgacgtggaagttgtctatggcggtattctgaaagaccgcaaaggcatgaatcttccgggtgtaaatctgcctgtggactgcatgactccaaaagatctggaggatttgcagttcggtattgccaataaagttgattatattgctttgagttttgttcgtcatgcccgtgatatccgcaagctgcgtgaattgatcgaggccgggaactccaatgcgaagatcgtagccaaaatcgagatggtggaagcgatcgaaaatctggaagaaatctgccgcctgagtgacgctgtcatggtggcgcgcggggatttggcagtggaagtcggtcaaagccgtctgccgggctatcagaagcgtattatttctgtatgcaatcaactgggtaagccggtgatcacggcgactcagatgctggacagcatggttgaaaaccctcgtccgacccgagctgagatcacggatgtggccaatgccgttttggatggaactgatgctttgatgctgtcggcggaatctgccagcggcaaatatccgttcaagtgtatccgcactatgcacgagatcatcactgaggtggaacgcaacgaagaagagtattataaaatctctcttgaaaacgagtttctgagcacgccggcgtctatcgccgccagtgcttcactgagtgcgctgaagctgaatgcaaccgcgatcatctgtctgacgacttccggtaaaacggcaaatatcatttcggccttccgtccgaaggcgcgcattatttccgtgactcagcatctggatgttttgaatggcatggaattgggctggggtattcagacccacgcgatcaagccatataagacgatggaagatatcctgcgtgaagtggatctgttgttggtgtcccatggcttgggtaaaaccggggaccgtgtgattctgacattgggtcagccgattgcttgtggtgcaaaaaccaattcgatctatgtgcacacagtgggcggggaaaacgtggcgaagcttcctaatgacaagttgcctctgcgttgtcaggaagagccggttgttgaataa

SEQ ID NO: 16561 - protein, 495 aa, Bdellovibrio bacteriovorus
MLADRRAKIVATIGPATRDEKNLEKAIKAGMNVARLNFSHGSHEDHLKVVHSLRKLSKELQAPVAILQDLQGPKIRVGKFENGSIEIKPGEKLVVTTAKVLGKPGLVPSDFQELPLACVPGTRILLDDGLMEVKVLQVRGEEIDVEVVYGGILKDRKGMNLPGVNLPVDCMTPKDLEDLQFGIANKVDYIALSFVRHARDIRKLRELIEAGNSNAKIVAKIEMVEAIENLEEICRLSDAVMVARGDLAVEVGQSRLPGYQKRIISVCNQLGKPVITATQMLDSMVENPRPTRAEITDVANAVLDGTDALMLSAESASGKYPFKCIRTMHEIITEVERNEEEYYKISLENEFLSTPASIAASASLSALKLNATAIICLTTSGKTANIISAFRPKARIISVTQHLDVLNGMELGWGIQTHAIKPYKTMEDILREVDLLLVSHGLGKTGDRVILTLGQPIACGAKTNSIYVHTVGGENVAKLPNDKLPLRCQEEPVVE

SEQ ID NO: 16562 - DNA, 1437 bp, Mycoplasma mycoides
  CDS (1)..(1437)
atgactaaagaaaaattacaaaagagaatgaagcgaaccaaagtaattacaacaattggtccttcaactcactctgcagaagctattaaagaattatttaacaatggaatgacaactattcgtttaaatttttcacatggtagttatgaagaacacggttatagaattaaagctgcaaaaaaaatctctaaagctttaaataagccaatctcaataatgttagacactaaaggtcctgaaataagattaggaaaatttaaagataataaacaagaagtagtaaaaggtcaagcaattactatttatacagataattattcttatttaaacaaagaatgtgttcaaggtgaaatgactgttgcttatgatatgtcagttgatttaaaacctgaagatatgattttaattgatgatggtaaattagaattaacagttgattcagttgaacctcaaattattaaagcaactgcatttaatcatcacattgtaaaaactaataaacgtgttaacttacctggaattgatttttcattaccatttttatctgaaaaagatgaaaaagatattttatttggatgtgaacaagatgttgattatatagctgcatcatttgtaaatacagctgaaaatgtaagacaaattaaagaaatcttaactaaagctaatgcaaatcatattcaaattatttcaaaaatagaatcacaagttggattagataatattgatgaaattattgaagaatctgatggaattatgattgcgcgtggtgatttaggattagaaattccatattatgatgtaccttattgagaaaaaattatcatcagaaaatgtagagaaaaaggaaaaatcgttattgttgctactcaaatgttagaaacaatgacagaaaatccatcaccaactagagctgaagtaactgatgtttattatgcaactgaacttggtgctgatgctacaatgttatctggtgaatcagctgctggagattatccatttttaacagttcatacaatgtcaacaattaataaaagagcagaagttgaattctacaacaaaatttactaccaagtacaattagataatgcaagaaactcaacatcaggacctagagctgaaatcgcagacttattagctacaaaaacaaaagatggtgaatataagtatgcaattgttttatcaaaaacaggtgaattattaaaaaccatttctaaatttagaccaaatgtaacaattttaggagttagtccagataagaaattgtgaacttcatttggtgtatgacattcaatttttatgaataaagttgatactttagataatttagataataatgttgaaaaactatcagaaattgctaagtcttgaggagctaagtttggtgaaaaagttttagttgtaagaagtacagctataaaagaaatagaagttatttaa

SEQ ID NO: 16563 - protein, 478 aa, Mycoplasma mycoides
MTKEKLQKRMKRTKVITTIGPSTHSAEAIKELFNNGMTTIRLNFSHGSYEEHGYRIKAAKKISKALNKPISIMLDTKGPEIRLGKFKDNKQEVVKGQAITIYTDNYSYLNKECVQGEMTVAYDMSVDLKPEDMILIDDGKLELTVDSVEPQIIKATAFNHHIVKTNKRVNLPGIDFSLPFLSEKDEKDILFGCEQDVDYIAASFVNTAENVRQIKEILTKANANHIQIISKIESQVGLDNIDEIIEESDGIMIARGDLGLEIPYYDVPYWEKIIIRKCREKGKIVIVATQMLETMTENPSPTRAEVTDVYYATELGADATMLSGESAAGDYPFLTVHTMSTINKRAEVEFYNKIYYQVQLDNARNSTSGPRAEIADLLATKTKDGEYKYAIVLSKTGELLKTISKFRPNVTILGVSPDKKLWTSFGVWHSIFMNKVDTLDNLDNNVEKLSEIAKSWGAKFGEKVLVVRSTAIKEIEVI

SEQ ID NO: 16564 - DNA, 1434 bp, Rhodopseudomonas palustris
  CDS (1)..(1434)
atgagacgcctgcgcaggatcaagatcctcgccacgctcggccccgcctcctccgacagcgcaatgatccgcaagctgttcgaggccggcgccgacgtgttccggatcaacatgagccacaccccgcacgacaagatgcgggagctggtgaagaccatccgtaacgtcgaaagcagctacggtcgcccgatcggcatcctggtcgatctgcagggaccgaagctgcggctgggctcgttcgccaatggaccgatccagctcaacaacggctcgaacttcgtcctcgactcgatcaaggagccgggcgacgagacgcgggtgtatctgccgcatccggagatcctcgcggcgctcaaggtcggagacgcgctgctgctcgacgacggcaaggtgcgcttgatctgcgaagagacccaaggcgatcgcgcggtgacccgcgtggtgatcggcggcaagatgagcgaccgcaagggcgtcagcctgcccgataccgatctgccgatgtcggcgatgaccaacaaggaccgcgccgacctggaagctgcgtgcgagaccggcatcgactgggtggcgctgagcttcgtgcagcgcgccgaagacgtcgtcgaagccaagcggatgatccgcggccgtgccgccgtgatggccaagatcgagaagccgcaagcgatcgaccggctcgaggacattctcgacgtctccgacgcgttgatggtggcgcgcggcgacctcggcgtcgagatgccgctggagcgggtgccgagcctgcagaagcagatgacccgcatggcgcggcgcgccggcaagccggtggtggtcgcgacccagatgctggaatcgatgatctccagcccggtgccgacccgtgccgaagtctccgacgtcgcaaccgccgtgtacgaaggcgccgacgcgatcatgctgtcggccgaatccgccgccggcaaatatccggtcgaagcggtgtcgacgatgaaccgcatcggcgaggaagttgagcgcgacgtcacctatcgcaccgtggtgacggcgcagcgccccgatccggaagcgaccgccggcgatgccatcgcgggcgcggcaaggcagatcgcagagacgctcgatctgtcggcgatcatctgctggacctcgtcgggctcgaccgcactgcgggtcgcgcgtgaacggccgaaggtgccggtggtggcgatcactccgagccttcacaccggacgcaagctgtcggcggtgtggggcgtccactgcgtggtagcggaagacgccaaggatcaggacgacatggtcgagcgcgccggccgcatcgcattccgcgacggcttcgccaaatccggccagcgcgtcatcatcgtcgccggcgtcccactcggcacccccggcgccaccaacatggtccgcatcgcctatgtcggaccgagcgatgcggacgtgtga

SEQ ID NO: 16565 - protein, 477 aa, Rhodopseudomonas palustris
MRRLRRIKILATLGPASSDSAMIRKLFEAGADVFRINMSHTPHDKMRELVKTIRNVESSYGRPIGILVDLQGPKLRLGSFANGPIQLNNGSNFVLDSIKEPGDETRVYLPHPEILAALKVGDALLLDDGKVRLICEETQGDRAVTRVVIGGKMSDRKGVSLPDTDLPMSAMTNKDRADLEAACETGIDWVALSFVQRAEDVVEAKRMIRGRAAVMAKIEKPQAIDRLEDILDVSDALMVARGDLGVEMPLERVPSLQKQMTRMARRAGKPVVVATQMLESMISSPVPTRAEVSDVATAVYEGADAIMLSAESAAGKYPVEAVSTMNRIGEEVERDVTYRTVVTAQRPDPEATAGDAIAGAARQIAETLDLSAIICWTSSGSTALRVARERPKVPVVAITPSLHTGRKLSAVWGVHCVVAEDAKDQDDMVERAGRIAFRDGFAKSGQRVIIVAGVPLGTPGATNMVRIAYVGPSDADV

SEQ ID NO: 16566 - DNA, 1422 bp, Corynebacterium diphtheriae
  CDS (1)..(1422)
atggaacgtcgaactaagattgtttgtacattagggccggcagtcgcttcccgtgagggaattcttggactggttaaagccggcatgaatgtcgcacgtatgaatatgtcacacggcgaccacgcagatcatgagaagaattaccagtgggtccgcgaagctacggatgaaaccggacgcgctgttggtattcttgccgatctgcaggggccaaagattcgtctcggtcgctttatcgatggcgcaacggtgtgggagaacggtgaaatcgttcgtatcactgttgatgacattgaaggtacacacgaccgtgtgtctaccacctacaagaacctcgctaaagatgcgaagcctggcgatcgtcttttggtcgacgacggcaaggttgcattgcgctgtgttgaagtagatggaaacgatgttgtttgtgaggttgtagaaggcggcccagtctctaacaacaagggtgtttcccttcctggaatggatatttccgttccagctttgtctgaaaaagacattgctgatttgcgcttcgctctcaatctcggtgttgacattattgcgttgtccttcgtccgctccccagcagacgtggaacttgttcatgccatcatggatgaagaaggtcgccgttgcccagtgatcgcaaagcttgagaagccagaagccatggacgctttggagtccatcgtattggctttcgacggcatcatgattgctcgtggtgacttgggtgttgagtgcccgttggagcaggtgccgctgttccagaagcgtgccatccagattgctcgtgaaaacgctaagcctgtgattgtggcaacccagatgctcgattccatgatcgagaacctacgcccaacccgtgctgaggcttctgacgtagctaacgctgttcttgacggtgcagatgccgttatgctgtccggtgagacttcggtcggtatcgatccagctaacgttgtccgtactatgtcacgtatcgtttcctacgctgagattgatggccgggtaccaaacttggctcatattccacgcaccaagcgtggcgtgatttcctactctgcacgcgacattgcagagcgtttgaatgcaaaggcacttgtagcattcacctcttcaggtgataccgcaaagcgtgttgctcgtttgcactcgcagctgccgctattggtctttacccctcaccaagaagtccgctctcagttggctttgacttggggtgtagaaaccttccttaccgacgaggttaaggacacagacgagatgatgcgtacgatcgatgagcagttgcttgctctcgatacctacagcgaagatgacatgatcgtgctcgtagccggaacccctccaggagtccaaggcaataccaacatgatccatgtacaccacctaggtgaggacctcaacggtctataa

SEQ ID NO: 16567 - protein, 473 aa, Corynebacterium diphtheriae
MERRTKIVCTLGPAVASREGILGLVKAGMNVARMNMSHGDHADHEKNYQWVREATDETGRAVGILADLQGPKIRLGRFIDGATVWENGEIVRITVDDIEGTHDRVSTTYKNLAKDAKPGDRLLVDDGKVALRCVEVDGNDVVCEVVEGGPVSNNKGVSLPGMDISVPALSEKDIADLRFALNLGVDIIALSFVRSPADVELVHAIMDEEGRRCPVIAKLEKPEAMDALESIVLAFDGIMIARGDLGVECPLEQVPLFQKRAIQIARENAKPVIVATQMLDSMIENLRPTRAEASDVANAVLDGADAVMLSGETSVGIDPANVVRTMSRIVSYAEIDGRVPNLAHIPRTKRGVISYSARDIAERLNAKALVAFTSSGDTAKRVARLHSQLPLLVFTPHQEVRSQLALTWGVETFLTDEVKDTDEMMRTIDEQLLALDTYSEDDMIVLVAGTPPGVQGNTNMIHVHHLGEDLNGL

SEQ ID NO: 16568 - DNA, 3179 bp, Lactobacillus casei
  CDS (1307)..(3070)
aaaaaattgcaaactgcccatggaccaattccagttatcactgtcgacacgaccagcaaggagagtgttttgttagataagcgatactgggtcactgctgacaccagcttgatggctgatcttgaatcgcggtttggtgcggctaatgtggtgttgcgaaaacgacaagaagaatagagaaaattgtaaaatgttctcattttcagggactttgtttctgaaaagtggtaaactcaatgagtatttgtgatgggacaaatcgcaaaagaatatgcatgaggtgaaataatgaaacgcattggtattttgaccagtggcggggatgcgcctggcatgaacgccgcggtccgcgctgttgctcgcaaggcgatgcacgaaggccttgaagtatatggcatcaattatggatttgctgggttagttgccggcgacattttcaaaatgaatgaatcaactgtcggtgataagattcaacgcggcgggaccatgttatattccgcacgttatccacaatttgcgcaagaagaaggccagttgcgcggggtcgaacaattaaacaagtttggcatcgaggcgttggtcgtcatcggcggagacggctcttatcacggtgcactagctttgacgcgtcacggtttcaacaccattggcctgccaggaacgatcgacaacgatattccttacacggacttcacgattggctttgatactgccgttaatacagttgtggaagctgttgaccgtcttcgcgataccgcggcttcgcatgaacgaacctttgtcattgaagtcatgggtcgtgaagctggggacattgccctttggtcgggcgtcgccggtggtgccgaggatgtcatcattccagaacacgactttgacgttaagaaaattgcgtcgaagttgcaaagttctcgtgaacgtggtcaaaagcatgcggtcattcttttggcagaaggcgtgatgcacgctgatcaatttgccaaggaattagccgcacatggcgatttccaattacgttcgacagttctgggacacattgttcgtggcggtgcaccgtccgcacgtgatcgcgttttggcttcacaaatgggttcatacgcggttgaacttttgttgcaaggcaaaggcgctttggctgtcggcattgaaaacaacaagatcacggcacatgatgttcggaccttgtttgatgccaagcatcacgcagaactttcgctctacaccttagcggaagagttaacattttaatctcgtaaacaaacgacattaacgtctgtttaaataatttcaaggagcgatttcacttatgaaaaaaaccaagatcgtcagcacgcttggacctgcaagtaacaccactgatatcatcgttaagttgattgaagcgggtgccaacgttttccgtttcaatttctcacatggtgatcatgaagagcatttggcacggatgaacatggttcacgaagctgaaaagatcacgggtaagaccgttggtatcatgctggatacgaagggtgccgaaattcggacaactcttgaagataccccgaatggtaagatcgattttcacaccggtgacaaagttcgcatctccatggatgcaagtctgaaaggcaccaaggaaaaagttgctgttacctatcctggcctttatgatgacactcacgttggcggccatgttttgtttgatgatggcttgattgacatgaagatcaccgaaaaggacgaaaagaaccgtgaactcgttaccgttgttcaaaacgacggtgtccttggtggtaagaaaggtgtcaacgctcctggtgttgccatcaacttgcctgggattacggaaaaagactccgatgacattcgtttcggcttggacaacgggatcaacttcattgctgcttcctttgttcgtaagcctcaagacgttttagacattcgtgaactccttgaagaaaagaacgcacttaatgttcagatcttccctaagatcgaatcacaagaaggcatcgacaacattgatgacatcttgaaggtttccgatggcttaatggttgctcgtggcgacatgggtgttgaaattccatttgaacatgttccgatcgttcagaagcgcttgatcaagaagtgcaactctttgggtaagccggttatcacggctacacaaatgttggattccatgcaagaaaacccacgtcctacccgtgccgaagtaaacgacgttgccaatgccgtgtttgatggcaccgatgcaacgatgctttctggcgaatctgctaatggtgactatccggttgaatccgttgctgcaatggctcggattgacgaatacaccgaagcagcgatgatggatcaggatgccttcgcattgaaggaatacagtaacaagaacgtcaccgaagctgttggccaaagtgttgcacacacggctcgcaacttaggggttaagaccattgttgctgcgaccgaatccggctacactgcccgcatgatttccaagtatcgtccgaaggctgacattcttgccattaccttcagcgaaaagacccaacgcggcctgatggtcaactggggtgtttacccaatcattgctgaaaagcctgctaacaccgatgctatgttcgacttggcaaccaagaaggcccaagaccttggctttgctaaggaaggcgatctgatcttgatcactgccggtgttcctgttggtgaatctggcacaaccaacgtaatgaaggttcactcatggctccagctggttcaaggctcaggtgtcggcgacgaatccacgattggtaaggcagtcatcgcaagcaacgctcaagaagctgctgctaagatgcaaaagggtgacattctggttgttaagacgactgacaaagattacttgccagcaatcgaaaaagcagctgccttggttgttgaaaccggtggcttgaccagtcacgcagctgttgttggtattgctatgggtatcccagttgttgttggtgctgaaaatgctaccagcgtcatctccgatggccagatcattactgttgactcccgtcgtgggatcatctacaaaggtgctaccaacgccctttaatcttcaaaatgacctgttaaaggttaggaaaaactctcaaggaaacttgggagtttttttcttcccaaaaaacagtagcgttacctgttttgagcaacttactgataaa

SEQ ID NO: 16569 - protein, 587 aa, Lactobacillus casei
MKKTKIVSTLGPASNTTDIIVKLIEAGANVFRFNFSHGDHEEHLARMNMVHEAEKITGKTVGIMLDTKGAEIRTTLEDTPNGKIDFHTGDKVRISMDASLKGTKEKVAVTYPGLYDDTHVGGHVLFDDGLIDMKITEKDEKNRELVTVVQNDGVLGGKKGVNAPGVAINLPGITEKDSDDIRFGLDNGINFIAASFVRKPQDVLDIRELLEEKNALNVQIFPKIESQEGIDNIDDILKVSDGLMVARGDMGVEIPFEHVPIVQKRLIKKCNSLGKPVITATQMLDSMQENPRPTRAEVNDVANAVFDGTDATMLSGESANGDYPVESVAAMARIDEYTEAAMMDQDAFALKEYSNKNVTEAVGQSVAHTARNLGVKTIVAATESGYTARMISKYRPKADILAITFSEKTQRGLMVNWGVYPIIAEKPANTDAMFDLATKKAQDLGFAKEGDLILITAGVPVGESGTTNVMKVHSWLQLVQGSGVGDESTIGKAVIASNAQEAAAKMQKGDILVVKTTDKDYLPAIEKAAALVVETGGLTSHAAVVGIAMGIPVVVGAENATSVISDGQIITVDSRRGIIYKGATNAL

SEQ ID NO: 16570 - DNA, 1341 bp, Onion yellows phytoplasma
  CDS (1)..(1341)
atgaacaaaactaaaataatttgtaccttaggacctgcttcttatgataaaaacattttacaagccttaattcaaacaggtttgaatgtagcaagatttaatttttctcacgctcaatacgaacaaactaaacttttaatgaaaaccattaaaactattagcgataaattagacaaaaacacaggacttatgttagatactaaaggacctgaaattagaactcacgaatttgatggtgtagtaacaattcaaaaagattctgaagtaaaaatatctatgacagaagttttaggtaatgctaaacttttttcagttagttattctaatttatacaatgaattaaaagttggcgatatggttaatattgatgatggatacttatctttggaagttgtaggcaaagacgaagccaaacaacaattagttactaaagccaaaaatactcactccatcaaatctcgtagaggtgtaaatgttcctaaagttaatttagaaatggattttatttctcctaaagattatcaagatattgtttttgctgcccaacaagattttgattatattgctgcttcatttgttagaagagctcaagatgtcaaagatattagaaaaattttacaagaacaaggaaattccaacatccaaattatttctaaaatagaaaatcaagaaggtgttgataatttagaagaaatcattcaagaatcagacggtattatggttgcaagaggtgatttaggaatagaagttgatggtgaattagtaccactttaccaaacgcgtatgattactaaatgtttagaatacggcaaaccagttgtagtagctactcaaatgttagaatctatgcaaagaaatccgcgcccaaccaaagctgaaacttctgatgtctttaatgcagttagagaaggcaccacctttactatgctatcgggcgaaagtgcttcaggtgaatatcctgtagaagctgtaacttatatgaaaaaaattaattatcaagctgaaaaagtagttaattatcaagctttatcacaagtataccaacctaaaaactccaaagaaaaccttttattaagtgctgtggaattggctttacgcaccgatgttaaagcaattgttgtctatgacttaaaagatgcttataatgtttctaaatttcatccatccgttcctgttttggctttagttaaaactgaacaagaagctcgtcgtttagtactaaattttggggtttgtccttttgtttctgaaaccaaattacaaactaaattggaagaacttacccaaaatcaaagtagtaattgtcttgttgttaaagatgggatgctttattttaaataa

SEQ ID NO: 16571 - protein, 446 aa, Onion yellows phytoplasma
MNKTKIICTLGPASYDKNILQALIQTGLNVARFNFSHAQYEQTKLLMKTIKTISDKLDKNTGLMLDTKGPEIRTHEFDGVVTIQKDSEVKISMTEVLGNAKLFSVSYSNLYNELKVGDMVNIDDGYLSLEVVGKDEAKQQLVTKAKNTHSIKSRRGVNVPKVNLEMDFISPKDYQDIVFAAQQDFDYIAASFVRRAQDVKDIRKILQEQGNSNIQIISKIENQEGVDNLEEIIQESDGIMVARGDLGIEVDGELVPLYQTRMITKCLEYGKPVVVATQMLESMQRNPRPTKAETSDVFNAVREGTTFTMLSGESASGEYPVEAVTYMKKINYQAEKVVNYQALSQVYQPKNSKENLLLSAVELALRTDVKAIVVYDLKDAYNVSKFHPSVPVLALVKTEQEARRLVLNFGVCPFVSETKLQTKLEELTQNQSSNCLVVKDGMLYFK

SEQ ID NO: 16572 - DNA, 1758 bp, Listeria monocytogenes str
  CDS (1)..(1758)
atgaaaaaaacgaaaattgtttgtacaattggtcctgcaagtgagtcagttgacacattagttcagttgatcgaagcaggaatgaacgttgcacgtcttaatttctctcacggagattttgaagagcacggtgcgcgtattgtaaatatccgcgaagcatcgaaaaaaactggtaaacaagtggctatcttacttgatacaaaaggtccagaaatccgtacaaacgacatggtcggcggaaaattagaattccaaacaggtgatgttgtacgtgtttctatgactcctgttgaaggaacaaaagaaaaattctccgtgacttacggcgaactttacgatgatgtagaaattggttcttccattttacttgatgacggcttaatcggtcttgaagtaatcgaaaaagacgaagctaatcgcgaactagtaacaaaagtacttaacccaggtgtacttaaaaataaaaaaggtgttaacgtaccaaacgtttctatcaacctaccaggaatcacagaaaaagatgctgctgatatccgctttggtttagaacaaggtattgattttatcgctgcatctttcgtacgtcgtgctacagatgttcttgaaatcactaaaattctagaagagcacaatgcaactcacgtacaaatcattcctaaaatcgaaaaccaagaaggcgttgataatatcgacgaaatcttacaagtatctcaaggcctaatggttgctcgtggggaccttggtgttgaaattccagctgaagaagttccgattgtacaaaaagaacttatcagaaaatgtaataaacttggtaaacctgttattactgcaacacaaatgcttgattccatgcaacgtaacccacgtccaactcgcgctgaagcaagtgacgtagcgaatgcgatttttgatggaacagatgcaattatgttgtccggtgaaacagctgctggggattatccagtagaagcagttaaaatgatggcgaaaatcgctgttcgtacagaagaagtactagttgctcaagataaatttgcacttaaacttcacgaaaatacggatatgacagaagctatcggtcaagcagttggccatactgcgaaaaacctaaatgtacaaactattgttgctgcgactcaaagtggtcacacagcgcgtatgatctctaaataccgtcctaaatctcatatcgttgctgtaacattcaacgagcatgtataccgcggtttagcactttcatggggtgtttatcctcgcctagctactccagttagcaacacagatgaaatgttcgaccttgcagtgaaagaatctcttgcttctggcgttgcaaaacaaggcgacttaattatcatcactgctggtgttccagttactgaaagtggaacaacaaacgtaatgaaaatccaattaattggtgaaaaagttgttaaaggccaaggtattggcagcaaatctgttatcggtaaagcaatcgttgctaaatccaatgcagaagcacttgaaaaagcagaagaaggcggaatcttaatcgttaaaacaacggataaagaaatgctacctgcattcgagaaaagtgcagcagttgttgtggaagaaggcggcttgactagccacgcagcagttgtaggaatcaacctaggcattcctgtcatcgttggcgctaaagatgcaacatctcttgtaaaagacggtgaaatcattactgttgattctcgtcaaggtgttgtatataacggcaaaacagcaacacattaa

SEQ ID NO: 16573 - protein, 585 aa, Listeria monocytogenes str
MKKTKIVCTIGPASESVDTLVQLIEAGMNVARLNFSHGDFEEHGARIVNIREASKKTGKQVAILLDTKGPEIRTNDMVGGKLEFQTGDVVRVSMTPVEGTKEKFSVTYGELYDDVEIGSSILLDDGLIGLEVIEKDEANRELVTKVLNPGVLKNKKGVNVPNVSINLPGITEKDAADIRFGLEQGIDFIAASFVRRATDVLEITKILEEHNATHVQIIPKIENQEGVDNIDEILQVSQGLMVARGDLGVEIPAEEVPIVQKELIRKCNKLGKPVITATQMLDSMQRNPRPTRAEASDVANAIFDGTDAIMLSGETAAGDYPVEAVKMMAKIAVRTEEVLVAQDKFALKLHENTDMTEAIGQAVGHTAKNLNVQTIVAATQSGHTARMISKYRPKSHIVAVTFNEHVYRGLALSWGVYPRLATPVSNTDEMFDLAVKESLASGVAKQGDLIIITAGVPVTESGTTNVMKIQLIGEKVVKGQGIGSKSVIGKAIVAKSNAEALEKAEEGGILIVKTTDKEMLPAFEKSAAVVVEEGGLTSHAAVVGINLGIPVIVGAKDATSLVKDGEIITVDSRQGVVYNGKTATH

SEQ ID NO: 16574 - DNA, 1425 bp, Thermus thermophilus
  CDS (1)..(1425)
atgccgccttttaagcgcaccaagatcgtggccaccctggggccggccacggacgacaaggaggtgatccgcgccctggcggaggccggggccgacgtcttccgcctgaacttcagccacggcgcccccgaggaccacaggcgccgggtgggctgggtgcgggaggtggcggaggagctcggccgaaccctggccgtcctccaggacctccagggcccgaagatccgtgtgggccgtttccgggagggccaggtcctcctccgcccggggcagaggttcgtcctcaccgccgagcccgtggagggggacgagcaccgcgtttccgtgagctacaaggggcttcccgaggacgtttccccggggcagatcctccttctggacgacggccgcatccggctcaaggtcctggaggtccggagcccggagatcctcacggaggtggaggtgggcggggtcctctccaacaacaaggggatcaacatccccggggcggacctctccatccccgccctctcggagaaggatatccaggacctggccctgggggcggagctcggggtggactgggtggcggtctccttcgtccgcacgcgggacgacctcctcctcgcccggcactacctctcccgctacggctccaaggccaggctcatggccaagatcgagaagccctcggccgtggcccggtttgaggagatcctggaggaggcggacgggatcatggtggcccggggggacctcggggtggagatgcccctggaggaggtgcccatcgtccagaagcgcctcatcctccggtgcatcgccgccgggaagccggtgatcaccgccacccagatgctggagtccatggtgcagaacccgagccccacccgggccgaggcctcggacgtggccaacgccatctttgacgggaccgacgcggtgatgctctccgcggagacggcggccggggcctacccggtggaggcggtggccatgatgagcaggatcgccaaggcggtggaatcctccccggagttcttgcagaagctcaacgtcctccgccccgcccccacccccaccacccaggacgccatcgcccaggcggcggacgacgtggtggaggcggtgggggcacgggccatcgtggtcttcacggccacgggcggctcggcgcggaggatcgcccgcacccggccccaggtgcccatcctggccctcaccccgaaccccgaggtgcggaaccagctggccttggtctggggggtctacccccatctcgcccccgacccccaggacaccgacgacatggtccgcatcgccctcagggaggtgaaagccctggggctcgcccaggtgggggaccgggtggtcatcgccgccggggttcccttcggggtccgggggacaacgaacctcatccgcgtggagcgggtggggtag

SEQ ID NO: 16575 - protein, 474 aa, Thermus thermophilus
MPPFKRTKIVATLGPATDDKEVIRALAEAGADVFRLNFSHGAPEDHRRRVGWVREVAEELGRTLAVLQDLQGPKIRVGRFREGQVLLRPGQRFVLTAEPVEGDEHRVSVSYKGLPEDVSPGQILLLDDGRIRLKVLEVRSPEILTEVEVGGVLSNNKGINIPGADLSIPALSEKDIQDLALGAELGVDWVAVSFVRTRDDLLLARHYLSRYGSKARLMAKIEKPSAVARFEEILEEADGIMVARGDLGVEMPLEEVPIVQKRLILRCIAAGKPVITATQMLESMVQNPSPTRAEASDVANAIFDGTDAVMLSAETAAGAYPVEAVAMMSRIAKAVESSPEFLQKLNVLRPAPTPTTQDAIAQAADDVVEAVGARAIVVFTATGGSARRIARTRPQVPILALTPNPEVRNQLALVWGVYPHLAPDPQDTDDMVRIALREVKALGLAQVGDRVVIAAGVPFGVRGTTNLIRVERVG

SEQ ID NO: 16576 - DNA, 1758 bp, Bacillus cereus
  CDS (1)..(1758)
atgcgtaaaactaaaattgtatgtactataggtcctgctagtgaaagtattgaaaaattagagcaattaatcgaagcaggtatgaacgttgctcgtttaaacttctctcatggtagccatgaagaacacggcgctcgtattaaaaacattcgtgaagcttcaaagaaaactggtaaaacagttggtatcttacttgatacaaaaggtccagaaatccgtactcacgacttcgtagacggacaagctgagcttgtaacaggtgcagaagttgttatttctactgagcaagtattaggtactgcagagaagttctctgtatcttatgctggtctttatgacgatgtaaacccaggttctcgcattctaatcgatgatggtcttatcgagctagaagtaatcgaaaaagctgacggaaacatccgtacaaaagttcttaacagcggaactgtaaaaaataaaaaaggtgttaacgtaccaaacgtaagcattaagcttcctggtatcactgaaaaagacgtaaaagatatcatcttcggtatcgagcaaaaagttgatttcatcgcagcttcattcgtacgtaaagcagctgacgtattagaaatccgtgaattactagaagagcataacgctcaatacatccaaatcgtaccaaaaatcgaaaaccaagagggtatcgacaatatcgattcaatcttagaagtttctgacggtttaatggtagctcgtggtgacatgggtgtagaaattccaccagaagaagtaccattagtacaaaaacgtctaatcaaaaaatgtaacgtgttaggtaaaccagttattactgcaacacaaatgttagattctatgcaacgtaacccacgtccaactcgtgcggaagcaagtgacgtagctaacgcaatcttcgatggtacagacgcaatcatgctttcaggtgaaacagctgctggacaatacccagtagaagcagtaacaatgatggctaacattgcagtacgtgttgaaaaatcattacaatatgaagatatgttcaaaaaacgtattaaagagttcactccaacaattacagatgcaattagccaatctgttgcgcatacagcacttgctcttgatgtagctgcaatcgtagctccaacagaaagtggatatactgcgaaaatgatctctaaataccgtccaaaatctccaatcgtagctgtaacatctgacgagcaagtaggacgtcgtcttgcgcttgtttggggtgtacaagcatttatggctgagaagcgcgcagcttctactgacgaaatgttagatacagcgattcaaacaggtatggatgcaggtctaatcggacttggagacactgtagtaatcactgctggtgttccagttgctgaaactggtacaacaaacttaatgaaaatccacgttgttggtgaagaagttgctaaaggacaaggaatcggtcgtaaagctgcaaaaggtaaagtagttgtagcgaaaacagctgctgaagctgtagcgaacgtaaacgaaggtgatatccttgttacaacaagcactgataaagatatgatccctgcaatcgaaaaagctgctgctctagttgtagaagaaggcggtctaacaagccatgcggctgttgtaggtgtatcaatcggtattcctgttatcgttggtgtaaacggcgtaacagcaactttaaaaaatggccaagaagtaacagttgatgcagcacgcggaattgtttataatggacatgcggaagtgctataa

SEQ ID NO: 16577 - protein, 585 aa, Bacillus cereus
MRKTKIVCTIGPASESIEKLEQLIEAGMNVARLNFSHGSHEEHGARIKNIREASKKTGKTVGILLDTKGPEIRTHDFVDGQAELVTGAEVVISTEQVLGTAEKFSVSYAGLYDDVNPGSRILIDDGLIELEVIEKADGNIRTKVLNSGTVKNKKGVNVPNVSIKLPGITEKDVKDIIFGIEQKVDFIAASFVRKAADVLEIRELLEEHNAQYIQIVPKIENQEGIDNIDSILEVSDGLMVARGDMGVEIPPEEVPLVQKRLIKKCNVLGKPVITATQMLDSMQRNPRPTRAEASDVANAIFDGTDAIMLSGETAAGQYPVEAVTMMANIAVRVEKSLQYEDMFKKRIKEFTPTITDAISQSVAHTALALDVAAIVAPTESGYTAKMISKYRPKSPIVAVTSDEQVGRRLALVWGVQAFMAEKRAASTDEMLDTAIQTGMDAGLIGLGDTVVITAGVPVAETGTTNLMKIHVVGEEVAKGQGIGRKAAKGKVVVAKTAAEAVANVNEGDILVTTSTDKDMIPAIEKAAALVVEEGGLTSHAAVVGVSIGIPVIVGVNGVTATLKNGQEVTVDAARGIVYNGHAEVL

SEQ ID NO: 16578 - DNA, 1416 bp, Treponema denticola
  CDS (1)..(1416)
atgaaaaaaacaaaaatagtatgcacaatagggcccgcttccgactcggaaagggtcttggcagaaatgtttaaagccggtttaaatgtctgccgccttaatttttcgcatggaagccatgaagaacacaaggttaaaatagatcgaataaaaaaaataagagaagagttaaaaatgcctattgcacttttactggatactaagggacccgaaatccgtttgggcctttttgaaaagcctgtagaaattgtacaaggtcaggaatttataattacaaccagagatgtaatcggaacaaatcaaatatgcagcatctcatataagaatattgccgccgaaattaaacctaaaagcagaatccttataaatgacggattattggagttacaggttatcgatattttaaacgatacggacatagaatgtgtcgcagtaaattccggaaccctaagcagccgaaaaggtgtaaacattccgggcttgagggtaaaccttccttacatgagtgaaaaggatatctccgatatcgaattcggaattgaaaatgatgtggattttattgccgcctcctttacacaaagagccgacgatattatccaaataagaaaacttttggaaaaacacaaaagtacaatcgccgttatagcaaaaatagaaaatcaagaaggcttggacaacatagatgaaattttagcggaagccgacggaataatggtagcccggggagatatgggtgtagaaatagagcccgaaaaaatccctcatcttcaaaagcagctgataaaaaaagcaaaccttgcaggaaagccggttatcaccgcaactcagatgctcgaatctatgacccacaacctgcgtcccaccagagccgaagttaccgacgttgcaaacgctattctcgacggaacatcagctgtaatgctttctggagaaaccgcagcaggcgaataccctgtcgaaaccgtggccatgatgacctcaattgcgaactctatagaagaaacattagattatgaaaaactatttgctgaaaatgcttctcttcatgagaccacaatcacaaatgcaattgcaagagccacctgctccactgccctagccctcgatgcaaatgcaatcataacggcatccgcttcgggaataacgcccagagctctttcaaaatttaaaccaagggtaccgattattgcaataacggaatcgcctcaggttatgagaaagatggccctcgactgggacgtatatccggttttagccgatcctataaaatcgaccgataacatgttcgatgtgtgttcgcaaattgcaaaggatacaggccatgtaaaaaaaggagacatagcaatccttacggccgggattcctataggcaaagcaggatctacaaaccttctaaaggtagaaataatagaataa

SEQ ID NO: 16579 - protein, 471 aa, Treponema denticola
MKKTKIVCTIGPASDSERVLAEMFKAGLNVCRLNFSHGSHEEHKVKIDRIKKIREELKMPIALLLDTKGPEIRLGLFEKPVEIVQGQEFIITTRDVIGTNQICSISYKNIAAEIKPKSRILINDGLLELQVIDILNDTDIECVAVNSGTLSSRKGVNIPGLRVNLPYMSEKDISDIEFGIENDVDFIAASFTQRADDIIQIRKLLEKHKSTIAVIAKIENQEGLDNIDEILAEADGIMVARGDMGVEIEPEKIPHLQKQLIKKANLAGKPVITATQMLESMTHNLRPTRAEVTDVANAILDGTSAVMLSGETAAGEYPVETVAMMTSIANSIEETLDYEKLFAENASLHETTITNAIARATCSTALALDANAIITASASGITPRALSKFKPRVPIIAITESPQVMRKMALDWDVYPVLADPIKSTDNMFDVCSQIAKDTGHVKKGDIAILTAGIPIGKAGSTNLLKVEIIE

SEQ ID NO: 16580 - DNA, 1419 bp, Mycobacterium paratuberculosis
  CDS (1)..(1419)
atgagtagacgcgggaagatcgtctgcacccttggcccggcgaccaattcggacgagttgattttggcgctggtcgaggccggaatggacgtcgcccgactgaacttcagccacggcgactacgccgaccacaaagccgcctacgaacgggtgcgggtggcctccgacgccaccggccgcgccgtcggcgtgctcgccgatctgcagggccccaagatccgcctggggcgctttgccaccgggcccacctactgggccgacggcgaaacggtccgcatcaccgtcgccgactgcgaaggcagccacgaccgggtgtcgaccacctacaaacaactggcccaggacgccgcggtcggggaccgggtcctggtcgacgacggcaaggtcggcctggtggtcgacggcatcgagggcgacgacgtcatctgcaccgtggtcgagggcggcccggtcagcaacaacaagggcatctcgctgccgggcatgaacgtctccgcaccggccttgtccgacaaggacatcgaggacctcaccttcgcgctcgagctgggcgtcgacctggtcgcgctgtccttcgtgcgttcgccctccgacgtcgagctggtgcacgaggtgatggaccgcgtcggccggcgggtgcccgtgatcgccaaactggaaaagccggaggccgtcgacaacctggaagccatcgtgctggccttcgacgccatcatggtggcccgcggcgacctcggtgtcgaacttcccctggaagaggttccgctggtgcagaagcgggccatccagatggcccgggagaacgccaaacccgtcatcgtggcaacccagatgctcgattcgatgatcgagaactcacggccgacccgggccgaggcctccgacgtcgccaacgccgtgctggacggcgccgacgccgtgatgctgtccggggagacctcggtgggcaagtacccgctggcggccgtgcggaccatggcgcgcatcatctgcgcggtcgaggacaactccacggccgccccgccgctcacccacgtgccccgcaccaaacgcggggtgatctcgtatgcggcccgcgacatcggcgaacgcctggacgccaaggcgctggtcgcgttcacccagtccggcgacaccgtcaagcggctggcgcggttgcacaccccgctgccgctgctggccttcacggcatggccggaggtgcgcagccagctggccatgacctggggcaccgagacgttcatcgtgccgatgatgacctccaccgacggcatgatccgccaggtggacaagtcgctgctggaactcggtcggtaccggcgtggtgacctggtggtgatcgtcgccggcgcgccacctggcacagtagggtcaaccaacctgatccacgtgcaccggatcggggaggacgacgtctag

SEQ ID NO: 16581 - protein, 472 aa, Mycobacterium paratuberculosis
MSRRGKIVCTLGPATNSDELILALVEAGMDVARLNFSHGDYADHKAAYERVRVASDATGRAVGVLADLQGPKIRLGRFATGPTYWADGETVRITVADCEGSHDRVSTTYKQLAQDAAVGDRVLVDDGKVGLVVDGIEGDDVICTVVEGGPVSNNKGISLPGMNVSAPALSDKDIEDLTFALELGVDLVALSFVRSPSDVELVHEVMDRVGRRVPVIAKLEKPEAVDNLEAIVLAFDAIMVARGDLGVELPLEEVPLVQKRAIQMARENAKPVIVATQMLDSMIENSRPTRAEASDVANAVLDGADAVMLSGETSVGKYPLAAVRTMARIICAVEDNSTAAPPLTHVPRTKRGVISYAARDIGERLDAKALVAFTQSGDTVKRLARLHTPLPLLAFTAWPEVRSQLAMTWGTETFIVPMMTSTDGMIRQVDKSLLELGRYRRGDLVVIVAGAPPGTVGSTNLIHVHRIGEDDV

SEQ ID NO: 16582 - DNA, 1443 bp, Geobacter sulfurreducens
  CDS (1)..(1443)
atggatacactgtcacgcaaaaccaagatcatcgccactctggggcccgtcagctcctcgcccgacatgatccggcagctgatggacgcaggagtcgatgtcttccggctcaacttttcccacggctccaacgaccagcggcgggaggtaatcgccgccatccggcgtctttccgccgaacggggcaaggagataggcattctggccgatctccaggggcccaagatcaggaccggcaggatggagaacggtgccattccgctggtgcggggcgactcgctcgacattaccaccgatgaggtcctggggcgccccggtctcatttccaccatctaccagtctctcccccacgacgtgaagcccggctcacgcatcctgctggacgacggccttatcgagttgcgggtccagtccgtgtccggcgccacggtccgttgcaccgtggtccaggggggcatgctcaaggatctgaaagggatcaacctccccggcgtcaaggtttctgcgccgtcgctgtcggagaaggacctccgcgatctggatttctgcctggaggtgggggtcgactacattgccctgtcctttgtccgcactgccgccgacgtggaggggctgaagcggatcctcttcgaacgggacgtccaggtgccggtggtggccaagatcgagaagcccgaggccctgcgcaacttcaaaagcatcctcaaggttgccgatgcggtcatggtggcccggggcgatctgggggtggaaatcagcccggaaaaggtccccctgttccagaaaaagatcatccgggcctgcaacgaggccggcaaaccggtgatcaccgccacccagatgcttgaatccatgattagccatccgcgccccacccgggccgagacctcggacgtggccaacgccatcctcgacggaaccgatgcggtcatgctctcgggtgagaccgcctcggggcagtttcccctggaagcggtgcgtaccatggacaaggtggccctcgacgttgagcgcttcgctcaggtggaggacggctcggggccacgccgccacagcgtcagcatcgccgaggcggtggccgaggccgcctgccacgctgccgtcattctgaaggcgaaggccgtggcctgcatgacccagtcggggagcacggctgcccgcatctcacgctaccggcctccgctgccgatcctcgccttcaccggttcggtggacaccatgcgacggctgtcgctctactggggagtcaaggcataccccatcggcaccatggccggcaccgacgagcagatagtggccgtggagtcgacgctcctgtccggtggctaccgcaagggcgacgtggtggtcatcaccatgggtgtgccggtggaggcccgggggtccaccaacctcatgaaggtccacaagctgggaaccggccagttcttcgagatattttga

SEQ ID NO: 16583 - protein, 480 aa, Geobacter sulfurreducens
MDTLSRKTKIIATLGPVSSSPDMIRQLMDAGVDVFRLNFSHGSNDQRREVIAAIRRLSAERGKEIGILADLQGPKIRTGRMENGAIPLVRGDSLDITTDEVLGRPGLISTIYQSLPHDVKPGSRILLDDGLIELRVQSVSGATVRCTVVQGGMLKDLKGINLPGVKVSAPSLSEKDLRDLDFCLEVGVDYIALSFVRTAADVEGLKRILFERDVQVPVVAKIEKPEALRNFKSILKVADAVMVARGDLGVEISPEKVPLFQKKIIRACNEAGKPVITATQMLESMISHPRPTRAETSDVANAILDGTDAVMLSGETASGQFPLEAVRTMDKVALDVERFAQVEDGSGPRRHSVSIAEAVAEAACHAAVILKAKAVACMTQSGSTAARISRYRPPLPILAFTGSVDTMRRLSLYWGVKAYPIGTMAGTDEQIVAVESTLLSGGYRKGDVVVITMGVPVEARGSTNLMKVHKLGTGQFFEIF

SEQ ID NO: 16584 - DNA, 1770 bp, Lactobacillus johnsonii
  CDS (1)..(1770)
atgaagaaaactaaaattgttagtactttagggccagcctcaaacgatgttgagactattactaaattagctgaagcaggtgcaaacgtattccgtttcaacttctcacacggtgaccacgaagaacaccgtgcacgtatgaacatggttcgtgaggttgaaaagaagactggtaaacttcttggcattgctcttgatactaagggtgccgaaattagaactactgaacaagaaggcggcaagttcactattaacactggtgacactatccgtatttctatggacgacactaagaagggtaacaaggacatgatccacgttacctacgatggtctttacgacgatactcacgttggtggtcacgtattaatcgatgatggtttagttgaccttttgattaaggacaaagatgacgctaagagagaattagtttgtgaagctcaaaacactggtgtaatcggttctaagaagggtgttaacgctcctggcgttgaaatccgcctcccaggtattactgaaaaagatactaacgatattaagttcggtttgaaggaaggtatcaacttcatctttgcttcattcgttcgtaaagcacaagatgttcttgacattcgtcaattgcttgaagaagcacattgtgaatacgtaaagatcttccctaagattgaatcacaagaaggtattgacaacatcgacgaaatcttaaaggtttctgatggtttaatggttgctcgtggtgacatgggtgttgaaattccatttatcaatgttccatttgtacaaaaagaattgatcaagagatgtaacgctttaggtaagccagttattactgctactcaaatgcttgactcaatgcaagaaaacccacgtcctactcgtgccgaagttactgacgttgccaacgctgttcttgatggtactgacgcaactatgctttcaggtgaatctgcaaacggtctttacccagttaaagctgttaaggctatggctgaaatcgacatgcgtactgaaaagcaacttgctaagcgtaacaagttagctcttcaaagattcgaagaatacaagggttcaaacgttactgaagctatcggtgaatcagttgttagaactgctgaagaattgggcgttaagactattattgctgcaactgaatctggttacactgcacgtatgatttctaagtaccgtccaaacgcagacattattgctatgactttcaacgacaagattcaacactcattaggtgttgtttggggtgtaaagccaatgttgactgaaaagcctaagtctactgaagaaatgtttgaaaaggcagctgaacttgctaaagaaactggtcttgcaaaagacggtgacttagtaattatcgttgctggtgttcctttgggcgaaactggtactactaacttgatgaagttacaattaatcggtacccaacttgttaaaggtttaggtgttggtgaacaatcagttattggtaaagctgtagttgcaacttctgctgaagaagctaacagcaaagttcaagatggtgacatcttagttgctaagactactgataaggattacttaccagcaatcaagaaggcttcaggtatggtagttgaagcttctggtttaactagccatgcagctgttgttggtctttcacttggtatcccagttatcgttggtgctactgatgcagtagaaaagatcaaggatggttctaagattactgttgatgctcgtcgcggtgctgtttaccaaggcgaagcaactaacctttaa

SEQ ID NO: 16585 - protein, 589 aa, Lactobacillus johnsonii
MKKTKIVSTLGPASNDVETITKLAEAGANVFRFNFSHGDHEEHRARMNMVREVEKKTGKLLGIALDTKGAEIRTTEQEGGKFTINTGDTIRISMDDTKKGNKDMIHVTYDGLYDDTHVGGHVLIDDGLVDLLIKDKDDAKRELVCEAQNTGVIGSKKGVNAPGVEIRLPGITEKDTNDIKFGLKEGINFIFASFVRKAQDVLDIRQLLEEAHCEYVKIFPKIESQEGIDNIDEILKVSDGLMVARGDMGVEIPFINVPFVQKELIKRCNALGKPVITATQMLDSMQENPRPTRAEVTDVANAVLDGTDATMLSGESANGLYPVKAVKAMAEIDMRTEKQLAKRNKLALQRFEEYKGSNVTEAIGESVVRTAEELGVKTIIAATESGYTARMISKYRPNADIIAMTFNDKIQHSLGVVWGVKPMLTEKPKSTEEMFEKAAELAKETGLAKDGDLVIIVAGVPLGETGTTNLMKLQLIGTQLVKGLGVGEQSVIGKAVVATSAEEANSKVQDGDILVAKTTDKDYLPAIKKASGMVVEASGLTSHAAVVGLSLGIPVIVGATDAVEKIKDGSKITVDARRGAVYQGEATNL

SEQ ID NO: 16586 - DNA, 1506 bp, Ashbya gossypii
  CDS (1)..(1506)
atggaatctagattgggatggctaactcgtttgaactacgacactggttctgcattgagaagaacgtcgatcatcgggacgattggtcctaagaccaacaacccagagacgttggtggagcttagaaaggcgggcttgaacatcgtgagaatgaacttctcgcacggctcgtacgagtaccaccagtcggtgatcgacaacgccagaaagtcggaggagttgtaccctggtagaccattggccattgcgttggacaccaagggtcctgagatcagaactggtaccactgtcgacaacgtcgactacccaatcccacctaaccacgagatgatcttcaccaccgacgaccagtacgccaagtcctgcgacgacaaagtcatgtttgtcgactacaagaacatcacgaaggtgattgagaagggcagagtgatttacgttgacgacggtgttctatcgttcgaggtgttggaggtcgtggacgacaagaccttgaaggtcaagtctttgaacgcagggaagatctgctcccacaagggtgtgaacttgccgggtaccgatgtcgacttgccagctctgtctgagaaggacaagtctgacttgcgcttcggtgtcaagaacggtgtgcacatggtcttcgcttccttcatcagaactgctggagacatcctaactatcagagagatcttgggcgaggatggcaaggacatcaagatcatcgccaagattgagaaccagcagggtgtgaacaacttcgacgagattttgaaggtcaccgacggtgttatggtcgccagaggtgacttgggtatcgagatcccagcgcctcaggtatttgctgtgcaaaagatgttgatcgccaagtgtaacttggctggtaagccagttatctgtgccacccagatgttggagtctatgacctataacccaagaccaaccagagctgaggtttctgacgttggtaacgctgtcctggacggtgctgactgtgttatgttgtctggtgagaccgccaagggtatctacccaatcaacgctgttaagaccatggctgagactgctttgattgctgagcaggccattccatacgttccaacttacgatgacctcagaaacttgactccaaagccaactccaacctccgagaccatcgctgctgctgctgtcgcggctactttcgagcagaaggccaaggccattgtcgtgctatccacctccggtgacaccaccagattggtctccaagtacaagccaaacgttccaatcgttatggtgaccagaaacccaagagcggccagatactgccacttgcacagaggtgtcttcccattcgtctacgaacaggaggcagctgatgagtggaccgatgacgtcgaggccagattgaacttcggtgtggagaagtccaaggagcttggtatcctgagcgagggtgacactattgtcactattcagggtttcgcgtctggtgttggccactctaacaccttgagggtgttgaccgtctaa

SEQ ID NO: 16587 - protein, 501 aa, Ashbya gossypii
MESRLGWLTRLNYDTGSALRRTSIIGTIGPKTNNPETLVELRKAGLNIVRMNFSHGSYEYHQSVIDNARKSEELYPGRPLAIALDTKGPEIRTGTTVDNVDYPIPPNHEMIFTTDDQYAKSCDDKVMFVDYKNITKVIEKGRVIYVDDGVLSFEVLEVVDDKTLKVKSLNAGKICSHKGVNLPGTDVDLPALSEKDKSDLRFGVKNGVHMVFASFIRTAGDILTIREILGEDGKDIKIIAKIENQQGVNNFDEILKVTDGVMVARGDLGIEIPAPQVFAVQKMLIAKCNLAGKPVICATQMLESMTYNPRPTRAEVSDVGNAVLDGADCVMLSGETAKGIYPINAVKTMAETALIAEQAIPYVPTYDDLRNLTPKPTPTSETIAAAAVAATFEQKAKAIVVLSTSGDTTRLVSKYKPNVPIVMVTRNPRAARYCHLHRGVFPFVYEQEAADEWTDDVEARLNFGVEKSKELGILSEGDTIVTIQGFASGVGHSNTLRVLTV

SEQ ID NO: 16588 - DNA, 1519 bp, Bombyx mori
  CDS (130)..(1341)
ggacggttcgcgctctcccgacgtggaattcaatttttcactcggaagggcagttcaagatcacgtaaaccgcccgtcagtcgtaaccgagagctcacagacaaatatcttcactataatccattaaaaatggtttaccctactattcacgatggcgaaatcgaggcgggtgcagttgaaaagcccacagtcgccaacgtcggctcccagctccagcatatgtgcggtctcgacattgactccaagtcttcgtacatccgtctctccggaataatctgtactattggaccggcatcccgtaatgtagctgtgctagagaagatgatggagacgggaatgaacgtggcaaggatgaacttctcgcacggttcccatgagtaccacgcagagaccattcgcaattgtcgcgaggccgagaagagttacagcgctaaactaggttcacccttctctttggccatcgcattggacactaaaggacctgagatcagaactggactcttggaaggcggcggctcagctgaagtcgaactgaagaagggagagaccataaagttgacgacaaatccggattatcaagagaaaggcaatgctgatacaatttacgtggactacaagaacataacgaatgtcgtgaagccaggaaaccgaatctttatcgacgatggcctcatctctatcatctgtcagtcggtcagcgctgacactcttacgtgtaccattgaaaacggaggtatgctcggatcccggaaaggcgtcaacctgcccggcatacccgtggacctacccgcagtctccgagaaggacaagtcggacctgctcttcggcgtcgaacaaggcgttgatatgattttcgcgtcattcatccgcaacggcgccgcgctgcacgagattcgcggcatcttcggcgaaaaggggaagaacatcaagatcatctccaagattgaaaatcaccagggaatggtcaatttagacgagattatagctgaatccgatggtatcatggttgctcgtggagatctgggtatcgagatccctccagaaaaggtattcctcgcccagaagaccatgatcgccagatgcaatcgggttggaaaaccagtgatctgcgcgactcaaatgctggaatccatggttaagaagcctcgtcccactagagccgagatctctgacgtggccaacgccatcctcgacggagctgactgcgtgatgctctccggggatactgccaagggcgactaccctgtcgagtgcgtccacaccatggccaacatttgcaaggaggctgaagctgtaatctggcacaggcaactcttcaacgaccttgtgtccgaggtttgaagttattttctcttcttataggtagttataagttaccgggatagactaatggtaccctggtgtcgttttttgtattatgctattcaaaagtgattcaagatcatgacacataactataagacaatagcaggaagaataaaccaaagaggaaaattaaaaaaaaaaaaaaaaaaaaaaa

SEQ ID NO: 16589 - protein, 403 aa, Bombyx mori
MVYPTIHDGEIEAGAVEKPTVANVGSQLQHMCGLDIDSKSSYIRLSGIICTIGPASRNVAVLEKMMETGMNVARMNFSHGSHEYHAETIRNCREAEKSYSAKLGSPFSLAIALDTKGPEIRTGLLEGGGSAEVELKKGETIKLTTNPDYQEKGNADTIYVDYKNITNVVKPGNRIFIDDGLISIICQSVSADTLTCTIENGGMLGSRKGVNLPGIPVDLPAVSEKDKSDLLFGVEQGVDMIFASFIRNGAALHEIRGIFGEKGKNIKIISKIENHQGMVNLDEIIAESDGIMVARGDLGIEIPPEKVFLAQKTMIARCNRVGKPVICATQMLESMVKKPRPTRAEISDVANAILDGADCVMLSGDTAKGDYPVECVHTMANICKEAEAVIWHRQLFNDLVSEV

SEQ ID NO: 16590 - DNA, 1437 bp, Pyrococcus kodakaraensis
  CDS (1)..(1437)
atgcggctcccaggacagaaaaccaagataatagccaccctaggtcctgcgtctctcaacgaaaagaccataacggcaatggttcgagcggggatgagtgttgcaaggataaacttcgcccacggtgatctgaaacagcacgagaagtcgataaaactcgtgagaaaggtctctgagaggctcaacaggcccgttgcaattctcggagacctgcccggagtgaagatccgcgttggtgagattgagggcggctcagtgacgctgagacgctggcagacggtaacccttaccacgagggacgtaatcggcaacgaggccgttatacccgttgagttcaaggactttccaaggctcgtctcgaagggggacgtcatctatctcagcgacggtttcatagcgctaagggttgaagacgtcagggaccaggatgtcatctgtaaggtgctcgtcggaggaactctcttctcccgcaaaggaatcaacattcccaaggctcgcctggctatcgaagcaataaccgagaaggatttagaattcctggagttctctctggagcacggagttgacgccgtcggcataagcttcgtcggttccgcctacgacgttctaaaggcaaggcgattcgtcgaggaaaggaacggcaagctgttcctgatagccaaaatagaaaggcccgacgcggtgagaaacttcgacgagattctcagggcggcggacggggtcatggtagccaggggagacctcggagtggagatgcccatagaaaagctcccgattctccagaaaaagcttatccaaaaggcaaactgtgcgggaaagcccgtgataacagcgactcagatgctagagagcatgacccacgagaagctcccaacgagggctgaggtcaccgatgttgcgaacgcaatccttgatggaaccgacgccgtgatgctctccgaggagacggcggtcggaaagtacccggttgagaccgtcaaaatgatggccaggatagcgaagactaccgaggcatacagggactccaaatgggctgaaagaaccgtcgaatggaagatgagtgagttgaggggtacacggccgacaaagggtaccataaaggacgcaataacgaggagtataatagaggccctgaactccatagacattaaatacatactaacaccgaccaggatgggacaaactgcgaggctaatagcccgttttaagccaaagcagtgggtactggcatttgtaactgatgaatgggtcaaaaacactctgatgttctcctacggcgtttatccgttcctcgttgaggacaccagcgaagaggagatactgcgcgtgataaccgggctcggactggtagatgagggcgatacggtacttctgacgaagggaacgcccataggaaagaccgcggggacgaacaccatccgcatcttcaacgtttga

SEQ ID NO: 16591 - protein, 478 aa, Pyrococcus kodakaraensis
MRLPGQKTKIIATLGPASLNEKTITAMVRAGMSVARINFAHGDLKQHEKSIKLVRKVSERLNRPVAILGDLPGVKIRVGEIEGGSVTLRRWQTVTLTTRDVIGNEAVIPVEFKDFPRLVSKGDVIYLSDGFIALRVEDVRDQDVICKVLVGGTLFSRKGINIPKARLAIEAITEKDLEFLEFSLEHGVDAVGISFVGSAYDVLKARRFVEERNGKLFLIAKIERPDAVRNFDEILRAADGVMVARGDLGVEMPIEKLPILQKKLIQKANCAGKPVITATQMLESMTHEKLPTRAEVTDVANAILDGTDAVMLSEETAVGKYPVETVKMMARIAKTTEAYRDSKWAERTVEWKMSELRGTRPTKGTIKDAITRSIIEALNSIDIKYILTPTRMGQTARLIARFKPKQWVLAFVTDEWVKNTLMFSYGVYPFLVEDTSEEEILRVITGLGLVDEGDTVLLTKGTPIGKTAGTNTIRIFNV

SEQ ID NO: 16592 - DNA, 1503 bp, Streptococcus pyogenes SSI
  CDS (1)..(1503)
atgaataaacgcgtaaaaatcgttgcaacacttggtcctgcggttgaaatccgtggtggtaaaaaatacggagaagatggctactgggctggtcaacttgatgttgaagaatcagcaaaaaaaatcgctgaattaattgaagctggtgcgaatgttttccgtttcaatttctcacatggtgaccacaaagaacaaggtgaccgtatggcaactgttcgccttgcagaagaaattgctcgtcaaaaagttggtttccttttggatactaaaggtcctgaaatgcgtacggaattgtttgcagatgatgctaaagaattcagctatgtcactggagaaaaaatccgtgtagcgactacacaaggtattcaatcaactcgcgatgttattgctttgaacgttgctggtagccttgacatctacgatgaagtagaagtaggtcatactattcttatcgatgatggtaaactcggtttgaaagtgatcgacaaagatatcgcaacacgtcaatttatcgttgaagtagaaaacgatggtattattgctaaacaaaaaggtgttaatatccctaacactaaaattcctttcccagcacttgcggaacgcgacaatgctgatatccgttttggtcttgaacaaggacttaactttattgcaatctcatttgttcgtacagccaaagacgttgaggaagttcgtgaaatctgtcgcgaaactggtaacgatcatgtgcaattatttgctaagattgaaaaccaacaaggtatcgataatcttgatgaaatcatcgaagctgctgatggtatcatgattgcacgtggcgacatgggtatcgaagtaccatttgaaatggttccagttttccaaaaaatgattatcactaaagtgaatgcagctggtaaagcagttatcacagcaacaaacatgcttgaaacaatgactgaaaaaccacgtgcgacacgttctgaagtatctgacgtcttcaatgctgttatcgatggtactgatgcaacaatgctttcaggagagtcagctaacggtaaatacccggttgaatctgttcgtacaatggcgactattgatcgtaatgcacaaactcttcttaacgaatatggtcgtttagattcatctgccttcccacgtaccaataaaacagatgttattgcttcagctgttaaagatgccactcattcaatggacatcaaacttgttgtgactattactgagacaggtaatacagctcgtgcgatttctaaattccgtccagatgcggatatcttagctgtaacatttgatgaaaaagtacaacgtgctttgatgattaactgggctgttattcctgttcttgctgaaaaacctgcatctactgatgacatgtttgaagtagcagagcgtgttgctgtggaggcaggcttagttcaatctggggataatattgttattgttgctggtgttccagttggtactggtggaacgaatactatgcgtgttcgtacagtaaaataa

SEQ ID NO: 16593 - protein, 500 aa, Streptococcus pyogenes SSI
MNKRVKIVATLGPAVEIRGGKKYGEDGYWAGQLDVEESAKKIAELIEAGANVFRFNFSHGDHKEQGDRMATVRLAEEIARQKVGFLLDTKGPEMRTELFADDAKEFSYVTGEKIRVATTQGIQSTRDVIALNVAGSLDIYDEVEVGHTILIDDGKLGLKVIDKDIATRQFIVEVENDGIIAKQKGVNIPNTKIPFPALAERDNADIRFGLEQGLNFIAISFVRTAKDVEEVREICRETGNDHVQLFAKIENQQGIDNLDEIIEAADGIMIARGDMGIEVPFEMVPVFQKMIITKVNAAGKAVITATNMLETMTEKPRATRSEVSDVFNAVIDGTDATMLSGESANGKYPVESVRTMATIDRNAQTLLNEYGRLDSSAFPRTNKTDVIASAVKDATHSMDIKLVVTITETGNTARAISKFRPDADILAVTFDEKVQRALMINWAVIPVLAEKPASTDDMFEVAERVAVEAGLVQSGDNIVIVAGVPVGTGGTNTMRVRTVK

SEQ ID NO: 16594 - DNA, 1596 bp, Caenorhabditis elegans
  CDS (1)..(1596)
atgagtgacgattcgttccagaaagagcttgaagcttctggatatgataagcaagagcagaagctcgctgctgttccagccactacccatatggagcatttgtgtcgtttggacattcgtgaggctccacatctcgttcgtcagaccggaattatttgcacaattggaccagcttgtgccagtgttgaaatgcttcaaaaattgattctcaatggaatgaacattgctcgtctcaacttttcccatggatctcatgagtaccatgccggaaccatcgccaacgttcgtgaagctgccgattcattctctgacaagcgtgtcattggaattgctttggacacgaagggacctgaaatccgtactggacttcttgccggcggtgcttctgctgaaattgagcttgcacgaggagcatcaatccgtttgactactgatccacacttttctgaatcaggaactgctgtcaatctttttgttgattacaagaacattgccaaagttctttcggttggatcccgtgtctacattgatgacggacttatctcattgattgtcgaagaattgcaaactgacgctgtcatttgctctgttgaaaatggtggaatgttgggaagcagaaagggagtcaatcttccaggaactatcgttgatttgccagctgtttccgagaaggactgtaaggatttgcagtttggtgtggaacaaggtgttgatatcatctttgcttcattcatccgaaacgctgaaggaattcgtacgattcgtaaagttctcggagagaaaggaaagaagattaagattattgcaaagattgagaatcaagaaggagttgataatgctgatgaaattatctctgaatctgatggagttatggttgctcgtggagatctcggtatcgaaattccagccgagaaggtgttccttgcacaaaagatgctcatctccaagtgtaatcgtgctggaaaacctgtcatttgtgcaactcagatgcttgaatcgatggttcacaagccacgtccaaccagagctgaaggatcagatgttgccaatgctgtgcttgacggagctgattgtgtgatgctttctggagagactgctaaaggagaatatccagttgatgcactcaagatcatgcattatatatgcaaagaagccgaagcagcagtttatcatcgtcgtctcttcgatgaacttcttcaaaacacacaaaaaccaactgacatgtctcatactattgctatcgctgccacatctgcagctgcatcgtgccatgcttcagcaattcttctcattaccaccactggacgctcggcaatccaatgctctcgctacaagccagccgtcccaattctgacaatctcgagagacgttgctgtgtgccgtcagcttcatctttacagaggagttttcccagttcattatccagctgaacgtgctgccgattggccaactgatgttgataacagaatcaaccatgctatcgccatcggaaaggatcgtggattcattcacaagggtgacttcttggttgttgtcactggatggagacagggagccggagctaccaacactcttcgtatcatcaccgccgaataa

SEQ ID NO: 16595 - protein, 531 aa, Caenorhabditis elegans
MSDDSFQKELEASGYDKQEQKLAAVPATTHMEHLCRLDIREAPHLVRQTGIICTIGPACASVEMLQKLILNGMNIARLNFSHGSHEYHAGTIANVREAADSFSDKRVIGIALDTKGPEIRTGLLAGGASAEIELARGASIRLTTDPHFSESGTAVNLFVDYKNIAKVLSVGSRVYIDDGLISLIVEELQTDAVICSVENGGMLGSRKGVNLPGTIVDLPAVSEKDCKDLQFGVEQGVDIIFASFIRNAEGIRTIRKVLGEKGKKIKIIAKIENQEGVDNADEIISESDGVMVARGDLGIEIPAEKVFLAQKMLISKCNRAGKPVICATQMLESMVHKPRPTRAEGSDVANAVLDGADCVMLSGETAKGEYPVDALKIMHYICKEAEAAVYHRRLFDELLQNTQKPTDMSHTIAIAATSAAASCHASAILLITTTGRSAIQCSRYKPAVPILTISRDVAVCRQLHLYRGVFPVHYPAERAADWPTDVDNRINHAIAIGKDRGFIHKGDFLVVVTGWRQGAGATNTLRIITAE

SEQ ID NO: 16596 - DNA, 1476 bp, Vibrio vulnificus
  CDS (1)..(1476)
atgaagatgtgtaaaaccaaaatcgtcgctacgcttggcccagccagtcagacacgcgaaaaactcactcaactcatccaagcgggcgtgaatgtagtgcgcttaaacttttcgcacggcagcgctgaagagcacatcgcccgtgctgaaatggtacgtgaaatcgcgcaagatcttaacgtcagcgttggcgtactcgttgacctacaaggtccaaaaattcgtatcgcttgctttgagcaaggctcaattcagctcaaagcgggtgatcctttcattctcgacggcacgctcgaccgcgaagcgggcacgcaagaacgcgtcggtttggattatccagagctgatcgatgacctgcaagtcggcaatattctgctgcttgacgatggtcgtatccagctcgaagtaacggccgttgatacacaaactcgcctggtcaacaccattgcattgaacggtggcaaactctcaaaccgcaaaggaattaacttactgggtggtggtctttccgcccccgcgttaaccgacaaagacaagcaagacattcttaccgcggccgaactaaaagcagattttcttgccgtgtcgtttcctcgtaacgctgacgatatcgaatacgcgcgctcccttgctctacaagcaggctgtcacgcacacatcgtcgcgaaagtagaacgtgctgaagtggttgccagcgaagaagcgatggatggtgtgattcgtgcctccgacgtcattatggtggcacgtggcgatttgggcgtggaaattggtgacgcgcgcctgcctggcgtacaaaaagcgctgatcgctcgtgcgaagtacttaggcaaaccagttatcacggcaacccaaatgatggaatcgatgatcgagaacccattgccaacacgcgcggaagtgttggacgttgccaacgcggtactcgatggtaccgacgcggtcatgctctctgctgaatcagcggcggggttgtatccggttgaagcggtagaagccatggttcgaattgcacaaggggtcgaacacgaaaccagttgtgcacaaggctgttgggataagctgcaccacctgtgtaatgacgcgggcaagagctttgctctctcctcgatgatctcggcaacaaaagtacacaaagatcttggagtcgctatcgtgactcaacatggtgaaacaccactgttgatgtcgcgttgccaaagccaagcaaccatttgggcggtctcggacaaacctgagttgctgcgtaagctggcgattctgcgcggcgtaaccccggtttatctacccactttggacaaacgcggtgacattgcacatcagctcgtcagcctactgggtgccgatgctaaacagaaacaaatctcatccatcatgatgacccaattagaatccgttgaaggcgtgggcgatatgaatgtctgccgcttactaaacctgaacgaaacacccataacaaccgccattgcggcataa

SEQ ID NO: 16597 - protein, 491 aa, Vibrio vulnificus
MKMCKTKIVATLGPASQTREKLTQLIQAGVNVVRLNFSHGSAEEHIARAEMVREIAQDLNVSVGVLVDLQGPKIRIACFEQGSIQLKAGDPFILDGTLDREAGTQERVGLDYPELIDDLQVGNILLLDDGRIQLEVTAVDTQTRLVNTIALNGGKLSNRKGINLLGGGLSAPALTDKDKQDILTAAELKADFLAVSFPRNADDIEYARSLALQAGCHAHIVAKVERAEVVASEEAMDGVIRASDVIMVARGDLGVEIGDARLPGVQKALIARAKYLGKPVITATQMMESMIENPLPTRAEVLDVANAVLDGTDAVMLSAESAAGLYPVEAVEAMVRIAQGVEHETSCAQGCWDKLHHLCNDAGKSFALSSMISATKVHKDLGVAIVTQHGETPLLMSRCQSQATIWAVSDKPELLRKLAILRGVTPVYLPTLDKRGDIAHQLVSLLGADAKQKQISSIMMTQLESVEGVGDMNVCRLLNLNETPITTAIAA

SEQ ID NO: 16598 - DNA, 1449 bp, Vibrio vulnificus
  CDS (1)..(1449)
atgactcagccattaagaagaacaaaaatcgtgaccactttaggtccttcaactgacaaagataatgtactagaagaaattattcgagccggcgcgaatgtggtcaggatgaatttttctcacggcagcgcagaggatcataaaactcgcgcagaaaaagtgcgcaatattgccgccagacttggcagacaagtggctattttaggtgatttacaaggcccgaagatccgagtatcaacctttaaagaagggaaaattttcctttcagtgggtgacctcttcactttagacagtgacttgcccaaaggcgaaggcgatcaaaaatcagtgggattagactataaagcactgcctcaggatgtgggaccagaagatattctgctgcttgatgatggacgtgtacaactgcaagtgctgacggtcgatggcaacaaggtgaacactcgtgtgatagtgggcggaccgctgtcaaacaataaaggtatcaataaaaaagggggcggcctctctgctgacgctctaacggaaaaagacaaacaagacatcttgctcgccgccgagatcaaagtcgattatctcgcgatctcctttccacgtaatggtgccgacatggactatgctcgtcgcttggccagagatgccggcttggaagccaaacttgttgccaaagttgaacgagcagaaaccgttcgaaacgatgaaaacatcgacgatattatcatggcttccgatgtcattatggttgctcgtggcgatctaggggtagaaatcggcgatccggaattgatcggtgtacagaaaaaactcatcaaacgagccaaagaactcaatcgtgtcgtcatcacggcaacacaaatgatggaatcgatgattgaaaatccaatgcccactcgagcagaagtcatggacgtagccaacgcggtgctggatggcaccgatgccgtgatgctttcaggggaaaccgccgctggtaaatacccagtcgaaacggtgcgctctatggcagaagtctgcattggggcagaaaaaacgtgggaaccgggcagccagaattatcgcatcgataaatcctttgtcaccgccgaagaaaccattgcaatgtcgacaatctacgccgcaaatcatatggaaggcgtcaaagcgatggtgacgttgactgaatcgggaagaaccgcattaatgacgtcaagattgaactcaacactgcccatttttgcgctttcgcctaatgagcgaacccttaatcgctgctctctctatcgtggcgtcactcccgtattttttgataccaaagtagaaactggatttgatgtcgcaatggccgcattgagcacgcttagaaagaaaaaactgctcgattttggggatttagtgatcatcacacagggggacatcatggatgttgaaggctcgactaactgcatgagaatcctgcctgtttttgactaa

SEQ ID NO: 16599 - protein, 482 aa, Vibrio vulnificus
MTQPLRRTKIVTTLGPSTDKDNVLEEIIRAGANVVRMNFSHGSAEDHKTRAEKVRNIAARLGRQVAILGDLQGPKIRVSTFKEGKIFLSVGDLFTLDSDLPKGEGDQKSVGLDYKALPQDVGPEDILLLDDGRVQLQVLTVDGNKVNTRVIVGGPLSNNKGINKKGGGLSADALTEKDKQDILLAAEIKVDYLAISFPRNGADMDYARRLARDAGLEAKLVAKVERAETVRNDENIDDIIMASDVIMVARGDLGVEIGDPELIGVQKKLIKRAKELNRVVITATQMMESMIENPMPTRAEVMDVANAVLDGTDAVMLSGETAAGKYPVETVRSMAEVCIGAEKTWEPGSQNYRIDKSFVTAEETIAMSTIYAANHMEGVKAMVTLTESGRTALMTSRLNSTLPIFALSPNERTLNRCSLYRGVTPVFFDTKVETGFDVAMAALSTLRKKKLLDFGDLVIITQGDIMDVEGSTNCMRILPVFD

SEQ ID NO: 16600 - DNA, 1410 bp, Photorhabdus luminescens subsp
  CDS (1)..(1410)
atgaaaaaaaccaaaattgtttgtactatcggaccaaaaacagaatccgaagaaaaactggccgaactgttgaatgccggcatgaatgttatgcgcctcaacttttcacacggagactatgaagagcacggccagcgtattcaaaatatccattcagttatgactaagacaggtaaacaagccgctattttgctggatactaaaggccctgaaattcgaactatgaagctggaaggcggtaacgatgtctctctaaccgcaggtcagaccttcacttttaccactgacacttccgttatcggtaataaagaccgtgttgctgtcacttaccgcggtttccccgcggatctggctcccggtaataccgtgctagttgatgacggcttgatcggcatgacagttaaagaagtcactaagtcagaggttatttgccaagttttgaataacggtgatttgggggaaaataaaggtgttaatctgccgggtatttccatcagcctgcctgccctggctgaaaaagataagcaagatttgatctttggttgccaacaaggtgttgatttcgtcgccgcttcttttatccgcaagcgctccgatgttctggaaatccgtgaacatctgaaagcgcacggcggtgaaaacattcaaatcatctctaagattgaaaatcaggaaggtctgaacaattttgatgaaattctggaagcttctgacgggatcatggttgctcgtggtgatcttggcgttgaaattccggttgaagaagtgatcttcgcccagaagatgatgattcaaaaatgtaatatcgctcgcaaagttgttatcactgcaactcaaatgctcgattctatgattaaaaacccgcgccctacccgtgcggaagccggtgacgtcgctaacgctattttggatggtactgatgcagttatgctttctggcgaaagtgcaaaaggcaaatatccaatagaagcagtgactatcatggcaacgatttgtgaacgtacagaccgcgttatgccaagccgtatcgaagccgtccattgccgtaacctgcgcgtgaccgaagcggtgtgtcgtggtgccgttgaaacagcagaaaaactggaagcccctctgattgtggtcgcaacctatggcggtaaatctgccaaatccattcgtaagtatttccctgacgcgcccattctggcattaacgactaatgaagtgactgcccgccaattactgcttgttaagggtgtttttacccaaattgttaaagaaatcgcctctaccgacgatttctaccgcattggtaaagaagcggcgctagcaagtggcctagcgaagaaaggtgaaatcgtggttatggtatctggtgccctggttccaagcggcacaaccaacacgtcgtctgttcacgtcctttaa

SEQ ID NO: 16601 - protein, 469 aa, Photorhabdus luminescens subsp
MKKTKIVCTIGPKTESEEKLAELLNAGMNVMRLNFSHGDYEEHGQRIQNIHSVMTKTGKQAAILLDTKGPEIRTMKLEGGNDVSLTAGQTFTFTTDTSVIGNKDRVAVTYRGFPADLAPGNTVLVDDGLIGMTVKEVTKSEVICQVLNNGDLGENKGVNLPGISISLPALAEKDKQDLIFGCQQGVDFVAASFIRKRSDVLEIREHLKAHGGENIQIISKIENQEGLNNFDEILEASDGIMVARGDLGVEIPVEEVIFAQKMMIQKCNIARKVVITATQMLDSMIKNPRPTRAEAGDVANAILDGTDAVMLSGESAKGKYPIEAVTIMATICERTDRVMPSRIEAVHCRNLRVTEAVCRGAVETAEKLEAPLIVVATYGGKSAKSIRKYFPDAPILALTTNEVTARQLLLVKGVFTQIVKEIASTDDFYRIGKEAALASGLAKKGEIVVMVSGALVPSGTTNTSSVHVL

SEQ ID NO: 16602 - DNA, 1443 bp, Photorhabdus luminescens subsp
  CDS (1)..(1443)
atgtccagacggctcagaagaactaagattgttactacacttggtccggctaccgaccgcgataataatcttgaaaagattattgctgcgggtgcaaacgtagtccgccttaacttttcccacggtaccgccgaagatcatctccagcgagccagcaaagtccgcgagattgcagcccgcctggggtgccatgtcgctattcttggcgatcttcaaggacctaaaatccgcgtatcaacgtttaaagagggcaaaattttcctgaatatcggagataaatttctccttgatgccaatcttggtaaaggcgaaggcgataaggagaaagtcggtatcgattacaaaggactacccacggatgttgtaccgggcgatattttgttgctggatgacggacgtgttcaactcaaagtattagacgttcagggaatgaaagtcttcacggaagtcactgtaggcggcccgctatctaacaataaaggcattaacaaactgggtggtggattatccgcagaagccctaactgaaaaagataaagaagatattattacggcggccagaatcggcgttgattaccttgccgtctctttccctcgcaccggtgaagatcttaactatgcccgccgtctggcacgagacgcaggctgtgaaacgcagatcgtggcaaaagttgaacgcgcagaagccgttagcagtgataaaaccatcgatgaaatcattctggcttctgatgtggtcatggttgcccgtggtgaccttggcgtagaaatcggcgatccagagttagttggcgttcagaaaaaattaattcgccgtgcccgccagctaaatcgtgtagttattaccgcgacccagatgatggaatctatgatcaccaatccaatgcccacccgtgcagaagtgatggatgtggcaaatgccgttctcgacggtactgacgccgtaatgctctccgctgaaaccgcagcgggccaataccctgccgaaaccgttgccgcaatggcacgagtctgtctcggagcagaaaaaatgcctggcctcaacgtatcaaaacatcggctagacacaatttttgacagtattgaagaagccattgcgatgtctaccatgtacgcggcaaaccacttaaatggagttaaagccattattgccatgaccgaatcaggccgcaccactcgcatcatgtctcgcattagttctggtctcccgatattctctatgtcccgtcatgagaaaaccttaaaccaaacggcactttaccgtggcgttacaccggtttattgcagtagtcatactgacggcattacggcggccaatgaagcagttaatcgcctgcgtgataaaggttatctagtttccggtgatcttgttctggttactcagggtgatcagatggggacgattggcagtactaacacctgccgtattcttgaagtggaataa

SEQ ID NO: 16603 - protein, 480 aa, Photorhabdus luminescens subsp
MSRRLRRTKIVTTLGPATDRDNNLEKIIAAGANVVRLNFSHGTAEDHLQRASKVREIAARLGCHVAILGDLQGPKIRVSTFKEGKIFLNIGDKFLLDANLGKGEGDKEKVGIDYKGLPTDVVPGDILLLDDGRVQLKVLDVQGMKVFTEVTVGGPLSNNKGINKLGGGLSAEALTEKDKEDIITAARIGVDYLAVSFPRTGEDLNYARRLARDAGCETQIVAKVERAEAVSSDKTIDEIILASDVVMVARGDLGVEIGDPELVGVQKKLIRRARQLNRVVITATQMMESMITNPMPTRAEVMDVANAVLDGTDAVMLSAETAAGQYPAETVAAMARVCLGAEKMPGLNVSKHRLDTIFDSIEEAIAMSTMYAANHLNGVKAIIAMTESGRTTRIMSRISSGLPIFSMSRHEKTLNQTALYRGVTPVYCSSHTDGITAANEAVNRLRDKGYLVSGDLVLVTQGDQMGTIGSTNTCRILEVE

SEQ ID NO: 16604 - DNA, 1818 bp, Gloeobacter violaceus
  CDS (1)..(1818)
atgcgcgtgggtgccgatgtgttcgttctagatgccaatgcccaacagacaactgccgcgccgagcgagcgggcgcgttttcgccgcaccaagattgtcgccaccatcggtcccgccgtcgacgacccgcaggccctgcgcaagctcatccaggccggggcgacgaccctcagactcaatttttcccacggcaaccacgaggagcaccgccgccgcatcggcctcatccgccagatttcctttgaactcaatcagccggtggccatcctgcaggatctgcaaggtcccaagatccggttgggcaagttcgccgacggaccaatcgtcctcaagcacggcgacccgtttattctgaccagccacgacgtgcccgccaaccagcacatcagtccgatcacctactcgcgacttatccaggaagtgcccaccggcgccacgatcttgctggatgacgggcgggtggaactggtagtcgaacgggtggacctcgaagcccaatacctgcactgccggacggtgggggggggcaagctctccaacagcaaaggcgtcaactttccgggtgtcaccctctcggtgccggcgatgaccgaaaaggaccgcgaggatttgctcttcggtctcaatcagggcgtcgattgggtggccctcagtttcgtgcgcaccccgagcgatttgctcgaactgaaggaactgattgcccaatcgggcaagcgggtgccggtgatcgccaagatcgaaaaattcgaggccttcgagaacctcgatgcggtgattgccgcctgcgacgggctgatggtggcccgtggcgatctgggcgtcgagatgcccgccgaggaagtgcccttgctccaaaagcggctgatcgcttcggccaatcgggccggcaagcctgtgatcaccgccacccagatgctcgattcgatggtgagcaacagccgcccgacccgcgccgaagtttccgatgtggccaacgccatcctggacggcaccgacgcggtgatgctctccaacgagaccgccgtgggcgagcacccgatcttggcggtcgagacgatggcgcgcatcgccgatcgcatcgagcgctcgatgccccagcgcacctgggtagacacgggccgctcgatcccgaacgccatctcccaggcagtgggaagcgtcgcccagcaattgggtgcccaggcgattctcaccctcaccaagtccggcgccaccgcccgcaacgtcagcaagtaccggccgagggtgccgattatcgcgattaccccgagcgtgtcggtggcgcgcgaactgcagatggtctggggggtctacccgctgatggtcctggatctgccttcgacccgccagacctttcaagcggcgatcagcgccgcccaggacgaaaacctcgtcctggaaggcgacctggtggtgatgaccgccggcaccatccaggggctctccggttcgacggacctgatcaaagtcgaggtggtgacggcgattctcggccggggattgggcctgggtcagaacgccgtgagtggacgcgcccgcatcgtccgccacagcgacgaagcggcggccttgagtcccggggacatcctgattgccccgcgcaccgacgccaattttatcgaagcgatcaagctcgcgggcggcatcgtcaccgaggagagcggcctcacctcccacgcagcgattatcgggctgcgcctcggactgccggtactgctcggggtgaaagactgcaccacccgcatcccggacggggtggtgctcaccctcgatccgcaaaaaggggtcatcttctccggggcggcctccgccgtctag

SEQ ID NO: 16605 - protein, 605 aa, Gloeobacter violaceus
MRVGADVFVLDANAQQTTAAPSERARFRRTKIVATIGPAVDDPQALRKLIQAGATTLRLNFSHGNHEEHRRRIGLIRQISFELNQPVAILQDLQGPKIRLGKFADGPIVLKHGDPFILTSHDVPANQHISPITYSRLIQEVPTGATILLDDGRVELVVERVDLEAQYLHCRTVGGGKLSNSKGVNFPGVTLSVPAMTEKDREDLLFGLNQGVDWVALSFVRTPSDLLELKELIAQSGKRVPVIAKIEKFEAFENLDAVIAACDGLMVARGDLGVEMPAEEVPLLQKRLIASANRAGKPVITATQMLDSMVSNSRPTRAEVSDVANAILDGTDAVMLSNETAVGEHPILAVETMARIADRIERSMPQRTWVDTGRSIPNAISQAVGSVAQQLGAQAILTLTKSGATARNVSKYRPRVPIIAITPSVSVARELQMVWGVYPLMVLDLPSTRQTFQAAISAAQDENLVLEGDLVVMTAGTIQGLSGSTDLIKVEVVTAILGRGLGLGQNAVSGRARIVRHSDEAAALSPGDILIAPRTDANFIEAIKLAGGIVTEESGLTSHAAIIGLRLGLPVLLGVKDCTTRIPDGVVLTLDPQKGVIFSGAASAV

SEQ ID NO: 16606 - DNA, 1422 bp, Gloeobacter violaceus PCC 7421
  CDS (1)..(1422)
atgcagcctttagaccgtcgaacgaaagtcgtcgcgacgatcggtcctgcgagcagttcgccggaagtgcttcggcagctggtgaaggcaggaatcaacgtcgcgcgcttgaatttttcccacggcagctacgaagaccacgcgcgcatggtcaagctgctgcgggaggtctccgaggaactcgacaccccgattacgctattgcaggatttgcaggggccgaagatccgcgtgggccagatgcccgagggcgggctggctttaggggagggcgacgagctgacgctgttgccggtggcggaatttgcgggcgaacccggcacggtatccatcgactacccgtatcttgtggaggaggcgacgccgggtacccaggtgctcctggacgacggcttgctcgaatttgccgtggttgaggtgaagggcaacgccgtgcgctgccgggtggtgcgcgggggggtgctcaaaagccgcaagggggtcaacctgcccagtctggatttgcgcctgccctcgatgaccgaaaaggacaagcaagatctcgaatttggactggagcagggggtcgattgggtgtctttgagcttcgtgcgccggggcgaggacattcgcgtgctcaaaggactgctcgctgaacacggggccgccgatgtgccggtgatcgccaagattgagaaaccccaggcgatcgccaatctggaggagattctcgatgaagtgcagggaatcatggtggccaggggcgatctgggcgttgagatgagcccggagaaggtgccgctgctgcaaaagcggatcattcggctttgtaaccggcggggcattccggtgatcaccgccacccagatgctcgacagcatgatccgcaatccccggccgacccgcgctgaggcgagtgatgtcgccaacgccatcctggacggcagcgacgcggtgatgctctcgggcgaatcggcggtgggcgattttccggtgcagtcggtggagatgctcgtgcgcatcgccaaagaagtcgagcgggagtttaccttcgacaacaatccgcccgccaaatccgatgaaatccacgccctgtgcgaatcgctgggcaccatcgacaagatcttggccctgcactgtattgccacttttactaccaccggcttcagcgcttcgatcgcggccgcggagcggccgaaggcgccggtggtcgccttcacccccgacttgaaggtgtatcaccggttgaatctggtctggggcgtgaagcccttgctgttggagcacccggcggcggaactcgaaaaactgatcgagcagatggaaagctgccttgtcgaacgcaacctcgccgcccccggcgaccggatgctggtgctgggaggtagccccgtccagagggcgggcggcacgaattttctgaagatccatacgctgcactaa

SEQ ID NO: 16607 - protein, 473 aa, Gloeobacter violaceus PCC 7421
MQPLDRRTKVVATIGPASSSPEVLRQLVKAGINVARLNFSHGSYEDHARMVKLLREVSEELDTPITLLQDLQGPKIRVGQMPEGGLALGEGDELTLLPVAEFAGEPGTVSIDYPYLVEEATPGTQVLLDDGLLEFAVVEVKGNAVRCRVVRGGVLKSRKGVNLPSLDLRLPSMTEKDKQDLEFGLEQGVDWVSLSFVRRGEDIRVLKGLLAEHGAADVPVIAKIEKPQAIANLEEILDEVQGIMVARGDLGVEMSPEKVPLLQKRIIRLCNRRGIPVITATQMLDSMIRNPRPTRAEASDVANAILDGSDAVMLSGESAVGDFPVQSVEMLVRIAKEVEREFTFDNNPPAKSDEIHALCESLGTIDKILALHCIATFTTTGFSASIAAAERPKAPVVAFTPDLKVYHRLNLVWGVKPLLLEHPAAELEKLIEQMESCLVERNLAAPGDRMLVLGGSPVQRAGGTNFLKIHTLH

SEQ ID NO: 16608 - DNA, 1407 bp, Chromobacterium violaceum ATCC 12472
  CDS (1)..(1407)
atgcttcgcaataccaaaatactcgccacgctcggcccctcctccagcgccccggaaaaaatcctggaactggcccgttccggggtcaacatcttccggctcaacatgagccacggcagccatgacgaccatcgcgcgcgcctggcggccatccgcgccgccgaaaaaacgctggatcgcccgatcggcgtgctggtggacctgcagggccccaagctgcgcatcggcaagtttccgcaaccaaccacggtgaaaaccggcgaccgctacgaattcgtgctggatgaaacggaaggcaatgccgaacgcgccaccctgccgcacccggaagcgttcgaggcgctggagcccggccacctgatcctggtgaacgacggcaagctcgccttcgaagtggcggaaatgcatccgcgccgcatcgtcacccgcgtcaccgtcggcggggaactgtccagcaacaagggcttcaacctgcctcacaccgtgctgccgctgtcggccatcaccggcaaggaccgcaaggacgcggagttcgcgctggaagagggcgccgactgggtggcgatgtccttcgtccagaccgcggccgacgtcaaggcgctgcgcgacatcgtcggcaaacgcgtcggcatcgtcgccaagatcgaaaaaccgtcggcggtggacgatctggaagccatcgccgagctggccgacggcgtgatggtggcgcgcggcgacctgggcgtggagctgccgccggaagacgtgccggtggtgcagcgccgcatcgtccaccactgccgccacctgggccgcccggtgatcgtggccacccagatgctggaatcgatgatcaccgcgccgaccccgacccgcgccgaggccaacgacgtggccaccgccgtctacgaaggcgcggacgcggtgatgctgtcggccgaaaccgccgccggccagtacccgctggaggcggtgcagatcatggaccgcatcatccgccgcgtggagaacgcgcccgactaccgcaaggtgatggcgctggattacagcgccgccgacgagccggaccgcaccgacgccatcgccgcctgcgtgcgcaaggtcagcaccctgctgccggtcaccgtggccgtcgccttcaccaccagcggcgccagctgtctgtcgctggcgcgcgagcgcccgtccacccccatcctgggcatctcgcccaggctggaaaccgcgcgccgcctgaccctggtgtggggcgtggtcgcctaccacggcccggacgccgagaacctggaagacatggtggtgaagaccaccttctgcgccaccaagctcagcctggccgagcagggcaagccgatggtgatcatcgccggcgtgcccttcggcacccccggctccaccaacctgctgcgcatcgtctatccataa

SEQ ID NO: 16609 - protein, 468 aa, Chromobacterium violaceum ATCC 12472
MLRNTKILATLGPSSSAPEKILELARSGVNIFRLNMSHGSHDDHRARLAAIRAAEKTLDRPIGVLVDLQGPKLRIGKFPQPTTVKTGDRYEFVLDETEGNAERATLPHPEAFEALEPGHLILVNDGKLAFEVAEMHPRRIVTRVTVGGELSSNKGFNLPHTVLPLSAITGKDRKDAEFALEEGADWVAMSFVQTAADVKALRDIVGKRVGIVAKIEKPSAVDDLEAIAELADGVMVARGDLGVELPPEDVPVVQRRIVHHCRHLGRPVIVATQMLESMITAPTPTRAEANDVATAVYEGADAVMLSAETAAGQYPLEAVQIMDRIIRRVENAPDYRKVMALDYSAADEPDRTDAIAACVRKVSTLLPVTVAVAFTTSGASCLSLARERPSTPILGISPRLETARRLTLVWGVVAYHGPDAENLEDMVVKTTFCATKLSLAEQGKPMVIIAGVPFGTPGSTNLLRIVYP

SEQ ID NO: 16610 - DNA, 1428 bp, Fusobacterium nucleatum subsp
  CDS (1)..(1428)
atgagtagtttgaaaaaaacaaaaatagtttgtactattggtcctgtgactgaatcagtagaaacattaaaagaattactaaatagagggatgaatgtaatgagattaaatttctctcatggtgattatgaagagcatggaataagaataaaaaattttagacaggctatgtctgaaactggaattagaggaggcttgttacttgatactaagggtccagaaataagaactatgactttaaaagatggaaaagatgtaagtattaaggctggacaaaaatttacttttacgacagatcaatcagttgttggagataatgaaagagtagcggtaacttatgaaaattttgcaaaagatttaaaagttggaaatatggttcttgttgatgatggattacttgaactagatgttacagaaataaaaggaaatgaagttatatgtgtagctagaaatagtggtgatttagggcaaaagaaaggaataaatttacctaatgtttctgttaatttgccagcattatctgaaaaagatatagaagatttaaaatttggttgtcaaaataatgttgattttgtagctgcttcatttataagaaaagctgatgatgtaagacaagttagaaaagttcttaaagaaaatggtggagaaagaatacaaataatttctaaaatagaaagtcaagaaggacttgataattttgatgaaattttagcagaatctgatggtataatggtagcaagaggagatttaggagtagaaattcctgttgaagaagttccttgtgcacaaaaaatgatgataaaaaaatgtaatagagcaggaaaagttgtaattactgcaactcaaatgcttgattcaatgataaaaaatccaagacctacaagagcagaagcaaatgatgttgctaatgctatatttgatggtacagatgcaataatgctttcaggagaaacagcaaaaggaaaatatccattagcagctgttgaggttatgaataaaatagccaaaaaagttgatgctacaataccagcattttatgtagatggggttataaataaacatgatataacttctgctgttgctgagggaagtgctgacataagtggaagattaaatgcaaaacttatagtagttggtacagaatctggaagagctgcaagagatatgagaagatattttcctaaggcaaatattttagcaataactaataatgaaaaaactgcaaatcaattagttttatcaagaggagtaatttcttatgtagatgcttcaccaaagactttggaagaattctttattttagcagaagttattgcaaaaaaattaaatttagttgaaaataatgatataattatagcaacttgtggagaaagtgtatttatacaaggaacaactaactcaataaaagttatacaagtaaaagcttag

SEQ ID NO: 16611 - protein, 475 aa, Fusobacterium nucleatum subsp
MSSLKKTKIVCTIGPVTESVETLKELLNRGMNVMRLNFSHGDYEEHGIRIKNFRQAMSETGIRGGLLLDTKGPEIRTMTLKDGKDVSIKAGQKFTFTTDQSVVGDNERVAVTYENFAKDLKVGNMVLVDDGLLELDVTEIKGNEVICVARNSGDLGQKKGINLPNVSVNLPALSEKDIEDLKFGCQNNVDFVAASFIRKADDVRQVRKVLKENGGERIQIISKIESQEGLDNFDEILAESDGIMVARGDLGVEIPVEEVPCAQKMMIKKCNRAGKVVITATQMLDSMIKNPRPTRAEANDVANAIFDGTDAIMLSGETAKGKYPLAAVEVMNKIAKKVDATIPAFYVDGVINKHDITSAVAEGSADISGRLNAKLIVVGTESGRAARDMRRYFPKANILAITNNEKTANQLVLSRGVISYVDASPKTLEEFFILAEVIAKKLNLVENNDIIIATCGESVFIQGTTNSIKVIQVKA

SEQ ID NO: 16612 - DNA, 1536 bp, Plasmodium yoelii yoelii
  CDS (1)..(1536)
atgaatccttttaaatttaaaaacgcaaccgctggagctagcttacaaagcgcagctaacattactttaaggcaaattttagaacctaataatgtgaatttacgttcaaaaaaaactcacattgtttgtacattaggcccagcatgtaaatctgttgaaacactcgtgcaaatgatagatgcaggaatggatatatgccgttttaacttttctcatggaactcatgatgatcacaagcaaatgtttgaaaatgttttaaaagcacaagcccaaagaccaaattgcacattaggtatgttattagatactaaaggacctgaaataagaacaggtttattaaaaaataaagaagctcatttaaaagaaggaagcaaattaaagttggttactgattattcctatttgggagatgaaacttgtattgcttgttcatacacaaaattaccacaaagtgtaaagccaggaagtattatattaatagctgatggatccgttagttgtagagtattagaaacacacgatgatcatgtaattacagaagtattaaataatgcaacaattggtgagaaaaaaaatatgaacttaccaaatgttaaggttgatttaccaattataagtgaaaaagataaggatgatatacttaactttgctataccaatgggatgcaattttattgctgcatcatttattcaatctgctgaagatgtgcgtttaatcagaaatttgttaggcccacgaggaagacatattaaaattattccaaaaatcgaaaatattgaaggtattataaattttgacaaaatattagctgaagccgatggaattatgattgcaagaggagatcttggtatggaaatatccgcagagaaggttttcttagcccaaaaacttatgatatcaaaatgtaatttacaaggaaagccaatcattacagccactcaaatgcttgaatctatgacaaagaacccaagaccaacaagagcagaagttacagatgtagctaatgcagttttagacggaaccgattgtgttatgctttcaggtgaaacagcaggcggtaaatttccagtagaagcagttactattatgtctaaaatatgtttagaagcagaagcatgcattgattataaattattatatcaatcattagtaaatgccatccaaaccccaataagtgtacaagaagcagtagctagatctgcagttgaaacagcagaatcgattgaagcatctgttattattacattaacagaaaccggatacactgctagactaatagctaaatacaaaccaagctgtactatattagctttaagtgcatctgattcaacagttagatgcttaaatgtacacagaggtgttacatgcattaaagttggatcattccaaggaactgataacgtattaagaaatgcaattgaaattgcaaaagaaagaaatatcgttaaacctggagatagtgccatatgtattcacggaattaaagaagaagtttctggaagtactaacttaatgaaagtaatacaagtagaataa

SEQ ID NO: 16613 - protein, 511 aa, Plasmodium yoelii yoelii
MNPFKFKNATAGASLQSAANITLRQILEPNNVNLRSKKTHIVCTLGPACKSVETLVQMIDAGMDICRFNFSHGTHDDHKQMFENVLKAQAQRPNCTLGMLLDTKGPEIRTGLLKNKEAHLKEGSKLKLVTDYSYLGDETCIACSYTKLPQSVKPGSIILIADGSVSCRVLETHDDHVITEVLNNATIGEKKNMNLPNVKVDLPIISEKDKDDILNFAIPMGCNFIAASFIQSAEDVRLIRNLLGPRGRHIKIIPKIENIEGIINFDKILAEADGIMIARGDLGMEISAEKVFLAQKLMISKCNLQGKPIITATQMLESMTKNPRPTRAEVTDVANAVLDGTDCVMLSGETAGGKFPVEAVTIMSKICLEAEACIDYKLLYQSLVNAIQTPISVQEAVARSAVETAESIEASVIITLTETGYTARLIAKYKPSCTILALSASDSTVRCLNVHRGVTCIKVGSFQGTDNVLRNAIEIAKERNIVKPGDSAICIHGIKEEVSGSTNLMKVIQVE

SEQ ID NO: 16614 - DNA, 1584 bp, Neurospora crassa
  CDS (1)..(1584)
atggccgctactgcgcttgaccatctcagcctcggcggcaagattcagtggctcgctcagcttaacactgagttccagcccgctcgcgagttccgtcgcacttccatcatctgcaccattggtcccaagaccaactcggtcgaggccatcaacaagctccgcgatgctggtctcaacgtcgttcgcatgaacttctcccacggaagctacgagtatcaccagtccgtcattgacaatgctcgccaggctgagaaggttcatcccggccgccctattgccattgcccttgacaccaagggccctgagatccgtaccggcaacaccaagaacgatgaggatattcccatctccgccggtaccatccttaacatcaccactgatgaaaagtacaaggatgagtgcactatcgagcacatgtacgtcgactatgtcaacatcaccaaggtcattgctcctggccgtatcatctacgtcgacgatggtgtcctcgctttcgaggtcctcgagattgtcgatgacaagaccatcaaggttaaggcccgcaacaacggctacatctcctcccgcaagggtgtcaaccttcccaacaccgatgtcgatctccctgctctttccgagaaggataaggccgatctcaggttcggtgtcaagaacaaggtcgacatggtctttgcttcttttatccgtcgcggccaggacatcaaggacattcgtgaggtccttggcgaggatggcaagcagatccagatcattgccaagatcgagaacaggcagggtctcaacaactttgctgagattctcgccgagaccgatggtgtcatggttgcccgtggtgacttgggtattgagatccccgccgccgaggtgttcgctgcccagaagaagatcatcgccatgtgcaacattgccggcaagcccgtcatctgcgctacccagatgctcgagtccatgatcaagaaccccagacccaccagagccgagatcagcgatgtcggtaacgctgttaccgatggtgctgactgcgtcatgctttctggtgagaccgccaagggtgcttaccccaccgaggccgtccgtgagatgagcgaggccgttcttaaggccgagaacaccatcccctacgtcagccacttcgaggagctttgcagcttggccaagcgccccgtctccattgtcgagtcctgcgccatggcctctgtccgcgcctcccttgaccttaacgccgctgccattcttgttctctccacctccggcgagtccgctcgtctcatctccaagtaccgccctgtgtgccccatcatcatgatcaccaggaacgactctgcttcgaggtacgcccacctttaccgtggcgtctaccccttccttttccccgagtccaagcccgactttagcaaggtcaactggcaggaggatgttgatcgtcgcatcaagtggggtctcagccacggtattggcctcaaggtcctcaacgagggcgaaaccgttgtcgttgttcagggctggaagggtggtatgggtaacaccaacaccttccgtatcgttaaggccgatgtcaaccacctcggtcttggccagccttaa

SEQ ID NO: 16615 - protein, 527 aa, Neurospora crassa
MAATALDHLSLGGKIQWLAQLNTEFQPAREFRRTSIICTIGPKTNSVEAINKLRDAGLNVVRMNFSHGSYEYHQSVIDNARQAEKVHPGRPIAIALDTKGPEIRTGNTKNDEDIPISAGTILNITTDEKYKDECTIEHMYVDYVNITKVIAPGRIIYVDDGVLAFEVLEIVDDKTIKVKARNNGYISSRKGVNLPNTDVDLPALSEKDKADLRFGVKNKVDMVFASFIRRGQDIKDIREVLGEDGKQIQIIAKIENRQGLNNFAEILAETDGVMVARGDLGIEIPAAEVFAAQKKIIAMCNIAGKPVICATQMLESMIKNPRPTRAEISDVGNAVTDGADCVMLSGETAKGAYPTEAVREMSEAVLKAENTIPYVSHFEELCSLAKRPVSIVESCAMASVRASLDLNAAAILVLSTSGESARLISKYRPVCPIIMITRNDSASRYAHLYRGVYPFLFPESKPDFSKVNWQEDVDRRIKWGLSHGIGLKVLNEGETVVVVQGWKGGMGNTNTFRIVKADVNHLGLGQP

SEQ ID NO: 16616 - DNA, 1455 bp, Synechococcus sp
  CDS (1)..(1455)
atgggccagttcgatcagaaccgtcggaccaagatcgtggccaccatcggtccagccacggaaagttccgagcgaatcaaggaactggttcaggctggagccaccacctttcggttgaatttctcccacggcgaccacagcgagcatgcggcgcggatttcgaccatccgccaggtgtctgaagagctcgggatcaacatcggcatccttcaagacctgcagggaccaaaaatccgcctgggccgttttgctgagggaccgatcacccttgccaatggcgacagcttctccctgacgtccaggccggtgagttgcaaccaatccatcgccaccgtcacctacgacaaactcgctgacgaagtcaccgcaggaagccgcatccttctcgacgacggccgcgttgagatgaaagtcgagcaggtggatcaggctgaacagaccctgcactgcaccgtcaccgttggcggtgttctctccaacaacaaaggagtgaacttccccgacgtgcagctgtccgtccgcgctctgacggacaaggacaaggtggatctggaattcggtctctcccagggggtcgactgggtggccctgagcttcgtacgcaacccctccgacatggaggaaatccgtggtctgatccgtgagcatggccacgagacccccgtcgtcgccaagattgagaagtttgaggccatcgaccagatcgatgccatccttcccctgtgcgatggcgtgatggtcgccaggggtgacctgggggtagagatgcccgctgaggaggttcctcttctgcagaaggaattgatccggaaagccaacagcctgggcattccgatcatcacggccacccagatgctggattcgatggcctccagcccgcgacccacccgcgctgaagtgagcgatgtggccaacgccattttggatggcaccgatgcagtgatgctctccaacgaaacggccgtcggcgatttcccggtggaagccgttcaaacgatggcgaccatcgcctgccggatcgaaaaggattatccccagcgttccgttgacagccatctggccagcacggtgccgaatgccctgagtggcgccgtcagcaccatcgccagtcagctgaacgcctcggcgatccttcctctcaccaaaagcggagcgacggctaagaacgtcagcaagttccgtcccgcatcgccgattctggccattacccctgatccaaccgtggcctgccgtctgcaactggtttggggagtgaagccgctggtgatcccgcagcacgaactcaccactcacacgttccttgccgcgatgacccaggccaaaacaatggggcttctgaaggaaggtgatctggtcgttcagacggccgggacccacacgggtgtctccggttccaccgatctggtcaaggtgggcatcgtcagttcagaggaagcacccgtcaacatgatctga

SEQ ID NO: 16617 - protein, 484 aa, Synechococcus sp
MGQFDQNRRTKIVATIGPATESSERIKELVQAGATTFRLNFSHGDHSEHAARISTIRQVSEELGINIGILQDLQGPKIRLGRFAEGPITLANGDSFSLTSRPVSCNQSIATVTYDKLADEVTAGSRILLDDGRVEMKVEQVDQAEQTLHCTVTVGGVLSNNKGVNFPDVQLSVRALTDKDKVDLEFGLSQGVDWVALSFVRNPSDMEEIRGLIREHGHETPVVAKIEKFEAIDQIDAILPLCDGVMVARGDLGVEMPAEEVPLLQKELIRKANSLGIPIITATQMLDSMASSPRPTRAEVSDVANAILDGTDAVMLSNETAVGDFPVEAVQTMATIACRIEKDYPQRSVDSHLASTVPNALSGAVSTIASQLNASAILPLTKSGATAKNVSKFRPASPILAITPDPTVACRLQLVWGVKPLVIPQHELTTHTFLAAMTQAKTMGLLKEGDLVVQTAGTHTGVSGSTDLVKVGIVSSEEAPVNMI

SEQ ID NO: 16618 - DNA, 1431 bp, Rhodopirellula baltica
  CDS (1)..(1431)
atgcaggactaccgtcacacaaaaatcattgccacgatcggcccggcaaccgagtcccccgaaaaactagcggcgttgatcgaagcgggcgtcgatgtcatgcgactcaatatggcacacggaacgcctgaatgggtcggcgaaatcgtcgcacggatccgaaaggtttccaaggatattagtcgtcacgttgcggtgatgatggacgtcaaaggcccagagattcgaaccggtgcggtggaggatgcgatcgaattgaaagccggcgacgagctggtcctgttcaccgaagactgcgcggatcaatcggcggtcgaatccgacggaactccgcgggtcagtgtgaactatctgggcctgcccggtgcgatcgacttggacagcacgattttggtcgacagcggtttgttgcattggcatgtactgaagaaagacgccaccaccgttcgctgccgcgtgatcacgcccggcgttctggaatctcgacgtcacatcaacttgcctggcgtccaagtcaacttgcccgcgatcacggacaaagaccgcaccgatttggcggcgggcgtcaaagcgggcatcgacttcgttgcgctttcgtttgttcgccaagcggaagacgtccgcacgctgcgtgcattcttagacgaacacggctcacccgcacgaatcatttcaaagatcgaagaccaagccggtgttcgcaacatgaaggcgatcatccggcaatccgatgcgatcatggtcgctcgtggtgacctcggcgttgaaattgattaccaccgattgccgcttgttcaaaccgatttgattcgtgcctgccaagaagatggcaagcccgtcatcatcgccacgcacctgctcgagtcgatgattcaatcgccggttccaactcgtgcggaagtgtcggacgtctccaacgcaattcgcgaacaagccgatgcggtgatgctgtctggtgaaacgaccacgggtaaatacccgctggagtccgttggtgtgctgcaaaacattgtcgccagcatcgagccaacggtcagccgccaactgaactcaaagatcgtgcttcgagagcccaaatcgatgatgctgcgatcggcgtgcaccttggcacaggagatgggtgattcaggaatcgttgtcttcacccgcagcggttttctcgcttacgtcctgggggccctgaggcctcggggtgtgccaattttcgccttcaccgatgtcgagcatacgttccgtcacttaatgttgccgtggggtgtggagccgttcttcatggagttctccgaagatcacgatcaaaccatcaccaacgcattggaagttctgaaggagagcggttggtgcaaaccgggcgtttggttgggggtcatcaccaacgctttggccgacgaaaaaatcatcgacacgcttcagttgcgtcaggtccagtaa

SEQ ID NO: 16619 - protein, 476 aa, Rhodopirellula baltica
MQDYRHTKIIATIGPATESPEKLAALIEAGVDVMRLNMAHGTPEWVGEIVARIRKVSKDISRHVAVMMDVKGPEIRTGAVEDAIELKAGDELVLFTEDCADQSAVESDGTPRVSVNYLGLPGAIDLDSTILVDSGLLHWHVLKKDATTVRCRVITPGVLESRRHINLPGVQVNLPAITDKDRTDLAAGVKAGIDFVALSFVRQAEDVRTLRAFLDEHGSPARIISKIEDQAGVRNMKAIIRQSDAIMVARGDLGVEIDYHRLPLVQTDLIRACQEDGKPVIIATHLLESMIQSPVPTRAEVSDVSNAIREQADAVMLSGETTTGKYPLESVGVLQNIVASIEPTVSRQLNSKIVLREPKSMMLRSACTLAQEMGDSGIVVFTRSGFLAYVLGALRPRGVPIFAFTDVEHTFRHLMLPWGVEPFFMEFSEDHDQTITNALEVLKESGWCKPGVWLGVITNALADEKIIDTLQLRQVQ

SEQ ID NO: 16620 - DNA, 1791 bp, Prochlorococcus marinus subsp
  CDS (1)..(1791)
atgtcgaatattgatttaaaaaggagaaccaagattgttgcaacaattggaccagctactcaatcagaagaaattattactgatcttattaaggctggagtcacaacatttcgattaaatttttctcatggcgatcataaagatcatcaagaaagaatacaaaccataagaaaagtttctgaaaagctagatctagatattggaatacttcaggatcttcagggtcctaaaataagattaggaagatttaaagatggtcctgtaaaagtaaaaaaaggagataaattctcattaacttccaatgaagttgaatgtacaaaaagtatagctaatgttacctacaacaaacttgcccaggaagtaacttcaggtaaaagaatattgttagatgatggaaaaattgaaatgattgttgaaaaggttgatataggaaataatttattagagtgtaaagtaactgttggaggagtcctttctaacaacaaaggtgtaaattttccagatgtacaattatctgttaaagctttaactgataaagatatagaagatcttgaatttggattaactgctggtgttgattggatagctctgagttttgtaagaaatccgtctgatattaatgaaataaaaaatttaataaataagaatggacattcaattcctgttgtagccaagattgaaaaatttgaagcaatagatcaaatagattcaatattacctttgtgtgatggggttatggttgcacgaggagacttaggagttgaaatgccagcagaagaagtccctcttttacaaaaagagttaattagaaaagcaaatacactagggatccccattattaccgccacacaaatgcttgactcaatggcatcaaatccaaggccaactcgcgctgaagtaagtgatgtagctaatgcaattcttgatggtacagatgctgtaatgctttcaaatgaaacagctgtgggtgattatccagtagaagctgttgagaccatggcgacaattgctagaagaattgaacgtgattatccactaaaagcaattgagagtcaccttcctagtactattccaaatgcaataagcgccgcagtcagcaacattgctagacaacttgatgctggggcaataatccctttaaccaaatccggttcaacagcccgtaatgtgagtaaattcagacctcctactcctattcttgctaccactacagagcgatgtgtcgcgagaagattgcaattagtatggggagtgactcctttattagtcaagaatgacgataggactgcaaaaacattcagtattgcaatgcaaatagcacaagaactagggattcttaagcaaggagacctggtagttcagactgcagggacactaacaggtataagtggttcgactgatctaataaaggttgggttagtaagaaaagtggtaactcgaggaatatcagtaggggagataggtgtaactggcaaagcaagaaatataaagactaatcttgatttatcattgatttctccaggtgaaattttatttgtaccaaaaaatatcttaatggatttacctttcaccaaaataattactggaatagttacggatgaaaatatagatgaatgctataaagtattcaaaaaaaataatattaagatatccactatttgtaatttatctgctattgacaatcttgtatcgaacggggatttaataacgttacaactcaatgaaggggttgtttatatggggcagatagaagacgatgaggatgcactagataaatataagtatgtctag

SEQ ID NO: 16621 - protein, 596 aa, Prochlorococcus marinus subsp
MSNIDLKRRTKIVATIGPATQSEEIITDLIKAGVTTFRLNFSHGDHKDHQERIQTIRKVSEKLDLDIGILQDLQGPKIRLGRFKDGPVKVKKGDKFSLTSNEVECTKSIANVTYNKLAQEVTSGKRILLDDGKIEMIVEKVDIGNNLLECKVTVGGVLSNNKGVNFPDVQLSVKALTDKDIEDLEFGLTAGVDWIALSFVRNPSDINEIKNLINKNGHSIPVVAKIEKFEAIDQIDSILPLCDGVMVARGDLGVEMPAEEVPLLQKELIRKANTLGIPIITATQMLDSMASNPRPTRAEVSDVANAILDGTDAVMLSNETAVGDYPVEAVETMATIARRIERDYPLKAIESHLPSTIPNAISAAVSNIARQLDAGAIIPLTKSGSTARNVSKFRPPTPILATTTERCVARRLQLVWGVTPLLVKNDDRTAKTFSIAMQIAQELGILKQGDLVVQTAGTLTGISGSTDLIKVGLVRKVVTRGISVGEIGVTGKARNIKTNLDLSLISPGEILFVPKNILMDLPFTKIITGIVTDENIDECYKVFKKNNIKISTICNLSAIDNLVSNGDLITLQLNEGVVYMGQIEDDEDALDKYKYV

SEQ ID NO: 16622 - DNA, 1818 bp, Prochlorococcus marinus
  CDS (1)..(1818)
atggtagtttccgcgatgtttcaggtcccgttgatggcccagattgatctgacacgacggaccaaaattgttgccaccataggtccggcaaccgagagcgccgaacgaatccgagaactcgttgaggtaggtgctaccaccttccggctgaatttctcacacggcgaccatgacgagcacgccaagcgcatctccaccatccgtcaggtttctgatgaattgggaatgcacatcggcattcttcaagacttgcaaggccccaaaattcgcctgggtcgttttgataaggggcctatcactctggccaatggcgattccttcgcactgacctccaaacaagttcaatgcaatcagtcagtggcaaccgtcacttacgacaagcttgcagacgaagtcacgaccggcagccgaatcttgcttgatgacggtcgagtggagatgaaagtcttaaaaatcgatcaaagcgaacaaaccttgcactgcatcgtcacggtgggaggggtgctctcaaataacaagggagtgaatttccctgatgtacagctttcggttcgcgcccttacagagaaagatcgccaagatctcgcctttggcctccagcaaggggtggactgggtcgcactgagctttgtgcgaaacccttcggacatgaaagagatccgcaaactcatccgcgatcatgggcacagcaccccagtgatcgcgaagatcgagaaatttgaggcgattgatcaaatcgattcaatccttcctctctgtgatggagtcatggttgcaaggggggacttaggcgttgagatgccagccgaagaagtgcctctactgcaaaaggatttgattcgcaaggccaacagccttggaattccaatcatcacagccacccagatgctcgactcgatggcctcaagcccgaggcccaccagagcagaagtcagtgatgtagcaaatgcgatccttgatggtactgatgcagtgatgctctcgaacgaaaccgctgtaggagactatccagtggaggcggttcaaacgatggccaccattgccagacggattgaacgggactatccacagcgtccaatcgaaacttatctagccagcaccatttccaacgcgattagttcagccgtaagcagcatcgccagtcatctcaacgcggcagcaatcgtgccactaactgaaagtggtgcaactgctcacaacgtcagtaaattccgcccagcagcgccaattttggccgtaaccaacaaattggctgtagcaagaaaacttcaattggcatggggtgttaccccactgcttgtcccaacccaaaaaagtaccactgcaaccttcagtgatgcaattgctgttgcccaggaattgggtcttctcaaagaaggagatctaacaattcaaactgcaggaacccttgctggcgtgagcgggtccacagatcttgtcaaagtaggaattgtcagtgcagtacttggccaagggatcggtattggcaatggaaccgttagcggcaaggtcagatttgctttctccccaaacgactcaacaaaaattgaaccaggcgagattctggtcattcatgaaacaagcgatgactatctcgatgcaatcagaaagtctgcaggagtgattacagaacaagaaggagaggaataccacgcagaaatgatctcaaaacgactagggattccgttcatcattgggatagcacatgccacgagaaacctgcttgaaggagaggtggtaacaatgcagctcagtaatggcaaagttcatcgcggcacaggcggcaagctgccaatgaagctcgactcaatggactga

SEQ ID NO: 16623 - protein, 605 aa, Prochlorococcus marinus
MVVSAMFQVPLMAQIDLTRRTKIVATIGPATESAERIRELVEVGATTFRLNFSHGDHDEHAKRISTIRQVSDELGMHIGILQDLQGPKIRLGRFDKGPITLANGDSFALTSKQVQCNQSVATVTYDKLADEVTTGSRILLDDGRVEMKVLKIDQSEQTLHCIVTVGGVLSNNKGVNFPDVQLSVRALTEKDRQDLAFGLQQGVDWVALSFVRNPSDMKEIRKLIRDHGHSTPVIAKIEKFEAIDQIDSILPLCDGVMVARGDLGVEMPAEEVPLLQKDLIRKANSLGIPIITATQMLDSMASSPRPTRAEVSDVANAILDGTDAVMLSNETAVGDYPVEAVQTMATIARRIERDYPQRPIETYLASTISNAISSAVSSIASHLNAAAIVPLTESGATAHNVSKFRPAAPILAVTNKLAVARKLQLAWGVTPLLVPTQKSTTATFSDAIAVAQELGLLKEGDLTIQTAGTLAGVSGSTDLVKVGIVSAVLGQGIGIGNGTVSGKVRFAFSPNDSTKIEPGEILVIHETSDDYLDAIRKSAGVITEQEGEEYHAEMISKRLGIPFIIGIAHATRNLLEGEVVTMQLSNGKVHRGTGGKLPMKLDSMD

SEQ ID NO: 16624 - DNA, 1785 bp, Prochlorococcus marinus
  CDS (1)..(1785)
atgacaacgatagatctaaaacgtaggacaaagatcgttgcgacaataggccctgcaacagaaagtccagagaaaatcacagagcttattaaagcaggtgctacaacctttagactgaatttctcgcatggagatcatgaagaacatgcaaaacggataaaaaccatcagatctgttgcatcagatttaggagtaaacataggcattcttcaggatttacaaggtcctaaaatcagattaggaagatttaaagagggtccagtcaacctaaaaacaggagatgtatttgccctaacttcagaaaacaaagactgcaatcaggaaatagctaatgtcacctatgaaaaccttgtcaatgaggtggaaaaaggaaaaagaatattattagatgatggaagagtcgaaatgattgtagagaatgtagacaagaaaaacaaatcacttatttgcaaagtcacagttggtggaattctttcaaacaacaaaggggttaatttccctgacgtacaactatcaattaatgctttaactgaaaaagataaaatagacctttcatttggtctaaaacaaggagttgactgggtagctctaagttttgttaggaatccagcggatattcaagaaatcaaggaattaatcagacggcatggttataccactccaatagttgcaaaaatagagaaatttgaagcaatagaccaaatagattcaatactcagcctttgtgatggggtgatggttgcaagaggcgatttgggtgttgaaatggatgcagaagaagtacctttgctgcagaaagaattaattaaaaaggccaatagccttgggataccaattattacagctacccagatgttggattcgatggcctcgagtcctagaccaactagggcagaagttagcgatgtagctaatgcaatacttgatggtacagatgcagtaatgctttctaacgaaacagcagtgggagattatccaatagaagctgtcgaaaccatggcaaaaatagcaagaagaatcgagagggattacccacaaagagctttagaaagccaccttccaagtacaattcctaatgcaattagtgccgcagtaagtactattgcaagacaattaaacgcagcagcaatacttcccctaactaaaagtggtgcaactgctcataatgtgagtaagtttcgtcctgctaccccaattcttgccataacaagtgaaattagcgtcgcaagaagacttcaattggtatggggtgtatctcccttgttgatagatgctcaaaaaagcacaagcaaaacctttggaatagcaatggagcaggcaatggacatgaaattattaaagcccggagatcaagtagtagaaacagcaggaaccctaacaggcataagtggttcaacagatttaattaaagtaggaattgtcagcaagatagtagcgagcggaaaaacaaaaccaatcgttaaagaaggaacaataagtggcaaacttagagttataaataaagcaaccgatctgtcagatttaaaatcaggcgaaatactagtacttgcagaaaatgtacaatataatttggacactaaaactcatatatcagcaatgatatttgaaggcgaatattcattaatcaatacaaataatcaaattgaagataataatataattcctgctatatataatgtagaaggagcatgtactaaatttaaaaatggcgagattgtcacactagatcttaaagatggaaatataataaagggtcttgctcaggacctgaaaacatataattaa

SEQ ID NO: 16625 - protein, 594 aa, Prochlorococcus marinus
MTTIDLKRRTKIVATIGPATESPEKITELIKAGATTFRLNFSHGDHEEHAKRIKTIRSVASDLGVNIGILQDLQGPKIRLGRFKEGPVNLKTGDVFALTSENKDCNQEIANVTYENLVNEVEKGKRILLDDGRVEMIVENVDKKNKSLICKVTVGGILSNNKGVNFPDVQLSINALTEKDKIDLSFGLKQGVDWVALSFVRNPADIQEIKELIRRHGYTTPIVAKIEKFEAIDQIDSILSLCDGVMVARGDLGVEMDAEEVPLLQKELIKKANSLGIPIITATQMLDSMASSPRPTRAEVSDVANAILDGTDAVMLSNETAVGDYPIEAVETMAKIARRIERDYPQRALESHLPSTIPNAISAAVSTIARQLNAAAILPLTKSGATAHNVSKFRPATPILAITSEISVARRLQLVWGVSPLLIDAQKSTSKTFGIAMEQAMDMKLLKPGDQVVETAGTLTGISGSTDLIKVGIVSKIVASGKTKPIVKEGTISGKLRVINKATDLSDLKSGEILVLAENVQYNLDTKTHISAMIFEGEYSLINTNNQIEDNNIIPAIYNVEGACTKFKNGEIVTLDLKDGNIIKGLAQDLKTYN

SEQ ID NO: 16626 - DNA, 1419 bp, Mycobacterium bovis
  CDS (1)..(1419)
atgacgagacgcgggaaaatcgtctgcactctcgggccggccacccagcgggacgacctggtcagagcgctggtcgaggccggaatggacgtcgcccgaatgaacttcagccacggcgactacgacgatcacaaggtcgcctatgagcgggtccgggtagcctccgacgccaccgggcgcgcggtcggcgtgctcgccgacctgcagggcccgaagatcaggttgggacgcttcgcctccggggccacccactgggccgaaggcgaaaccgtccggatcaccgtgggcgcctgcgagggcagccacgatcgggtgtccaccacctacaagcggctagcccaggacgcggtggccggtgaccgggtgctggtcgacgacggcaaagtcgcattggtggtcgacgccgtcgagggcgacgacgtggtctgcaccgtcgtcgaaggcggcccggtcagcgacaacaagggcatctcgttgcccggaatgaacgtgaccgcgccggccctgtcggagaaggacatcgaggatctcacgttcgcgctgaacctcggcgtcgacatggtggcgctttccttcgtccgctccccggccgatgtcgaactggtccacgaggtgatggatcggatcgggcgacgggtgccggtgatcgccaagctggataagccggaagccatcgacaatctcgaagcgatcgtgctggcgttcgacgccgtcatggtcgctcggggcgacctaggtgttgagctgccgctcgaagaggtcccgctggtacagaagcgagccatccagatggcccgggagaacgccaagccggtcattgtggcgacccagatgctcgactcgatgatcgagaactcgcggccgacccgagctgaggcctccgacgtcgccaacgcggtgctcgatggcgccgacgcgctgatgctgtccggggaaacctcggtagggaagtacccccttgctgcggtccggacaatgtcgcgcatcatctgcgcggtcgaggagaactccacggccgcaccgccgttgacacacattccccggaccaagcgtggggtcatctcgtatgcggcccgtgacatcggcgaacgactcgacgccaaggccttggtggccttcactcagtccggtgataccgtgcggcgactggcccgcctgcataccccgctgccgctgctggccttcaccgcgtggcccgaggtgcgcagccaactggcgatgacctggggcaccgagacgttcatcgtgccgaagatgcagtccaccgatggcatgatccgccaggtcgacaaatcgctgctcgaactcgcccgctacaagcgtggtgacttggtggtcatcgtcgcgggtgcgccgccaggcacagtgggttcgaccaacctgatccacgtgcaccggatcggggaagatgacgtctag

SEQ ID NO: 16627 - protein, 472 aa, Mycobacterium bovis
MTRRGKIVCTLGPATQRDDLVRALVEAGMDVARMNFSHGDYDDHKVAYERVRVASDATGRAVGVLADLQGPKIRLGRFASGATHWAEGETVRITVGACEGSHDRVSTTYKRLAQDAVAGDRVLVDDGKVALVVDAVEGDDVVCTVVEGGPVSDNKGISLPGMNVTAPALSEKDIEDLTFALNLGVDMVALSFVRSPADVELVHEVMDRIGRRVPVIAKLDKPEAIDNLEAIVLAFDAVMVARGDLGVELPLEEVPLVQKRAIQMARENAKPVIVATQMLDSMIENSRPTRAEASDVANAVLDGADALMLSGETSVGKYPLAAVRTMSRIICAVEENSTAAPPLTHIPRTKRGVISYAARDIGERLDAKALVAFTQSGDTVRRLARLHTPLPLLAFTAWPEVRSQLAMTWGTETFIVPKMQSTDGMIRQVDKSLLELARYKRGDLVVIVAGAPPGTVGSTNLIHVHRIGEDDV

SEQ ID NO: 16628 - DNA, 1440 bp, Haemophilus ducreyi 35000HP
  CDS (1)..(1440)
atgtctagaaaacttagaagaaccaaaattgtttgtacaatggggcctgcaactgatcgtagcaataatttggaaagaattatcgctgcaggagcaaacatggttcgtatgaacttctcacacggcgtgcctgaagaccatattgaacgagcaaataaagttcgtgaaatagctgcacgcttgggtaaacatgttgctattttaggtgacttacaaggtccaaaaattcgtgtatcgacgttcaaagaaggaaaaattttcttaaacataggcgataaatttaccttagatgctgatttacctcgtggtgaaggagatcaacaagtggtcggtttagattataaaaacttacccaacgatgtcgtacccggtgatatccttttattagatgatggtaatgtacaattaaaagttatttctgtagagggtgctaaagtacatactgaagtcacgcttggtggccctttatcaaataataaaggcattaataagttaggcggtggtttatctgctcctgcactaacggaaaaagataaagaagatattaaattagctgcgcgtatcggtgtagattatttagcggtttcatttccacaatctagtcaagacttacactatgcacgtcaattagcagaagaagcgggcttagatgccaaaattgtcgccaaagtagaacgtgctgaaactgtagcaactgaagaagcaatggacgatatcattttaggtgctgatgtggtgatggttgcacgtggtgacttaggtgttgagattggtgatgctgcattagttggcgtacaaaaacgattaattcgtcgtgcaagaaagttaaaccgcgtagtgatcaccgcaactcaaatgatggaatcaatgatcaagaaaccaatgccaacacgtgctgaagtaatggatgtggctaatgccgtgttagatggcactgatgccgtaatgttgtcaggcgaaactgcaagcggtgattaccctgtagaaactgttaaatcaatggcagaagtctgtttaggtgcagaaactatgccaagtattaatatttctcgccaccgcatgcaaggcaaattcgccgccattgatgaagccgttgcaatgtctgcgatgtacacggctaaccatctagaaagcgtttctgcaatcattgcattgactcactccggtgaaacggcaaaattaatgagccgtattagttctggcttaccaatttatgcgctatcacgtaatcaacaagcattaaatcgtaccgcactttatcgtggtgtaacgcccgtatactataacgaagaaagccgtacaatcgaaggagctaaaaaaggtattgcattgctcaaagaaaaaggctatttgatgaccggtgatttagtcttattaacacaaggtagcgaatcaaaagatggcggtactaatacttgtcgaattttaaaagtggaataa

SEQ ID NO: 16629 - protein, 479 aa, Haemophilus ducreyi 35000HP
MSRKLRRTKIVCTMGPATDRSNNLERIIAAGANMVRMNFSHGVPEDHIERANKVREIAARLGKHVAILGDLQGPKIRVSTFKEGKIFLNIGDKFTLDADLPRGEGDQQVVGLDYKNLPNDVVPGDILLLDDGNVQLKVISVEGAKVHTEVTLGGPLSNNKGINKLGGGLSAPALTEKDKEDIKLAARIGVDYLAVSFPQSSQDLHYARQLAEEAGLDAKIVAKVERAETVATEEAMDDIILGADVVMVARGDLGVEIGDAALVGVQKRLIRRARKLNRVVITATQMMESMIKKPMPTRAEVMDVANAVLDGTDAVMLSGETASGDYPVETVKSMAEVCLGAETMPSINISRHRMQGKFAAIDEAVAMSAMYTANHLESVSAIIALTHSGETAKLMSRISSGLPIYALSRNQQALNRTALYRGVTPVYYNEESRTIEGAKKGIALLKEKGYLMTGDLVLLTQGSESKDGGTNTCRILKVE

SEQ ID NO: 16630 - DNA, 1467 bp, Candidatus Blochmannia floridanus
  CDS (1)..(1467)
atgccgcaattattaagaagaactaaaattatcgctactctaggacctgctactgatcaaaaaaatactcttgaaaaaatcattatttcaggagttaatatagtaagattaaatttttcacatggaaattcttcagaacattttttcagagcaaataaagttcgaaaacttgctaatcaactacataaatatatagctattttaggcgacctacaaggccccaaaatcagaatttcaacctttcaaactaataacatatatttacagtctggagatgattttttaatagattctacgttaaaaaatagtcataataatcaaaaatatgtaggagtaaactataaagaattaccacaagatgtttctccaggagattatttattattggatgacggaaaaattcaattaaaagttataaaaattcaaaatacccaaattttcactaaagtagtaattggaggattattatctaataataaaggaatcaacaaattaggcggaggattatctgcaaaagtattaacaaataaagataaattagatattatcactgcagccaaaatcggagtagattatctagcgatatcctttcctcgcaacagtatggatttaaactttgcccgaaaactaattacagatgctggaagcaatgcaaaaattatatctaaaatagaaagagctgaagtagttaaatccgatgacacaatagatgatattattaaagcatctgatgcagttatgatagctagaggagatttaggaatagaaattggagaaccacaattagtaggaatacaaaaaaaaattatacaaagagcacatctcctaaatagagctgttattacagcaacacaaatgatggaatccatgataattaattcggttcctactcgagcagaaatcatggatgtcgccaatgcagtattggatggaacagatgcggttatgttatccgcagaaactgcaaccggacagtatccatctgaaaccgtttcttctatggctgatgtctgtttaggagcagaaaaaactctaaataatactaataatcaattaatatttatcaatcaactacaaaaaaaaattaacaataccaaagaagctattgcagcatcaacaatgcatatagctaattgtttaagtaaaatacgtgcaattatttctataactgattgggaacatattgtattattattatctcgatttaactctcaattacctatttttgctttatccaaacacattcatattcttaacattgttactttatataaaggagtaatacctatttattttaatcgaactggtaataatataatagatgcaagacaggcgagtaacttattgcgagatcaaggttttctaacacctggagaactagtaataataatacaagataatattgtgaatcaatctaatattaataacgtaactcatattcttacaatagaagaacaatgtaaataa

SEQ ID NO: 16631 - protein, 488 aa, Candidatus Blochmannia floridanus
MPQLLRRTKIIATLGPATDQKNTLEKIIISGVNIVRLNFSHGNSSEHFFRANKVRKLANQLHKYIAILGDLQGPKIRISTFQTNNIYLQSGDDFLIDSTLKNSHNNQKYVGVNYKELPQDVSPGDYLLLDDGKIQLKVIKIQNTQIFTKVVIGGLLSNNKGINKLGGGLSAKVLTNKDKLDIITAAKIGVDYLAISFPRNSMDLNFARKLITDAGSNAKIISKIERAEVVKSDDTIDDIIKASDAVMIARGDLGIEIGEPQLVGIQKKIIQRAHLLNRAVITATQMMESMIINSVPTRAEIMDVANAVLDGTDAVMLSAETATGQYPSETVSSMADVCLGAEKTLNNTNNQLIFINQLQKKINNTKEAIAASTMHIANCLSKIRAIISITDWEHIVLLLSRFNSQLPIFALSKHIHILNIVTLYKGVIPIYFNRTGNNIIDARQASNLLRDQGFLTPGELVIIIQDNIVNQSNINNVTHILTIEEQCK

SEQ ID NO: 16632 - DNA, 1443 bp, Bordetella parapertussis
  CDS (1)..(1443)
atgcccgtactgcgccgcaccaaaatcgttgccaccctggggcccgccacgtccacgcccgagcggctcgacgggctgatacgcgccggcatggacgtggcccgcctgaatttctcgcacggcagcgcgcaggaccatcgcgagcgcgtgcggctggtgcgcgagctggcggccgagcaagggcgcttcgtggccctcatgggcgacttgcagggcccgaagatccggatcgcccgcttcaccgaccagcaggtcaccctgcaggccggccagcctttcacgctgtcgcgttcacattccaaggaggccggcgacgcaaccatcgtgggtatcgattatcccgagctggtgcaggactgccgccctggcgacgagctgctgctcgacgatggccgcgtggtgctggtggtcgacagcgtgggggccgaggaggtccacaccaccgtgacggtgggcgggccgctgtcgaacaacaagggcatcaaccggcgcggcggcggcctttcggcgcccagcctcaccgacaaggaccgcaccgacatcaagctggccgccgagatggagctggactacgtggccgtatcgtttccgcgctatggggccgacatcgatgaagcccgcgcgctgctgcgcgcggccggcagccaggcctggatcatcgccaagatcgagcgcgccgaggcggtggccgacgacgacgcgctggatgcgctgatccgcgccagcgacggcgtgatggtggcgcgcggcgacctgggcgtggaagtgggcgacgccgaactggtcggcatccagaagcgcatcatccagcacgcgcgtacgctgaacaaggtggtcatcacggccacccagatgatggagtccatggtggccagccccatgcccacgcgcgccgaggtgtcggacgtggccaacgcggtgctcgactacacggacgccgtcatgctgtcggccgaaagcgcctcgggccagtatccgatcgaggcggtggcggcgatggcacgggtctgtctgggggcggagaagcaccctaccaccacgcattcgcaccatcgcctgggcgagacgttcacgcgctgcgacgagaccatcgcgctggcggccatgtacgcggccaaccatttcccgggcgtgaaggccatcatcgcgctgaccgaaagcgggcacacgccgctgatcatgtcgcgcatccgttcgggcgtgccgatctactgctacagcccgcatggtcccacgcagcggcgcgcggcgctgtttcgcggcgtctacacggtgcccttcgcgccggccgaatacgacccggccgacttgagcaacgcggccatcgacgagctgaagaagcgtggccgtgtcgcggcgggcgactgggtcatcctgaccaagggcgatttctaccgcgacagcggcggcaccaacggcctgaagatcctgaaggtggaatag

SEQ ID NO: 16633 - protein, 480 aa, Bordetella parapertussis
MPVLRRTKIVATLGPATSTPERLDGLIRAGMDVARLNFSHGSAQDHRERVRLVRELAAEQGRFVALMGDLQGPKIRIARFTDQQVTLQAGQPFTLSRSHSKEAGDATIVGIDYPELVQDCRPGDELLLDDGRVVLVVDSVGAEEVHTTVTVGGPLSNNKGINRRGGGLSAPSLTDKDRTDIKLAAEMELDYVAVSFPRYGADIDEARALLRAAGSQAWIIAKIERAEAVADDDALDALIRASDGVMVARGDLGVEVGDAELVGIQKRIIQHARTLNKVVITATQMMESMVASPMPTRAEVSDVANAVLDYTDAVMLSAESASGQYPIEAVAAMARVCLGAEKHPTTTHSHHRLGETFTRCDETIALAAMYAANHFPGVKAIIALTESGHTPLIMSRIRSGVPIYCYSPHGPTQRRAALFRGVYTVPFAPAEYDPADLSNAAIDELKKRGRVAAGDWVILTKGDFYRDSGGTNGLKILKVE

SEQ ID NO: 16634 - DNA, 1536 bp, Oryza sativa
  CDS (1)..(1536)
atggcgaacatcgacatggggaagatcctggcggggctggagaacgacgacgcgcgggtgcccaagaccaagctggtctgcacgctcggcccggcctcccgctccgtccccatgctcgagaagctgctccgcgccgggatgaacgtcgcgcgcttcaacttctcccacggcacccacgagtaccaccaggagaccctcgacaacctccgccaggccatgcacaacaccggcgtcctctgcgccgtcatgctcgataccaagggtcctgagattcgtactggatttttgaaggatggcaagccaatcaagctaacaaagggtcaagaactcactgttaccaccgattatgagatcaagggtgatgagaacatgattaccatgagttacaagaaactgccagttgatgtgaagcctggaaatgtcattctctgcgccgatggtacaatctctttgactgttttgtcctgtgatccaaaggctggaactgtgaggtgtaggtgtgagaacacagcaatgcttggcgagagaaagaattgcaatctgccaggaattgttgtggaccttcctacactgactgagaaggataaagaagacattttgggatggggtgtgccaaatgacatagacatgattgctctgtcgtttgtccgtaaaggatcagatttggttaccgtcagacaacttcttggacagcatgcaaagcgcatcaagctgatgtcaaaggttgaaaaccaagagggtgttgtaaacttcgatgagatcttgagggaaacggatgcatttatggttgctagaggtgatcttggaatggagattccagttgagaagatattccttgcacagaagatgatgatttacaagtgcaaccttgctggaaagcctgttgtgactgctactcagatgcttgagtcgatgatcaaatcaccacgtccaactcgtgctgaggcaactgacgttgcaaatgcagttcttgatggaactgactgcgtcatgcttagtggagagagtgctgctggagcataccctgaagtagctgtgaagatcatggcacgtatatgtgttgaggcagagtcttcccttgacaacgaagctgtcttcaaggagatgatcaggtctgcgccccttccgatgagcccattggagtctctcgcatcctctgctgtacgcacagccaacaaggccaaggcagccctgattgttgtcttgactcgtggtggtaccacggcaaagctggttgccaagtatcgtcccagggttccaatcctctctgtggttgtccccgtgttgacaaccgattcattcgactggacaatcagctcggagggcccagcaaggcacagcctaatctacagaggtcttgttcctctcctggctgagggttctgccaaagccaccgattcggagtcgacagaggtcatccttgatgctgctctcaagtcagctgtacagaagcagttgtgcaagcctggtgatgctgttgttgctctgcaccgtattggcgtcgcatccgtgatcaagatctgcatcgtgaagtaa

SEQ ID NO: 16635 - protein, 511 aa, Oryza sativa
MANIDMGKILAGLENDDARVPKTKLVCTLGPASRSVPMLEKLLRAGMNVARFNFSHGTHEYHQETLDNLRQAMHNTGVLCAVMLDTKGPEIRTGFLKDGKPIKLTKGQELTVTTDYEIKGDENMITMSYKKLPVDVKPGNVILCADGTISLTVLSCDPKAGTVRCRCENTAMLGERKNCNLPGIVVDLPTLTEKDKEDILGWGVPNDIDMIALSFVRKGSDLVTVRQLLGQHAKRIKLMSKVENQEGVVNFDEILRETDAFMVARGDLGMEIPVEKIFLAQKMMIYKCNLAGKPVVTATQMLESMIKSPRPTRAEATDVANAVLDGTDCVMLSGESAAGAYPEVAVKIMARICVEAESSLDNEAVFKEMIRSAPLPMSPLESLASSAVRTANKAKAALIVVLTRGGTTAKLVAKYRPRVPILSVVVPVLTTDSFDWTISSEGPARHSLIYRGLVPLLAEGSAKATDSESTEVILDAALKSAVQKQLCKPGDAVVALHRIGVASVIKICIVK

SEQ ID NO: 16636 - DNA, 1446 bp, Chlamydophila caviae GPIC
  CDS (1)..(1446)
atgatcgcaagaacgaaaatcatttgtactataggtccagcaacaaacactccagaaatgcttgagaagcttttagatgcgggtatgaatgttgctaggttgaattttagtcatggtactcatgaaagtcatggtgagacaattcgtcttcttaaggaattgcgagaaaagaaaggggctcctttagcgattatgttggataccaagggtccagaaattcgtttagggaatattcccacaccaattcaggtatctcgaggtcagaaaattaccttagtaggaaaagaggtagagggatctgccgaaggtggcgttaccttacatcctcaatgtgttttcccttatgtgcgtgagggtgttgatgtcttgatagacgatggttatattcaagctgttgtgacctctgttggtgaggatcatctagaattagagtttattaactctggagaattaaagtcgcacaagtctttaagcataagagaaattgatttagctcttccttttatgacggataaggatatcaatgatcttcagtttggcgttgcgcagggcgttgatgttattgctgcttcttttgtccgttatgctgaggatatcgaaagtatgcgcaagtgcttagcagatgctggccgtccggatatgcccattattgctaagatagaaaatcgtttgggagtagagaatttttctcagattgctaaagcttccgatgggattatgattgcccgtggagatttagggattgagctttctgttgttgaggtccctaatttacagaagtttatggcaaagatgtctcgtgaaatgggacgtttttgcattaccgctacgcaaatgttagaatctatgattcgcaatgttttaccgacacgagcagaagtttctgatgttgctaatgctatttatgatggtacctcagcagtaatgttatctggggaaacggcctcgggaagttatcctgtcgcggctgtgaaaattatgcgttctgtgattcaagagacagaaaaaaatcttaattataagtctttcttagaacttagcgatagtgaatgtgctgttaaggtatccccttatcttaagtctataggtttatcaggaattcaaattgctgagaaagctgatgctaaagccattatcgtttacacggaatccggaggatcacccattttcctttctaaataccgtccgcgttttccaattattgctgttacaccaaatctatctgtgtattacaggcttgctttagagtggggagtctatcctatgcttacgcaagagtcagaccgtgcagtatggagacatcaagcttgtatttatggaatcgaaagaggaattttatcaaattatgataagattttagttttgagtcgtggcgctcaaatgaaagatactaataatcttaccttaacaacggtaaatgatatcatcacagcatcagctaaataa

SEQ ID NO: 16637 - protein, 481 aa, Chlamydophila caviae GPIC
MIARTKIICTIGPATNTPEMLEKLLDAGMNVARLNFSHGTHESHGETIRLLKELREKKGAPLAIMLDTKGPEIRLGNIPTPIQVSRGQKITLVGKEVEGSAEGGVTLHPQCVFPYVREGVDVLIDDGYIQAVVTSVGEDHLELEFINSGELKSHKSLSIREIDLALPFMTDKDINDLQFGVAQGVDVIAASFVRYAEDIESMRKCLADAGRPDMPIIAKIENRLGVENFSQIAKASDGIMIARGDLGIELSVVEVPNLQKFMAKMSREMGRFCITATQMLESMIRNVLPTRAEVSDVANAIYDGTSAVMLSGETASGSYPVAAVKIMRSVIQETEKNLNYKSFLELSDSECAVKVSPYLKSIGLSGIQIAEKADAKAIIVYTESGGSPIFLSKYRPRFPIIAVTPNLSVYYRLALEWGVYPMLTQESDRAVWRHQACIYGIERGILSNYDKILVLSRGAQMKDTNNLTLTTVNDIITASAK

SEQ ID NO: 16638 - DNA, 1437 bp, Streptomyces avermitilis
  CDS (1)..(1437)
atgcgccgagcaaagatcgtctgtactctgggccccgccaccgactcgtacgaccagatcaaggcactggtcgaggccggaatggacgtagcccgcttcaacctcagccacggcacctacgccgagcacgaggagcgttaccagcacgtccgcaaggcctccgacgagaccgggcgcagcgtcggagtcctcggcgaccttcaaggtccgaagatccgcctcggccgcttcaacgaaggacccgtactccttgaacgcggcgacaccttcaccatcaccgtcgaggaaggcgtcgaaggcgaccgccagacctgcggcaccacctacgccggcctcgccgccgacgtcactcccggtgagcgcatcctcgtcgacgacggcaaggtctgcctcgaagtcacctccgtcgacggcccccgcgtccacaccaccgtcgtcgaaggcggcatggtctccgaccacaagggcctgaacctgcccggcgtggccgtctcggtccccgccctctccgacaaggacgaggccgacctccgctgggccctccgtcagggcttcgacgtcatcgcgctgtccttcgtacgcagcggcaaggacatcaaggacgtccaccggatcatggacgaagaaggccgccggctccccgtcatcgccaaggtggaaaagccccaggccgtcgagaacatcgacgacatcgtcgccgccttcgacggaatcatggtcgcccgcggagacctcggcgtggaaatgccgctcgaacaggtcccgatcgtccagaagcgcgccatcaaactcgccaggcgcaacgcgaagccggtcatcgtcgcgacgcagatgctggactccatgatcgacaactcccgcccgacccgcgcggaggcctcggacgtcgccaacgccgtcatcgacggcaccgacgcggtgatgctgtccggcgagacgagcgtgggcaagtaccccgtcgaaacggtccgcaccatgtcccgcatcgtggaagcggcggaagaggacatcctggccacgggcctgccgccgctgaccgaacgcaacaagccccgcacccagggcggcgcggtggcccgcgcggcggccgagatgggcgacttcctcggcgccaagttcctggtggcgttcacgcagtccggagacacggtccgccgcctctcgcgctaccgttccccgatcccgctcctggccttcaccccgatgccggcgacgcgctcccagctcaacctgacatggggcgtggagacgttcctgggcccgcacgtggattcgacggacgcgatggtggaccaggtcgacgagctgctgctcaagtacggccgctgcgagaagggcgacgtggtggtcatcacggcgggctcaccccccggcgtctcgggctcgacgaacctggtccgagtccaccacatcggcgaggacgacagccccaagtag

SEQ ID NO: 16639 - protein, 478 aa, Streptomyces avermitilis
MRRAKIVCTLGPATDSYDQIKALVEAGMDVARFNLSHGTYAEHEERYQHVRKASDETGRSVGVLGDLQGPKIRLGRFNEGPVLLERGDTFTITVEEGVEGDRQTCGTTYAGLAADVTPGERILVDDGKVCLEVTSVDGPRVHTTVVEGGMVSDHKGLNLPGVAVSVPALSDKDEADLRWALRQGFDVIALSFVRSGKDIKDVHRIMDEEGRRLPVIAKVEKPQAVENIDDIVAAFDGIMVARGDLGVEMPLEQVPIVQKRAIKLARRNAKPVIVATQMLDSMIDNSRPTRAEASDVANAVIDGTDAVMLSGETSVGKYPVETVRTMSRIVEAAEEDILATGLPPLTERNKPRTQGGAVARAAAEMGDFLGAKFLVAFTQSGDTVRRLSRYRSPIPLLAFTPMPATRSQLNLTWGVETFLGPHVDSTDAMVDQVDELLLKYGRCEKGDVVVITAGSPPGVSGSTNLVRVHHIGEDDSPK

SEQ ID NO: 16640 - DNA, 1431 bp, Streptomyces avermitilis
  CDS (1)..(1431)
atgcgccgttcgaaaatcgtctgtactctcggccccgcggtcgactcccacgagcagctcgtcacgctgatcgaggccggcatgaacgtggcccgcttcaacttcagccacggcacgcacgccgagcaccagggccggtacgaccgggtccgggccgcggccgccgagaccggcaaggccatcggtgtcctcgcggacctccagggcccgaagatccggctggagaccttcgccgagggtcccgtcgagctggtgcgcggtgacgagttcatcatcaccaccgaggacgtgccgggcgacaagcacatctgcggcacgacgtacaagggcctgcccggggacgtctccaagggcgaccagatcctcatcaacgacggcaacgtcgagctgcgggtcgtcgaggtcgacgggccgcgggtcaagacggtcgtcatcgagggcggcgtgatctccgaccacaagggcatcaacctgcccggcgcggccgtgaacgtgcccgcgctgtccgacaaggacatcgaggacctgcgcttcgccctgaagatgggctgcgacctggtcgcgctgtccttcgtgcgcgacgcgagcgacgtgaaggacgtccacaaggtgatggacgaggagggccgccgggtccccgtcatcgccaaggtggagaagccgcaggcggtggagaacatggaggccgtcgtcgcggccttcgacggcgtgatggtggcgcgcggcgacctggccgtcgagtacccgctcgagaaggtcccgatggtgcagaagcgcctcgtggagctgtgccgccgcaacgccaagccggtgatcgtcgcgacccagatgatggagtcgatgatcaccaactcccgcccgacgcgcgccgaggcgtccgacgtggccaacgcgatcctcgacggcgcggacgcggtgatgctgtccgccgagtcgtcggtcggcgcctacccgatcgagacggtcaagacgatgtcgaagatcgtcacggcggcggaggaagagctgctgtcgaagggcctgcagccgctggtccccggcaagaagccccgtacgcagggtggttcggtcgcccgcgcggcctgcgagatcgccgacttcctgggcggcaagggcctggtggccttcaccaagtcgggcgacaccgcccgtcggctctcccgctatcgcgcggcccagccgatcctggccttcaccacggacgagggcacgcgcaaccagctcgcactgagctggggcgtcgagtcccacgtcgtgccgttcgtgaacagcaccgacgagatggtcgacctggtcgactccgagctgcagaacctgaagcggttcaacgacggcgacgtcgtcgtgatgaccgccggctcgccccccggcgtcccgggcacgacgaacatggtgcgagtgcaccacctgggcgagggcaagcgcgcctga

SEQ ID NO: 16641 - protein, 476 aa, Streptomyces avermitilis
MRRSKIVCTLGPAVDSHEQLVTLIEAGMNVARFNFSHGTHAEHQGRYDRVRAAAAETGKAIGVLADLQGPKIRLETFAEGPVELVRGDEFIITTEDVPGDKHICGTTYKGLPGDVSKGDQILINDGNVELRVVEVDGPRVKTVVIEGGVISDHKGINLPGAAVNVPALSDKDIEDLRFALKMGCDLVALSFVRDASDVKDVHKVMDEEGRRVPVIAKVEKPQAVENMEAVVAAFDGVMVARGDLAVEYPLEKVPMVQKRLVELCRRNAKPVIVATQMMESMITNSRPTRAEASDVANAILDGADAVMLSAESSVGAYPIETVKTMSKIVTAAEEELLSKGLQPLVPGKKPRTQGGSVARAACEIADFLGGKGLVAFTKSGDTARRLSRYRAAQPILAFTTDEGTRNQLALSWGVESHVVPFVNSTDEMVDLVDSELQNLKRFNDGDVVVMTAGSPPGVPGTTNMVRVHHLGEGKRA

SEQ ID NO: 16642 - DNA, 1491 bp, Nitrosomonas europaea ATCC 19718
  CDS (1)..(1491)
atgatgcgaagaacaaaaattgtagcaacgttaggaccggcttccagtaatgctgaagttctggggcgaatgctcgaagctggtgtcgatgttatccgtatcaatttctcacacggaacaaaagatgagcacatcgcttccgtagaactggttcgttcgctcgcccgctcgcttggccgtacagtcggtgtactggctgatttacaggggccaaaaattcgtatcggtaagtttgaacagggaaaaattcgactcaaaaccggggatgaattcatactcgatgcagaatgccagctgggaaaccaggaacgggtcggactggattatcgggaacttcctaatgatgtcgaagcaggcgccacgctcttattggatgatggacgtatcgttctgacggtggccaaagtcagagaaagtgaaatcttttgtgaagtgttgcagggcgggattctttccaacaataaaggtattaaccggaaaggcggagggttgagcgcacctgcactcactgcgaaagatttactggatatcaagacttccgcagtcattcgagcagattatctcgcagtatccttccctcgctccggtgacgatatcagacgcgcgcgcgcactgatgcaggaagctcaggggcatagtttgctcatggcaaaaatcgagcgctcagaagccattctggcactggatgatattctggaagcgtctgatgccatcatggtggcccgtggagatctggcagtcgaagtaggagatgccgctgttcccgccttgcaaaaacgcatgatacgatctgcacgtgaagcaaataagctggtaattaccgctacgcaaatgatggaatccatgatttccaaccctattccgacacgcgcagaagtatcagatgttgccaatgccgtactggatggtaccgatgcagtcatgctgtccgctgagtcggccgcagggcaatacccggttgaagccgtcgaagccatggccagagtttgtctcgaagcagaaaaggaatatacacccagtttgagagcacgccgttcccccgatacacagtcaatcagtattgaagatgccattgcgcgcgctaccatgtacgcagccggttcactcaatatccaggcaattgcagcattgacacaaagtggtgtaacagcgttgttcatgtcacgcagaagttcgaaagcacccatctttgcactcagcccgcaagaagataccctgggtaaagtcacccttttccgaggcgtttatcccatagaattcggacaaggactgtgtgatcccgaaatcatcctaggcatggctgaagacgagttactcaagcgtggtgcggtacgcgacgaagatctgataatcatgacgatcggtgaaccggttggcaaagctggcgggacgaacaccatgaagatcatcaaagtaggcagttccaagaaagctgcacaagcagtaagagaagtggcgcaacaacccttttctgatccgcagaatctgtaa

SEQ ID NO: 16643 - protein, 496 aa, Nitrosomonas europaea ATCC 19718
MMRRTKIVATLGPASSNAEVLGRMLEAGVDVIRINFSHGTKDEHIASVELVRSLARSLGRTVGVLADLQGPKIRIGKFEQGKIRLKTGDEFILDAECQLGNQERVGLDYRELPNDVEAGATLLLDDGRIVLTVAKVRESEIFCEVLQGGILSNNKGINRKGGGLSAPALTAKDLLDIKTSAVIRADYLAVSFPRSGDDIRRARALMQEAQGHSLLMAKIERSEAILALDDILEASDAIMVARGDLAVEVGDAAVPALQKRMIRSAREANKLVITATQMMESMISNPIPTRAEVSDVANAVLDGTDAVMLSAESAAGQYPVEAVEAMARVCLEAEKEYTPSLRARRSPDTQSISIEDAIARATMYAAGSLNIQAIAALTQSGVTALFMSRRSSKAPIFALSPQEDTLGKVTLFRGVYPIEFGQGLCDPEIILGMAEDELLKRGAVRDEDLIIMTIGEPVGKAGGTNTMKIIKVGSSKKAAQAVREVAQQPFSDPQNL

SEQ ID NO: 16644 - DNA, 1758 bp, Enterococcus faecalis V583
  CDS (1)..(1758)
atgaaaaaaacgaaaatcgtatgtacgattggaccagctagtgaatccgttgatatgctagtaaacttaattaatgcaggtatgaatgtttgccgtttgaacttttcacatggtgactacgaagagcatggtgctcgtattaaaaacattcgtgaagctgtaaaaattacagggaaacgcgtagcgatcttactagatacaaaaggtcctgaaatccgcacaaatgacatggaaaatggcgcaatcacaatgaaaattggtgactcagtacgtatttctatgacagaagttttaggaacaaatgaaaaattctcaatcacttatccagaattaatcaatgatgtaaacgtaggttcacacattcttttagatgatggtttaatcgatttagaagtaactgatatcgaccgtgatgcaaacgaaatcgtaacagttgttaaaaacgaaggcgtcttgaaaaacaaaaaaggcgttaacgtaccaggcgtttctgtaaacttaccagggatcactgaaaaagatgctaacgatatccgtttcggaattggtcaaggaattgactttatcgcagctagcttcgttcgtcgtgcttctgacgttttagaaatcactaaaattttagaagaagaaaacgcaacacacatccaaatcattcctaaaatcgaaaaccaagaaggtatcgataatatcgatgaaatcttaaaagtttctgatggtttaatggttgctcgtggtgacatgggtgttgaaattccaacagaagatgttccagttgtccaaaaagctttaattaaaaaatgtaatgctttaggtaaaccagttatcactgcaacacaaatgttagattcaatgcaacgtaacccacgtccaacacgtgcggaagcaaatgacgtagcaaacgcaatctacgatggaacagatgcagtaatgttatcaggcgaaactgcagcaggggattacccattagaagctgttcaaacaatggctcgtattgcagttcgtacagaagaaacattagttaaccaagattcattcgcattgaaattatatagcaaaacagatatgactgaagcaatcggacaatctgttggccatacagcacgtaacttgggtatccaaacaatcgttgcggcaacagaatcaggccatacagcacgtatgatctctaaataccgtccaaaagcacatatcgttgcaattacgttctcagaacaaaaagcacgtagcttgtcattatcatggggtgtttacgcaacagttgctgacaaaccatcaagcacagatgaaatgtttaatttagcttcaaaagtatcacaagaagaaggttatgcttcagaaggtgatttaatcattatcactgctggtgttccagttggcgaaaaagggacaacaaacttaatgaaaattcaaatgatcggttctaaattagttcaaggtcaaggtgtcggcgaagaagcaattattgcaaaagccgttgtggcagcaactgctgaagaagcagttgctaaagcgactgaaggagctattttagttacaaaaacaacagataaagaatacatgccagcaattgaaaaagcatcagcattagttgttgaagaaggtggtttaacttctcatgcagctgttgtagcgattgcgcaaaatattccagttatcgtaggtgctgcagatgcaacatcattaattaataatgacgaagtgattactgttgatcctcgtcgtggtattgtttaccgcggagcaacaacagctatctaa

SEQ ID NO: 16645 - protein, 585 aa, Enterococcus faecalis V583
MKKTKIVCTIGPASESVDMLVNLINAGMNVCRLNFSHGDYEEHGARIKNIREAVKITGKRVAILLDTKGPEIRTNDMENGAITMKIGDSVRISMTEVLGTNEKFSITYPELINDVNVGSHILLDDGLIDLEVTDIDRDANEIVTVVKNEGVLKNKKGVNVPGVSVNLPGITEKDANDIRFGIGQGIDFIAASFVRRASDVLEITKILEEENATHIQIIPKIENQEGIDNIDEILKVSDGLMVARGDMGVEIPTEDVPVVQKALIKKCNALGKPVITATQMLDSMQRNPRPTRAEANDVANAIYDGTDAVMLSGETAAGDYPLEAVQTMARIAVRTEETLVNQDSFALKLYSKTDMTEAIGQSVGHTARNLGIQTIVAATESGHTARMISKYRPKAHIVAITFSEQKARSLSLSWGVYATVADKPSSTDEMFNLASKVSQEEGYASEGDLIIITAGVPVGEKGTTNLMKIQMIGSKLVQGQGVGEEAIIAKAVVAATAEEAVAKATEGAILVTKTTDKEYMPAIEKASALVVEEGGLTSHAAVVAIAQNIPVIVGAADATSLINNDEVITVDPRRGIVYRGATTAI

SEQ ID NO: 16646 - DNA, 1422 bp, Tropheryma whipplei
  CDS (1)..(1422)
atgtttatgcgtagggccaagattgttgttactctcggtccggcagtatcagatcttgattctgtgagagatcttatatccgctggtgccgacgtctttcgcatgaatctcagccacggatcgttggattttcacagggaggtatttctgaatgttaggacggctgctgctgagctagacaggcatattgctatatttgctgatcttcagggtccaaaaatacgtttagggcgttttgcttctgggccgtataccctacaagagggtgatatctttacaatcacaaccgagcaggtgttgggaacgaaagagctttccagcacaactttgccgacattaccagataatgtctcagagggggatttgcttttaattgatgatggcaaagttgccctgagggcgattgggaatgacggggttcggatcactacacgtgttgaagttccgggaaaggtctcgaataataagggtattaaccttccgggtgttggagttaaagttccggccttatctgaaaaggatattgactcactccgctgggccctttctcttccagttgatatgattgccttgagttttgtgcgctgcgcatcagatgtggatgctgtgcacaaggttatggatgaagagggtattcgccttcctgttattgcaaagatagaaaagcctcaagcagtatctgccatagaggagattgcactgcggtttgatgcgattatggtagcaaggggtgatcttggggttgaactgccgcttgaagatgtgccggtagcccagaaggaaattgttaaggttgcacgcaggtttgctcggccggttattatcgcaacccagatgcttgagtcaatgatctcttcctcgcggcccaccagggctgaggcgagtgatgttgcaaacgctgttcttgatggagccgatgcactgatgctaagcggtgagacaagtgttggtgagtggcccgttgaagctgtgcgggtcatgtcgagggttattgaaaaaacagaggaaaaggcaatttcacaaatagtcggttttggtacaactccaaaaacacagggtggtgccctcgcctgggccgcagcaaaggttgctgagtttatcgatgcgcgttatctgtgtgtctttagtgaaagtggagattcaataagacgggtgtcgcgactgcgtcatgatatacccattattggatttagtccggttgggtccgttgtccgacaggtctctctctcttggggtgttcgatgttttttgatagagaggctccatcagactgatcagatgatgcgtaaggctgaacatgttctcctcacaaacaatttggccgagattggagagaagattgtgattatttcaggatcaccagttggggtgccggggagtacaaaccatatgagaatccacgagcttggaagcacgtcctag

SEQ ID NO: 16647 - protein, 473 aa, Tropheryma whipplei
MFMRRAKIVVTLGPAVSDLDSVRDLISAGADVFRMNLSHGSLDFHREVFLNVRTAAAELDRHIAIFADLQGPKIRLGRFASGPYTLQEGDIFTITTEQVLGTKELSSTTLPTLPDNVSEGDLLLIDDGKVALRAIGNDGVRITTRVEVPGKVSNNKGINLPGVGVKVPALSEKDIDSLRWALSLPVDMIALSFVRCASDVDAVHKVMDEEGIRLPVIAKIEKPQAVSAIEEIALRFDAIMVARGDLGVELPLEDVPVAQKEIVKVARRFARPVIIATQMLESMISSSRPTRAEASDVANAVLDGADALMLSGETSVGEWPVEAVRVMSRVIEKTEEKAISQIVGFGTTPKTQGGALAWAAAKVAEFIDARYLCVFSESGDSIRRVSRLRHDIPIIGFSPVGSVVRQVSLSWGVRCFLIERLHQTDQMMRKAEHVLLTNNLAEIGEKIVIISGSPVGVPGSTNHMRIHELGSTS

SEQ ID NO: 16648 - DNA, 1584 bp, Shigella flexneri 2a str
  CDS (1)..(1584)
atgacgatcgctaaaagcgactgtcactgtcctaatcttatacgacatccgaatgagattaatttatcgccatcgcggcgttatttcattcggatttcatgttcaagcaacacctggttgtttcagtcaacggagtattacatgtccaaaaggcttcgcagaacaaaaatcgttaccacgttaggcccagcaacagatcgcgataataatcttgaaaaagttatcgcggcgggtgccaacgttgtacgtatgaacttttctcacggctcgcctgaagatcacaaaatgcgcgcggataaagttcgtgagattgccgcaaaactggggcgtcatgtggctattctgggtgacctccaggggcccaaaatccgtgtatccacctttaaagaaggcaaagttttcctcaatattggggataaattcctgctcgacgccaacctgggtaaaggtgaaggcgacaaagaaaaagtcggtatcgactacaaaggcctgcctactgacgtcgtgcctggtgacatcctgctgctggacgatggtcgcgtccagttaaaagtactggaagttcagggcatgaaagtgttcaccgaagtcaccgtcggtggtcccctctccaacaataaaggtatcaacaaacttggcggcggtttgtcggctgaagcgctgaccgaaaaagacaaagcagacattaagactgcggcgttgattggcgtagattacctggctgtctccttcccacgctgtggcgaagatctgaactatgcccgtcgcctggcacgcgatgcaggatgtgatgcgaaaattgttgccaaggttgaacgtgcggaagccgtttgcagccaggatgcaatggatgacatcatcctcgcctctgacgtggtaatggttgcacgtggcgacctcggtgtggaaattggcgacccggaactggtcggcattcagaaagcgttgatccgtcgtgcgcgtcagctaaaccgagcggtaatcacggcgacccagatgatggagtcaatgattactaacccgatgccgacgcgtgcagaagtcatggacgtagcaaacgccgttctggatggtactgacgctgtgatgctgtctgcagaaactgccgctgggcagtatccgtcagaaactgttgcagccatggcgcgcgtttgcctgggtgcggaaaaaatcccgagcatcaacgtttctaaacaccgtctggacgttcagttcgacaatgtggaagaagctattgccatgtcggcaatgtacgcagctaaccacctgaagggcgttacggcgatcattaccatgaccgaatcgggtcgtaccgcgctgatgacctcccgtatcagctctggtctaccaattttcgccatgtcgcgccatgaacgtacgctgaacctgactgctctctatcgtggcgttacgccggtgccctttgatagcgctaatgacggcgtagcagctgccagcgaagcggttaatctgctgcgcgataaaggttacttgatgtctggtgacctggtgattgtcacccaaggcgacgtgatgagtaccgtgggttctactaataccacgcgtattttaacggtagagtaa

SEQ ID NO: 16649 - protein, 527 aa, Shigella flexneri 2a str
MTIAKSDCHCPNLIRHPNEINLSPSRRYFIRISCSSNTWLFQSTEYYMSKRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPTDVVPGDILLLDDGRVQLKVLEVQGMKVFTEVTVGGPLSNNKGINKLGGGLSAEALTEKDKADIKTAALIGVDYLAVSFPRCGEDLNYARRLARDAGCDAKIVAKVERAEAVCSQDAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVPFDSANDGVAAASEAVNLLRDKGYLMSGDLVIVTQGDVMSTVGSTNTTRILTVE

SEQ ID NO: 16650 - DNA, 1620 bp, Microbispora rosea subsp
  CDS (41)..(1465)
gccgtcactgcaagtggtctgtaccaattagggtagtgctatgagtcgtcgagcaaagatcgtctgtaccctcgggcccgccacctcctccccggagcgcctacgcgagctcatcaaggcgggaatgaacgtcgcccgcttcaacctctcgcacggcagccacgagctgcacaaggaggtgttcgaccgggtcagggccgccgccgacgagctgggctgcgccgtcggcgtcctcgccgacctgcagggccccaagatccgtgtcggacgcttcgcctccggtcccgtacggctcggctacggcgacgtcttcacgatcactaccgaggacgtccccggtgaccgggacatcgtctccaccacgtacgagggcctgccgggcgatgtgaagcccggcgacacgatcctcgtggacgacggccggctgaacctcgaagtgaccgcagtggacgggccgcgcgtcgtcaccaaggtcgtcatcggaggcatgatctccgacaacaagggcctcaacctccccggcgtcgccgtcagcgccccggcgctcacggagaaggacgaggaggacctgcgctgggcgctgcgcaccggcttcgacatgatcgccctgtcgttcgtccggtgcccggacgcgctcgtccgcgcgatcatggaggaggagggcgtccggctcccgcttctcgcgaagatcgaaaagccgcaggccgtcgaacgcctcgaggagatcgtggacaccttcgacggcgtcatggtcgcccgcggcgacctcggcgtcgagctgccgctggagcaggtgccgatcgtccagcgccgcatcatcgacctgtgccgggagaaggcccaccccgtcatcgtggccacccagatgctcgactcgatgatgagctcaccccgccccacccgcgccgaggcctccgacgtcgcgtacgccgtcatggacggcgcggacgcggtcatgctgtccggcgagacctcggtcggcaactaccccgtcgaggcggtctccacgatggcccgcatcgcgtcgccgcggagagcaacacgctgcaggccacccacaccctggaccgcctgcccgagaccaccggcggcgcatcgcccgcgcggcgccgaggtcggcgcgatcgtcggggccaaggccctggtggcgtacacgatgtccggcgagaccgcccggcgcctggcccgctaccgctcgcccatcccgctgctggccttcacctccaacccgctggtgcgcggccagctcgcgctgacctggggcgtggagacgttcgaggtgccgttcgtgcaccacaccgacgacatggtccgccaggtcgaggcctcgctgctgtcgctcggcatctgcgagaagggcgacaaggtcgtcgtcgtcgccggctccccgcccggcaaccacggctccaccaactcgctgcgcgtccacaccatcggctcggcggtcgcccacccggcggtctgaccccggcggccgggttcccccggaccccgccgcctgggacacccggtggcggcgggaaacctcttgaaggcgcggcgccctccgacggagcatggcaggagcgagtcgagccgtcctgtcagacgccggaggagcgctgcgcccgttgaccgacc

SEQ ID NO: 16651 - protein, 474 aa, Microbispora rosea subsp
MSRRAKIVCTLGPATSSPERLRELIKAGMNVARFNLSHGSHELHKEVFDRVRAAADELGCAVGVLADLQGPKIRVGRFASGPVRLGYGDVFTITTEDVPGDRDIVSTTYEGLPGDVKPGDTILVDDGRLNLEVTAVDGPRVVTKVVIGGMISDNKGLNLPGVAVSAPALTEKDEEDLRWALRTGFDMIALSFVRCPDALVRAIMEEEGVRLPLLAKIEKPQAVERLEEIVDTFDGVMVARGDLGVELPLEQVPIVQRRIIDLCREKAHPVIVATQMLDSMMSSPRPTRAEASDVAYAVMDGADAVMLSGETSVGNYPVEAVSTMARIASPRRATRCRPPTPWTACPRPPAAHRPRGAEVGAIVGAKALVAYTMSGETARRLARYRSPIPLLAFTSNPLVRGQLALTWGVETFEVPFVHHTDDMVRQVEASLLSLGICEKGDKVVVVAGSPPGNHGSTNSLRVHTIGSAVAHPAV

SEQ ID NO: 16652 - DNA, 1506 bp, Kluyveromyces lactis
  CDS (1)..(1506)
atggaatctagattaggctggttgaccgatttgagtaccgaaactggtaccaacttgagaagaacctcaattatttgtaccattggtccaaagaccaacaacccagaaactttggttgaattgagaaaggctggtatgaacattgttcgtatgaacttctcccacggttcttacgaataccatcaatctgtcattgacaacgccagaaaatctgaagaactataccaaggtagacctctggctattgcattggacactaagggtcctgaaatcagaactggtaccaccactaacgatgtggattacccaattcctccaaaccacgaaatgatcttcactactgatgacaagtacgctaaggcttgtgacgacaaaaccatgtacgttgattacaagaacatcaccaaggtcattgaagctggtagaattatctacgtcgatgatggtgttttgtcattcgaagttttggaagttattgatgacaacaccttgaaggttaagtctttgaacgccggtaagatttgttctcacaagggtgtcaacttgccaggtaccgatgtcgatttgccagctttgtccgaaaaggacaagtctgacttgaaattcggtgtcaagaacggtgtccacatggtcttcgcctctttcatcagaaccgctcaagatgttttgactatcagagaagttttgggtgagcaaggtaaggatatcaagatcattgttaagattgaaaaccaacaaggtgtcaacaactttgacgatatcttgaaggtcactgacggtgttatggttgctagaggtgatttgggtattgaaattccagctcctcaagtgtttgctgtgcaaaagaagttgattgctaagtgtaacttggctggtaagccagttatctgtgctacccaaatgttggaatccatgacctacaacccaagaccaaccagagctgaagtctctgatgttggtaacgccgttcttgatggtgctgactgtgttatgttgtctggtgaaactgccaagggtaactacccaatcaatgccgttaagaccatggctgaaactgctttgattgctgaacaagccatcccatacatcccaacttacgatgacttaagaaacttgactccaaagccaacctcaaccactgaaactatcgctgctgcttctgtttctgctgtatttgaacaaaaggccagagctttgattgtcctatccaccaccggtgacactccaagattggttgccaagtacaagccaaatgtcccaattgttatggttactagaaacccaagagctgctagattctctcatctatatagaggtgtcttcccattcgtatacgatgaatcctctgactccgaatggactgtcgatgttgaaaagagaatcaacttcggtgtcaagaaggccaaggaattcggaattttggttgacggtgacaccattgtcaccattcaaggtttcgccgctggtgtcggtaactccaacactctacgtgtcttgaccgtttaa

SEQ ID NO: 16653 - protein, 501 aa, Kluyveromyces lactis
MESRLGWLTDLSTETGTNLRRTSIICTIGPKTNNPETLVELRKAGMNIVRMNFSHGSYEYHQSVIDNARKSEELYQGRPLAIALDTKGPEIRTGTTTNDVDYPIPPNHEMIFTTDDKYAKACDDKTMYVDYKNITKVIEAGRIIYVDDGVLSFEVLEVIDDNTLKVKSLNAGKICSHKGVNLPGTDVDLPALSEKDKSDLKFGVKNGVHMVFASFIRTAQDVLTIREVLGEQGKDIKIIVKIENQQGVNNFDDILKVTDGVMVARGDLGIEIPAPQVFAVQKKLIAKCNLAGKPVICATQMLESMTYNPRPTRAEVSDVGNAVLDGADCVMLSGETAKGNYPINAVKTMAETALIAEQAIPYIPTYDDLRNLTPKPTSTTETIAAASVSAVFEQKARALIVLSTTGDTPRLVAKYKPNVPIVMVTRNPRAARFSHLYRGVFPFVYDESSDSEWTVDVEKRINFGVKKAKEFGILVDGDTIVTIQGFAAGVGNSNTLRVLTV

SEQ ID NO: 16654 - DNA, 1506 bp, Saccharomyces kluyveri
  CDS (1)..(1506)
atggaatctagactaggttggttaactgaattgcaaactgaaaccggtgctaacttgagaagaacctctatcatcggtaccattggtccaaagaccaacaacccagaaaccttggttgccttgagaaaggctggtttgaacattgttcgtatgaacttctctcacggttcttacgaataccaccaatctgtcattgacaacgctagaaagtctgaagagctatatccaggtagaccattggctattgctttggacaccaagggtccagaaatcagaactggtaccaccactaacgaagtcgactacccaatcccaccaaaccacgaaatgatcttctccattgacgacaaatacgccaaggcttgtgatgacaaggttatgtacattgactacaagaacatcaccaaggttatcgaaaagggtaagatcatctacgttgatgacggtgtcttgtctttcgaagttttggaagtcgttgacgaacaaactttgaaggttaagtccttgaacgctggtaagatctgctcccacaagggtgttaacttgccaggtaccgatgtcgacttgccagctttgtccgaaaaggacaagtctgacttgagattcggtgtcaagaacggtgtccacatggtcttcgcttctttcatcagaaccgctcaagatgttttgaccatcagagaagttttgggtgaagacggtaaggacgtcaagatcattgtcaagattgaaaaccaacaaggtgttaacaactttgacgaaatcttgaaggttactgacggtgtcatggttgccagaggtgacttgggtatcgaaatcccagctccacaagttttcgctgtccaaaagaagttgattgctaagtgtaacttggccggtaagccagttatctgtgccacccaaatgttggaatctatgacttacaacccaagaccaaccagagctgaagtttccgatgtcggtaacgctgttttggacggtgctgactgtgtcatgttgtctggtgaaaccgctaagggtaactacccaattaacgccgttaccatcatggctgaaaccgctttgattgctgaacaagctatcccatacgtcgccacttacgacgacttgagaaacttcactccaaagccaacttctaccactgaaaccatcgctgccgccgctgtctcttctgttttcgaacaaaaggccaaggctatcattgtcttgtctaccaccggtgacaccccaagattggtctccaaatacaagccaaacgttccaattgttatggttaccagaaacccaagagctgctagattctctcacttgtacagaggtgtcttcccattcgtctacgaatctgacactgaatccgaatggaccaaggatgttgaaagccgtttgaacttcggtattgccaaggccaaggaattcggtatgttgaaggaaggtgacaccattgtcactatccaaggtttcgctgctggtgttggtcactctaacactttgcgtgtcttgaccgtctaa

SEQ ID NO: 16655 - protein, 501 aa, Saccharomyces kluyveri
MESRLGWLTELQTETGANLRRTSIIGTIGPKTNNPETLVALRKAGLNIVRMNFSHGSYEYHQSVIDNARKSEELYPGRPLAIALDTKGPEIRTGTTTNEVDYPIPPNHEMIFSIDDKYAKACDDKVMYIDYKNITKVIEKGKIIYVDDGVLSFEVLEVVDEQTLKVKSLNAGKICSHKGVNLPGTDVDLPALSEKDKSDLRFGVKNGVHMVFASFIRTAQDVLTIREVLGEDGKDVKIIVKIENQQGVNNFDEILKVTDGVMVARGDLGIEIPAPQVFAVQKKLIAKCNLAGKPVICATQMLESMTYNPRPTRAEVSDVGNAVLDGADCVMLSGETAKGNYPINAVTIMAETALIAEQAIPYVATYDDLRNFTPKPTSTTETIAAAAVSSVFEQKAKAIIVLSTTGDTPRLVSKYKPNVPIVMVTRNPRAARFSHLYRGVFPFVYESDTESEWTKDVESRLNFGIAKAKEFGMLKEGDTIVTIQGFAAGVGHSNTLRVLTV

SEQ ID NO: 16656 - DNA, 1506 bp, Saccharomyces castellii
  CDS (1)..(1506)
atggaatccagattagccagattaaccactttacaagttaccgccggtgacaacttaagaagaacctctattattggtactattggtccaaagaccaacaacccagaagtcttggttgctctaagaaaggctggtttgaacattgtccgtatgaacttctctcacggttcttacgaataccatcaatccgttattgaaaacgccagaaagtctgaagaactttacccaggtagaccattagctattgctttggacaccaagggtccagaaatcagaactggtaccaccaccggtgaagttgactacccaattccaccaaaccacgaaatgatcttctctactgatgaaaagtacgctaaggcttgtgatgacaaggttatgttcgtcgactacgctaacatcaccaaggttatctccaagggtaagatcatctacgtcgatgacggtgtgttgtctttcgaagttttggaagtcgttgatggtaagactttgaaggttaagtccttgaacgccggtaagatctgttctcacaagggtgttaacttaccaggtaccgatgtcgatttgccagctttgtccgaaaaggataaggctgatttgagattcggtgttaagaacggtgtccacatggtcttcgcttctttcattagaaccgctcaagatgttttgaccatcagagaagtcttaggtgaagatggtaaggacatcaagattgttgtcaagattgaaaaccaacaaggtgttaacaacttcgacgaaatcttgaaggtcactgatgccgttatggttgccagaggtgatttaggtattgaaattccagccccagaagtcttagctgtccaaaagaaattgattgctaagtctaacttggccggtaagccagttatctgtgctacccaaatgttggagtctatgacttacaacccaagaccaaccagagctgaagtttccgatgtcggtaacgctatcttggatggtgctgactgtgttatgttgtctggtgaaaccgccaagggtaactacccaatcaatgctgtcaccaccatggctgacactgctttgattgctgaacaagccattgcttaccaaccattgtacgatgacttgagaaacttgactccaaagccaacttctaccactgaaaccgttgctgcttccgctgttgccgctgtctacgaacaaaaggccaaggctatcattgtcttgtctacttccggtaccactccaagattggtctccaagtacagaccagactgtccaattatcttggttaccagaaacccaagagctgctagattctctcacttgtctagaggtgttttcccattcgtctacgaagctgactccgttgctgactggactgaagatgtcgaattgagattgaagttcggtattgaaaaggccatcgaaatgggtgtcatgaagaagggtgacacttacgtctccattcaaggtttcaaggctggtgaaggtcactccaacactttgcaagtctctaacgcttaa

SEQ ID NO: 16657 - protein, 501 aa, Saccharomyces castellii
MESRLARLTTLQVTAGDNLRRTSIIGTIGPKTNNPEVLVALRKAGLNIVRMNFSHGSYEYHQSVIENARKSEELYPGRPLAIALDTKGPEIRTGTTTGEVDYPIPPNHEMIFSTDEKYAKACDDKVMFVDYANITKVISKGKIIYVDDGVLSFEVLEVVDGKTLKVKSLNAGKICSHKGVNLPGTDVDLPALSEKDKADLRFGVKNGVHMVFASFIRTAQDVLTIREVLGEDGKDIKIVVKIENQQGVNNFDEILKVTDAVMVARGDLGIEIPAPEVLAVQKKLIAKSNLAGKPVICATQMLESMTYNPRPTRAEVSDVGNAILDGADCVMLSGETAKGNYPINAVTTMADTALIAEQAIAYQPLYDDLRNLTPKPTSTTETVAASAVAAVYEQKAKAIIVLSTSGTTPRLVSKYRPDCPIILVTRNPRAARFSHLSRGVFPFVYEADSVADWTEDVELRLKFGIEKAIEMGVMKKGDTYVSIQGFKAGEGHSNTLQVSNA

SEQ ID NO: 16658 - DNA, 1521 bp, Saccharomyces bayanus
  CDS (1)..(1521)
atgccagaatcaagactgcagagactagccaacttgaaaataggcactccgcaagagcttagacggacctccattataggcaccatcgggcccaagactaatagctgcgaggcaatcaccgctttgaggaaggctgggctgaacatcatccgaatgaacttctcccacggctcttatgaattccaccaatcggtgatagacaatgccttgaagtcggaacagcaattccccggaagaccgcttgccattgctctggacaccaagggccctgagattaggacaggccgcaccccgaacgaccaggacttccacatcctcgttgaccaccagatgatcttcaccaccgacgcgaagttcgaacactcctctaatgacaaaatcatgtatatagactatgccaatttgacaaaggtaattgtgcccgggaaactcatctacgtcgatgacgggattctgtcttttaaagtgctccagatcatggacgatgccaacataagggtccaagctctcaattcgggctatatctcatcccgtaaaggtgtcaacttacccaataccgacgtggatttgccccctctttccgcaaaggatattcaggacttgcaattcggcatgcggaatggaatccacatggtgtttgcctctttcattagggcccccgaagacgtcttgaccattaggaaagtcctgggcaccgaaggcgaggacatcaaaatcatctccaagatcgaaaatcaacaaggcctggataatttcgacgaaatcctgcaagtcacagatggtgtcatgatagccaggggtgatctgggcattgagatcctggcaccagaagtgctggccattcagaaaaaactcattgccaaatgtaacgtggcgggcaaacctgtcatttgcgcgacccaaatgctggagtcaatgacctacaacccaagacccacaagggctgaagtctctgatgtcggaaacgccgttttggatggtgccgattgtgttatgttgtctggcgaaacggcaaagggcgattatccagttaatgcagtcaagataatggcggccacagctctaattgcagagagtactattgcgcatttggctctatacgatgatcttagagacgccacttctaagcccacctccactacagaaaccgttgcagccgcagccactgcagcgatcttggagcaaaatggtaaagccatcgttgtattatccactacgggaaacacagcaaggctgttgtctaagtacagaccaagttgtcctatcatactagtgacgaggcacgcaagaacggcaagaatcgcacatttatacagaggtgtttttccatttgtctttgagccaaaacggctgtacgattggggtgaagacgttcacagacgcttaaagtttggcgtggaaatggcaagatcttttggaatggttgaaagtggtgataccgttgtatccatccaaggcttcagaggcggtattggtcattcaaacaccttgcgtgtttctaccgttggtgaagagttttag

SEQ ID NO: 16659 - protein, 506 aa, Saccharomyces bayanus
MPESRLQRLANLKIGTPQELRRTSIIGTIGPKTNSCEAITALRKAGLNIIRMNFSHGSYEFHQSVIDNALKSEQQFPGRPLAIALDTKGPEIRTGRTPNDQDFHILVDHQMIFTTDAKFEHSSNDKIMYIDYANLTKVIVPGKLIYVDDGILSFKVLQIMDDANIRVQALNSGYISSRKGVNLPNTDVDLPPLSAKDIQDLQFGMRNGIHMVFASFIRAPEDVLTIRKVLGTEGEDIKIISKIENQQGLDNFDEILQVTDGVMIARGDLGIEILAPEVLAIQKKLIAKCNVAGKPVICATQMLESMTYNPRPTRAEVSDVGNAVLDGADCVMLSGETAKGDYPVNAVKIMAATALIAESTIAHLALYDDLRDATSKPTSTTETVAAAATAAILEQNGKAIVVLSTTGNTARLLSKYRPSCPIILVTRHARTARIAHLYRGVFPFVFEPKRLYDWGEDVHRRLKFGVEMARSFGMVESGDTVVSIQGFRGGIGHSNTLRVSTVGEEF

SEQ ID NO: 16660 - DNA, 1467 bp, Xylella fastidiosa
  CDS (1)..(1467)
atgtctgaacgccagcgccgtaccaggattcttgccactcttgggccagcgacagatccgcctggtgtgcttgatgcgctgtttaaggcgggagttaatgtggtgcggctgaatttcagccatggcgatgtttcggatcaggccaggcgtgttgctgaagtgcgtgcggcggcggcgcatgtgggcgttgagattggcattcttgcggatctacccggcccgaagatccgtattggacgttttaccgggggaaaagtgcggcttgtggctggtgcgcgctttgatctgcttgccgatagcaatgcgtcgctgggggatacgactcaagttggggtcagttatctggggttgccgcaggatgtcgccgccggagatgtgttgttactggatgatggcctcatgcaattgcaagtggtgcaagtgcagggtgcgcggattgtgacgacggttcttaacgatggtgtgttgtccgaccgtaaggggctgaataagcaaggtggcggtttgtcgctgggtgcgctgacggatcgtgatcgcgaactgattggtatcgttgccaggatggggatcgactttattgcagtttcgttttgtcgtcatgctgaagagatgcatgaggcgcgtcgcattgctcgggagtgcggctgtgatgctgcgttggtgtctaagatcgagcgtgctgaggctatcgtgaatcttgccgagattgttgcggcttcggatgtggtgatggttgcgcgtggtgatttaggtgtggagattggtgacgctcaattgccgggcttgcaaaaaaagatcatcaaagaagcgttgttacagaacaaggtggtgattactgccacgcagatgctgcaatcaatggttgaaagtccgataccgacccgtgctgaggtgctggatgtggccaatgcggtgattgatgggaccgatgcggtgatgctgtcggctgaaacggcgacaggtgattatccagtcaaggcagtagaggcgatggcgcgtatctgtctgggagcggaacaccagtttgagtttgatactgattatgagatggcgcagcgtaatttgcagcgtgcagatcatgcgattgcaatggcaacgatgttcttatctgagcacatttgccttggtggtgtggttgcgttgacggagtccggtacgacgccacggtttctctcgcggttccggtcgcacgtcccgatctatgcgtttacgcgtcacgaggatgtgcggcggcgcatggtgctgatgcgtggtgtatttccgatgcgttttgacagccgtggtttaacgccgcgtgaggcagctagggcgacaatccgtcttttggtggaatgtggttgtatgagtccgggtgatcgtgtggtgttcacgagcggcgagcatatggaaacgcttggcgcaaccaatacactgcgtttacttgaagtaggcgctgatgggtgtgtcagtggtctgtgggaactctaa

SEQ ID NO: 16661 - protein, 488 aa, Xylella fastidiosa
MSERQRRTRILATLGPATDPPGVLDALFKAGVNVVRLNFSHGDVSDQARRVAEVRAAAAHVGVEIGILADLPGPKIRIGRFTGGKVRLVAGARFDLLADSNASLGDTTQVGVSYLGLPQDVAAGDVLLLDDGLMQLQVVQVQGARIVTTVLNDGVLSDRKGLNKQGGGLSLGALTDRDRELIGIVARMGIDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPIPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGCVSGLWEL

SEQ ID NO: 16662 - DNA, 1443 bp, Vibrio parahaemolyticus
  CDS (1)..(1443)
atgacttccaaattaagaagaacgaaaattgtcaccactcttggcccttcaactgataaagacaatgtactggaggaaatcattaaagctggagcgaacgtcgttcgtatgaacttttctcacggtacaagtgaagaccacattcaacgcgctaaaaaagtacgcgcgattgccgcaagattagggcgtcaggttgccattcttggcgatttacagggacctaaaattcgtgtttcgacctttaaagacggtaaaatcacactcaaagtcggcgataaattcacactagatagcgacttaccaaaaggcgaagggaaccaagaatccgttggtttggattacaaagaactgcctcaagatgtttcaccgaacgacattctactgcttgatgatggcagagttcaattgcaagtcaccagcgtagaaggaaataaagtccatacccgtgtgaccgttggtggcccattatccaataacaagggcatcaacaaaaaaggcggtggcttatcagccgatgcactcacggaaaaagacaaagctgacataatcacagccgcagaaattaaggtcgactatttggccatttctttcccacgcaatggcgaggacatgcactatgccagacgcttggcccgggatgccggcttagaagcaaaactcgtcgcaaaagtagaacgtgcagaaaccgtcgccacgagcgagtcgattgacgatatcatcctagcttctgacgtcgtgatggtcgctcgcggcgatttaggcgttgagattggcgatcctgagctgatcggtgttcagaaaaaactcattcgtcgagctcgcagtttgaaccgcgtcgtcattactgcaactcaaatgatggaatccatgatcaatagcccaatgccaacgcgtgcagaagtcatggacgtagcaaacgccgttttggatggcaccgatgccgtgatgctgtctggagagaccgctgccggtcaatatccggtagagaccgtgaaatcaatggcggatgtctgtattggcgcagaaaagatgtctgaagcaagtctatcgacctaccgtctcgaccgcacctttgaaacagcagaagagaccattgcaatggcaaccatgtactcagcgaatcacatggaaggcattaaagcgatgattgcattaacagagtcaggaagaacagctttgatgatgtcacgcctaagctctggtttgccgatttttgctttatcgcgtaacgaatcgacgctcaaccgcgcagcgttatatcgtggcgtgacgccagtgtactttgatgcgaaatgcgatgcgggcttaccaaccgctcaagccgcaatttctagcctcaaagatcaaggttacttacatgaaggtgacttagtgatcatcactcaaggtgacgtgatggacgtcgttggttcaaccaactgcatgcgtattctgccagtctaa

SEQ ID NO: 16663 - protein, 480 aa, Vibrio parahaemolyticus
MTSKLRRTKIVTTLGPSTDKDNVLEEIIKAGANVVRMNFSHGTSEDHIQRAKKVRAIAARLGRQVAILGDLQGPKIRVSTFKDGKITLKVGDKFTLDSDLPKGEGNQESVGLDYKELPQDVSPNDILLLDDGRVQLQVTSVEGNKVHTRVTVGGPLSNNKGINKKGGGLSADALTEKDKADIITAAEIKVDYLAISFPRNGEDMHYARRLARDAGLEAKLVAKVERAETVATSESIDDIILASDVVMVARGDLGVEIGDPELIGVQKKLIRRARSLNRVVITATQMMESMINSPMPTRAEVMDVANAVLDGTDAVMLSGETAAGQYPVETVKSMADVCIGAEKMSEASLSTYRLDRTFETAEETIAMATMYSANHMEGIKAMIALTESGRTALMMSRLSSGLPIFALSRNESTLNRAALYRGVTPVYFDAKCDAGLPTAQAAISSLKDQGYLHEGDLVIITQGDVMDVVGSTNCMRILPV

SEQ ID NO: 16664 - DNA, 1413 bp, Vibrio parahaemolyticus
  CDS (1)..(1413)
atgaaaaagaccaaaatcgtttgtacgattggccctaaaactgaatctgtagagaagctaactgaactagtaaacgcaggcatgaacgtaatgcgtcttaacttctctcacggtgactacgaagaacacggcactcgtatcgcgaacttccgcaaagtaatggaagctactggcaaacaactagcaatccttctagatactaaaggtccagaaatccgcactatcaaactagaaggcggtaacgacgttgatctagtagctggtcaagaattcactttcacaactgacacttcagttgtaggtaacaaagacaaagttgcagtaacttacgctggcttcgcagctgacctaaacgttggtaacactatcctagtagacgacggtctaatcgagatggaagttatcgcaacaactgacactgaagttaaatgtaaagttcttaacaacggtgctctaggcgaaaacaaaggtgttaaccttcctggcgtttctgtaaacctacctgctctatctgaaaaagataagaacgaccttaaattcggttgtgagcaaggcgttgatttcgtagctgcatctttcatccgtaaagcttctgacgttcaagaaatccgtgaagttctagctgcaaacggcggcgagaacatccacatcatctctaagatcgaaaaccaagaaggtgttgataacttcgatgagatcctagaactttctgacggcatcatggttgctcgtggcgacctaggtgttgaaatcccagctgaagaagtaatcttcgctcagaaaatgatgatcgagaagtgtaaccgtgcacgtaagatggttatcactgcaactcaaatgcttgattctatgatcaacaacccacgtcctactcgtgcggaagcaggcgacgttgcaaacgcagtaatggacggcacagacgcagtaatgctttctggcgaaacagcaaaaggtaaataccctgttgaagcggtaactatcatggctcaaatcgctaagcgtactgactctgtacttaaagctgaactaggttctcgtctagacagcccacgtctacgcatcactgaagcagtatgtaaaggcgcagtagacacagctgaaaaactggctgctccactgatcgttgttgcaactgaaggcggtaagtctgcacgttcagtacgtaagtacttcccaactgcaaacatcctagcgctaacaactaacaagaaaactgcagcacaactagttctaactaagggtgttactccagttgttgttgacgctatcgaaagcactgacgcattctacgtagcaggtaaagaacttgctctagaatctggtctaggtaacaaaggcgatatcgtagtaatggtttctggtgctctagtcgcttcaggtactacgaacacagcttctgtacacgtactataa

SEQ ID NO: 16665 - protein, 470 aa, Vibrio parahaemolyticus
MKKTKIVCTIGPKTESVEKLTELVNAGMNVMRLNFSHGDYEEHGTRIANFRKVMEATGKQLAILLDTKGPEIRTIKLEGGNDVDLVAGQEFTFTTDTSVVGNKDKVAVTYAGFAADLNVGNTILVDDGLIEMEVIATTDTEVKCKVLNNGALGENKGVNLPGVSVNLPALSEKDKNDLKFGCEQGVDFVAASFIRKASDVQEIREVLAANGGENIHIISKIENQEGVDNFDEILELSDGIMVARGDLGVEIPAEEVIFAQKMMIEKCNRARKMVITATQMLDSMINNPRPTRAEAGDVANAVMDGTDAVMLSGETAKGKYPVEAVTIMAQIAKRTDSVLKAELGSRLDSPRLRITEAVCKGAVDTAEKLAAPLIVVATEGGKSARSVRKYFPTANILALTTNKKTAAQLVLTKGVTPVVVDAIESTDAFYVAGKELALESGLGNKGDIVVMVSGALVASGTTNTASVHVL

SEQ ID NO: 16666 - DNA, 1452 bp, Pseudomonas syringae pv
  CDS (1)..(1452)
atgaccgttcgccgcaccaaaatcgtcgccacacttggccctgccagcaactcgccggaagtcatcgaacaactgatcctctcgggtctggacgttgctcgtctgaacttctctcacggtactccggatgagcacaaggcacgcgccaaactcatccgcgaaatcgccgccagacacgggcgcttcgtcgctctgctgggcgacctgcagggtcctaaaatccgtatcgcaaagttcaccgacaagcgaatcgagctgaaggtcggtgacaagttcaccttctcgactgctcacccgctgaccagtggcaaccagcagatcgtgggtatcgactacccggatctggtcaaggattgcggcgtaggcgacgagctgttgctcgacgacggtcgcgtggtcatgcgcgtcgacacccagaccgcacacgaactgcactgcaccgtgctgatcggcggtccgctgtccgaccacaaaggcatcaaccgtcgtggtggtggccttaccgctccggcgttgaccgaaaaagacaagcaggacatcaagctcgctgccgaaatggacctggattacctggccgtttccttcccgcgcgatgccgccgacatggaatatgctcgccagctgcgtgacgaatccggtggcactgcctggctggttgccaagatcgaacgcgctgaagcggtcgccaacgacgaagtgctcgatgcactgatccgtgccagtgacgctgtgatggttgcccgtggcgacctgggcgttgaaatcggcgacgccgaactggtcggtgttcaaaaacgcatcattctgcacgcacgtcgccacaacaaggcggtgatcgtcgccacgcagatgatggagtcgatgatctcaagccccatgccgacccgcgccgaagtgtccgatgtggccaacgccgtgctcgattacaccgacgccgtcatgctctcggcagaaagtgcggcaggttcctacccggtcgaagccgtacaggccatggcacgtatctgcgtaggcgctgaaaagcacccgaccggcaaaacgtccagccaccgtatcggtcactcgttcacgcgttgcgacgaaagcatcgcgctggccgccatgtacaccgccaaccacttccctggcgtgaaggcgatcatcgcactgaccgaaagcggctacaccccgctgatcatgtcgcgcatccgctcctcggtgccgatctacgcgttctctccgcaccgtggcactcaagcgcgcgctgcgatgttccgtggtgtctacaccgtgccgttcgacccgggagccctgccgccaggtcaggtcagccaggccgccgtcgacgaactgctcaagcgtggcctggtcgagcaaggtgactgggtcatcctgaccaagggcgacagctaccacaccatcggtggcaccaacggcatgaagatcctgcacgttggcgacccattggtctga

SEQ ID NO: 16667 - protein, 483 aa, Pseudomonas syringae pv
MTVRRTKIVATLGPASNSPEVIEQLILSGLDVARLNFSHGTPDEHKARAKLIREIAARHGRFVALLGDLQGPKIRIAKFTDKRIELKVGDKFTFSTAHPLTSGNQQIVGIDYPDLVKDCGVGDELLLDDGRVVMRVDTQTAHELHCTVLIGGPLSDHKGINRRGGGLTAPALTEKDKQDIKLAAEMDLDYLAVSFPRDAADMEYARQLRDESGGTAWLVAKIERAEAVANDEVLDALIRASDAVMVARGDLGVEIGDAELVGVQKRIILHARRHNKAVIVATQMMESMISSPMPTRAEVSDVANAVLDYTDAVMLSAESAAGSYPVEAVQAMARICVGAEKHPTGKTSSHRIGHSFTRCDESIALAAMYTANHFPGVKAIIALTESGYTPLIMSRIRSSVPIYAFSPHRGTQARAAMFRGVYTVPFDPGALPPGQVSQAAVDELLKRGLVEQGDWVILTKGDSYHTIGGTNGMKILHVGDPLV

SEQ ID NO: 16668 - DNA, 1416 bp, Pseudomonas putida
  CDS (1)..(1416)
atgacgcctgataaaaaagttaagatccttgccacccttggccctgcgatcaacggcatcgacgatatccgccagctggtcgaagccggggtgaacatcttccgcctcaacttcagccacggcgaacatgccgaccacgccctgcgctaccagtggatccgcgaagtcgagcaacagctgaactacccgctgggcatcctcatggacctgcaagggccgaagctgcgcgttggccgcttcgccgaaggcaaggtgcagttgcaacgcgggcaggccctgcgcctggatctggacaagaccccgggcgacagccgccgggtcaacctgccgcaccccgaaatcatcgccgccctcgaacccggcatggacctgctgctggacgacggcaagctgcgcctgcgcgtgaccgccaagcacagcgacgccatcgacaccgaggtgctgaatggtggcgagctttccgaccgcaagggcgtcaacgtaccgcaagcggtgctcgacctctccccgctcaccgaaaaagaccgccgcgacctggcctttggcctggagctgggtgtggactgggtcgccctgtcgttcgtgcagcgccctgaggacatcgtcgaagcgcgccagctgattggcgaccgcgcctacctgatggccaaaatcgagaaaccatcggcagtcgagcaactgcaagccatcgccgagctggcagacgcgatcatggtggcccgtggtgacctgggcgtggaagtaccggccgagagcgtgccgcagatccagaagcgcatcatcggcacctgccgccagctaggcaaacccgtggtggtggccacgcagatgctcgagtcgatgcgtttctcgccagcgccaacccgcgccgaagtcacggacgtggccaacgcggtggccgaaggtgccgatgcagtgatgctgtcggccgaaaccgcctcgggtgattacccgctggaagccgtgcagatgatgagcaagatcatccgccaggttgagaacggcccggactaccaggcccagctcgacgtcggccggccaaaggccgaagccaccgtgtcggatgccatcagctgcgccatccgccgcatcagcggcatcctgccagtggcggtgctggtcaactacagcgagtcgggtgcctcgaccctgcgcgcggcacgtgaacggccacgggcaccgatcctcaacctgacgccgaacctgaacaccgcgcgccgcctgagcgtggcttggggtgtgcattcggtggtcaacgaccgcctgcgtcaggtcgacgaggtggtttccaccgccctggagattgcccaggcgcaaggcatggccagccgtggcgacacgctgctgatcaccgctggcgtgcctttcggcaagccgggtacgactaacacgctgcggatcgagactttgatctga

SEQ ID NO: 16669 - protein, 471 aa, Pseudomonas putida
MTPDKKVKILATLGPAINGIDDIRQLVEAGVNIFRLNFSHGEHADHALRYQWIREVEQQLNYPLGILMDLQGPKLRVGRFAEGKVQLQRGQALRLDLDKTPGDSRRVNLPHPEIIAALEPGMDLLLDDGKLRLRVTAKHSDAIDTEVLNGGELSDRKGVNVPQAVLDLSPLTEKDRRDLAFGLELGVDWVALSFVQRPEDIVEARQLIGDRAYLMAKIEKPSAVEQLQAIAELADAIMVARGDLGVEVPAESVPQIQKRIIGTCRQLGKPVVVATQMLESMRFSPAPTRAEVTDVANAVAEGADAVMLSAETASGDYPLEAVQMMSKIIRQVENGPDYQAQLDVGRPKAEATVSDAISCAIRRISGILPVAVLVNYSESGASTLRAARERPRAPILNLTPNLNTARRLSVAWGVHSVVNDRLRQVDEVVSTALEIAQAQGMASRGDTLLITAGVPFGKPGTTNTLRIETLI

SEQ ID NO: 16670 - DNA, 1455 bp, Pseudomonas putida
  CDS (1)..(1455)
atgagcatccgccgcaccaaaatcgtcgccacccttggccccgccagcaactcgccggaagtgatcgaacaactgatcctcgccggcctggacgtggcacgtctgaacttctcccacggcacgccggacgagcacaaggcccgcgcgcgcctgatccgtgacatcgccgccaagaatggccgccatgttgcactgctgggcgacctgcagggtccgaagatccgcatcgccaagttcgccaacaagcgcatcgaactgaagatcggtgacaagttcaccttctccaccgcccacccgctgaccgaaggcaaccaggacatcgtcggtatcgactaccccgacctggtcaaggactgcggcgttggtgacgaactgctgctcgacgatggccgcgtggtcatgcgcgtcgaaaccgccactgcagatgccctgcactgcgtggtgatcatcggtggcccactgtcggaccacaaaggcatcaaccgtaaaggtggcggcctgaccgcaccggccctgaccgaaaaagacaaggccgacatcaaactggctgcggaaatggacctggactacctggccgtatccttcccgcgtgacgccagcgatatggaatacgcgcgcaagctgcgtgacgaagccggcggcagcgcctggctggtagccaagatcgaacgcgccgaagcggtggccgatgacgagaccctcgacaagctgatcgccgcctccgacgctgtgatggttgcccgtggtgacctgggcgtggaaatcggcgacgccgagctgatcgctatccagaagaagatcatccagcacgcccgccgcaacaacaaggccgtgatcgtggcgacccagatgatggagtcgatgatccagaacccgatgccgacccgcgcggaagtgtccgacgtggccaacgccgtgctggacaacaccgatgcggtgatgctgtcggccgaaagcgccgccggttcctacccgatcgaagctgtccaggccatggcacgcatctgcctgggtgccgaaaagcacccgaccagccagaagtccagccatcgcctgcacaccaccttccagcgctgcgacgaaagcatcgccttggcggccatgtacactgccaaccacttcccgggcgtaaaggcgatcatcgccctgaccgaaagcggctacaccccgctgatcatgtcgcgcctgcgttcgcatgtaccgatcttcgccctgtcgccgcaccgcgccacccaggcgcgcgcctcgatgttccgtggcgtgtacccgattgccttcgacccggccgcgctgccggccgataaggtgagccaggcggcggtcgacgaactgctcaaacgtggcctggtggagcaaggtgactgggtgatcctgaccaagggtgacagctaccacaccatcggtggcaccaatggcatgaagatcctgcacgtcggtgatccgctggtcggttga

SEQ ID NO: 16671 - protein, 484 aa, Pseudomonas putida
MSIRRTKIVATLGPASNSPEVIEQLILAGLDVARLNFSHGTPDEHKARARLIRDIAAKNGRHVALLGDLQGPKIRIAKFANKRIELKIGDKFTFSTAHPLTEGNQDIVGIDYPDLVKDCGVGDELLLDDGRVVMRVETATADALHCVVIIGGPLSDHKGINRKGGGLTAPALTEKDKADIKLAAEMDLDYLAVSFPRDASDMEYARKLRDEAGGSAWLVAKIERAEAVADDETLDKLIAASDAVMVARGDLGVEIGDAELIAIQKKIIQHARRNNKAVIVATQMMESMIQNPMPTRAEVSDVANAVLDNTDAVMLSAESAAGSYPIEAVQAMARICLGAEKHPTSQKSSHRLHTTFQRCDESIALAAMYTANHFPGVKAIIALTESGYTPLIMSRLRSHVPIFALSPHRATQARASMFRGVYPIAFDPAALPADKVSQAAVDELLKRGLVEQGDWVILTKGDSYHTIGGTNGMKILHVGDPLVG

SEQ ID NO: 16672 - DNA, 1761 bp, Lactobacillus plantarum
  CDS (1)..(1761)
atgaaaaaaaccaagattgtttcaacacttggtcctgccagcaccgatactgacactattgttaaattaatcgaagccggcgcaaatattttccgctttaacttttcacatggtgatcatgaagaacatttagatcgcttaaacaaagttcacgaagcagaaaagattacgggtaagaccgttggtatcatgcttgatactaagggtgctgaaattcggacgaccgttcaagctaacggaaaatctgaatacaagatcggtgacaaggttcgtatcaccatggatgattcattagatacgacccatgataagattgccgttacttacaagaacctctatgatgatgttcatgtaggtggccatgtcctctttgatgatggtttattagatatgaagatcgacgaaaaggacgaagctaaccgcgaattggttacaactgttcaaaacgccggcgttttaggctcacgtaagggtgttaacgctcctggcgtttcaatcaacttacctgggatcactgaaaaagactcaagtgatattcgctttggtttggatcatgaaatcaactacatcgctgcttcattcgttcgtaagccacaagatgtcttagacattcgtgaattacttgaagaaaagcacatggaacacgttcaaatcttccctaagatcgaatcacaagaaggtatcgacaacgccgatgaaattcttaaggtttgtgatggtttgatggttgctcgtggtgacatgggtgttgaaattcctgctgaaaatgtgccattggtacaaaagagtttaatcaagaagtgtaatgctttaggtatgcctgttatcacggctactcaaatgttagactcaatgcaagaaaacccacgtcctactcgtgccgaagcttctgacgttgccaacgctgtctttgatggtactgacgcaacgatgctttctggtgaaagtgctaacggtctttaccctgttgaatctgttgccatgatggctaagattgacgaaaaggctgaaaacactttggctgaaaacggtacgttacaattaaaccgtttcgacaagactagtgttactgaaacaatcggtattgcgattgctcgggcagctaagaacttgaacattaagacgattgttgctgcgactgaatctggctacactgctaagatgatttcgaagtaccgtccaaatgctgatatcttagcaatcacttttgacgaacggactcaacgtggcttaatggttaactggggtgttcaaccaatcgtggctgaaaaaccagaaaccactgatgacatgtttgatttagctgcttctaaggctgttgaacttggctttgccaaggaaggcgacttaatcttgattactgccggtgtgccagttggcgaacgcggtacgactaacatcatgaagatccaattaattggttctaagttagctgatggtcaaggtgtcggtgatgaaacggttatcggtaaagccgtaatcgcaacgtctgctcaagaagctatcgacaaggccgttgaaggtggcgtcttagttactaagacgactgacaaagactacttaccagcaatcgaaaagtctagtgctttagttgttgaaaacggtggtttaacttcacacgctgctgttgttggtatctcaatgggaattcctgttatcgttggtgttaaggacgctactagtgttattgctgatggtcaattgatcacagttgattcacgtcgtggccttgtataccgcggtgcttcaaacgccctttaa

SEQ ID NO: 16673 - protein, 586 aa, Lactobacillus plantarum
MKKTKIVSTLGPASTDTDTIVKLIEAGANIFRFNFSHGDHEEHLDRLNKVHEAEKITGKTVGIMLDTKGAEIRTTVQANGKSEYKIGDKVRITMDDSLDTTHDKIAVTYKNLYDDVHVGGHVLFDDGLLDMKIDEKDEANRELVTTVQNAGVLGSRKGVNAPGVSINLPGITEKDSSDIRFGLDHEINYIAASFVRKPQDVLDIRELLEEKHMEHVQIFPKIESQEGIDNADEILKVCDGLMVARGDMGVEIPAENVPLVQKSLIKKCNALGMPVITATQMLDSMQENPRPTRAEASDVANAVFDGTDATMLSGESANGLYPVESVAMMAKIDEKAENTLAENGTLQLNRFDKTSVTETIGIAIARAAKNLNIKTIVAATESGYTAKMISKYRPNADILAITFDERTQRGLMVNWGVQPIVAEKPETTDDMFDLAASKAVELGFAKEGDLILITAGVPVGERGTTNIMKIQLIGSKLADGQGVGDETVIGKAVIATSAQEAIDKAVEGGVLVTKTTDKDYLPAIEKSSALVVENGGLTSHAAVVGISMGIPVIVGVKDATSVIADGQLITVDSRRGLVYRGASNAL

SEQ ID NO: 16674 - DNA, 1755 bp, Clostridium tetani
  CDS (1)..(1755)
atgcaaaaaactaaaatggtgtttaccataggaccagctagtgatagcgaagaagtattaagtgagttaataaaagcaggaatgagtgcatcaaggcataacttttcacatgggacccatgaagaacataaaataaggattgatttaataagaaaattaagtgacaaatttaataagaatattgctgtaatattagacacaaaaggacctgaaataagaacaggagattttaaagataaaactgtacaattaaaagaaggaaataaattcactatatactgtggggaagaaattttaggagatgaaacaaagtgttctataacttataatgatttgcataatgatgtaaaaacaggagattccatactaatagatgatggacttgtaggattagaagttgaagaagtagagggaagtaaagtacattgtgtagttaaaaatagtggtgctgtaagtaaccataagggtgtaaatgtacctggagtagatgtttcattaccttcattaacagaaaaagataaaagtgatcttgaatttggatgtaaagtaggagtagattttattgcagcatcttttattagaaaaggttcagacgtattggaaataagaaaggttctagaagaaaacggcggtacagatatacaaatattttctaaaatagaaaatcaacaaggggtagaaaatatagatgaaataataaagttttctgatggaataatggtagctagaggagatatgggtgtagaattacaaatggaacaagtacctataattcaaaaaatgattatagagaaatgtaacaaagctggcaaacctgttatcacagctactcaaatgttagactctatgattagaaatccaagaccaacaagagcagaagtttcagatgtagccaatgctatatttgatggaactgatgcggtaatgttaagtggtgaaacagcaggaggaaaatatcctatagaagctgctaaagctatggctaagattgctagaactgcagaagaaacaatggattatgatgaaatatttaacagaaaaagagaagcgcgtgtattaagtgtggctaatgcgataagcatagcaacctgtacaacagcttcagagttaaatgcatctgctatattaacagctactcaaacaggatatacagctagagcagtttccaaatatagaccagcatgtcctattatagcgattacaccaagtaagaatgtagcaagaaagttagcattgagttggggtgtgttcccaatacttactactaaatttacatccacagatgctttaatagaaaactctgttgatatagcattgacagcagaatatataagaaaaggagatttggttgtaatagcagctggaatacctgtaagttattcaggaacaactaacatgctaaaggttcatgtagttggagatatccttgttcagggaagaggtgctggaaatagtgcaggttatggtatagctaaagttgtaaatagtacagaagaagcagaaagggttatagaaagtggagatatattagttgtaaaagatgcagatatagattatgtttctatactaaatagagtatcaggagttataactgaaagaggaggattgacttctcacttagcaatagaatgtataaccaatgaaataccatttatatgtggggcaggtggggcaacagatgtattaaaaagtggatatttcataaccatggatgtaaaaagaggaatagtatataacggtaggattactatataa

SEQ ID NO: 16675 - protein, 584 aa, Clostridium tetani
MQKTKMVFTIGPASDSEEVLSELIKAGMSASRHNFSHGTHEEHKIRIDLIRKLSDKFNKNIAVILDTKGPEIRTGDFKDKTVQLKEGNKFTIYCGEEILGDETKCSITYNDLHNDVKTGDSILIDDGLVGLEVEEVEGSKVHCVVKNSGAVSNHKGVNVPGVDVSLPSLTEKDKSDLEFGCKVGVDFIAASFIRKGSDVLEIRKVLEENGGTDIQIFSKIENQQGVENIDEIIKFSDGIMVARGDMGVELQMEQVPIIQKMIIEKCNKAGKPVITATQMLDSMIRNPRPTRAEVSDVANAIFDGTDAVMLSGETAGGKYPIEAAKAMAKIARTAEETMDYDEIFNRKREARVLSVANAISIATCTTASELNASAILTATQTGYTARAVSKYRPACPIIAITPSKNVARKLALSWGVFPILTTKFTSTDALIENSVDIALTAEYIRKGDLVVIAAGIPVSYSGTTNMLKVHVVGDILVQGRGAGNSAGYGIAKVVNSTEEAERVIESGDILVVKDADIDYVSILNRVSGVITERGGLTSHLAIECITNEIPFICGAGGATDVLKSGYFITMDVKRGIVYNGRITI

SEQ ID NO: 16676 - DNA, 1437 bp, Bradyrhizobium japonicum USDA 110
  CDS (1)..(1437)
atgaggcgtcttcgccgtatcaagattctcgcgacccttggacctgcctcttcggacctcgcgatgatccgccgcctgttcgaggccggcgccgacctgttccgcatcaacatgagccacaccccgcatgacaagatgcgggagctggtggcgacgatccgcaatgtcgagagcagctacggccggccgatcggcatcctggtcgaccttcagggaccgaagctcaggctcggcgccttcgccgaaggctcggtccagctccagaacggccagaccttcacgctcgattccgacaaggcgccgggcgatgccacgcgcgtcaatctcccgcatccggagatcctcgccgcgctgcggcccggccatgcgctgctgctggacgacggcaaggtccggctgatcgcggaggagacctcgaaagagcacgcggtgacgcgcgtcgtggtcggcggacggatgtccgaccgcaagggcgtcagcctgcccgacaccgacctgccggtctcggcgatgacgccgaaggaccgcgccgacctcgaggcggcgctggtcaccggcgtcgactggatcgcgctgtccttcgtgcagcgcgccgacgacgtgatcgaggccaagaagatgatccgcggccgcgccgctgtcatggccaagatcgagaagccgcaggcgatcgaccgcctcgccgacatcatcgaggcctccgacgcgctgatggtggcgcgcggcgatctcggtgtcgagctgccgctggagcgcgtgccgagcctccagaagcagatgacgcgcatggcgcgccgcgccggcaagccggtggtgatcgcgacccagatgctggaatcgatgatccagtcgccggtgccgacacgcgccgaggtctcggacgtcgccaccgccgtctatgaaggcgccgacgccatcatgctgtcggcggaatcggcggccggaaaattcccggtcgaggcggtctcgaccatgaaccgcatcggcgaagaggtcgagcgcgacccgatttatcggtccgtgctgaccgcgcagcgccccgcgccggaatccaccgcaggcgacgccatcgcggacgccgcccgccagatcgccgagacgctcgacctgccggccctgatctgctggaccagctcgggctcgaccgcggtgcgcgtcgcgcgcgagcggccgaagccgccgatcgtggcgatcacgccgaacatcgcggccggacgccggctggcggtggtctggggcgtgcattgcgtggtggcggaagatgcgcgcgaccaggacgacatggtgagccgcgccggccagatcgcgttccgcgacggcttcgtccgcgccggccagcgcgtgatcatcgtcgccggcgtgccgctcggcattcccggcaccaccaacatggtgcgcatcgcctccgtcggccccgagggcggcgcggatatctag

SEQ ID NO: 16677 - protein, 478 aa, Bradyrhizobium japonicum USDA 110
MRRLRRIKILATLGPASSDLAMIRRLFEAGADLFRINMSHTPHDKMRELVATIRNVESSYGRPIGILVDLQGPKLRLGAFAEGSVQLQNGQTFTLDSDKAPGDATRVNLPHPEILAALRPGHALLLDDGKVRLIAEETSKEHAVTRVVVGGRMSDRKGVSLPDTDLPVSAMTPKDRADLEAALVTGVDWIALSFVQRADDVIEAKKMIRGRAAVMAKIEKPQAIDRLADIIEASDALMVARGDLGVELPLERVPSLQKQMTRMARRAGKPVVIATQMLESMIQSPVPTRAEVSDVATAVYEGADAIMLSAESAAGKFPVEAVSTMNRIGEEVERDPIYRSVLTAQRPAPESTAGDAIADAARQIAETLDLPALICWTSSGSTAVRVARERPKPPIVAITPNIAAGRRLAVVWGVHCVVAEDARDQDDMVSRAGQIAFRDGFVRAGQRVIIVAGVPLGIPGTTNMVRIASVGPEGGADI

SEQ ID NO: 16678 - DNA, 1458 bp, Bacteroides thetaiotaomicron VPI
  CDS (1)..(1458)
atgttactgaaacagacaaaaatcgtcgcatccatttcggacagacgttgcgatgtggactttataaaacagctgtttgaagctgggatgaatgtggtacgtatgaatacggctcacgctagccgtgaaggttttgaagcgttgattgccaatgtacgttccgtatccaaccggattgcaatcctcatggataccaaaggaccggaagtacgtacaactgccaatgcggaaccgattccatatcagataggtgataaagtaaagattgtcggcaatcctgatcaggagacgactcgtgaatgtatcgctgtttcgtatcctaactttgtgaacgatttgaatatcggaggtctggttctgattgacgatggtgatcttgaactggaagtaatcgataagacagccgattatctgctttgcgaagtgaaaaacgatgcaacgttgggaagccgcaagagcgtgaacgtcccgggtgttcgtatcaatcttccttcattgacagagaaagaccgtaacaatatactttacgcgattgaaaaggatatcgatttcatcgctcactctttcgtgcgcaaccgtcaggacgtacttgatatccgtgaaattctggatgctcacaatagtgatatccggattattgccaagattgagaatcaggaaggggtggacaacatcgacgagattcttgaagtggcggacggcgtgatggtagcccgtggtgacctgggtatcgaagtgccgcaggaacgtattccgggtatccagcgtgtgctgatccgcaaatgtatcctggcaaagaaaccggtgatcgttgcgactcagatgcttcataccatgatcaacaatcctcgtccgacccgcgcggaagtgaccgatatcgcgaatgcaatctactatcgtacggatgctctgatgttgagcggtgagactgcttatggcaaatatccggtagatgcagtcaagacaatgaccaagatcgcggcccaggctgaaaaagataaactggaagagaatgatatccgtatcccgttgaacgaaaacagtaacgatgtaacggccttccttgctaaacaggcagtgaaagctacatcgaaactgaagatacgtgccatcatcacagacagctatagcggacggaccgcccgtaatctggcagctttccgtggtaagttcccggtattggctatctgctataaagaaaagaccatgcgtcatctggcactttcttatggagtggaagcaatctatatgccggagctggccaacggacaggaatattattttgccgctttgcgccgcctgttgaaggaaggacgtttgcagccgactgatatggtaggatatctgagtagcggtaaggcaggtacacaaacttcattcctcgaaatcaatgtcgtggaagatgcgttgaaacatgcgggagaaactgtattgcctaacaacaatcgttatctctaa

SEQ ID NO: 16679 - protein, 485 aa, Bacteroides thetaiotaomicron VPI
MLLKQTKIVASISDRRCDVDFIKQLFEAGMNVVRMNTAHASREGFEALIANVRSVSNRIAILMDTKGPEVRTTANAEPIPYQIGDKVKIVGNPDQETTRECIAVSYPNFVNDLNIGGLVLIDDGDLELEVIDKTADYLLCEVKNDATLGSRKSVNVPGVRINLPSLTEKDRNNILYAIEKDIDFIAHSFVRNRQDVLDIREILDAHNSDIRIIAKIENQEGVDNIDEILEVADGVMVARGDLGIEVPQERIPGIQRVLIRKCILAKKPVIVATQMLHTMINNPRPTRAEVTDIANAIYYRTDALMLSGETAYGKYPVDAVKTMTKIAAQAEKDKLEENDIRIPLNENSNDVTAFLAKQAVKATSKLKIRAIITDSYSGRTARNLAAFRGKFPVLAICYKEKTMRHLALSYGVEAIYMPELANGQEYYFAALRRLLKEGRLQPTDMVGYLSSGKAGTQTSFLEINVVEDALKHAGETVLPNNNRYL

SEQ ID NO: 16680 - DNA, 1758 bp, Staphylococcus epidermidis ATCC 12228
  CDS (1)..(1758)
atgagaaagactaaaattgtatgtacaataggaccagcttcagaatcagaggaaatgctcgaaaaactaatgaatgcaggaatgaacgttgcgcgtttaaatttctcacatggtagtcatgaagaacataaagcaagaattgatacaattcgtaaagttgctaaacgtttaaataaaacaattggcttgttattggatactaaagggccagaaattcgtactcacaatatgaaagatggacttattgttttagaaaaaggcaaagaagtcattgtaagcatgaatgaagttgaaggaacacctgaaaaattctctgtaacatatgaaaatctaatcaatgatgtcaatattggatcatatatactattagatgatggtttagttgaacttcaagtcaaagaaattaacaaagataaaggcgaagttaaatgtgatatcttaaatactggtgaattaaaaaataaaaaaggtgttaacttacctggtgttaaagttaatttacctggtatcactgataaagatgccgatgatatcagatttggtataaaggaaaatgtagactttatagctgcaagttttgtaagacgtccaagtgatgttttagatatccgtcaaattcttgaagaagaaaaagcagaaataacaattttccctaaaattgaaaaccaagaaggtatcgataatattgaagaaattcttgaagtatctgatggattaatggtagcacgtggtgatatgggtgttgaaattccgccagaaagcgtaccaatggttcaaaaagatttaattagaaaatgtaataaattaggaaaacctgtaattactgcgactcaaatgcttgattctatgcaacgtaatccacgtgcgacacgtgcagaagcaagtgacgtagctaatgcaatatacgatggtactgacgcggtaatgttatcaggtgaaactgcagcaggtcaatatcctgaagaagctgttaaaactatgcgtaatattgcagtttctgctgaagcagcgcaagactataaaaaattattaagtgatcgtactaaattagttgaaacttcattagtaaatgcaattggtgtttctgttgcacatactgccttaaacttaaatgtaaaagctattgtagcagcaactgaaagtggttcaacagcacgtacgatttctaaatatcgtccacattcagatatcattgctgtaacacctagcgaaaaaactgctagacaatgtgcaattgtatggggagtaaatccggtcgttaaagaaggacgtaaaacaactgatgctttactaaataatgctgtagcaacagcagtagaaactggtagagtttcaaacggagatttaattattattactgctggtgtacctactggagaaaaaggaactacaaatatgatgaaaatccacttagtaggtgatgagattgctaaaggtcaaggtgttggtagaggatctgttgtaggccatgcaattgtcgcagatagtgctagtgatttagaaggtaaagatttatctgataaagttattattacaaattctgttgatgaaacattagtaccatatgttgaaaaagctataggtctaattacagaagaaaatggtattacttcaccaagcgcaattataggtttagaaaaaggcatacctactgttgttggtgtagaacaagcaaccaaagaaattaaaaatgatatgttagtgactttagatgcgtcacaaggtaaagtgtttgaaggttatgctaacgtcctttaa

SEQ ID NO: 16681 - protein, 585 aa, Staphylococcus epidermidis ATCC 12228
MRKTKIVCTIGPASESEEMLEKLMNAGMNVARLNFSHGSHEEHKARIDTIRKVAKRLNKTIGLLLDTKGPEIRTHNMKDGLIVLEKGKEVIVSMNEVEGTPEKFSVTYENLINDVNIGSYILLDDGLVELQVKEINKDKGEVKCDILNTGELKNKKGVNLPGVKVNLPGITDKDADDIRFGIKENVDFIAASFVRRPSDVLDIRQILEEEKAEITIFPKIENQEGIDNIEEILEVSDGLMVARGDMGVEIPPESVPMVQKDLIRKCNKLGKPVITATQMLDSMQRNPRATRAEASDVANAIYDGTDAVMLSGETAAGQYPEEAVKTMRNIAVSAEAAQDYKKLLSDRTKLVETSLVNAIGVSVAHTALNLNVKAIVAATESGSTARTISKYRPHSDIIAVTPSEKTARQCAIVWGVNPVVKEGRKTTDALLNNAVATAVETGRVSNGDLIIITAGVPTGEKGTTNMMKIHLVGDEIAKGQGVGRGSVVGHAIVADSASDLEGKDLSDKVIITNSVDETLVPYVEKAIGLITEENGITSPSAIIGLEKGIPTVVGVEQATKEIKNDMLVTLDASQGKVFEGYANVL

SEQ ID NO: 16682 - DNA, 1440 bp, Wigglesworthia glossinidia brevipalpis
  CDS (1)..(1440)
atgcatagaataataagaagaacaaaaatagttgctacattaggaccatcaacagatttaaataataatttagaaaaaatgatattagctggagctaatatggttcgtatgaatttttctcatggaaatttttacgatcatgcaagaagaacaaaacaagtgagaaacatttctcataaactaggtaaaaatattgctattttaggagatttacaaggaccaaaaataagaatatctacttttatgacaggcaaagtatttttatcaccaggagatcaattcatactagatgcatcattaagcaaggatcttggaacagttgaaagtgttggaattgattataaatatcttccaaaagatgtatttccaggagatgttttattattagatgacggaaggatacagctaaaagtcaaaaaaattgtaaataaaaaaatttttacaactgtatatataggaggatatttatataataataaaggtattaataaattaggaggaggtttatcggctaattctttgacagaaaaagacaaaaaagatattatttgcgcagctaaaataggaatagattatttagctgtttcttttcctagaacaggaaaagacttaaaatatgcaagaaatttattaaataatgtagaaagtcatgcaaaaattatttcaaaaatagaaagagcagaagcggtagcaaataatgatattatagatgaaataataacagaatcagatgctattatggtagctagaggagatttgggaatagaaattggagatccagaattagtaggagtgcaaaaaaaattaatacaaagagctagagatttaaatcgtgcggtaattactgcaactcaaatgatggaatccatggtttataaccctatgccaaccagagcagaagttatggatgttgctaatgcagtattggatggcacagatgcagttatgttatcagcagaaacagctattggaaaatatccagtagaaactgtagaatctatgtctaatgtatgcataggagctgaaaaaatttctaatattaattctttgaagaatagattaaacattaaatttaaaaccgtagaagaatcaatggcggtatctgcaatgtatattgcaaatcatttaaatatgataaaagctataatttctcttacagaatctggtaaaactccattaattatgtctcgtataagttctggattaccaatttttgctctttcaaaacatgaacatactttaaatttaacagctttatatagaggggttactcctgtttattttaaaaataatgaaaaaggaatttcagctgctgattctgctattaatttgcttaaagaaaaaaaatttttattctctggagattttgtagtaattactcaaggagatgtcatggggactattggaaaaacaaataccagccgtatattaattgtataa

SEQ ID NO: 16683 - protein, 479 aa, Wigglesworthia glossinidia brevipalpis
MHRIIRRTKIVATLGPSTDLNNNLEKMILAGANMVRMNFSHGNFYDHARRTKQVRNISHKLGKNIAILGDLQGPKIRISTFMTGKVFLSPGDQFILDASLSKDLGTVESVGIDYKYLPKDVFPGDVLLLDDGRIQLKVKKIVNKKIFTTVYIGGYLYNNKGINKLGGGLSANSLTEKDKKDIICAAKIGIDYLAVSFPRTGKDLKYARNLLNNVESHAKIISKIERAEAVANNDIIDEIITESDAIMVARGDLGIEIGDPELVGVQKKLIQRARDLNRAVITATQMMESMVYNPMPTRAEVMDVANAVLDGTDAVMLSAETAIGKYPVETVESMSNVCIGAEKISNINSLKNRLNIKFKTVEESMAVSAMYIANHLNMIKAIISLTESGKTPLIMSRISSGLPIFALSKHEHTLNLTALYRGVTPVYFKNNEKGISAADSAINLLKEKKFLFSGDFVVITQGDVMGTIGKTNTSRILIV

SEQ ID NO: 16684 - DNA, 1413 bp, Vibrio vulnificus
  CDS (1)..(1413)
atgaaaaagaccaaaatcgtatgtacgattggcccaaaaactgagtctgtagagaaactgactgaactagtcaactcaggtatgaacgtaatgcgcctgaacttttctcacggtgactacgtagagcacggcactcgtatcgcgaacttccgccaagtaatggaaaacacaggtaagcaacttgctatcttactagacactaaaggtccagaaatccgcactatcaaactagaaaacggcgacgacgttgatctagtagctggtcaagaattcactttcacgactgatacttctgttgttggtaacaaagacatcgtagcagtaacttacccaggttttgctgcggatctatctgctggtaacactatcctagttgacgatggtctaatcgagatggaagttatcgcaacgactgcgactgaagttaagtgtaaagtactgaacaacggtgctctaggcgaaaacaaaggtgttaacctaccaggcgtttctgtaaacctacctgcactatctgaaaaagacaaaaacgaccttaaatttggttgtgagcaaggcgttgacttcgttgcagcatctttcatccgtaaagcatctgacgtaaaagaaatccgtgaagttctagcagcaaacggcggcgcgaacattcagatcatttctaagattgaaaaccaagaaggtgttgataacttcgacgaaatcctagagctttctgacggtatcatggttgctcgtggtgacctaggtgtagaaatccctgcagaagaagttatcttcgcacagaagatgatgatcgaaaaatgtaaccgcgcacgtaaagtggttatcactgcaactcaaatgctagattctatgatcaagaacccacgtccaactcgtgctgaagcgggtgacgttgcgaacgcaatcatggatggtactgatgcagtcatgctttctggcgaaacagcgaaaggtaaataccctgttgaagcggtaactatcatggcgcaaatcgctaaccgtactgattctgtactaaaagcagagctaggctctcgtctagacagcccacgcctacgtatcactgaagcggtatgtaaaggtgcagtagacacagctgagaaactagcagcaccactgatcatcgttgcaactgaaggtggtaagtctgcacgctctgtacgtaagtacttcccaactgcaaacattcttgcgctaacgacgaacaagaagacagcagctcaacttgtactgactaaaggtgttacacctgttgttgttgattcaatcgacaacacggatgcgttctacgtaaccggtaaagagcttgctcttgaatctggcctaggtagcaaaggcgacatcgttgtgatggtatctggtgctcttgttgcatctggtacaacgaatactgcgtcagtacacgtactataa

SEQ ID NO: 16685 - protein, 470 aa, Vibrio vulnificus
MKKTKIVCTIGPKTESVEKLTELVNSGMNVMRLNFSHGDYVEHGTRIANFRQVMENTGKQLAILLDTKGPEIRTIKLENGDDVDLVAGQEFTFTTDTSVVGNKDIVAVTYPGFAADLSAGNTILVDDGLIEMEVIATTATEVKCKVLNNGALGENKGVNLPGVSVNLPALSEKDKNDLKFGCEQGVDFVAASFIRKASDVKEIREVLAANGGANIQIISKIENQEGVDNFDEILELSDGIMVARGDLGVEIPAEEVIFAQKMMIEKCNRARKVVITATQMLDSMIKNPRPTRAEAGDVANAIMDGTDAVMLSGETAKGKYPVEAVTIMAQIANRTDSVLKAELGSRLDSPRLRITEAVCKGAVDTAEKLAAPLIIVATEGGKSARSVRKYFPTANILALTTNKKTAAQLVLTKGVTPVVVDSIDNTDAFYVTGKELALESGLGSKGDIVVMVSGALVASGTTNTASVHVL

SEQ ID NO: 16686 - DNA, 1785 bp, Thermosynechococcus elongatus BP
  CDS (1)..(1785)
atgtcgaaccagccgttgcaacgccgcaccaaaattgtcgccaccattggtccagcagtcagtcaccccgacaaattgcgcgccattattcaagcgggagcaaccaccctgcgtctaaacttttcccatggcacccatgacgatcaccagcgcagcattcgcctcattcgccaaatttcctatgaactcgggcaaccggtggggattttgcaggacttgcaaggccccaagattcgccttgggcggtttgagcatggctccatttccctcaagcggggcgatcgctttaccctcacgagtcgccctatcctgggcaatcagcacattagctcaattacctatccccccttggcccaagaggtgcccgccggtgccacgattttgctcgacgatggccgcgtggaaatgctcgtggaagaagtggataaagaggcgggggagctccattgccaagtgattgttgggggtaccctctccaatgccaagggtgtgaactttccgggggtttacctttcgattaaagccctaacagagaaagatcgcgaagatctgatgtttggcctcaatcaaggggtggattgggtggccctcagcttcgttcgcaatccccaagatgtactggagatcaaagaactgattgccaacgctgggaagcaggtgccagtcattgccaaaatcgaaaagcacgaggcgatcgagcagatggatgccattctctccctctgtgatggcgtcatggtggcacggggtgatttgggggttgaattgcccgccgaagatgtaccgattctgcaaaaacggctgatcgctgctgccaaccgcttgggcattccggtcattacggccacacaaatgctcgacagcatggtgaaaagccctcgtcctacccgggccgagatttccgatgtcgccaatgccattctcgatggcactgatgccgtgatgctctccaatgaaacggcgatgggggaataccccgtcgaggcggtcaagatgatggccaccattgccgcccgcattgacaatcaacctcaactgcggcaacctcccggggctgagtctacggcggtgcgttctattcccagtgccattagtcaagcggtgggacaggtggcggcgcagctgcatgccaaagcgatcattacccaaactaaaacaggcgcaacggcgcggaatgtttccaagtttcgtccccaaattcctattttggcggcaacaccccatatcgaagtggcccgtcgcctccagttggtctggggcgtcgaaccgctgctgacattggatcatccctcgatgcgcgaatccttccaggcggcgattaatgctgcccaggagcggggcttccttgaggagggggatctggtggtcatgacggcgggcaccctacaaggggtttctggctccacggatatgatcaaggtggaactggttacctcagtgatgggacggggttgtggcattggccatggatctgttagtggtcctgcgcgggtggtacgccaagggatgccggtgcgtacgtttaatcgtggggaaattttggtggctgagcgcaccagtgctgagttggtggaagtgattcgcaaagcggcaggcattattaccgaggaggacagcctcacaagccatgccgccgtcttggggttgcggctgggtattcctgtgattgtgggcgtcaaaaatgccactcgcctgatccgtgagggcaccattctgacgatggatgtggaacggggcgtggtttattccggtgcccgcaatggcggcgagcgatcgccagagtag

SEQ ID NO: 16687 - protein, 594 aa, Thermosynechococcus elongatus BP
MSNQPLQRRTKIVATIGPAVSHPDKLRAIIQAGATTLRLNFSHGTHDDHQRSIRLIRQISYELGQPVGILQDLQGPKIRLGRFEHGSISLKRGDRFTLTSRPILGNQHISSITYPPLAQEVPAGATILLDDGRVEMLVEEVDKEAGELHCQVIVGGTLSNAKGVNFPGVYLSIKALTEKDREDLMFGLNQGVDWVALSFVRNPQDVLEIKELIANAGKQVPVIAKIEKHEAIEQMDAILSLCDGVMVARGDLGVELPAEDVPILQKRLIAAANRLGIPVITATQMLDSMVKSPRPTRAEISDVANAILDGTDAVMLSNETAMGEYPVEAVKMMATIAARIDNQPQLRQPPGAESTAVRSIPSAISQAVGQVAAQLHAKAIITQTKTGATARNVSKFRPQIPILAATPHIEVARRLQLVWGVEPLLTLDHPSMRESFQAAINAAQERGFLEEGDLVVMTAGTLQGVSGSTDMIKVELVTSVMGRGCGIGHGSVSGPARVVRQGMPVRTFNRGEILVAERTSAELVEVIRKAAGIITEEDSLTSHAAVLGLRLGIPVIVGVKNATRLIREGTILTMDVERGVVYSGARNGGERSPE

SEQ ID NO: 16688 - DNA, 1503 bp, Streptococcus mutans
  CDS (1)..(1503)
atgaataaacgcgtaaaaattgttgcaactttaggtccagcggtagaaatccgtggtggtaaaaaatttggtgaagatggctattggggtgaaaagcttgatgttgaagcttcagcagcaaaaattgctgaattgattacagaaggagccaatgtttttcgttttaacttttcacatggtgaccatgctgagcaaggtgaacgtatggcgactgtacgtcgcgcggaagaattggcacgtcaaaaggttggattccttcttgatactaaaggacctgaaatgcgtacagaattgtttgcagatggtgtcaaagaatatgaatataagactggtgataaacttcgtatagcaactaaacaaggcattgaatcaactaaggatgtcattgctttaaatgttgcaggcggtcttgatatttatgatgatgttgctgtcggtcagactattcttattgatgatgggaaacttggccttacagtaaccgctaaagatattacaactcgcgagtttgaagtaaccgttgaaaatgatggcattattgctaaacaaaaaggtgtcaatattcctaatactaaaattcctttcccagcacttgctgagcgtgataatgcagatattcgctttggtttggaacaaggtcttaactttattgctatttcttttgttcgtactgctaaggatgttaatgaagttcgtcaaatttgtaaagaaacaggtaacgagcacgtaaaactttttgctaaaattgaaaatcaacaaggtattgataacattgatgaaatcattgatgcagctgacggtatcatgattgctcgcggtgacatgggtattgaagtgccgtttgaaatggttccagtttatcaaaaaatgattatcacgaaagttaatgcagcagggaagtcagctatcacagcaacaaatatgcttgaaacaatgactgacaaaccacgtgcaacacgttccgaagtctctgatgtctttaatgctgtcattgatggtactgatgcaacaatgctttctggtgaatcagctaatggtaagtatccagttgaagctgttcgtaccatggcaacaattgataagaatgctcaaacacttcttaatgaatatggccgtttgaattcagataatttgccacgtaccaacaagactgaggttgtcgcttcagctgttaaagatgcgactaaatcaatggatattaaattggttgttacaattacagaatctggtaacacagctcgtttaatttcaaaataccgtccggatgcagatatcttagctttaacatttgatgaaaaagtccaaaaatcattgatgattaactggggagttattccaatcttaacagaaaaacctgcatctactgatgatatgtttgaaattgcagaaaaagcagctcttaaatcaggtttggtagagtctggtgacaacatcgttattgttgctggtgtaccggttggatctggtggtaccaatactatgcgtgttcgtaccgttcaataa

SEQ ID NO: 16689 - protein, 500 aa, Streptococcus mutans
MNKRVKIVATLGPAVEIRGGKKFGEDGYWGEKLDVEASAAKIAELITEGANVFRFNFSHGDHAEQGERMATVRRAEELARQKVGFLLDTKGPEMRTELFADGVKEYEYKTGDKLRIATKQGIESTKDVIALNVAGGLDIYDDVAVGQTILIDDGKLGLTVTAKDITTREFEVTVENDGIIAKQKGVNIPNTKIPFPALAERDNADIRFGLEQGLNFIAISFVRTAKDVNEVRQICKETGNEHVKLFAKIENQQGIDNIDEIIDAADGIMIARGDMGIEVPFEMVPVYQKMIITKVNAAGKSAITATNMLETMTDKPRATRSEVSDVFNAVIDGTDATMLSGESANGKYPVEAVRTMATIDKNAQTLLNEYGRLNSDNLPRTNKTEVVASAVKDATKSMDIKLVVTITESGNTARLISKYRPDADILALTFDEKVQKSLMINWGVIPILTEKPASTDDMFEIAEKAALKSGLVESGDNIVIVAGVPVGSGGTNTMRVRTVQ

SEQ ID NO: 16690 - DNA, 1503 bp, Streptococcus agalactiae
  CDS (1)..(1503)
atgaataaacgcgtaaaaatcgttgcaacacttggtcctgcggttgaattccgtggtggtaagaagtttggtgagtctggatactggggtgaaagccttgacgtagaagcttcagcagaaaaaattgctcaattgattaaagaaggtgctaacgttttccgtttcaacttctcacatggagatcatgctgagcaaggagctcgtatggctactgttcgtaaagcagaagagattgcaggacaaaaagttggcttcctccttgatactaaaggacctgaaattcgtacagaactttttgaagatggtgcagatttccattcatatacaacaggtacaaaattacgtgttgctactaagcaaggtatcaaatcaactccagaagtgattgcattgaatgttgctggtggacttgacatctttgatgacgttgaagttggtaagcaaatccttgttgatgatggtaaactaggtcttactgtgtttgcaaaagataaagacactcgtgaatttgaagtagttgttgagaatgatggccttattggtaaacaaaaaggtgtaaacatcccttatactaaaattcctttcccagcacttgcagaacgcgataatgctgatatccgttttggacttgagcaaggacttaactttattgctatctcatttgtacgtactgctaaagatgttaatgaagttcgtgctatttgtgaagaaactggcaatggacacgttaagttgtttgctaaaattgaaaatcaacaaggtatcgataatattgatgagattatcgaagcagcagatggtattatgattgctcgtggtgatatgggtatcgaagttccatttgaaatggttccagtttaccaaaaaatgatcattactaaagttaatgcagctggtaaagcagttattacagcaacaaatatgcttgaaacaatgactgataaaccacgtgcgactcgttcagaagtatctgatgtcttcaatgctgttattgatggtactgatgctacaatgctttcaggtgagtcagctaatggtaaatacccagttgagtcagttcgtacaatggctactattgataaaaatgctcaaacattactcaatgagtatggtcgcttagactcatctgcattcccacgtaataacaaaactgatgttattgcatctgcggttaaagatgcaacacactcaatggatatcaaacttgttgtaacaattactgaaacaggtaatacagctcgtgccatttctaaattccgtccagatgcagacattttggctgttacatttgatgaaaaagtacaacgttcattgatgattaactggggtgttatccctgtccttgcagacaaaccagcatctacagatgatatgtttgaggttgcagaacgtgtagcacttgaagcaggatttgttgaatcaggcgataatatcgttatcgttgcaggtgttcctgtaggtacaggtggaactaacacaatgcgtgttcgtactgttaaataa

SEQ ID NO: 16691 - protein, 500 aa, Streptococcus agalactiae
MNKRVKIVATLGPAVEFRGGKKFGESGYWGESLDVEASAEKIAQLIKEGANVFRFNFSHGDHAEQGARMATVRKAEEIAGQKVGFLLDTKGPEIRTELFEDGADFHSYTTGTKLRVATKQGIKSTPEVIALNVAGGLDIFDDVEVGKQILVDDGKLGLTVFAKDKDTREFEVVVENDGLIGKQKGVNIPYTKIPFPALAERDNADIRFGLEQGLNFIAISFVRTAKDVNEVRAICEETGNGHVKLFAKIENQQGIDNIDEIIEAADGIMIARGDMGIEVPFEMVPVYQKMIITKVNAAGKAVITATNMLETMTDKPRATRSEVSDVFNAVIDGTDATMLSGESANGKYPVESVRTMATIDKNAQTLLNEYGRLDSSAFPRNNKTDVIASAVKDATHSMDIKLVVTITETGNTARAISKFRPDADILAVTFDEKVQRSLMINWGVIPVLADKPASTDDMFEVAERVALEAGFVESGDNIVIVAGVPVGTGGTNTMRVRTVK

SEQ ID NO: 16692 - DNA, 1440 bp, Shewanella oneidensis
  CDS (1)..(1440)
atgttccgcagaaccaaaatcgtcaccacactgggtcccgccactgaccgtgacgataacttacgccgtattattgcggcaggtgcaaacgttgttcgtcttaacttctcccacggctcccccgaagatcatctcaaacgcgctactcaagctcgcgaaatcgcaaaagaattaggtgtacatgttgctattttaggtgacctacaaggccctaaaatccgtgtgtctacctttaaagacaacaagaaaattcaactgaaattaggccaaacctatattcttgacgccgaacttgctaaaggtgaaggcgatgagaatcaagtcggtatcgactataagcaattgcctgatgatgtgaatgttggcgacatcctgatgctcgatgacggccgagtacaactgcgtgttgagcgcgttgaaggtcgtaaagtccatactactgtgacggttgcaggtcctttatcgaacaataaagggatcaacaagcaaggtggtggtttgtcggctgcggcactaactgaaaaagacaaggcagacattctcaccgcagctatgatccaagtggattacttagccgtgtcattcccacgtagcggtgcagatctcgaatatgcacgctctttagcgcagcaggctggcagtaacgcactgatcgtcgcgaaggttgaacgtgcagaagcggttgccagtgatgaagcaatggatgatgtgattttagcctctgatgttgtgatggttgcccgcggtgatttaggggttgagattggtgatgctgcactggtagcagtacaaaagaaactcatcgcccgttcacgtcagctcaataaaatcgtcatcaccgcgacccaaatgatggaatcgatgatctcgagcccaatgccaacccgtgcagaagtgatggacgtggcaaacgccgtgcttgatggtaccgacgctgtgatgttatcagccgaaaccgcagcgggtgacttcccagaagaaactgttaaagcaatggcgaatgtgtgtgtcggtgcagaatctcacccaagtgtgaaagtttctaagcacagattagatgcacgtttcacgtcggttgaagaaaccatcgccctatcgactatgtatgcggcaaaccacctagaaggtgttaaagcgattatcgctttaacagagtcaggtgcgacacctaaactgatgtcgcgtatcagttcatctttaccaatccttggcctatctcgccatgacacaacactggcgaagatggctctgtaccgtggtgtactaccgatttacttcgactcaacgatctatccagccgatgagcttgcacaaaaagcattggaatcattaaccaaagcgggttacttgcacagcggtgacttagtgttaatgaccaaaggtgatgcgatggaaaccatcggtggcacgaacacttgtaaagtgctgattgtcgcttaa

SEQ ID NO: 16693 - protein, 479 aa, Shewanella oneidensis
MFRRTKIVTTLGPATDRDDNLRRIIAAGANVVRLNFSHGSPEDHLKRATQAREIAKELGVHVAILGDLQGPKIRVSTFKDNKKIQLKLGQTYILDAELAKGEGDENQVGIDYKQLPDDVNVGDILMLDDGRVQLRVERVEGRKVHTTVTVAGPLSNNKGINKQGGGLSAAALTEKDKADILTAAMIQVDYLAVSFPRSGADLEYARSLAQQAGSNALIVAKVERAEAVASDEAMDDVILASDVVMVARGDLGVEIGDAALVAVQKKLIARSRQLNKIVITATQMMESMISSPMPTRAEVMDVANAVLDGTDAVMLSAETAAGDFPEETVKAMANVCVGAESHPSVKVSKHRLDARFTSVEETIALSTMYAANHLEGVKAIIALTESGATPKLMSRISSSLPILGLSRHDTTLAKMALYRGVLPIYFDSTIYPADELAQKALESLTKAGYLHSGDLVLMTKGDAMETIGGTNTCKVLIVA

SEQ ID NO: 16694 - DNA, 1761 bp, Oceanobacillus iheyensis HTE831
  CDS (1)..(1761)
atgagaaacacaaaaatcgtatgtacaattggtcctgcatcagaatcaattgaaaagttagagcaacttattgaagcaggaatgaacgtagctcgtctcaacttttctcatggagattatgcagagcatggcgcacggattgaaaatatccgaaaagcagctaaaaataaaaataaaacagtagcaattcttttagatactaaaggaccagagattcgtactggtagctttaaagaaggtagagcagatcttatgcagggcaaccctgtaacaatcgctatggatgaagtagaggggactgctgagaaattctctgttacataccaagggctaatcaatgatgtacatgaaggttcaaagattcttttggatgatggacttattgaattagaagtaaaatctattgataaaagtaaaggtgaaattgaaactattgcacttaactctggggaaataaagaataaaaaaggtgttaacgttcctaatgtttctgtaaatctacccggtataacagaaaaagacaccaatgatattatctttggaattgaacagggtgttgattttattgctgcatcttttgtgcgtcgagcttcggatattttagaaattaaagaagtgctagatcagcatcaggcacagtatataaaaatcatccctaaaattgagaaccaagaaggtgtcgataatatcgatagtattcttgaggtaagtgatggattaatggtagctcgtggtgatttaggagtggagatcccagctgaagatgtaccattggtacagaaaaaattaattaagcaatgtaataatgctggaaagccagtaattactgctacacaaatgttagattcgatgcagcgtaatccacgacctacacgtgcagaagcatcagacgttgctaatgcgatttttgatggcacagatgcaattatgctttctggagaaactgctgcgggaacctacccagtagaatctgtacaaacaatgagtaatattgcactaaaagctgaatctgcattagatcataaacaaatgttagaagaacgttcacaatatgtcgatatgactataacagaagcaattagtcaatccgttacgcacacagcatccaatttaaatgttgatacaattatcacaccgacagaaagcggacatacagctagaatgatttctaaataccgtccgaaagcttccattctagcagttacttttaacgaagtagtaaatcgtcaactatccttagtttggggagtgcatgctgttctgggtaaaccagcgacgtctactgacgaaatgctagaaattgcagttgataaaggattaaatacaggaatctgcagtagaggaagccgtgtcattattacggctggtgtacctgttggagagagtggaacaactaacctgttaaaagttcatgtgattggtgatgtgattgctaaaggacaaggaattggaagaagaagtgcatatggacatgccgtatttgctaaaacgaataaagaagctttagaaaaagtacaagacggtgatattttagtaacctatgcaacagaaaaagaaatgatgcctgcaattgaaaaagcatcagctattattacagaagaaggtggattaacttctcatgcagctgttgtcggattaagtcttggaattccagtaattgttggggttgacaatgtatttgaaattcttcaagatggacaagatattactgtagatggtaaccgtggagatatctacgctggccatgcaggtgtattgtaa

SEQ ID NO: 16695 - protein, 586 aa, Oceanobacillus iheyensis HTE831
MRNTKIVCTIGPASESIEKLEQLIEAGMNVARLNFSHGDYAEHGARIENIRKAAKNKNKTVAILLDTKGPEIRTGSFKEGRADLMQGNPVTIAMDEVEGTAEKFSVTYQGLINDVHEGSKILLDDGLIELEVKSIDKSKGEIETIALNSGEIKNKKGVNVPNVSVNLPGITEKDTNDIIFGIEQGVDFIAASFVRRASDILEIKEVLDQHQAQYIKIIPKIENQEGVDNIDSILEVSDGLMVARGDLGVEIPAEDVPLVQKKLIKQCNNAGKPVITATQMLDSMQRNPRPTRAEASDVANAIFDGTDAIMLSGETAAGTYPVESVQTMSNIALKAESALDHKQMLEERSQYVDMTITEAISQSVTHTASNLNVDTIITPTESGHTARMISKYRPKASILAVTFNEVVNRQLSLVWGVHAVLGKPATSTDEMLEIAVDKGLNTGICSRGSRVIITAGVPVGESGTTNLLKVHVIGDVIAKGQGIGRRSAYGHAVFAKTNKEALEKVQDGDILVTYATEKEMMPAIEKASAIITEEGGLTSHAAVVGLSLGIPVIVGVDNVFEILQDGQDITVDGNRGDIYAGHAGVL

SEQ ID NO: 16696 - DNA, 1461 bp, Leptospira interrogans
  CDS (1)..(1461)
atgaagagcgaatcctccgtttttagaaaaaccaaaatcatctgtacgattggtcctgcgacctcagataaaaaaatgattcaggctcttgccgaagccggaatgaacgtggcacgattaaacatgtctcacggaaaccacgattttcatagaagtatcattcgtaatattaagtccctcaataaggacgtgttgaaaaatccgattgcgattttactcgatacacaaggaccggaaattcgaactggagatcttcaagtagatcatctggatttaaaagtaggtgagacctttacctttcatatcattccgggggaagaatctgaagaacaatccgtatttgtaaactataaggatatagttaaagatttaaaagtaggcgatccagtaaccgtagataacggtttaatcaatcttgtagtagaggaaatcaatgattctgctcttaagtgtaaggtgttagacggtggaagactaggttctagaaaacacattaatcttccaggaattcgggttaatcttccctcgatcactccaaaggatcataaggatattctattcggattagaagaagatgtagattttattgcactttcttttgttcgttctgtggaagacattaatcaattaaaacaaattatagaagagaacgatggacacgcgcagatcatcgctaagatagaagatcaagaagcggtgcgtaatatgaaagaaatcgtggaagccgcagacggtgtgatggttgcgagaggggatttgggggttgaagttccaattgaagaattgccgatcttgcaaagagctatcattaaagaatgtgctctcaaaggaaaaagggtgatcgtagcaacccatcttttagaatctatgattcataatccttcgcctacgagggcggaggtgaccgacgtcgctaacgcgatttatgaagaagcggacgcgattatgctttctggagaaaccgcggccggtaaatttccgattcgttgtgtggaaatgatggataagatcgcacaacgtgtagaaaagactggcggtgtagattacgttaaggataaaattccacaggataaaaaagagcagatggcaagggcggctgcaaaacttgcagattctttaaagtgtccggcgattatagtaattacaagaagagggaccaccgcgttgaacgtggcgggttttcatcctcattatcctttgatttatgcgtttacgaatatgacaactgttaggcgaaagctctggttgactcgaggagtgattccgcatagaatcgatttttccaaagatccggaaaagacgattcgactcgcgatcgaaactttgaagaaaacgggaaggatcgaggatggggatcaagttgtgattctgtcagacatcatcgcgggcgaagatcgtgtggaaacgattcagattcgagaagtaaaaacgtattttaatgtggaagtggaaaaactttga

SEQ ID NO: 16697 - protein, 486 aa, Leptospira interrogans
MKSESSVFRKTKIICTIGPATSDKKMIQALAEAGMNVARLNMSHGNHDFHRSIIRNIKSLNKDVLKNPIAILLDTQGPEIRTGDLQVDHLDLKVGETFTFHIIPGEESEEQSVFVNYKDIVKDLKVGDPVTVDNGLINLVVEEINDSALKCKVLDGGRLGSRKHINLPGIRVNLPSITPKDHKDILFGLEEDVDFIALSFVRSVEDINQLKQIIEENDGHAQIIAKIEDQEAVRNMKEIVEAADGVMVARGDLGVEVPIEELPILQRAIIKECALKGKRVIVATHLLESMIHNPSPTRAEVTDVANAIYEEADAIMLSGETAAGKFPIRCVEMMDKIAQRVEKTGGVDYVKDKIPQDKKEQMARAAAKLADSLKCPAIIVITRRGTTALNVAGFHPHYPLIYAFTNMTTVRRKLWLTRGVIPHRIDFSKDPEKTIRLAIETLKKTGRIEDGDQVVILSDIIAGEDRVETIQIREVKTYFNVEVEKL

SEQ ID NO: 16698 - DNA, 1437 bp, Leptospira interrogans
  CDS (1)..(1437)
atgccttgcatgaaaattctaaacagaaaaaaaaccaaaatcgtctgcactataggtccggcttcttcttccgaagaaaccatactttctattctcaaagcgggaatggatatagctcggatgaatttttcacacggcacacatgattctcataaaagagtctacgacacgttacgcaagtgcgaacaaattttcggatttcctttagggatcatggcagacctacaaggccctaaaattcgaaccggaaaattaaaactcaactccattctacttcataaaaatcaggagattgaaatcgtcccagattctgatattttgggagatgaacacaaaatcggttgtacatatccaaatctaattagagatatacaagaagaagacaagattctaattgatgacggtaagttaattttaaaagttatttctaaaaaatcgaactccgccattttaaaagtaatcgtaggtggaatcttatggagcaacaaaggaatcaatcttccaggaactcctatctctgctcctgcactttccgaaaaagacatagaagatcttaagttcgcactctctctaggtgtagattacgcggctcttagttttgttcgtactggggcagacttagaattagcaaggtcttatttagaaggtacatatacagggctgatcgcaaagatagaaagaccggaagcaattggaaacatagaagaaatcatagaacgagcagatggcatcatgattgcaagaggagatttaggagtagaaattgatacggaaaaggttcccattctacaaaaagaacttatctataaactcaatcaagcgggtaaaccggtcattactgcaacccaaatgctggaatctatgattgaaaacccaagaccaacacgtgcagaggcgagcgacgtagcaaatgcggttatggacggaacggatgcagttatgctttctgcagaatcggctaacggccattatccggtcgaatccgttgaaatcatgtctaaaatcattcaagaaactgaaaccattgatcatatctatgagattcactggaacattaaaaaaactttcttagaatcagaaagaactgcactgggaaatgccgcaagggagattgcccacggaatccacgcaaaggcaatcgtcaattttacgagaagcggttattccgcattgattacctccgaaatgagacccaaggttccgatctactcttttactccgtttgcaaccaccgccagaaagatgaaactctatcgaggtgtggtgccatttgtaatgcctttctttacaagattggaagatatgattgcttatatgaatcaaaaactcaaagaagatgaatttctttttccaggagataaggtggtaattctttccggagccccaggaaccacagtcagaagtgtagactttttacaggtttataaaatacattga

SEQ ID NO: 16699 - protein, 478 aa, Leptospira interrogans
MPCMKILNRKKTKIVCTIGPASSSEETILSILKAGMDIARMNFSHGTHDSHKRVYDTLRKCEQIFGFPLGIMADLQGPKIRTGKLKLNSILLHKNQEIEIVPDSDILGDEHKIGCTYPNLIRDIQEEDKILIDDGKLILKVISKKSNSAILKVIVGGILWSNKGINLPGTPISAPALSEKDIEDLKFALSLGVDYAALSFVRTGADLELARSYLEGTYTGLIAKIERPEAIGNIEEIIERADGIMIARGDLGVEIDTEKVPILQKELIYKLNQAGKPVITATQMLESMIENPRPTRAEASDVANAVMDGTDAVMLSAESANGHYPVESVEIMSKIIQETETIDHIYEIHWNIKKTFLESERTALGNAAREIAHGIHAKAIVNFTRSGYSALITSEMRPKVPIYSFTPFATTARKMKLYRGVVPFVMPFFTRLEDMIAYMNQKLKEDEFLFPGDKVVILSGAPGTTVRSVDFLQVYKIH

SEQ ID NO: 16700 - DNA, 1530 bp, Bifidobacterium longum
  CDS (1)..(1530)
atgagtcggctcgcgctagtagactgggtttcggcaaatggggcaatcgcgcctcgaaccaaattgaacaagaataggcaggcattcatgcgtaaagccaagatcgtagacaccatcggtccttccaccgaggattacgacaacctcctgaagctcgttgaagctggtatggacgttgctcgtctgaaccgctcccacggcacccccgaggatcacctcaaggtctacaacaacgtgcgcaaggccagcgaagccactggtcgcaacgttgccgcgctcgttgatttgcagggcccgaagattcgctgcggttggttcaagaagaacgccgatggcgaagacaaggttcagctgcagctcggccaggaattcgtcatcaccactgatgacgtcgagggcgacgagcacatcacctccaccaccttcaagggcctgccgggcgattgccacccgggcgacccgatcctgatcgatgacggcaaggtccgtcttgaggtcaccaaggtcgagggcaacaacgtgtacaccaaggtcgtcgtggccggtcctgtgtcctcccacaagggcatcaacctgccgggcgtcgccgtctccctgccggctctgaccgagaaggatgaggccgacctgcgttgggccatccgcaccggtgccgacatcatcgccatgtccttcgtgcgtttcgccaccgacatcgaccgcgcccacgagatcatggacgaggaaggccgtcgcatcccgatcatcgccaagatcgagaagccgcaggctctggagaacctcgaagagatcgtcaagaccttcgacggcgtcatggccgcccgtggcgacatggccgttgagtgcccgctggaagaggtcccgctggccactaagcgcatcatcgagctggctcgccagtacgccaagccggtcatcgtggctaccgaagtcctcggctccatggtgaactccccggttccgactcgtgcagaggcttccgactgcgccaacgccatcctcgacggctccgacgccaccatgacctccaacgagaccgccgttggtaagtacccggatgtgaccgtggccaccatggcccgtatctccggctacgccaccgaccacggcttcgaccgtatcccggagctcaagaaccttgacatgtcctccaccggcgctgtctcctccgccgctgtggacctggccgacaagctcaacgccaaggccatcgttgcttacacccagaccggtgccaccgtgcaccgcgtctcccgtgagcgtccggccgccccgatctacggcctgaccagcaacgagcacacctaccactggctggctctgtcctggggcaccgaagccttcctgctcaaggaggactaccacgacaagtcccgcaaggatctcatggtctacacggacaaggtcctcaaggatgctggcaaggttgctgacggcgacaagatcgtcatcctgagctctgctcagggcgatcaccagccgggccgcactgactccatctacgtgcacaccgttggcgcttgcgactga

SEQ ID NO: 16701 - protein, 509 aa, Bifidobacterium longum
MSRLALVDWVSANGAIAPRTKLNKNRQAFMRKAKIVDTIGPSTEDYDNLLKLVEAGMDVARLNRSHGTPEDHLKVYNNVRKASEATGRNVAALVDLQGPKIRCGWFKKNADGEDKVQLQLGQEFVITTDDVEGDEHITSTTFKGLPGDCHPGDPILIDDGKVRLEVTKVEGNNVYTKVVVAGPVSSHKGINLPGVAVSLPALTEKDEADLRWAIRTGADIIAMSFVRFATDIDRAHEIMDEEGRRIPIIAKIEKPQALENLEEIVKTFDGVMAARGDMAVECPLEEVPLATKRIIELARQYAKPVIVATEVLGSMVNSPVPTRAEASDCANAILDGSDATMTSNETAVGKYPDVTVATMARISGYATDHGFDRIPELKNLDMSSTGAVSSAAVDLADKLNAKAIVAYTQTGATVHRVSRERPAAPIYGLTSNEHTYHWLALSWGTEAFLLKEDYHDKSRKDLMVYTDKVLKDAGKVADGDKIVILSSAQGDHQPGRTDSIYVHTVGACD

SEQ ID NO: 16702 - DNA, 1890 bp, Lactobacillus delbrueckii
  CDS (1)..(1770)
atgaaaaaaacaaagattgttagtactttaggaccagcttcaaacgatattgaaactattaccaagttagccgaagcaggcgcaaacgtattccgtttcaacttctcacacggcgaccacgaagaacacttggcaagaatgaacatggttcgtgaagttgaaaagaagactggcaagcttttgggcatcgctttggacaccaagggtgctgaaatcagaaccactgaccaagaaggcggcaagttcactatcaacactggtgacgaaatccgcgtgtcaatggacgcaactaaggccggcaacaaggacatgatccacgttacctacccaggtctgttcgacgacactcacgtaggcggcactgtattgatcgacgacggtgctgttggtttgactatcaaggccaaggacgaagaaaagcgcgaattgatttgtgaagctcaaaacactggtgtcatcggctcaaagaagggtgttaacgctccaggtgttgaaatccgcctcccagggattactgaaaaggacactgacgacatccgctttggtttgaagcacggtattaacttcatctttgcttcttttgtacgtaaggctcaagacgttcttgacattcgcgcactttgcgaagaagctaacgcaccatacgttaagatcttcccaaagattgaatcacaagaaggtattgacaacatcgacgaaatcttgcaagtttcagatggtttgatggttgcccgtggtgacatgggtgttgaaatcccattcatcaacgtgccatttgttcaaaagactttgatcaagaagtgcaacgctttgggcaagccagttatcactgctactcaaatgctggactcaatgcaagaaaacccacgtccaacccgtgccgaagtaactgacgttgctaacgccgttcttgacggtactgacgcaactatgctgtcaggcgaatcagcaaacggtttgtacccagtagaatcagttcaagctatgcacgacatcaatgttcggactgaaaaggaaatggacacccggaacactctggctctgcaacgctttgaagaatacaagggctcaaacgttactgaagctatcggcgaatcagttgtccgcactgctcaagaactgggcgttaagactatcatcactgctactagctccggctacacagctcgtatgatctccaagtaccgtccagacgcaaccatcgttgccttgactttcgacgaaaagatccaacactcattgggtatcgtttggggcgttgaaccagttttggcaaagcaaccttcaaacactgacgaaatgttcgaagaagctgcccgcgtagctaaggaacacggtttcgttaaggatggcgacctggtaatcatcgttgccggcgtaccattcggccaatcaggtactactaacttgatgaagctgcaaatcatcggcaaccaacttgctcaaggtttgggcgtaggcactggctcagttatcggcaaggctgttgttgcgaacagcgctgaagaagccaacaataaggttcacgaaggcgacatcctggtagctaagactactgacaaggactacatgccagctatcaagaaggccagcggtatgatcgttgaagcttccggcttgaccagccacgcagctgttgtcggcgtatcactcggcattccagttgttgtcggtgctgctgacgcaacttcaaagatcgctgacggctcaactttgactgttgacgcacgtcgcggcgcaatttaccaaggtgaagtttcaaacctgtaatctaggattgcaagtctgacaaccacagaagaaagagttcaatcaatcgattgagctctttttctttgccaattttttctctgctttctttaatgattgccttgaatatagctaaggcaa

SEQ ID NO: 16703 - protein, 589 aa, Lactobacillus delbrueckii
MKKTKIVSTLGPASNDIETITKLAEAGANVFRFNFSHGDHEEHLARMNMVREVEKKTGKLLGIALDTKGAEIRTTDQEGGKFTINTGDEIRVSMDATKAGNKDMIHVTYPGLFDDTHVGGTVLIDDGAVGLTIKAKDEEKRELICEAQNTGVIGSKKGVNAPGVEIRLPGITEKDTDDIRFGLKHGINFIFASFVRKAQDVLDIRALCEEANAPYVKIFPKIESQEGIDNIDEILQVSDGLMVARGDMGVEIPFINVPFVQKTLIKKCNALGKPVITATQMLDSMQENPRPTRAEVTDVANAVLDGTDATMLSGESANGLYPVESVQAMHDINVRTEKEMDTRNTLALQRFEEYKGSNVTEAIGESVVRTAQELGVKTIITATSSGYTARMISKYRPDATIVALTFDEKIQHSLGIVWGVEPVLAKQPSNTDEMFEEAARVAKEHGFVKDGDLVIIVAGVPFGQSGTTNLMKLQIIGNQLAQGLGVGTGSVIGKAVVANSAEEANNKVHEGDILVAKTTDKDYMPAIKKASGMIVEASGLTSHAAVVGVSLGIPVVVGAADATSKIADGSTLTVDARRGAIYQGEVSNL

SEQ ID NO: 16704 - DNA, 2043 bp, Stigmatella aurantiaca
  CDS (463)..(1896)
ctgcagcgcctcttcgacacggtgaaccggctgtacttccaggatggcatccaggcccggatcggctggggccgcatgccgccccggcgccgccggaagtccattcgtttgggtgtctatgatcatcagacgcgggagatccgcatccacccggcgctggaccggccggaggtgcccgcgttctttgtggagttcatcgtcttccacgaaatgctccaccagttgtttcccagcacgggccggggcgggcgccgggtgcaccacccgcgcgcgttccgggagcgggagaaggccttcccccactacggcctggcgctgcggtgggagcgggagaatctgggcgtgctgctccggggctgaagccctgggccgcctggaggcccttttaccgttttaccgggcggtggacgtgcgcagcatgcttgaccgagcgcggtgcgcgcccccatcctccgtgcccttatgcgacgagcaaagattgtctgcacccttggtcccgccagccagagccaggacatgttagaggccctcatcgaggccggcatggacgtggcccggttgaacttctcccacggcagtcacgagcagcacgcggagaacatcgccaaactccgcgcggcttcgctgaagcttcgcaaggcggtgggcatcctcggagacctgcaaggaccgaagatccgcacgggccgcttcatcaccggcagcacggtgctgaaggaaggcgccatcttttccatcaccaccgacgagagcgtgaagggcaacgacgacatcgtgtccaccacgtacgcgcacctggcggcggacgtgaatcccggggaccgcatcctcttggatgacggcctgctggagctcaaggtcctcgagacggacaagaagcagctcctgcgcacgcaggtcgtcatcggcggcacgctgaagaacaacaagggcatcaacctgccgggcgtggcggtgcgcgccgacgcgctgacgccgaaggaccgcgaggacctcgtcttcggcatcaaggaaggcgtggacttcctggcgctgtccttcgttcgccagccggcggacatcgagctggcgcgccaggccatggcggaggcgggccggcaggtgcccatcgtcgccaagctggagaagccggaggccatcgcgcggctggacgccatcctggacaagacggacggggtgatggtggcgcgcggcgacctgggcgtggagattccccccgaggaggtgccggccgtccagaaggacatcatccggcgctccaaccagcgcggcctgccggtcatcgtggccacgcagatgctcaactcgatgatcgagaacccccgccccacgcgcgcggaggccagcgacgtggccaacgccgtgttcgacggggcggacgcggtcatgctctcgggcgagacggccagcggccgctaccccatcgagtcggtgcagatgatggaccgcatcgtcctggcggccgagtcggcgggtcgggcgcagtcgtcgctgggccggatcccggatgggcccatcggcgtgccctcgcacttcccggacgtgattgcccgggtggcgtgccaggcggcgcaggcgagcggcgcttcgctcatcgcggcgttcacgctgtcgggcgtgacggcgcggctgctggcgcactaccggccggcggtccccatcgtggcgttcagcccgaaccaggaagtgcgccgccgcctggcgctgctctggggcgtggtgccgcgggtgctggagcccatccaggagaccgaggcgatggtgaagcgcgtggaggaggaactgctggcgcgcggactggcgcgcaagggcgagcgcatcgtcatcgtctttggcgcgcccgtgggacagccagggaagatcaacagcctgcgcctgcacaccatccagggctgaggcgagggggcccgagggccccgggccgcgcgagggaggctacttcgcgcggttcatcaccttgcggacgatctccgcctcgttgaacaccgtgaggaggtcccggtcgagctggccggaggaggcctcccgggagaggatgtcgac

SEQ ID NO: 16705 - protein, 477 aa, Stigmatella aurantiaca
MRRAKIVCTLGPASQSQDMLEALIEAGMDVARLNFSHGSHEQHAENIAKLRAASLKLRKAVGILGDLQGPKIRTGRFITGSTVLKEGAIFSITTDESVKGNDDIVSTTYAHLAADVNPGDRILLDDGLLELKVLETDKKQLLRTQVVIGGTLKNNKGINLPGVAVRADALTPKDREDLVFGIKEGVDFLALSFVRQPADIELARQAMAEAGRQVPIVAKLEKPEAIARLDAILDKTDGVMVARGDLGVEIPPEEVPAVQKDIIRRSNQRGLPVIVATQMLNSMIENPRPTRAEASDVANAVFDGADAVMLSGETASGRYPIESVQMMDRIVLAAESAGRAQSSLGRIPDGPIGVPSHFPDVIARVACQAAQASGASLIAAFTLSGVTARLLAHYRPAVPIVAFSPNQEVRRRLALLWGVVPRVLEPIQETEAMVKRVEEELLARGLARKGERIVIVFGAPVGQPGKINSLRLHTIQG

SEQ ID NO: 16706 - DNA, 1437 bp, Bartonella henselae
  CDS (1)..(1437)
atgaagcgtgcacgtaaagtaaaaattatagccactcttggcccttcttcgttttctatttccatgattgagaagctttttatggcgggagcagatgtttttcgtttgaatatgagccatactgaccgtgaaacaatggttgatttggttcagcgcatacggaaggttgaaaaaactgttcgccggccaatcggtattttagtagatctccagggaccaaaattacgcgtcggctgttttgataaagggcaagaagatttgcgtattgggcaaagttttaccttggatgatcgtgatattcttggtgatgcgcagcgtgttttttttccgcacggggaggtgctggcagctattaaacccggtgatcggttgttaattgatgatggaaagttggaactgcttgcacaggtgtgtgatggtcattctgtgcagtgccttgtggttgctgggaaccgtatttctgatcgaaaaggggtaagtcttcccgatacagttttgccttttgggccaatgactctcaaggataaagccgatcttcaggcagttttggagcagcctgttgattgggttgctctgtcttttatccagcgtccggaagatattatagcagtgcgtgcgttgaccaaaagcaaagtgtctttgatggctaagatcgaaaaacctcaagctttggagcatatagaagagattattgatgttgccgatggtattatgattgcacgcggagatctgggggtagaaatgcccttggagagggttcctgccattcagatggaacttataaaagcttgtcgtttagctggaaagcccgtcgtggtggccacgcaaatgctcgagtcaatgattacgtcatctgttcctacaagggcagaagtttctgatgttgcgacagcagtttatacgggaactgacgctgtcatgttgtctgcggaatctgcctctggtcgttatcctgaagaagctgtgctgatgatggatcgaatcgcacaacaaattgaacaagatcagacttatgcggctcaagttggcgcacagcatcctgctccagaatcaacggggaccgatgcgatttctctcgctgcgcgtcagatcgccgaaacactgcaattgacagctatcgttgcttatactgcttcaggcacaacgggtgtgcgcacatcacgggagcgtccaaacaggcccattattgccttatcgcctattgtaaaaacagcaagacgtttggctttggtctggggacttcattgtgtggtcactgaagacgcgcgggatttggaggatatggttgatcgtgcggctgcgattgcttttcaagaaggcttttgccaagggggagatcgcttccttgtgacagctggtgttcctcttggtacacctggtgctaccaatctcttgcgtatcgcttctgtttctcaagatggaacaaagggtgtttaa

SEQ ID NO: 16707 - protein, 478 aa, Bartonella henselae
MKRARKVKIIATLGPSSFSISMIEKLFMAGADVFRLNMSHTDRETMVDLVQRIRKVEKTVRRPIGILVDLQGPKLRVGCFDKGQEDLRIGQSFTLDDRDILGDAQRVFFPHGEVLAAIKPGDRLLIDDGKLELLAQVCDGHSVQCLVVAGNRISDRKGVSLPDTVLPFGPMTLKDKADLQAVLEQPVDWVALSFIQRPEDIIAVRALTKSKVSLMAKIEKPQALEHIEEIIDVADGIMIARGDLGVEMPLERVPAIQMELIKACRLAGKPVVVATQMLESMITSSVPTRAEVSDVATAVYTGTDAVMLSAESASGRYPEEAVLMMDRIAQQIEQDQTYAAQVGAQHPAPESTGTDAISLAARQIAETLQLTAIVAYTASGTTGVRTSRERPNRPIIALSPIVKTARRLALVWGLHCVVTEDARDLEDMVDRAAAIAFQEGFCQGGDRFLVTAGVPLGTPGATNLLRIASVSQDGTKGV

SEQ ID NO: 16708 - DNA, 1533 bp, Glycine max
  CDS (1)..(1533)
atggcgaacatagacatcgaagggatcttgaagcagcagcctgatgatgggcgcgttccgaagacgaaaatagtgtgtactttgggccccgcttctcgatccgtggaaatgactgagaagcttcttagggctgggatgaacgttgctcgtttcaatttctctcatggcacccacgactatcatcaggaaaccctcaacaatctcaagactgctatgcacaacactggtatactctgtgccgtcatgcttgacactaagggacctgagattcggactggttttctgaaagatggaaaacctattcaacttaaggaaggacaagaaatcaccataactactgattatgacattaagggggatcaggagatgatatccatgagttacaagaagctgcctgtccacttgaagcctggaaacaccatattgtgctctgatgggacgattactctcactgtcttatcttgtgatcctgatgctggtactgttagatgtcgttgtgaaaacactgctacgttgggtgagagaaaaaatgttaaccttcctggtgttgttgttgatctccccacacttactgagaaggataaggaagatattcttcaatggggtgtacccaacaagattgacatgattgctctttcatttgttcgcaaaggctcagatcttgttaatgtccgcaaggttctcgagccacatgcaaagactattcagttgatgtctaaggttgagaatcaggaaggagtcctgaattttgacgaaatcctgcgcgagactgatgcattcatggtggcacgaggtgatcttggaatggagatcccagttgaaaagatattcctggcgcagaagatgatgatatacaagtgtaatctggttgggaagccagtggtgactgctacccaaatgcttgaatcaatgataaagtctcccaggccaacccgagctgaagcaactgacgtagccaatgcagttcttgatggaacagattgtgtgatgcttagtggtgaaagtgctgctggggcatacccagaacttgctgtgaaaatcatggctcgtatctgcattgaagcagaatcatcccttgactatggtgccatcttcaaagagatgataaggtctacaccattgccaatgagtccattggagagccttgcatcatctgctgtccgcacagcaaacaaggccaaagcaaaactcattgttgtactgacacgtggcgggtctacagctaagttggttgctaagtataggccagcggttccaatattatcggtggtggttccagtgttgagcacagactcatttgattggacatgcagtgatgagacgccagcaaggcacagcttgatatataggggcttgattccaatattgggggagggatccgccaaggctactgatgcagaatctacagaggtcattctcgaagctgctcttaagtccgcaacacaaaggggcctttgtaagcctggtgatgcagttgttgccctgcatcgtattggcactgcctctgtcataaagatctgcatagtcaaataa

SEQ ID NO: 16709 - protein, 510 aa, Glycine max
MANIDIEGILKQQPDDGRVPKTKIVCTLGPASRSVEMTEKLLRAGMNVARFNFSHGTHDYHQETLNNLKTAMHNTGILCAVMLDTKGPEIRTGFLKDGKPIQLKEGQEITITTDYDIKGDQEMISMSYKKLPVHLKPGNTILCSDGTITLTVLSCDPDAGTVRCRCENTATLGERKNVNLPGVVVDLPTLTEKDKEDILQWGVPNKIDMIALSFVRKGSDLVNVRKVLEPHAKTIQLMSKVENQEGVLNFDEILRETDAFMVARGDLGMEIPVEKIFLAQKMMIYKCNLVGKPVVTATQMLESMIKSPRPTRAEATDVANAVLDGTDCVMLSGESAAGAYPELAVKIMARICIEAESSLDYGAIFKEMIRSTPLPMSPLESLASSAVRTANKAKAKLIVVLTRGGSTAKLVAKYRPAVPILSVVVPVLSTDSFDWTCSDETPARHSLIYRGLIPILGEGSAKATDAESTEVILEAALKSATQRGLCKPGDAVVALHRIGTASVIKICIVK

SEQ ID NO: 16710 - DNA, 1527 bp, Xanthomonas campestris
  CDS (1)..(1527)
atgccatcctcggtacgtgacgcgtgtgttaagtttcgcggcttttacagggaggccatcatgaaagaacgtcaacgccgcaccaagatcctcgccacgctgggaccggccacggatccgcctggtgtgctggacgccttgttcaaggcgggcgtcaacgtggtgcgcctcaacttcagccacggcgacccgtccggccaggccaagcgcgctgccgaagtgcgtgccgccgccgtccgcgtcggcgccgaagtgggcatcctggccgacctgccgggcccgaagatccgcatcgagcgctttgccggaggcaagatcaagctgaccatgggcgatcgtttcgacctggtggccgatatcaatgcgccggccggcgatcagcatcaggtgggcgtgagctacctgggcctgccgcaggatgtcaccgccggtgacgtgctgctgctcgacgatggcctggtgcagctgcaggtcaccgacgtgcagggcgcgcgcatcgtcaccaccgtgctcaacgatggtgtgttgtccgaccgcaagggcctcaacaagcagggcggcggtctgtcgctgggcgcgttgaccgagcgcgacaaggagctgatcggcatcgtggccaagatcggcgtggacttcatcgcggtgtcgttctgccgtaacgcgcaggacatgcacgacgcccgccagatcgcccagcagcacggctgcgatgcgcagttggtgtccaagatcgagcgcaccgaagcgatcgagaacctggtcgaaatcgtcgaagcctccgacgtggtgatggtggcgcgtggcgatctgggcgtggaaatcggcgatgccgaattgccgggcctgcagaagaagatcattcgcgagtcgctggcgcagaacaaggtggtgatcacggccacccagatgctgcagtcgatggtggaaagcccgatcccgacccgcgccgaagtactcgacgtggccaacgcggtcatcgacggcaccgatgcggtgatgctctcggccgaaaccgctgccggtgcgtatccggtgcgtgcagtggaagcgatggcgcgcatctgcctgggcgccgagcaccagttcgagttcgataccgacttcgaagcggcgcaacgcaacctgcagcgcgccgaccaggcgatcgcaatggcgaccatgttcctgtccgagcacatcggtctgggcggcgtggtggcgttgaccgaatccggcggcacgccgcgttacctgtcgcgcttccgttccaatatgccgatctatgcattcacccgtcatgacggcgcgcgtcgccagatggcgatgatgcgtggcgtgttcccgatcggtttcgacagccgtggcctgaccccacgcgaagccgcgcgcgcagcgatccgcctgctggtggagaacgagcgcatggggcctggcgaccgcgtggtgttcaccagcggcgagcacatggaaacccatggcgccaccaacacgctgcgtctgctggaagtgggcgaagacggccgcgccagcggtctgggcgagctgtag

SEQ ID NO: 16711 - protein, 508 aa, Xanthomonas campestris
MPSSVRDACVKFRGFYREAIMKERQRRTKILATLGPATDPPGVLDALFKAGVNVVRLNFSHGDPSGQAKRAAEVRAAAVRVGAEVGILADLPGPKIRIERFAGGKIKLTMGDRFDLVADINAPAGDQHQVGVSYLGLPQDVTAGDVLLLDDGLVQLQVTDVQGARIVTTVLNDGVLSDRKGLNKQGGGLSLGALTERDKELIGIVAKIGVDFIAVSFCRNAQDMHDARQIAQQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRYLSRFRSNMPIYAFTRHDGARRQMAMMRGVFPIGFDSRGLTPREAARAAIRLLVENERMGPGDRVVFTSGEHMETHGATNTLRLLEVGEDGRASGLGEL

SEQ ID NO: 16712 - DNA, 1506 bp, Xanthomonas axonopodis
  CDS (1)..(1506)
atgtgtgttaagtttcgcggcttttacagggaggccatcatgaaagaacgtcaacgccgcaccaagatcctcgccaccctcggaccggcaacggatgcgcccggtgtgctggatacgctgttcaaggcgggcgtcaacgtggtgcgcctcaacttcagccatggcgacccctccggccaggccaagcgtgccgccgaagtgcgtgccgctgcggcccgcgtcggtgccgaagtcggcatcctggccgacttgccgggcccgaagatccgtatcgaacgttttgccgaaggcaagatcaagctgaccatgggcgatcgcttcgacctggtggccgatgccaacgcgccggctggcgaccagacacaggttggcgtcagctatctgggtctgccgcaggacgtgaccgccggcgacgtcctgctgctcgacgatggcctgatgcagttgcaggtcaccgatgtgcagggcgcgcgcatcgtcaccaaggtgttgaacgatggcgtgctgtccgaccgcaagggcctcaacaagcagggcggtggtctgtcgctgggcgcgttgaccgaacgcgacaaggaactgatcggcatcgttgccaagatcggcgtggacttcatcgcggtgtcgttctgtcgtaacgcgcaggacatgcacgacgcacgtcagatcgcccagcagcatggctgcgatgcgcaactggtgtccaagatcgagcgcaccgaggcgatcgaaaacctggtcgagatcgtcgaagcctccgatgtggtgatggtggcgcgtggcgacctgggcgttgaaatcggcgacgccgaattgccgggcctgcagaagaagatcattcgcgaatcgctggcgcagaacaaggtggtgatcaccgccacgcagatgctgcagtcgatggtcgaaagcccgatccccacccgcgccgaagtgctggacgtggccaacgcggtcatcgacggcaccgacgcggtgatgctctcggccgagaccgccgccggcgcctacccggtgcgtgcggtggaagcgatggcgcgcatctgtctgggggccgaacaccagttcgagttcgataccgacttcgaagcggcgcaacgcaatctgcagcgcgccgaccaggcgattgcgatggcgaccatgttcctgtccgagcacatcggcctgggcggcgtggtggcgttgaccgaatccggcggcacgccgcgcttcctgtcgcgcttccgctccaatatgccgatctacgccttcacccgtcacgatggcgcacgccgccagatggcgatgatgcgtggcgtgttcccgatcagcttcgacagccgcggcctgaccccgcgcgaggccgcacgtgcggcgatccgcctgctggtggagaacgagcgcatggggcctggcgaccgcgtggtctttaccagtggcgagcacatggaaacccacggcgccaccaacacgctgcgcctgctggaagtgggcgaagacggccgcgccaccggtctgggcgagctgtaa

SEQ ID NO: 16713 - protein, 501 aa, Xanthomonas axonopodis
MCVKFRGFYREAIMKERQRRTKILATLGPATDAPGVLDTLFKAGVNVVRLNFSHGDPSGQAKRAAEVRAAAARVGAEVGILADLPGPKIRIERFAEGKIKLTMGDRFDLVADANAPAGDQTQVGVSYLGLPQDVTAGDVLLLDDGLMQLQVTDVQGARIVTKVLNDGVLSDRKGLNKQGGGLSLGALTERDKELIGIVAKIGVDFIAVSFCRNAQDMHDARQIAQQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRFLSRFRSNMPIYAFTRHDGARRQMAMMRGVFPISFDSRGLTPREAARAAIRLLVENERMGPGDRVVFTSGEHMETHGATNTLRLLEVGEDGRATGLGEL

SEQ ID NO: 16714 - DNA, 1434 bp, Methanosarcina mazei Go1
  CDS (1)..(1434)
atggaaatcccggatcataaaacaaagatcgtctgtacaataggacctgcctcttcttctgaagagatgataaggaagcttatgcttgcgggcatgaacgtggcaaggataaatttttctcacggagactttgagagccactcaagggttgtccgaattatccgtaaggttgcagatgaacttggcaggacaattgcaatccttgcagacctgcctggcccgaaaatacgcataggcaaactcgaaaaagagcctgttatgctccataaagggaacccgataacccttacaattgacgacactccgggaaacgaagagagaatccctgtcagttacaaacagcttccggaaagcgtaacccctgggagccttatctacctcagtgacgggttcatacagctcctctgcaaggaggttacaggaaaagacgttctctgtgaagtccttatcggaggagagctttattcgcacaaagggctgaaccttccaggggcaaagatctttcttgacgctgtgactgaaaaagatttcaggatcctggaatttgcccttgaagaggacattgacactttcagcatctcttttgtagaaaatgcagaagatatccgaaaagtaagaaattttgccgcttccagaggaaagcaggtaaatatagtatcaaaaatagaacgcaggcaggctgtagaaaatataggagaaatccttgacgagaccgatgcccttatggttgcaaggggagacctgggagttgaaattcctatccaggaagtcccttcggtccagaaagaacttatccagagggcaaagctccttggggttcctgtgattactgcaacccatatgctggcttccatgacagataatataagacccacgcgtgccgaagccacggatgttgcaaacgctatccttgacggcacggatgctgttatgctctcggaagaaacagcagtcggaaactaccccgtggaagctgtcgagatgatggcaaagattgcaaagaccactgaaaactggcgctcccggactaaatgggggcttgacacaatgatcaaatccataactgccagggagatgtcagtggatgaggtaatcaccttacaggtttatgaagccctgcagaaactgcctgttgcagccgtacttaccccgacaaggagcggagcgactccccgcaggatttcgcgctttaatcctgacccctggattctggctttcagccgcgttcctaagacctgcaggttcctttccctgtcttacggggtttatcctgttgccgtaaacgaatctattgaaagctgggaaaaagagacaacggaaagaacaaaagaattgggatttgcgaaaagtaaagatctcgtgatttttacccagggccctgcttccggaaaacccggaggtacgaatatgctcaagatcctgacccttgactga

SEQ ID NO: 16715 - protein, 477 aa, Methanosarcina mazei Go1
MEIPDHKTKIVCTIGPASSSEEMIRKLMLAGMNVARINFSHGDFESHSRVVRIIRKVADELGRTIAILADLPGPKIRIGKLEKEPVMLHKGNPITLTIDDTPGNEERIPVSYKQLPESVTPGSLIYLSDGFIQLLCKEVTGKDVLCEVLIGGELYSHKGLNLPGAKIFLDAVTEKDFRILEFALEEDIDTFSISFVENAEDIRKVRNFAASRGKQVNIVSKIERRQAVENIGEILDETDALMVARGDLGVEIPIQEVPSVQKELIQRAKLLGVPVITATHMLASMTDNIRPTRAEATDVANAILDGTDAVMLSEETAVGNYPVEAVEMMAKIAKTTENWRSRTKWGLDTMIKSITAREMSVDEVITLQVYEALQKLPVAAVLTPTRSGATPRRISRFNPDPWILAFSRVPKTCRFLSLSYGVYPVAVNESIESWEKETTERTKELGFAKSKDLVIFTQGPASGKPGGTNMLKILTLD

SEQ ID NO: 16716 - DNA, 1752 bp, Thermoanaerobacter tengcongensis
  CDS (1)..(1752)
atgaggagaacaaaaatagtctgtacaattggacctgctagtgaggactacaatatactgagaaagttaatagaaaaaggaatgaatgtagcaaggcttaatttttcccatggagattttgaagagcacggagcgaggattgacaacataaaaaagataagggaagaattaggtcttcctgtagctattttgctggacacaaaaggacccgagattagaacgggaaagtttaaaaacggcggagtagagttaaaggaaggccagacttttacattaactacaagggatgtaataggagatgaaacggtagtcagtgtttcctacaaaggtttgcctcaagatgtttcaagaggtacccaaattttgattgatgacggattgatctcactaagggttgtggatgtcaaaggggaagacataatctgtgtagttgaaaattcgggatttcttggagaccacaaaggagtaaatgttcctggagtgaaattgaatctcccggctttgacacaaaaagacatagaagatatagagtttggcataaagaaaggtattgacatgatagctgcttcttttgtcaggaaagcggcagatgtgcttgctataaggaggcttcttgaggacaataaagcagaccacattcagataattgctaaaatagaaaaccgcgaaggagtagaaaatatagacgaaataataagggtatctgacgggataatggtggccagaggagatttgggcgttgagatacctctggaggaaataccgatagtgcagaagatgataataaagaagtgcaatgaagctggaaagccagttattactgcaacccaaatgctggattccatgatgagaaatccgcgtcctactcgtgctgaagttacggatgttgctaatgctattttggatggaacggatgccataatgctgtcaggtgagacggcccagggcaaatatcctgtcgaagcttttgagacaatggccaggattgcggaaaagacagaggtttacgtccagtacagagatatagtaggtgtaggtacagagagaaatgtttccattactaatgcgataagccatgctacctgcacgactgcgagagatataggcgcttcagctatcataacctgtacaaaatcaggttatacggctaggatggtttcaaggtataggccttcctctcctatcatagctactactcctagcgagcaggtggcaagaaagctttccatcgtgtggggagtatatcctttagtgacaaaagaagtgtcaaccacagacgaaatgatagatgttgcaatagaaagtgcgttaaaagctgggcttataaggaatggagatattgtggtgatttctgcgggaatacctgttgccatgactggcaccacaaacatgctcaaagttcacatagttggagatgtgattttaagaggtattggtataggttcaaaatctactactggcactgtgtgcataattcatgacattggcaaggacagagacaagtttagagaaggagatataattgttacaaccaagacagagagagattttatgcctcttattgaaaaagcttctgccataataacagaagaaggcgggctcacctcccacgctgctattgttgggcttaacttggggatccctgtgattgtagggtgtgaaggagctacttcaaaacttcaggatgggatgacagtcactgttgacaccacgagaggactggtgtataaaggaattgtaaacataaaatga

SEQ ID NO: 16717 - protein, 583 aa, Thermoanaerobacter tengcongensis
MRRTKIVCTIGPASEDYNILRKLIEKGMNVARLNFSHGDFEEHGARIDNIKKIREELGLPVAILLDTKGPEIRTGKFKNGGVELKEGQTFTLTTRDVIGDETVVSVSYKGLPQDVSRGTQILIDDGLISLRVVDVKGEDIICVVENSGFLGDHKGVNVPGVKLNLPALTQKDIEDIEFGIKKGIDMIAASFVRKAADVLAIRRLLEDNKADHIQIIAKIENREGVENIDEIIRVSDGIMVARGDLGVEIPLEEIPIVQKMIIKKCNEAGKPVITATQMLDSMMRNPRPTRAEVTDVANAILDGTDAIMLSGETAQGKYPVEAFETMARIAEKTEVYVQYRDIVGVGTERNVSITNAISHATCTTARDIGASAIITCTKSGYTARMVSRYRPSSPIIATTPSEQVARKLSIVWGVYPLVTKEVSTTDEMIDVAIESALKAGLIRNGDIVVISAGIPVAMTGTTNMLKVHIVGDVILRGIGIGSKSTTGTVCIIHDIGKDRDKFREGDIIVTTKTERDFMPLIEKASAIITEEGGLTSHAAIVGLNLGIPVIVGCEGATSKLQDGMTVTVDTTRGLVYKGIVNIK

SEQ ID NO: 16718 - DNA, 1428 bp, Fusobacterium nucleatum
  CDS (1)..(1428)
atgaggagtttgaaaaaaacaaaaatagtttgtactattggtcctgtgactgaatcagtagaaactttaaaagaattactaaataggggaatgaatgtaatgagattgaatttctctcatggtgattatgaagaacatggaatgagaatgaagaattttagacaagcaatgtctgaaactggaattagaggaggaatacttcttgatactaagggtccagaaataagaacaatgactttaaaagatggaaaagatgtaagtattaaggctggacaaaaatttactttcacaacagatcaatcggttgttggagataatgaaagagtagcagtaacttatgaaaattttgcaaaagatttaaaagttggaaatatggttcttgttgatgatggattattagaactagatgttgtggaaataaaaggaaatgaagttatatgtatagccagaaataatggagatctaggacaaaagaaaggaataaatttacctaatgtttctgttaatttaccagcattatctgagaaagatatagaagatctaaaatttggttgtcaaaataatgttgattttgtggcagcatcatttataagaaaagctgatgatgtaagacaagtaagaaaagttcttagagaaaatgatggagaaagaatacaaataatttctaagatagaaagccaggaagggcttgataattttgatgaaattttagcagaatctgatggtataatggtagcaagaggagacttaggtgtagaaatccctgttgaagaagttccttgtgcgcaaaaaatgatgataagaaaatgtaatagagtaggaaaaactgttattacagcaactcaaatgctagattcaatgattaaaaatccaagacctacaagagcagaagcaaatgatgttgccaatgctatattagatggtacagatgcagtaatgctttcaggtgaaactgcaaagggaaaatatccattagcagctgttgaagttatgaataaaatagctaaaaaagttgatgctacaataccaccattttacatagaaggtgttataaataaaaatgatataacttctgctgttgcagaaggaagtgctgacataagcgaaaggttaaatgcaaaacttatagttgttggtacagaatctggaagagctgcaagagacatgagaagatatttccctagagcacatattttagcaataactaataatgaaaaaactgcaaatcaattagttttatcaagagggataatttcatatgtagatgcttcaccaaaaactttagaagaattctttgttgtagcagaatctgttgcaaaaaaattaaatttagttaaaaataatgatataattatagcaacttgtggagaaagtgtatttatacaaggaacaactaactcaataaaagtaatacaagtaaaagcatag

SEQ ID NO: 16719 - protein, 475 aa, Fusobacterium nucleatum
MRSLKKTKIVCTIGPVTESVETLKELLNRGMNVMRLNFSHGDYEEHGMRMKNFRQAMSETGIRGGILLDTKGPEIRTMTLKDGKDVSIKAGQKFTFTTDQSVVGDNERVAVTYENFAKDLKVGNMVLVDDGLLELDVVEIKGNEVICIARNNGDLGQKKGINLPNVSVNLPALSEKDIEDLKFGCQNNVDFVAASFIRKADDVRQVRKVLRENDGERIQIISKIESQEGLDNFDEILAESDGIMVARGDLGVEIPVEEVPCAQKMMIRKCNRVGKTVITATQMLDSMIKNPRPTRAEANDVANAILDGTDAVMLSGETAKGKYPLAAVEVMNKIAKKVDATIPPFYIEGVINKNDITSAVAEGSADISERLNAKLIVVGTESGRAARDMRRYFPRAHILAITNNEKTANQLVLSRGIISYVDASPKTLEEFFVVAESVAKKLNLVKNNDIIIATCGESVFIQGTTNSIKVIQVKA

SEQ ID NO: 16720 - DNA, 1903 bp, Oryza sativa
  CDS (1)..(1713)
atggcggcggcggcggctgagatcgtggggtccgcggcggcgcgcatggcggcgccggcagtgaggccggctccgcccgcggcggcggcggcggcggcgcccccgcagccgaggagggccgtggcggcgcgctccctcaggacctccacctccgacagggtggcggcggatctcgcgctcgggagcaacggctccctctccgctcagaacattgctgagaataccgctgacgctacttcgcaagtggtctctgcgaattcccgtaggaagacaaagattgtttgcaccataggcccctcaaccaacacacgcgagatgatatggaaacttgctgagactggaatgaacgtcgcacgcatgaatatgtcccatggtgaccaccagtcgcaccagaaggtgattgatttggtgaaggagtacaatgcgaagaatactgatggcaatgtcattgctattatgctggataccaagggtccagaagtgagaagtggggatgttccagaaccaatcatgctcgaggaaggtcaagagttcaattttactattaaaagaggggtgagcaccaaagacaccgtcagtgtgaattacgatgacttcataaacgatgttgaagttggggacatactgttggtggatggaggaatgatgtcactcgctgtcaagtctaaaacagctgatacggttaagtgtgaagtagttgatggtggggaactgaaatcaaggcgccacctaaatgtccgtggaaagagtgcgactttgccatctattacagagaaagattgggaggacataaagtttggtgttgaaaatggtgttgatttctatgccgtttcctttgtgaaggatgcaaaagttattcatgaactgaaggactaccttaaaagtgctaatgcagatatacatgtcattccaaagattgaaagtgcagattcaataccaaacctccagtccattattgctgcttcagatggggcgatggtggcaagaggggatcttggtgctgaacttccaattgaggaagttcctttgctgcaggaggagattgtcagaacatgccgaagcatgcagaaaccagttattgttgccacgaatatgttagagagcatgatagaccatcccactccaacaagagcagaagtttctgatatagcaattgcagttcgtgaaggttctgatgccatcatgctgtctggtgaaactgcccatggaaagttcccactgaaggcagtcaaggtgatgcacacagtggcacagagaacagaatccagcctgtataacccaactacatctcctagtcttgttgcacatcctcaggctctgctcaacgaggaattttcgcaaagccaactaagcaaaatgtttggatctcatgctacaatgatggcgaacaccctttgcaccccaattattgtgtttacacgaaccggctccatggcagtccttctcagccactaccggccctcgtctacaatttttgcatttacaaatgaggaacgagtgaagcaacgtctggcactctaccagggtgtggttcccatttacatgaagttttctgatgatgcagaggaaactttctctagagcaattagtagcttgctgaacgcccaattcgtgaaagaaggggactacgtgacccttgttcagagtggagtgaagtcgatctggagagaggagtctactcaccacattcaagtgaggaaagtccagggctaatgagcctgaccgtcataccgtcacagggatgtacctgttcaaattttgtttgttacttgatgtgctaaattacgagtaacttttacggggaacaagtttggattattatatgttatgttgattttacttgtaggctctggaattgaataagataatctatattaattttcacatggttccaattggactg

SEQ ID NO: 16721 - protein, 570 aa, Oryza sativa
MAAAAAEIVGSAAARMAAPAVRPAPPAAAAAAAPPQPRRAVAARSLRTSTSDRVAADLALGSNGSLSAQNIAENTADATSQVVSANSRRKTKIVCTIGPSTNTREMIWKLAETGMNVARMNMSHGDHQSHQKVIDLVKEYNAKNTDGNVIAIMLDTKGPEVRSGDVPEPIMLEEGQEFNFTIKRGVSTKDTVSVNYDDFINDVEVGDILLVDGGMMSLAVKSKTADTVKCEVVDGGELKSRRHLNVRGKSATLPSITEKDWEDIKFGVENGVDFYAVSFVKDAKVIHELKDYLKSANADIHVIPKIESADSIPNLQSIIAASDGAMVARGDLGAELPIEEVPLLQEEIVRTCRSMQKPVIVATNMLESMIDHPTPTRAEVSDIAIAVREGSDAIMLSGETAHGKFPLKAVKVMHTVAQRTESSLYNPTTSPSLVAHPQALLNEEFSQSQLSKMFGSHATMMANTLCTPIIVFTRTGSMAVLLSHYRPSSTIFAFTNEERVKQRLALYQGVVPIYMKFSDDAEETFSRAISSLLNAQFVKEGDYVTLVQSGVKSIWREESTHHIQVRKVQG

SEQ ID NO: 16722 - DNA, 1872 bp, Oryza sativa
  CDS (1)..(1872)
atggcgcaggtggtggctgcggcagggacggcggcggcggtggcggcggtggggaggccgctgggtggcggcggatctggggccgacgcgctccgcccggcggcgaggctgtcgttcgcgccgcgctggtgcggtgggagcgcgggggcagcaagggcgcgccgcgagtccgccgtcacgtccgtgattagccgcgccccgcgtctcgacgccgaggtgctgccggtgtcggccgacgacgacgcggacgaagaagaaaacttccagcatctcaaggccattcagcaacttgcaacatcagccaatggtgtgtggtctaaaccaaatgtgagacgcaagacaaagatcgtgtgcaccattggtccttcaactaacacaaaggagatgatatggaaacttgctgaggctggcatgaatgtggctcggcttaatatgtcacatggagaccatgcatcacaccagaaagttattgacttagtaaaggaatataatgctcaaacaaaggataacgtgattgctattatgcttgacacgaagggaccagaagttaggagtggagatttgcctcaaccaataatgttggaaactggccaggagttcactttcacaattaagagaggagttgggactgagacatgtgttagcgttaactatgatgactttgttaatgatgtagaagtgggtgacatgctcctcgtagatggtggaatgatgtcgttgttggtcaagtccaaaactgaagattcggtaaaatgtgaagttattgatggaggtgaactgaaatccaggcgtcacctgaatgttcgtggaaagagcgcaaccttgccatcaataactgacaaggattgggatgatattaagtttggtgtggagaatcaagttgactactatgccgtttcttttgtcaaagatgctcaagttgtgcatgaattgaaggattatctcagaagctccaatgccgatatacatgtaattgtaaagattgaaagtgcagattccattccaaacctacactcaatcatcacagcatcggatggggctatggttgccagaggtgacttgggagctgaactccctattgaggaggtaccgctgctgcaggaagaaattattagaatgtgcaggagcatgggaaaagctgttattgttgccactaatatgctagaaagtatgattgttcatccaactccaacccgagcagaagtttcagacattgctatagctgttcgagaaggttctgatggcattatgctttctggggaaactgcacacggaaagtttcctttgaaagctgttaaggtcatgcatactgttgccctgagaactgaagccactatgtctggtggggaaacaccggctaaccttggtcaggtgttcaagaatcacatgagtgaaatgtttgcataccattcaacaatgatgtccaacactcttggaacatcaattgtggttttcaccaggacaggatttatggctatcctacttagtcattaccgcccttctggcaccatttttgcctttacggaccaggagagagttagacaacgattggctttgtaccaaggtgtatgtccagtccagatggaattttctgatgatgctgagaagacatttggtgacgctttgtcatacttgctgaaacatggtatggtgaaggaaggcgaggaggttgcacttgttcaaagtggcaggcaacctatctggcggtcgcagtccacccataatattcagcaaaaccttaggcctgatgataataccacgctggcattactggcatcatttaactgtgagcttagtgagttgtgtgcaagacatgagagagccattgttgtgattctatattcgttgctaaatatgttaccttgcatgtaa

SEQ ID NO: 16723 - protein, 623 aa, Oryza sativa
MAQVVAAAGTAAAVAAVGRPLGGGGSGADALRPAARLSFAPRWCGGSAGAARARRESAVTSVISRAPRLDAEVLPVSADDDADEEENFQHLKAIQQLATSANGVWSKPNVRRKTKIVCTIGPSTNTKEMIWKLAEAGMNVARLNMSHGDHASHQKVIDLVKEYNAQTKDNVIAIMLDTKGPEVRSGDLPQPIMLETGQEFTFTIKRGVGTETCVSVNYDDFVNDVEVGDMLLVDGGMMSLLVKSKTEDSVKCEVIDGGELKSRRHLNVRGKSATLPSITDKDWDDIKFGVENQVDYYAVSFVKDAQVVHELKDYLRSSNADIHVIVKIESADSIPNLHSIITASDGAMVARGDLGAELPIEEVPLLQEEIIRMCRSMGKAVIVATNMLESMIVHPTPTRAEVSDIAIAVREGSDGIMLSGETAHGKFPLKAVKVMHTVALRTEATMSGGETPANLGQVFKNHMSEMFAYHSTMMSNTLGTSIVVFTRTGFMAILLSHYRPSGTIFAFTDQERVRQRLALYQGVCPVQMEFSDDAEKTFGDALSYLLKHGMVKEGEEVALVQSGRQPIWRSQSTHNIQQNLRPDDNTTLALLASFNCELSELCARHERAIVVILYSLLNMLPCM

SEQ ID NO: 16724 - DNA, 1950 bp, Drosophila melanogaster
  CDS (102)..(1766)
cgtaaaacgtcacagagttttttttataactgcagagtgattgattttaatggtagttgcccaaaattttaagttatttctcttatcccaaatttacaaccatgtcgttgtccgcgaaatccgtgctaaaggagggctccacacagctgagccacatctgcgagctggatcttgcccagcaggcgtcccatcagcgcctggtgtccctgatcgcgaccatatcggtcagttcccggaacgcggacaccatatacaccatgataatgcgcggagtgaacatattccgtctgaacttctcccacgaatcgcacgagatgcactcgaaaacgatagagctgatcaacgaggcgctggagaggattcataaggagacgggccaaatccgaacggtcgccattgcggcggacacgcgtggaccccagatccgtactggcctactggatggagatgtgttcctgcgcagcggcgacaatctgcggctctcgatcaatcgggatctttacgacaagggcaacaaggaggcggtctacgtggactacccgaacatcatcaatctgaccaagaccggcgatcgcctgttcatcgacgacggcaggctgctgctccacatcttggaagtgggagtggatggtctgctgtgcgaggtcatccatggcggccagctgaacaacaactgcaacgtgatcctgccggagatcgagatcgatttgcccgccgtctccgagaaggatatgtttgacatccagttcagcataaaggccaacgtggacttcctcttcgcctccgccgtgcgcagtgccaagaacgtcaaggagctgcgaacggtgctcggcgagaagggcaagcacatcaagatcatcgccaagatggacagcaagatagctctgagcaggttctcggagattctgcgtgcggcggatggattgctgctttcgcgagcggatctgggcacccagatacccattgaaaagctcttcatcacccagaagagcatactgggccaatgcaacaaggtgggcaagccggtcatagtggcctcccacatcctcgagtccatgcgcaccctgccccatcccacacgggccgagtgcttcgatttggccaacgccatcatcgatggagcagactgcatcatgctgtcgtcggaagtggccattgggtcgtttcccaaggagacggtggccacctgcgacacattgtgccgggaggccgagaaggtgctctggtttcgagacctcttctccgacctggtcagcgaggtgcgtggcgagctggacgcggcccactcgctggccattgcagccgtggagacggccaagcgcaccaatgccaccctgatcatcgtgctgaccacctcgggccgctcggccactctggtcagcaagttccgaccccgctgtcccatcatggctatcacgcgctgcgaacggaccgcccgctgggtctatctgcatcgcggagtcctgccgatactgtacacctcggagcccagcacggactacgccaccgatgtggacgctcgggtgcagttcgccatgacctctgccaagaagtggggcatcatcgacgacggcgatcccattgtgatagtgagtgcctggaaggatggcggcgggttcaccaacaatgtccgtgtggtctacgccttcttcgaggcggatcgcgtggactgcctgttccggtcggacaggcggcattctcgaaagaacaccaacctgcagatggcaaatcgggagcctgatgataagaaaagtgctaatgcgtagctgagcccggagaaatggaccttggttgcctcaaatgtaatcatcaaataaattattttggaagatcgttattttactttcgtcccagtattgttttttatattttattttatctgtacaaaattagaaaagcctctattctagtaaaatttcgatacgtacttaaaaaaaaaaaaaaaaaaaa

SEQ ID NO: 16725 - protein, 554 aa, Drosophila melanogaster
MSLSAKSVLKEGSTQLSHICELDLAQQASHQRLVSLIATISVSSRNADTIYTMIMRGVNIFRLNFSHESHEMHSKTIELINEALERIHKETGQIRTVAIAADTRGPQIRTGLLDGDVFLRSGDNLRLSINRDLYDKGNKEAVYVDYPNIINLTKTGDRLFIDDGRLLLHILEVGVDGLLCEVIHGGQLNNNCNVILPEIEIDLPAVSEKDMFDIQFSIKANVDFLFASAVRSAKNVKELRTVLGEKGKHIKIIAKMDSKIALSRFSEILRAADGLLLSRADLGTQIPIEKLFITQKSILGQCNKVGKPVIVASHILESMRTLPHPTRAECFDLANAIIDGADCIMLSSEVAIGSFPKETVATCDTLCREAEKVLWFRDLFSDLVSEVRGELDAAHSLAIAAVETAKRTNATLIIVLTTSGRSATLVSKFRPRCPIMAITRCERTARWVYLHRGVLPILYTSEPSTDYATDVDARVQFAMTSAKKWGIIDDGDPIVIVSAWKDGGGFTNNVRVVYAFFEADRVDCLFRSDRRHSRKNTNLQMANREPDDKKSANA

SEQ ID NO: 16726 - DNA, 1470 bp, Methanosarcina acetivorans
  CDS (1)..(1470)
atgaatataaacgtgaatataaacggccgtgaaaatatgcaaatccctgaccataaaacaaagatcgtctgcaccataggccctgcttccttctccgaggaagtcctcaggaaactggtgcttgcgggaatgaacgttgcaaggattaacttttcccacggagacttcgagagccacggaaaagttatccggagggtccgaaaggttgcagaagagcttgacaggacagttgctatccttgccgacctcccaggcccgaaaattcgcgtaggcaagctcaaaaaagagccgcttatgctccataaagggaaccgaataacccttaccactgacgagacttctggaagcgaggaccgcatcccggtcaactacaaacagctccctgagagcgtctccccgggaagccttatctacctgagtgacggatttatccagctcctctgcctggaaatctcgggaaaagatgtagtctgcgaagttatggtcggaggacaactctactcccataaagggctgaacctgccaggggcaaaaatttacctggactctgtgacggaacatgacttcaaaatccttgagtttgccctgaacgaagaagttgacgcagtcagcatctcttttgtggaaaaagccgaagatatccgaaaagtccggaattttgcttcaaccatgggaaaacctgtatacgttgtctcaaaaatcgaacggagccaggcggtccagaatatagaagagatccttgaggaaaccgatgccctgatggttgccagaggagacctgggagttgagattcctatccaagaagtaccttcggtccagaaagaactcatccggagtgcaaagctcctgagcatccccgtaattactgcaacccacatgctggcctccatgaccgacaacatcaggcctacaagggcggaggctacagacgttgccaacgccatccttgacgggacggacgcggtcatgctctcggaagaaaccgcagttgggaactatcccgtggaaactgtggagatgatggcaaaaattgcaaaaacaacagaaaactggcgctcccgaacgaagtggggacttgacacaatgctcaagggaattacggcacagaaaatgtcagtggacgaggtaatcgctctccaggtacacgaagccctgcaaaagcttcctgtagccgttgtactcaccccaacccgaagcggagcaaccccgcgcaggctttcccgcttcaagcctgaaccctggatcctggctttcacccgcttcccgaaaacctgtagctcccttgccttgtcctatggggtttatccgataatagtaaaagaagtctctgaaaactgggaaacggagaccacggaaaaggcaaaggaactgggatttgcaaaaagcggagagctcgtagttttcacccagggacctgcttccggaaaaccaggaggcacaaacatgctcaagatcctgactctggactga

SEQ ID NO: 16727 - protein, 489 aa, Methanosarcina acetivorans
MNINVNINGRENMQIPDHKTKIVCTIGPASFSEEVLRKLVLAGMNVARINFSHGDFESHGKVIRRVRKVAEELDRTVAILADLPGPKIRVGKLKKEPLMLHKGNRITLTTDETSGSEDRIPVNYKQLPESVSPGSLIYLSDGFIQLLCLEISGKDVVCEVMVGGQLYSHKGLNLPGAKIYLDSVTEHDFKILEFALNEEVDAVSISFVEKAEDIRKVRNFASTMGKPVYVVSKIERSQAVQNIEEILEETDALMVARGDLGVEIPIQEVPSVQKELIRSAKLLSIPVITATHMLASMTDNIRPTRAEATDVANAILDGTDAVMLSEETAVGNYPVETVEMMAKIAKTTENWRSRTKWGLDTMLKGITAQKMSVDEVIALQVHEALQKLPVAVVLTPTRSGATPRRLSRFKPEPWILAFTRFPKTCSSLALSYGVYPIIVKEVSENWETETTEKAKELGFAKSGELVVFTQGPASGKPGGTNMLKILTLD

SEQ ID NO: 16728 - DNA, 1434 bp, Pyrococcus furiosus
  CDS (1)..(1434)
atgagaagggtgaagctcccatctcacaagacaaaaattgtagctacaatagggccagcgactaattcgagaaaaatgataaaacaactcattaaggcggggatgaatgttgcaagaataaacttctcccatggaagttttgaagagcatgcaagagtcatagaaataataagagaggaggcacaaaaattagacaggagagttgcaatacttgcagatctacctggattgaaaataagagtcggtgagataaaagggggttacgtagagctaaagagaggagaaaaggtaatattaacaacaaaggatgttgagggtgatgaaactacgataccagtggattataaaggctttccaaatttggtatcgaagggagacatcatataccttaatgacggatacatagtcttaaaggtggagaacgttagggagaacgaagttgaagcagttgttctttcaggaggaaagctcttctcgagaaagggcgtcaatatacccaaggcctacctcccagtcgaagccataactccaaaagactttgaaattatgaaatttgcaattgagcatggggtggatgcaataggattgagcttcgttgggagcgtttatgatgttctaaaggccaagagtttccttgagaaaaataatgccgaggatgtatttgtaattgcaaagatcgaaagacctgacgccgtgaggaattttgacgagattcttaatgccgctgatggaattatgattgctagaggagatttaggggtagagatgccgatagagcagctaccaattcttcagaagaaattgatcaggaaagccaatatggaagggaaaccagtgattacggcaacacaaatgcttgtgtcaatgacaacggaaaaagtgccaacaagggccgaagttacggacgttgcaaacgcaattcttgatggaacggatgcagttatgctatcagaagaaacggccataggaaaattccccattgagaccgtagagatgatgggaaagatagctaaggtcactgaagaatatagggaaagttttgggttaagcagaataagggagtttatggagatcaaaaagggaacaataaaagaggctatcactagaagtataattgacgcaatatgcacaatagacattaagtttatactaacacccaccagaacgggaagaactgctaggctaatctcaagatttaagcccaagcagtggattttagccttctcaacaaatgaaagggtgtgcaacaatctcatgttcagctatggagtttatcccttctgcctagaagagggattcgatgagaacgatatagttaggttgataaaaggactgggccttgtggaaagcgatgatatggttttaatgacggaaggaaagccaattgaaaaaacagttggaactaactcaattaagatattccaaatagcttga

SEQ ID NO: 16729 - protein, 477 aa, Pyrococcus furiosus
MRRVKLPSHKTKIVATIGPATNSRKMIKQLIKAGMNVARINFSHGSFEEHARVIEIIREEAQKLDRRVAILADLPGLKIRVGEIKGGYVELKRGEKVILTTKDVEGDETTIPVDYKGFPNLVSKGDIIYLNDGYIVLKVENVRENEVEAVVLSGGKLFSRKGVNIPKAYLPVEAITPKDFEIMKFAIEHGVDAIGLSFVGSVYDVLKAKSFLEKNNAEDVFVIAKIERPDAVRNFDEILNAADGIMIARGDLGVEMPIEQLPILQKKLIRKANMEGKPVITATQMLVSMTTEKVPTRAEVTDVANAILDGTDAVMLSEETAIGKFPIETVEMMGKIAKVTEEYRESFGLSRIREFMEIKKGTIKEAITRSIIDAICTIDIKFILTPTRTGRTARLISRFKPKQWILAFSTNERVCNNLMFSYGVYPFCLEEGFDENDIVRLIKGLGLVESDDMVLMTEGKPIEKTVGTNSIKIFQIA

SEQ ID NO: 16730 - DNA, 1404 bp, Clostridium perfringens str
  CDS (1)..(1404)
atgagaagaacaaaattagtatgcactatcggaccagctagtgaaaacgaagaaatcttaacaaaaataatcgaagcaggtatgaacgcttcaagacacaatttctcacatggtgaccatgaagaacataaaggaagaatggttaaagtaagagaaatatcaaaaaaattaggtaaagaagtagctatattattagatactaaaggacctgaaataagaactggaaaattcgagccaagcaaagttgaattaactgctggaactgaatttactatatatgctggagcagaagacgtaataggagacactactaagtgttcagttacatatgctggattagctaaagacgttaaagctggagatactatcttaatagacgacggtttagttggattagaagttgtatctgtagaaggaaacgctgttaaatgtgtagtaagaaacactggattagttggaactcacaaaggagttaacgttcctggagtatcaataaaattaccagctatgactgataaagatagagctgacttaatattcggttgtgaaatgggcgttaacatggttgctgcttcattcataagaaaagcagaagacgttaaagctataagagaagtattagttgctaacggtggagctgatatacaaatattctcaaaaatcgaaaaccaagaaggtgttgataacatagatgctatcatcgaagcttcagacggtatcatggtagctagaggagaccttggtgttgaaataccaatggaagacgttccttcagttcaaaaaatgatcatcgaaaaatgtaacaatgctggaaaaccagttataactgctactcaaatgttagactcaatgatgagaaacccaagaccaacaagagctgaggtttcagacgtaactaacgctatcttagatggtactgatgctatcatgttaagtggtgagtcagctaacggaagctggccagtagaagctgttgaaactatggttaaaatagctactaaatcagaagaaatgttaagctacgaattagcttcatcaaaagctaaaaaacatataccagctgtaccaggagttatctcaagagctgcttgtaatgctgcacacgagttaaaatcagctgctatagtttcattaactcaatcaggagctactgctaagagaatatctcaatgcagaccagatgcaccaatcgttactgtaactccaaacgaaagagttgctaagaaagttgctttatgcttcggtgtttacccagttgttgctgaaaatgctacaatggaaaacgctgttgaaatagctaaaaatgctggattcgttaaagctaatgacactgctgtagttgttgcaggtgtaccagctaacgaaggaaacactaacatagtaaaagttgaagttgtaaaataa

SEQ ID NO: 16731 - protein, 467 aa, Clostridium perfringens str
MRRTKLVCTIGPASENEEILTKIIEAGMNASRHNFSHGDHEEHKGRMVKVREISKKLGKEVAILLDTKGPEIRTGKFEPSKVELTAGTEFTIYAGAEDVIGDTTKCSVTYAGLAKDVKAGDTILIDDGLVGLEVVSVEGNAVKCVVRNTGLVGTHKGVNVPGVSIKLPAMTDKDRADLIFGCEMGVNMVAASFIRKAEDVKAIREVLVANGGADIQIFSKIENQEGVDNIDAIIEASDGIMVARGDLGVEIPMEDVPSVQKMIIEKCNNAGKPVITATQMLDSMMRNPRPTRAEVSDVTNAILDGTDAIMLSGESANGSWPVEAVETMVKIATKSEEMLSYELASSKAKKHIPAVPGVISRAACNAAHELKSAAIVSLTQSGATAKRISQCRPDAPIVTVTPNERVAKKVALCFGVYPVVAENATMENAVEIAKNAGFVKANDTAVVVAGVPANEGNTNIVKVEVVK

SEQ ID NO: 16732 - DNA, 1419 bp, Ralstonia solanacearum
  CDS (1)..(1419)
atgcaacgttccagccatgccaagatcgtcgccacgctgggtccggccagcgacgaccacgccacgatcgaagcgctcgcgcgtgcgggcgcggatgtcttccgcctgaatttcagccacggcgcgcatgccgatcatcaacggcggctcgaacggatccgcgcggtggaggccgcgctcggccggcccctcggtgtgctgctcgatctgcaaggccccaagctgcgcgtgggcaccttcgccgagggccgggtgcggctggacgatggcgcgccattccggctcgacctggagaccggccgccccggcgacgcgacgcgcgtcgcgctgccgcatccggaaatcttcgcggccatccggcccggcgtggcgctgctgctggacgacggcaagctgcggctcgaagtcgtggcctgcggcccggaccacgccgagacgcgcgtcgtcaacggcggcatgctgtccgaccgcaagggcgtcaacgtgccgggcgtggtgctgcccctgtcggcgctgacggagaaggaccgcgccgacctggccttcggcctggcgctcggtgtcgactggatcgcgctgtcgttcgtgcagcgcgccgccgacatcgccgagatccggcagctcgtgcacggccgcgcgggcattgtcgccaagctggaaaagccggccgccatcgacagcctggatgccatcctggccgagacggacgcggtgatggtcgcgcggggcgacctgggcgtcgagctgccggccgagcaggtgcccgccatccagaagcgcatcgtgcgggcctgccgccggctgggcaagccggtcatcgtggccacgcagatgctggagtcgatgatcggcgcgccggtgcccacccgcgccgaggcctcggacgtggccactgccgtctacgatggcgccgatgcggtcatgctgtccgccgagaccgcttccggccagttcccggtcgaagccgtcgccatgatgcggcggatcatcgcgcagaccgaagccgacccgcactatcgcgccgccatcgacgcctcgcacacgccgcccggcgccaatacgccggatgcgatcggctgcgccgcgcactcggtggccggcctgctggacgtggcggccatggttgcctacacgagctcgggcgcctcggcgctgcgcatggcgcgcgagcggccccgcgccgccatcctgggcatgacgccgcgcccggaaaccgcgcgccggctggcgctggtgtggggcgtccatccggtgatctgcgacggcgtgctcgacgtcgaggcgatgaccgacgtggcgcggcagacggccgtgcagcggcggttcgcgcaagcggggcagaccctcgtcatcgcggcgggcctgccattcggcacgccgggatcgaccaacctgctgcgcatcgcgcaggtggaatga

SEQ ID NO: 16733 - protein, 472 aa, Ralstonia solanacearum
MQRSSHAKIVATLGPASDDHATIEALARAGADVFRLNFSHGAHADHQRRLERIRAVEAALGRPLGVLLDLQGPKLRVGTFAEGRVRLDDGAPFRLDLETGRPGDATRVALPHPEIFAAIRPGVALLLDDGKLRLEVVACGPDHAETRVVNGGMLSDRKGVNVPGVVLPLSALTEKDRADLAFGLALGVDWIALSFVQRAADIAEIRQLVHGRAGIVAKLEKPAAIDSLDAILAETDAVMVARGDLGVELPAEQVPAIQKRIVRACRRLGKPVIVATQMLESMIGAPVPTRAEASDVATAVYDGADAVMLSAETASGQFPVEAVAMMRRIIAQTEADPHYRAAIDASHTPPGANTPDAIGCAAHSVAGLLDVAAMVAYTSSGASALRMARERPRAAILGMTPRPETARRLALVWGVHPVICDGVLDVEAMTDVARQTAVQRRFAQAGQTLVIAAGLPFGTPGSTNLLRIAQVE

SEQ ID NO: 16734 - DNA, 1440 bp, Ralstonia solanacearum
  CDS (1)..(1440)
atgactcgcgccaccaagatcgtcgccacactcggcccttcgtccaatacgctggagatcctgacgcgcatgatcgcggcgggggtggacgtggtgcggctgaacttctcgcacggcaccgcgcaggaccacgtggcgcgcgccgagctggtgcgcgagacggcgcgcgcggtgggccgcgaggtcggcatcatggccgacctgcagggcccgaagatccgcgtcggcaagttcgagagcggcaagatcaccctgagcccgggcgagcgcttcacgctggatgcccgctgcgagctgggcaaccaggagcgcgtcggcctggactacaaggagctgccgcgcgacgtcggccccggtgacctgctgctgctcaacgacggcctgatcgtgctgcaggtcgagcgcgtggtgggcgaggagatcgagaccgtcgtcaaggtcggcggcgatctgtccaacaacaagggcatcaaccgccagggcggcgggctgtcggcgccggcgctgacggccaaggacatggaagacatcaagaccgcgatggcgctgggcgccgactacatcgcggtcagcttccccaagaacgccaccgacatggaaatggcgcgccagctggccgccgtggccggcgcgccgcacagccacaagaccaagatgatcgccaagatcgagcgtgccgaggccatccgcccgggcgtgctggaagagatcctggcggcgtccgacggcatcatggtggcgcgcggcgacctcgcggtggaggtcggcaacgcggccgtgccggcgctgcagaagcgcatgatcaagctcgcgcgcgaggccaacaagctggccatcacggccacgcagatgatggagtcgatgatcgtcaacccggtgccgacgcgcgccgaggtgtcggacgtcgccaacgccgtgctcgacggcaccgatgcggtgatgctgtcggccgagaccgccgccggccgctacccggtcgagaccatcgaggccatggccgccatctgcgtggaggccgagaagtcgcagccggtgcacctcgacacggatttcctcgaccagaccttcagccgcatcgaccagtcgatcgccatgggggcgctgtttacggcctaccatctgcaggtcaaggcgattgccgcgctgaccgactcaggtgccaccgcgctgtggatgagccgccacggcatcaatgtgccgatctatgcgatcacgcccaacgtcgcgtcgcagcgcaagatggccctgtaccgcaacgtgcagccgctgccgctggccatcagcctggaccgcgacgaggcgctgcggcaggccgaggagctgctggtcgcgcgcggcgtggtgcagcgcggcgacttcatcgtcctgaccgtcggcgagccgatggggcaggcgggcgggaccaacacactcaagatcgtgcgcgtcggcatgcactga

SEQ ID NO: 16735 - protein, 479 aa, Ralstonia solanacearum
MTRATKIVATLGPSSNTLEILTRMIAAGVDVVRLNFSHGTAQDHVARAELVRETARAVGREVGIMADLQGPKIRVGKFESGKITLSPGERFTLDARCELGNQERVGLDYKELPRDVGPGDLLLLNDGLIVLQVERVVGEEIETVVKVGGDLSNNKGINRQGGGLSAPALTAKDMEDIKTAMALGADYIAVSFPKNATDMEMARQLAAVAGAPHSHKTKMIAKIERAEAIRPGVLEEILAASDGIMVARGDLAVEVGNAAVPALQKRMIKLAREANKLAITATQMMESMIVNPVPTRAEVSDVANAVLDGTDAVMLSAETAAGRYPVETIEAMAAICVEAEKSQPVHLDTDFLDQTFSRIDQSIAMGALFTAYHLQVKAIAALTDSGATALWMSRHGINVPIYAITPNVASQRKMALYRNVQPLPLAISLDRDEALRQAEELLVARGVVQRGDFIVLTVGEPMGQAGGTNTLKIVRVGMH

SEQ ID NO: 16736 - DNA, 1443 bp, Salmonella typhimurium LT2
  CDS (1)..(1443)
atgtccagaaggcttcgcagaaccaaaatcgttaccacgttaggcccggcaactgaccgcgataacaaccttgagaaggttatcgccgcgggcgcaaacgtagtacgtatgaacttctctcacggctcgccggaagatcataaaatgcgtgctgataaagtccgtgagattgccgccaaactggggcgtcatgtggctattttaggcgacctgcaagggccaaaaattcgcgtttccacttttaaagaaggcaaagtgttcctcaacatcggggacaaatttctgttagacgctaacctgggtaaaggcgaaggcgacaaagaaaaagtcggcattgattacaaagggttgccggcagacgtcgttcctggcgatatcctgctgcttgacgatggtcgagtgcagttgaaagtgcttgaagtccagggcatgaaagtctttaccgaggtcaccgtcggcggcccgctgtctaacaataaaggcattaacaagctcggcggcgggctttctgctgaagcgctgaccgaaaaagacaaagccgatattcaaaccgctgcgctgataggtgttgactatctggccgtctccttcccgcgctgcggcgaagatctgaactatgcacgccgcctggcgcgcgacgccggctgcgacgcgaaaattgtggctaaggtcgaacgcgccgaagcggtatgcgaccaaaacgccatggacgatatcattctggcctctgacgttgtgatggtcgcacgtggcgatctgggcgttgaaatcggcgatccggagctggttggtatccagaaagcgctgattcgccgtgcgcgtcagctaaaccgcgcagtcatcaccgcaacgcaaatgatggagtcgatgatcaccaacccgatgccgacccgtgcggaagtgatggacgtggcgaacgccgtcctggatggcacggatgcggttatgctgtctgccgaaaccgcagccggtcagtatccttctgaaaccgttgccgcaatggcgcgcgtctgcctgggcgcagaaaaaatccccagcatcaatgtgtctaaacaccgtctcgacgtgcagttcgacaacgttgaagaagccattgccatgtctgcgatgtatgcggcaaaccatctgaaaggcgttaccgcgatcatcaccatgacggaatccggtcgtaccgcgctaatgacttcccgtatcagctccggcctgccgattttcgccatgtcgcgccatgaacgcacgctgaacctgaccgcgctctatcgcggagtaacgccggtgcattttgatagcgcggctgatggcgttgtcgcggcacatgaagctgttaatctgctgcgcgataaagggtatctggtttccggcgacctggttatcgtgacccagggcgatgtcatgagcaccgtcggttcaaccaataccacgcgtattttgaccgttgagtaa

SEQ ID NO: 16737 - protein, 480 aa, Salmonella typhimurium LT2
MSRRLRRTKIVTTLGPATDRDNNLEKVIAAGANVVRMNFSHGSPEDHKMRADKVREIAAKLGRHVAILGDLQGPKIRVSTFKEGKVFLNIGDKFLLDANLGKGEGDKEKVGIDYKGLPADVVPGDILLLDDGRVQLKVLEVQGMKVFTEVTVGGPLSNNKGINKLGGGLSAEALTEKDKADIQTAALIGVDYLAVSFPRCGEDLNYARRLARDAGCDAKIVAKVERAEAVCDQNAMDDIILASDVVMVARGDLGVEIGDPELVGIQKALIRRARQLNRAVITATQMMESMITNPMPTRAEVMDVANAVLDGTDAVMLSAETAAGQYPSETVAAMARVCLGAEKIPSINVSKHRLDVQFDNVEEAIAMSAMYAANHLKGVTAIITMTESGRTALMTSRISSGLPIFAMSRHERTLNLTALYRGVTPVHFDSAADGVVAAHEAVNLLRDKGYLVSGDLVIVTQGDVMSTVGSTNTTRILTVE

SEQ ID NO: 16738 - DNA, 1440 bp, Rhizobium meliloti
  CDS (1)..(1440)
atgagacggaacaggaaagtcaaaatcctcgcgacgctcgggccggcatcggccgacgagcaaatgattcagaagctgcacgaggcgggggccgatctgttccgtatcaacatgagccatgcaagccatgaggtcatgcgcacgctgatcgagcggatccgtgtggtcgaggcgcgctgcggccgtccgatcggcatcctcgccgatctgcaggggccgaagctgcgcgtcggaaagttcgccgaaggcaaggtcgagctcaagatcggccagacattcacgctcgacaaccgcgacgtgcccggcgacagccgccgcgtctatcttccgcatccggagatcctcgaagcggtgaagcccggccatcgcctgctcatcgacgatggcaagctgcatctgcgcgccgaaaagaccgatggcaagagcatcgtcaccacggtcgtttccggcacgcggatttcggatcgcaagggcgtcagcctgcccgataccctgcttggcgtcggcgcgctgacggacaaggaccgcgtcgacctcgacgccgtgctggcgacaggagaggtcgattgggtggcgctttccttcatccagcgccctgaggaccttgccgaggttcgcaagatcgcccgcggccgcgttggactgatgtcgaagatcgagaagccgcaggcgatcgagcggatagacgagatcatcgagctttcggatgcgctgatggtggcacgcggcgacctgggcgtcgaaatgccgctcgaatccgtaccgggacttcagaagcaactgacgcgtgcctgccggcgagccggcaagccggtcgtcgtcgccacgcagatgctcgaatcgatgatctcctcgcctgtgccgacgcgcgcagaagtgtcggacgtggctaccgccgtgttcgagggtgccgatgcggtgatgctttcggccgaatccgcctccggcgagtaccccgtcgaggcggtttctaccatggcgtcgatcgccagcaacgtcgagcgcgatccgcattatccggggatcatctacgctcagcgcacgccgccggaggcaacgggcgcggacgccatttcgcttgccgctcaccagatcgccgagacgctcaagcttgccgcaatcgtgacctacacctcctctggcaccaccggcctgcgcgcggcgcgcgagcgcccccaggtgcctgtcatcgcgctttcgccgatcgtccagacggcccgtcgcctttccgtggtctgggggctgcactgtgtcgtcacagaggacgcgaccgacctcgacgatatggtcaaccgcgcctgtcgaatcgtctcgacggaaggcttcggcaagccgggagaccgcatcatcgttaccgccggcgtgccgctcggtacccccggcgccaccaacatgctgcgcatcgcctatatcggctcggacggccaatcgggcatctga

SEQ ID NO: 16739 - protein, 479 aa, Rhizobium meliloti
MRRNRKVKILATLGPASADEQMIQKLHEAGADLFRINMSHASHEVMRTLIERIRVVEARCGRPIGILADLQGPKLRVGKFAEGKVELKIGQTFTLDNRDVPGDSRRVYLPHPEILEAVKPGHRLLIDDGKLHLRAEKTDGKSIVTTVVSGTRISDRKGVSLPDTLLGVGALTDKDRVDLDAVLATGEVDWVALSFIQRPEDLAEVRKIARGRVGLMSKIEKPQAIERIDEIIELSDALMVARGDLGVEMPLESVPGLQKQLTRACRRAGKPVVVATQMLESMISSPVPTRAEVSDVATAVFEGADAVMLSAESASGEYPVEAVSTMASIASNVERDPHYPGIIYAQRTPPEATGADAISLAAHQIAETLKLAAIVTYTSSGTTGLRAARERPQVPVIALSPIVQTARRLSVVWGLHCVVTEDATDLDDMVNRACRIVSTEGFGKPGDRIIVTAGVPLGTPGATNMLRIAYIGSDGQSGI

SEQ ID NO: 16740 - DNA, 1745 bp, Mastigamoeba balamuthi
  CDS (36)..(1541)
gaaacgcacgaggcacctcctcctccgcagcaaacatggcccagaagaccgtccgccccgccaagctcaccaagatcgttgcgaccgtcagcgatctgcgctgccaggttgagaccctgcgccagctgtggatgaccggcgtcgatgtgatccgcctgaacacggcgcaccagaccgaggccgacaccctcctcgtcgtcgagaacgcccgcgccgtcggccggacgatccccctgatgctcgacaccaagggccccgaggtgcgcactgcgctcctgacggccgagaaggtcatcgacgtcaagaccggcgacaaggtcttcgtctgccccagcgaggccatcctcaacgagtacaaggccaagggccagaacgccttcacgaccaactacgcgcgtttcaccgacgaggtcggcatgaacaaccgcgtcctgatcgacgacggcctgctgggcatgcacgtcgttgccaaggacgaggccaggcgcgtcctggagctcgtcgtcgagaacgacggtgtcatcaagggccgcaagtcggtcaacacccccgacgtcaagctccagctcgagtcggtcaccgagcgcgacaagaccttcctcaggttcgccgccaagcacgacctcgagttcgtcgcccactcgttcgtccgctgccgcaaggacatcgaggacgtccgcgccatcctcagcgagaacggctcgcacgcccagatcatcgccaagatcgagaaccgtgagggcatcgacaacatcgacgagatcctcgacgttgccgacggcatcatggttgcccgtggcgacctcggcatcgaggttcccttcgaggaggtccccatgatgcagaagatgctcatccgcaagtgcaacgagcgcgccaagcccgtcatcactgccacccagatgctccacacgatgatggagaaccctcgcccgacccgcgccgaggtctcggacatcgccaacgccatcctcgacggcactgacgcgattatgctgtcgggcgagaccgcctcgggcaagtacccgttcgagtctgtcgagaccatggtcaagatcgccatgcgcatcgagagcgagcgcgccaagaacaaggagctgtggactcgcacgctctgcaagagcatcaacaccccccgcgcggtgctctgctcggcggccatgtcggccatccagacgctgcccgtcaaggcgctcgtctgcgacaccctcaccggccgctcggcccgcatcatcgcgacgtacaaggcgcccgtccccgtgtacgcgcagtgccacgactcgcgcatcagccgcatgctggcgctgtcgtacggtgtctactcgcgctacgtgcccctccccaactcgaccgacgcgctcatcgtcgagtcgctgacggcgctctcggagcccgccactgtcggcaaggacgacctgatcgtcttcgtcgcgggcacccccggcaaccagaagggctcgaacatcatcgagatcaacactgtcgacctgatcctccagggccacagcgcgcactgcgtcaaggctgaggagcgcatctagagcggcttcctctccctctttactagctactgcccccgcatgaaccacctccctaatgcatccccttaaccctccttcgtctgtcgcacacgggacgcacgaagggtcgtttcattaatcggctgcaacaacggaaacttctgagttcgcgttcataagacaaacaaaccttctgccttgttctccaaaaaaaaaaaaaaaaaa

SEQ ID NO: 16741 - protein, 501 aa, Mastigamoeba balamuthi
MAQKTVRPAKLTKIVATVSDLRCQVETLRQLWMTGVDVIRLNTAHQTEADTLLVVENARAVGRTIPLMLDTKGPEVRTALLTAEKVIDVKTGDKVFVCPSEAILNEYKAKGQNAFTTNYARFTDEVGMNNRVLIDDGLLGMHVVAKDEARRVLELVVENDGVIKGRKSVNTPDVKLQLESVTERDKTFLRFAAKHDLEFVAHSFVRCRKDIEDVRAILSENGSHAQIIAKIENREGIDNIDEILDVADGIMVARGDLGIEVPFEEVPMMQKMLIRKCNERAKPVITATQMLHTMMENPRPTRAEVSDIANAILDGTDAIMLSGETASGKYPFESVETMVKIAMRIESERAKNKELWTRTLCKSINTPRAVLCSAAMSAIQTLPVKALVCDTLTGRSARIIATYKAPVPVYAQCHDSRISRMLALSYGVYSRYVPLPNSTDALIVESLTALSEPATVGKDDLIVFVAGTPGNQKGSNIIEINTVDLILQGHSAHCVKAEERI

SEQ ID NO: 16742 - DNA, 2207 bp, Toxoplasma gondii
  CDS (225)..(1820)
ggcacgagcccgtgtgctacccttttttccgtttctcgcctgtgtgcggaatctggtgcttttacccgtaacgaacactttcgaatgcgagcgtctgtcgtcactgaggtttgttcacctgtccgtgtcggttcgtgtgtgtgacgctttctgcgttttttctgttcctgccacaactgtttgcttgggctttttgactttttacctgctctcctcttatcacaatggcatctaaacaaccgcagacactgagcgccggcgccgtcgagagcggccgcgttgcccgcctcgtgtccgccagttctgtgatgactcagcagctgggaaaaagcacgaacatccgcatgtcccagattctggagccgcgctccgaagaagactggactgcccaccgcactcgcattgtctgcaccatgggccccgcatgctggaacgtagacaccctcgtcaaaatgatcgacgctggcatgaacgtctgccgcttgaacttctcgcacggcgaccacgaaacacacgcacgcactgtccagaacatccaggaagccatgaagcaaagacctgaagcgcgcttggcgattctcctggacaccaagggacccgaaatccgcactggattcttgaaggaccacaagcccatcactctgcagcaaggcgccactctgaagatcgtgacggactacaacttgattggcgacgagacaacgattgcatgctcctacggtgccctccctcaatcggtgaagcccggcaacaccattctcattgccgacggttccctctccgtcaaggtcgttgaagttgggagcgattacgttattacccaggctcagaacaccgctaccatcggcgaacgcaagaacatgaacctacccaacgtcaaagtccagctgcccgtcattggcgagaaggacaagcacgacatcctgaactttggcattcccatgggatgcaactttattgctgcttccttcgtccaaagcgcggatgatgtccggtacattcgcggtctgcttggcccccgtggccgccacatccgcattattccgaagatcgagaatgtcgagggtctcgtcaacttcgacgaaattctcgcggaagccgacggtatcatgatcgcgcgtggtgacttgggaatggaaatcccccccgaaaaggttttcctggctcagaagatgatgattgctaagtgcaacgtcgtgggcaagcccgttattacagcgacccagatgctggagagtatgatcaagaacccgcgcccgacacgtgcggaggccgccgatgtggcgaacgcggtgttggacggcacagattgcgtgatgctttctggagagactgctaacggagaattcccggttatcaccgttgagacaatggcccgcatctgctacgaggcggaaacctgcgtggactaccctgcgctgtaccgtgccatgtgcctggcagttcccccacccatttcgactcaggaagctgttgcgagagcagctgtcgagacggccgagtgcgtcaacgcagcgatcatcctggctttgaccgagaccggtcagactgcgcgtctgatcgccaagtaccgcccgatgcagccgattctggccctgagtgcttcagaaagcaccatcaagcacctgcaggtgatccgcggtgtgacgacgatgcaggttccctcgttccagggaaccgaccacgtgatcagaaacgcgattgtcgtggccaaggagagagaactcgttactgagggcgagagcatcgtcgctgtgcacggcatgaaagaggaagtcgctggctccagcaaccttctcaaggttcttactgtggagtaaactgcagaacagagcaggtgcgaaggaatagacgcaggagcaagaaggagagagcttctatgtagacgatgtcggaatcgagtttttggcagttggttacggtttttttttatgtccctccaaccagaatcgagtagcaccttccacagtggacgcatgtggtaattttccacggagggcagtggcgtgcgacgaaaaggttgccgcctgcgaccgtgcctgatttttttttgcgttggtgaaactttctgcattttgcctttttctgttccccacaagattcgactcgcaagtgaccagcgtttttaccgtagttcgttgctgcgaccttgacgtgaactgaaagaggatagcgtaaacctctgcctcctcgaaaaaaaaaaaaaa

SEQ ID NO: 16743 - protein, 531 aa, Toxoplasma gondii
MASKQPQTLSAGAVESGRVARLVSASSVMTQQLGKSTNIRMSQILEPRSEEDWTAHRTRIVCTMGPACWNVDTLVKMIDAGMNVCRLNFSHGDHETHARTVQNIQEAMKQRPEARLAILLDTKGPEIRTGFLKDHKPITLQQGATLKIVTDYNLIGDETTIACSYGALPQSVKPGNTILIADGSLSVKVVEVGSDYVITQAQNTATIGERKNMNLPNVKVQLPVIGEKDKHDILNFGIPMGCNFIAASFVQSADDVRYIRGLLGPRGRHIRIIPKIENVEGLVNFDEILAEADGIMIARGDLGMEIPPEKVFLAQKMMIAKCNVVGKPVITATQMLESMIKNPRPTRAEAADVANAVLDGTDCVMLSGETANGEFPVITVETMARICYEAETCVDYPALYRAMCLAVPPPISTQEAVARAAVETAECVNAAIILALTETGQTARLIAKYRPMQPILALSASESTIKHLQVIRGVTTMQVPSFQGTDHVIRNAIVVAKERELVTEGESIVAVHGMKEEVAGSSNLLKVLTVE

SEQ ID NO: 16744 - DNA, 1437 bp, Rhizobium loti
  CDS (1)..(1437)
atgagacgcagccgcaaggtcaagatcctagccacaatcggtccggcctcctcctccgaggagatgctgcagaagctgttcgaagcgggcgccgatgtgttccgcatcaacatgagccataccgaccacgaactgatgcgcacgctggtcgggcgcatccgcgccgtcgaggaaaaggtcggccggccgatcggcatcctcgccgacctgcaaggccccaagctgcgcgtcggcaagttcgccaatggcaaggaggtgctgacgccaggccagaccttcacgctcgacgacaatcccgagcccggcacgtcgagcagggtctatctgccgcatccggaaatcctgagttcggtcgagcccggtcaccgtcttttgatcgacgacggcaagctcgagctgaaggcggtgaagagcgatggcaagtcgatcgtctgcacggtcgtcgccggcaccacgatttccgacaagaagggcgtcagcctgcccgataccgacctgccggtcggcgctctgaccgaaaaggaccgcaaggatctcgacgcggtgctcgccacgggcgtcgactggatcgcgctgtccttcgtgcagcgccccgaggatctggccgaggcgcgcaagatcgcgcggggccgggcgctgatcatggccaagatcgaaaagccgcaggccgtcgcccgcttggccgagatcatcgaactgtccgacgcgctgatggtcgcccgtggcgatctcggcgtcgaaatgccgctggaagccgttcccggcatccagaagcagatcacgcgcgccgcgcgccgcgccggcaagccggtggtggtcgccacgcaaatgctggaatcgatgatcaccgccccggtgccgacccgcgccgaagtctccgacgtctcgatcgccgtcttcgagggcgccgacgccatcatgctgtcggcggaatcggcggcgggtgcctatcccgtcgaagccgtggcgatgatggaccgcatcgccaccaaggtcgaaaccgatccgacctatgccggcatcatcaacgcccagcgctccgagccggaagcgaccggagccgacgcgatctcgctggctgcccgcgaaatcgccgagactctgaaactgtcggcgatcatcacctacacggcgtccggcaccaccgggctgcgcgccgcgcgcgaacggccacaggtgccgatcatcgctctgtcgccgatcctcaacaccgcacggcggctgtcgcttctgtggggcacgcactgtgtcgtttcgcccgatgccaccgatctcgacgacatggtcaaccgcgcctgccgcattgcgctggaagaagagttcggcaagccgggcgaccgcgtcatcatcacggccggtgtgccgctgaggacgcccggctcgaccaacatgctgcgcattgcctatgtcgggtcggaaaagcagggcagccggtaa

SEQ ID NO: 16745 - protein, 478 aa, Rhizobium loti
MRRSRKVKILATIGPASSSEEMLQKLFEAGADVFRINMSHTDHELMRTLVGRIRAVEEKVGRPIGILADLQGPKLRVGKFANGKEVLTPGQTFTLDDNPEPGTSSRVYLPHPEILSSVEPGHRLLIDDGKLELKAVKSDGKSIVCTVVAGTTISDKKGVSLPDTDLPVGALTEKDRKDLDAVLATGVDWIALSFVQRPEDLAEARKIARGRALIMAKIEKPQAVARLAEIIELSDALMVARGDLGVEMPLEAVPGIQKQITRAARRAGKPVVVATQMLESMITAPVPTRAEVSDVSIAVFEGADAIMLSAESAAGAYPVEAVAMMDRIATKVETDPTYAGIINAQRSEPEATGADAISLAAREIAETLKLSAIITYTASGTTGLRAARERPQVPIIALSPILNTARRLSLLWGTHCVVSPDATDLDDMVNRACRIALEEEFGKPGDRVIITAGVPLRTPGSTNMLRIAYVGSEKQGSR

SEQ ID NO: 16746 - DNA, 1440 bp, Pasteurella multocida
  CDS (1)..(1440)
atgtctagaagactaagaagaacgaagattgtatgtacaatgggaccgtcaacagagcgtgggaataatcttgaaaaaattatcatggctggcgcgaatgttgttcgtatgaacttttctcatggcacaccagaagatcatatcggtcgcgcggagaaagtacgtgaagtggcaaaaaaacttggaaaaaccgttgctattttaggtgatttacaaggccctaaaatccgtgtctcaactttcaaagatggtaaaattttcttaaatattggtgataaatttgtgcttgatgccgatttaccaaaaggtgaaggtacgcaagaaggtgttggtttagactacaaaacattaccacaagacgttgtgccaggcgatattttattgttagatgatggtcgtgttcaattaaaagtcttatctacagaaggtaataaagtttttactgaagtcactgttggtggtccattatcgaacaataaaggtattaacaagttaggcggaggtttatctgctgatgcattaactgaaaaagataaaaatgatattttattggcagcaaaaatcggtgtagattatttagcggtttctttccctcgttcaagtgcagatttaaactatgcgcgtgagttagctgaagctgcaggcttaaaagcaaaaatcgtggcaaaagtagaacgtgcagaaactgttgcaaccactgaagcaatggatgatattattttagcatcagatgtcatcatggtagcacgtggtgacttaggggttgaaattggtgaccctgaattagtgggtgtacagaaaaaattaatccgtcgcgcacgccaattaaaccgtgttgttattacagcaacacaaatgatggaatctatgattagcaatccaatgccgactcgtgcggaagtgatggacgtagcgaatgccgtattagatggtacagacgccgtgatgctttctgcagaaacagcggcagggcaatatccagcagaaacagtggctaccatggcaaaagtgtgtttaggtgctgaaaaaatgccaagcatcaatgtttctcgtcaccgtatggatatcacttttgattctatcgaagaatccgttgcaatgtctgcaatgtatgctgcaaaccacatgaaaggtgttgctgcaattattgcaatgacacatactggacgtaccgcgttattaatgtcacgtattagttctggtttaccgatttttgccttatctcgtaaccaagatgcattaaatctttgtgcattataccgtggtgttacacctgttcattttgatgaagtcagccgtaattcaaaaggtgcagctgcagcgattcgtttgttaaaagagaaaggtttcttagtatcgggtgatttagttcttttaactcaaggtgatgaattgttagcaagtggtacaaatacttgccgtacactagttgtagaataa

SEQ ID NO: 16747 - protein, 479 aa, Pasteurella multocida
MSRRLRRTKIVCTMGPSTERGNNLEKIIMAGANVVRMNFSHGTPEDHIGRAEKVREVAKKLGKTVAILGDLQGPKIRVSTFKDGKIFLNIGDKFVLDADLPKGEGTQEGVGLDYKTLPQDVVPGDILLLDDGRVQLKVLSTEGNKVFTEVTVGGPLSNNKGINKLGGGLSADALTEKDKNDILLAAKIGVDYLAVSFPRSSADLNYARELAEAAGLKAKIVAKVERAETVATTEAMDDIILASDVIMVARGDLGVEIGDPELVGVQKKLIRRARQLNRVVITATQMMESMISNPMPTRAEVMDVANAVLDGTDAVMLSAETAAGQYPAETVATMAKVCLGAEKMPSINVSRHRMDITFDSIEESVAMSAMYAANHMKGVAAIIAMTHTGRTALLMSRISSGLPIFALSRNQDALNLCALYRGVTPVHFDEVSRNSKGAAAAIRLLKEKGFLVSGDLVLLTQGDELLASGTNTCRTLVVE

SEQ ID NO: 16748 - DNA, 1880 bp, Arabidopsis thaliana
  CDS (126)..(1658)
ctgttcgtcgatataaaactttcttcgttaccattttgagtctccggcggctttcacactccagaaaaaaaacacagaagctacgtttttcaggactttgattaggtttttggagatttacaaaaatgtcgaacatagacatagaaggaatattgaaggagctacctaatgatgggaggactcctaagactaagatcgtttgtacattaggtcctgcgtctaggtctgtgacaatgattgagaagcttcttaaagcaggcatgaatgtagctcgattcaatttctctcacggaagccatgagtaccatcaggagactcttgacaatctccgcaccgctatgcagaataccggcattctcgctgctgttatgcttgatacaaaggggcctgagattcgtaccggtttcttgaaagatgggaaccctatacaactaaaggaaggccaagagatcacaattaccactgattatgacatcaagggcgatgagaaaacgatttccatgagctacaaaaagctcccagtggatgtgaagcccggaaataccatactatgtgcagatggaagcataagtcttgctgtcgtgtcatgtgatccaaacgctgggactgttatatgtcgatgtgaaaatacagccatgctaggtgaaagaaaaaatgtgaatctcccaggtgttgttgttgatctccccacattgactgacaaggatgtagaagatattcttaaatggggtgttccaaacaacatcgatatgattgctctttcatttgttcgcaaaggttcagatcttgttaatgtccggaaagtccttggatcacattccaagagtataatgttgatgtcgaaggttgagaaccaagaaggagtcctgaatttcgatgagattttgcgtgaaactgatgcattcatggttgctcgtggtgatcttgggatggagattccgatagagaagatcttcttggctcagaagatgatgatctacaagtgtaaccttgcaggtaaaccggtggtcacagccactcaaatgctcgagtcgatgatcaaatcaccacggccaacacgagcagaagccacagatgtagcaaacgcagttctcgatggcactgactgtgtgatgcttagcggagaaagtgctgcaggagcttaccctgaaatagcagtgaaaacaatggctaaaatctgcatcgaggcggaatcatcgcttgactacaacacaatcttcaaggagatgattagagcaactccacttccaatgagcactcttgagagtcttgcatcatcagctgtacgaacggcaaacaaagccaaagccaaactcatcatcgtgttgaccagaggaggtacaacagctaaactggtggccaagtatagaccggctgttccaattctatcggtggttgttccggtcttcaccagcgatacgtttaactggagttgcagcgatgagtcaccggcgaggcatagtttgatatatagaggtctgataccggttttgggtgaaggatctgcaaaagcaactgatagtgaatccacagaggagattattgaatctgctttgaagtcagcgacagagaaaggactgtgtaaccatggtgatgctgtggtggctctgcaccgtattggagctgcttcggttatcaagatctgtgtggtgaagtgatttttctactaaatatcttgaattttattcttggttaatgtttcttgatgaaataatccaataaagaaccagggaataggttcctgaaagtgttttgtgtggggcatttcttctctttcttttgctgttttagcttataagattatgaatgcactaatgactcttgctcatattattatagtttaattagccaataataacaatttttaaggctcgttttct

SEQ ID NO: 16749 - protein, 510 aa, Arabidopsis thaliana
MSNIDIEGILKELPNDGRTPKTKIVCTLGPASRSVTMIEKLLKAGMNVARFNFSHGSHEYHQETLDNLRTAMQNTGILAAVMLDTKGPEIRTGFLKDGNPIQLKEGQEITITTDYDIKGDEKTISMSYKKLPVDVKPGNTILCADGSISLAVVSCDPNAGTVICRCENTAMLGERKNVNLPGVVVDLPTLTDKDVEDILKWGVPNNIDMIALSFVRKGSDLVNVRKVLGSHSKSIMLMSKVENQEGVLNFDEILRETDAFMVARGDLGMEIPIEKIFLAQKMMIYKCNLAGKPVVTATQMLESMIKSPRPTRAEATDVANAVLDGTDCVMLSGESAAGAYPEIAVKTMAKICIEAESSLDYNTIFKEMIRATPLPMSTLESLASSAVRTANKAKAKLIIVLTRGGTTAKLVAKYRPAVPILSVVVPVFTSDTFNWSCSDESPARHSLIYRGLIPVLGEGSAKATDSESTEEIIESALKSATEKGLCNHGDAVVALHRIGAASVIKICVVK

SEQ ID NO: 16750 - DNA, 1982 bp, Arabidopsis thaliana
  CDS (238)..(1734)
ctaaaccaataaccttcaatttcatttctcattttttacctcaaaagtcaaaaaaaactctagaagaagactcttaactcataaatctctcattctttctcagattctctctctctgttttccttgttctccaagccagatctctctccataaatctctcttcatctctctctttccaccaaacatccgcgatcctcgattctcaattccgtgtctgttttttttcttcacttagcgatggcgatgatagagcaaaggccgaagacgaagatcgtttgtactctaggtccagcttccagatctgttccgatggtcgagaagcttcttagggctggtatgaacgttgctcgtttcaatttctctcatggatctcatgaataccatcaagagactctcgataatcttcatcaagctatgcttaacactgggattctctgtgccgtcatgctcgacaccaagggtccagaaatccgaaccgggttcttgaaagatgggaaaccaatccagctgaaacaaggacaagagatcactatttcgactgactatgacttgaagggtgacgagaacacgatttgcatgagctacaaaaagttggctgttgatgtgaacccaggaatggtcattctttgtgctgatggtacaatctccttactggttctctcttgtgacaaagagaacggtacagtccgttgccggtgtgagaactctgcgatgctcggtgagagaaagaacgttaatctcccaggtgttgttgtggatctcccaactctaactgagaaagacaaagaagacatcatgcaatggggagtcccgaatcaaatcgacatgattgctctgtcttttgtcaggaaaggttcagacttggttcaagtccggaaacttctaggaaagcacgccaaaaacattcttctcatgtctaaggtcgagaaccaagaaggtgtggcaaattttgatgacattttggtcaattcagacgctttcatgattgctagaggagatctgggcatggaaatcccgattgagaagatcttcttagctcagaaggtgatgatctacaaatgcaacatccagggaaaacctgtggtcacagcaactcagatgctcgagtccatgatcaaatctcctagacccacaagagccgaagctacggatgtagcaaacgcagtccttgatggtacagactgtgtcatgctcagtggtgaaactgcagctggagcataccctgaactagccgtccgtacaatggctaagatctgcgtggaagccgagagcacccttgactacggtgatgtcttcaagaggatcatgctgtactctccagttccaatgagtccactcgagtcacttgcatcttcagctgtcagaactgctaactcagctagagccactctcatcatggtcctaaccagaggaggaagcacagcaagacttgtggctaagtacagaccaggaatgcctattctatccgtcgttgttcctgagatcaaaaccgacttctttgactggtcttgcagcgatgaatcccccgcgagacacagccttatcttccgtggtctgatcccagtgctctacgctggatccgcaagagcctcacacgatgaatcaacagaagaagctatcgagtttgctactcagtacgggaaagagaaagagctatgcaagactggagattccgttgttgctctactccgagtcggtaatgcttccgtgatcaagatcttgaccgtcaagtgatgattccactcaaaaattcacgtttttggcgtttggggaacgctactttaaacgttttattatgaaactattcaagattgtgattaaaatcttgagatagaaaactcaagttctattttttgcttattaccacaactactgtgaccggtgaatccacttaacagctccttttgggatattttggttgtattgaaacctattggatcattcatacacgtatcaattatcatgatttctttttgtttctc

SEQ ID NO: 16751 - protein, 498 aa, Arabidopsis thaliana
MAMIEQRPKTKIVCTLGPASRSVPMVEKLLRAGMNVARFNFSHGSHEYHQETLDNLHQAMLNTGILCAVMLDTKGPEIRTGFLKDGKPIQLKQGQEITISTDYDLKGDENTICMSYKKLAVDVNPGMVILCADGTISLLVLSCDKENGTVRCRCENSAMLGERKNVNLPGVVVDLPTLTEKDKEDIMQWGVPNQIDMIALSFVRKGSDLVQVRKLLGKHAKNILLMSKVENQEGVANFDDILVNSDAFMIARGDLGMEIPIEKIFLAQKVMIYKCNIQGKPVVTATQMLESMIKSPRPTRAEATDVANAVLDGTDCVMLSGETAAGAYPELAVRTMAKICVEAESTLDYGDVFKRIMLYSPVPMSPLESLASSAVRTANSARATLIMVLTRGGSTARLVAKYRPGMPILSVVVPEIKTDFFDWSCSDESPARHSLIFRGLIPVLYAGSARASHDESTEEAIEFATQYGKEKELCKTGDSVVALLRVGNASVIKILTVK

SEQ ID NO: 16752 - DNA, 1819 bp, Arabidopsis thaliana
  CDS (146)..(1678)
gctaccaaacttcgctaaactttagtgctttactccaaaacccagagtccatcacacaagtccaagcccgaaaacaagggttcttgctccgacacgacaacaaatccagattttgagcttagggaaacttgagaaggagaaaaaaatgtcgaacatagacatagaagggatcttgaaggagctacctaatgatgggaggatcccaaagacgaagatagtttgcacattaggaccagcttctcgcactgtttccatgatcgaaaagcttttgaaagccggtatgaatgtggctcgcttcaacttctcacatggaagccatgaataccatcaagagacactcgacaacctccgctctgctatgcataataccggcattctcgctgctgtcatgcttgatactaaggggcctgagattcgtactggtttcttgaaagatgggaaccctatacaactgaaggaaggtcaagagattactataaccactgattatgacattcaaggagacgaatcaacgatatccatgagctataaaaagctgcctttggatgtgaagcccggaaacaccatactctgtgcagatggaagcataagtctagctgtcttgtcatgtgatcctgagtctggaactgttaggtgccggtgtgaaaactcggcgatgcttggtgaaagaaagaatgtgaatcttcctggcgttgttgttgatcttcccactttgacagataaggatattgaagatattctcggttggggtgttccgaacagcattgatatgattgctctttcgtttgtccgtaaaggttcggatcttgttaatgtccgcaaggttcttggatctcatgctaaaagcataatgctcatgtcaaaggttgagaaccaggaaggtgtgattaactttgatgagatcttgcgtgaaacagatgcgttcatggttgcccgtggtgatctcgggatggagattccgatagagaagatcttcttggctcaaaagttgatgatctacaagtgtaaccttgcgggtaaaccggtggtcacagccactcagatgctggagtcaatgatcaaatcacctcggccaacccgagctgaagccacagatgttgcaaatgctgttcttgatggtactgactgtgtgatgcttagcggtgagagtgcagcaggagcttatccggaaatagctgtgaaagtcatggctaagatctgcattgaagccgaatcctcgcttgattacaacacaatctttaaagagatgatccgagcaactccacttccaatgagcccactcgagagtcttgcatcatccgctgtacggactgctaacaaagcgagggcaaaactcatcattgtgttgacacgtggaggttcaactgctaatctcgtggctaaatacagaccggctgttccgattctgtcagtggttgtcccggttatgaccactgattcctttgactggtcttgtagtgacgagtcacctgcaaggcatagtctgatatacagaggtctaatccctatgttggctgaaggatctgcaaaggcaacagatagtgaagccaccgaagttatcattgaagctgctctgaagtcggctactcagagaggactgtgcaaccgtggtgatgcaatcgtggcgctgcaccgtattggagctgcctcagttattaagatctgtgtggttaagtgagattacagacttctttcaatacctcaaatcttggattgttggtaatcgtaactgagattttgctttgtagcatgaaataaagaaaacaggtcacaatagttcctgaaactctgttacttttaagatatctctctctctttt

SEQ ID NO: 16753 - protein, 510 aa, Arabidopsis thaliana
MSNIDIEGILKELPNDGRIPKTKIVCTLGPASRTVSMIEKLLKAGMNVARFNFSHGSHEYHQETLDNLRSAMHNTGILAAVMLDTKGPEIRTGFLKDGNPIQLKEGQEITITTDYDIQGDESTISMSYKKLPLDVKPGNTILCADGSISLAVLSCDPESGTVRCRCENSAMLGERKNVNLPGVVVDLPTLTDKDIEDILGWGVPNSIDMIALSFVRKGSDLVNVRKVLGSHAKSIMLMSKVENQEGVINFDEILRETDAFMVARGDLGMEIPIEKIFLAQKLMIYKCNLAGKPVVTATQMLESMIKSPRPTRAEATDVANAVLDGTDCVMLSGESAAGAYPEIAVKVMAKICIEAESSLDYNTIFKEMIRATPLPMSPLESLASSAVRTANKARAKLIIVLTRGGSTANLVAKYRPAVPILSVVVPVMTTDSFDWSCSDESPARHSLIYRGLIPMLAEGSAKATDSEATEVIIEAALKSATQRGLCNRGDAIVALHRIGAASVIKICVVK

SEQ ID NO: 16754 - DNA, 1581 bp, Aspergillus oryzae
  CDS (1)..(1581)
atggccgccagcagttctctcgaccatttgagcaaccgtatgaagctggagtggcactccaagctgaacacggagatggtgcccgcgaagaacttccgccgcacctccatcattggcaccattggccctaagaccaactcggtggagaagatcaacgctctccgcagatccggtctcaatgttgttcgtatgaacttctcccacggttcgtatgagtaccaccagtccgttatcgacaacgcccgtgaggccgccagagtccagaccggacgtcccctcgccattgctcttgataccaaaggacctgaaatccgtactggaaacactaccgatgataaggatatccccatcaaggagggtcacgagctcaacatcaccactgatgagaagtacgctaatgctagcgacgaccagaacatgtacctggactataagaacattaccaatgtgatcgctcccggaaagctcatctatgtcgacgatggtatcctctccttccaggttctggaggtcgttgacgacaagaccctgcgcgtcaagtgtcttaacaatggcaacatctcctctcgcaagggtgttaacctgcccggcaccgatgttgaccttcccgccctttccgagaaggatatcagtgatctcaagttcggtgtcaagaacggcgtcgacatgatctttgcctcgttcattcgtcggggaagtgacatccgccacattcgtgacgtgttgggtgaagagggtaaggagattcagatcatcgccaagattgagaaccagcagggtgtcaacaacttcgacgagattctcgaggagactgacggtgttatggtcgcccgtggtgatcttggtatcgaaatccccgcccccaaggtcttcatcgctcagaagatgatgatcgccaagtgcaacatcaagggcaagcctgtcatctgtgccactcaaatgctcgagtccatgacatacaaccctcgccccactcgtgccgaggtgtccgatgtcgctaacgctgttcttgacggagccgactgtgtcatgctttctggtgagaccgctaagggctcatacccttgtgaggctgttaagatgatgagcgagacctgtttgctcgccgaggttgccattccccacttcaatgtctttgacgagttgcgcaacctcgctccccgccccactgatactgtggaatccatcgccatggctgccgttagcgccagtcttgagcttaacgccggtgccattgttgtcttgaccaccagtggtaacactgctcgccttctttccaagtaccgccctgtgtgccccatcctgatggtcacccgtaaccctagagcttcgaggtattctcacctctaccgtggtgtctggcccttcctcttccccgagaacaagcccgacttcaacgtcaagatctggcaggaggacgttgaccgccgtctcaagtgggctatctcccacggtatcaagctcggtatcatcaacaagggagacaacattgtctgtgtccagggttggcgcggaggccagggccacaccaacaccgtccgtgtggtcccagctgaggagaaccttggtctgattgagtaa

SEQ ID NO: 16755 - protein, 526 aa, Aspergillus oryzae
MAASSSLDHLSNRMKLEWHSKLNTEMVPAKNFRRTSIIGTIGPKTNSVEKINALRRSGLNVVRMNFSHGSYEYHQSVIDNAREAARVQTGRPLAIALDTKGPEIRTGNTTDDKDIPIKEGHELNITTDEKYANASDDQNMYLDYKNITNVIAPGKLIYVDDGILSFQVLEVVDDKTLRVKCLNNGNISSRKGVNLPGTDVDLPALSEKDISDLKFGVKNGVDMIFASFIRRGSDIRHIRDVLGEEGKEIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGSYPCEAVKMMSETCLLAEVAIPHFNVFDELRNLAPRPTDTVESIAMAAVSASLELNAGAIVVLTTSGNTARLLSKYRPVCPILMVTRNPRASRYSHLYRGVWPFLFPENKPDFNVKIWQEDVDRRLKWAISHGIKLGIINKGDNIVCVQGWRGGQGHTNTVRVVPAEENLGLIE

SEQ ID NO: 16756 - DNA, 1431 bp, Streptomyces coelicolor
  CDS (1)..(1431)
atgcgccgttcgaaaatcgtctgtactctcggccccgcggtcgactcccacgagcagctcgtcacgctgatcgaagccggcatgaacgtggcccgcttcaacttcagccatggcacccacgccgagcaccagggtcgttacgaccgggtccgggccgccgccaaggagaccggccgggccatcggcgtcctcgccgacctccagggcccgaagatccgcctggagaccttcgcggagggccccgtcgagctggtgcgcggtgacgagttcaccatcaccgccgaggacgtcccgggcgacaggacgatctgcggcacgacctacaagggcctgcccggtgacgtcaccaagggcgaccaggtgctcatcaacgacggcaacgtcgagctgaaggtcaccgaggtcgagggcccccgggtgaagacgatcgtcatcgagggcggcgtcatctccgaccacaagggcatcaacctgccgggcgcggcggtcaacgtccccgcgctgagcgagaaggacgtcgaggacctccggttcgcgctgcgcatgggctgcgacctggtcgccctctccttcgtccgggacgccaaggacgtcgccgacgtgcaccgcgtcatggacgaggagggccgccgggtcccggtgatcgccaaggtcgagaagccccaggcggtcgacaacatggaggacgtcgtgatggcgttcgacggcgtgatggtcgcccgtggcgacctggccgtcgagtacccgctcgagaaggtccccatggtgcagaagcgcctgatcgagctgtgccggcgcaacgccaagccggtgatcgtggcgacccagatgatggagtcgatgatcacgaactcccggccgacccgcgccgaggcctccgacgtggccaacgcgatcctggacggcgccgacgcggtcatgctgtccgccgagtcgagcgtgggcgcctacccgatcgagaccgtcaagacgatgtcgaagatcgtcaccgccgccgagcaggagctgctctccaagggcctccagccgctggtgccgggcaagaagccgcgcacgcagggcggttcggtggcccgtgcggccgccgagatcgccgacttcctgggcggcaagggcctggtcgccttcacccagtccggcgacaccgcccgccggctctcccgctatcgcgcggcccagccgatcctcgccttcaccaccgacgagtccacccgcaaccagctggcgctcagctggggagtggagccgcacgtggtgccgttcgtgaacaccacggacgagatggtggacctggtggaccaggagacggcccgcctcggccggttcagcgacggcgacaccgtcgtgatcaccgccggttcgccccccggcgtgtccggcaccaccaacatggtgcgggtcctccacctgggcgagacacggcgcggctga

SEQ ID NO: 16757 - protein, 476 aa, Streptomyces coelicolor
MRRSKIVCTLGPAVDSHEQLVTLIEAGMNVARFNFSHGTHAEHQGRYDRVRAAAKETGRAIGVLADLQGPKIRLETFAEGPVELVRGDEFTITAEDVPGDRTICGTTYKGLPGDVTKGDQVLINDGNVELKVTEVEGPRVKTIVIEGGVISDHKGINLPGAAVNVPALSEKDVEDLRFALRMGCDLVALSFVRDAKDVADVHRVMDEEGRRVPVIAKVEKPQAVDNMEDVVMAFDGVMVARGDLAVEYPLEKVPMVQKRLIELCRRNAKPVIVATQMMESMITNSRPTRAEASDVANAILDGADAVMLSAESSVGAYPIETVKTMSKIVTAAEQELLSKGLQPLVPGKKPRTQGGSVARAAAEIADFLGGKGLVAFTQSGDTARRLSRYRAAQPILAFTTDESTRNQLALSWGVEPHVVPFVNTTDEMVDLVDQETARLGRFSDGDTVVITAGSPPGVSGTTNMVRVLHLGETRRG

SEQ ID NO: 16758 - DNA, 1503 bp, Streptococcus thermophilus
  CDS (1)..(1503)
atgaataaacgcgtaaaaatagttgctacacttggtcctgcggttgaaatccgtggtggcaagaaatttggtgaagatggttactggagtgaaaaacttgaccctgatgcatctgctaaaaacattgctcaattgatcgaggaaggtgctaacgttttccgtttcaacttctcacatggtaaccacgctgagcaaggtgaacgtatggatgtcgtacgtatggctgaatctattgctggtcaaaaagtaggtttccttcttgacactaagggacctgaaatccgtactgaattgtttgaaggtgatgctaaagagtatgcatacaaaactggtgaacaaatccgtattgctactaaacaaggtctcaaatcaactcgcgacgttattgctttgaacgttgctggtgcacttgacattttcgacgatgtagaagttggtaaacaagttcttgtggatgatggtaaacttggtcttcgtgttgtagacaaggatgctgaaaaacgtgaattcatcgttgaagttgaaaatgatggtattattgctaaacaaaaaggtgtaaacatcccttacactaaaattcctttcccagcacttgctgaacgtgataatgctgatattcgttttggtctcgaacaaggtattaactttatcgcaatctcatttgtacgtactgcgaaagacgtacaagaagtacgtgctatctgtgaagaaactggaaacggccacgttaaattgttggctaaaatcgaaaaccaacaaggtatcgataatatcgatgaaatcattgaagctgctgatggtatcatgatcgctcgtggtgacatgggtatcgaagtaccattcgaaatggttccagtttaccaaaaaatgattatcactaaagtaaatgctgctggtaaaattgttgttacagctacaaacatgcttgaaacaatgacagaaaaaccacgtgcaactcgttctgaagtatctgacgtgtttaacgcagttatcgacggtactgatgcgacaatgctttctggtgagtctgcaaatggtccatatcccgttgaatcagttcgtacaatggccacaattcataaaaacgctcaaactcttcttaaagagtacggtcgtcttaattcatcaacatttgatcgctcaagtaacactgaagtcgttgcatctgcagttaaagatgctactaactcaatgcatatccaacttattgttgcacttactgaatctggtaacacagctagcttgatcgatacataccgtccagaagctgacatctgggcaataacattcgatgaacttactcaaaaatcattgatgcttaactggggtgttattccagttgttactgaaacaccttcatctactgatgatatgtttgaagttgctgagcgtgttgctcttgaatcaggtcttgtagaatcaggtgataacattgttattgttgctggtgttccagttggttctggtaatacaaatactatgcgtatccgcacagttaaataa

SEQ ID NO: 16759 - protein, 500 aa, Streptococcus thermophilus
MNKRVKIVATLGPAVEIRGGKKFGEDGYWSEKLDPDASAKNIAQLIEEGANVFRFNFSHGNHAEQGERMDVVRMAESIAGQKVGFLLDTKGPEIRTELFEGDAKEYAYKTGEQIRIATKQGLKSTRDVIALNVAGALDIFDDVEVGKQVLVDDGKLGLRVVDKDAEKREFIVEVENDGIIAKQKGVNIPYTKIPFPALAERDNADIRFGLEQGINFIAISFVRTAKDVQEVRAICEETGNGHVKLLAKIENQQGIDNIDEIIEAADGIMIARGDMGIEVPFEMVPVYQKMIITKVNAAGKIVVTATNMLETMTEKPRATRSEVSDVFNAVIDGTDATMLSGESANGPYPVESVRTMATIHKNAQTLLKEYGRLNSSTFDRSSNTEVVASAVKDATNSMHIQLIVALTESGNTASLIDTYRPEADIWAITFDELTQKSLMLNWGVIPVVTETPSSTDDMFEVAERVALESGLVESGDNIVIVAGVPVGSGNTNTMRIRTVK

SEQ ID NO: 16760 - DNA, 1413 bp, Selenomonas ruminantium
  CDS (1)..(1413)
atgttaaaaaagacgaaaatcgtttgcacgcagggtccgtccacagagaaaccgggcgtaattgatgcactgattgccaatggcatgaactgcgcacgcttcaatttctcccatggtgaccacgaagaacatcttggccgtatcaatatggttcgtgaagctgccaagaaggctggcaaggttatctctttaatcctcgataccaaaggtccggaaatgcgtctgggcgagttcaaagatggcaaagttatgctcgaaaagggcaacaagttcactttgacctatgacgatgaaccgggtgatgaaactcatgtttccgtaaaccacaaaggtctttacacggaagttaagccgggcgacaccctgctcctctccgatggcctcgtagctctcaaagttgatgaaatcaagggcaaggatatcgttacgacgattcagaacagcggtaagatgagcacgcgcaagcgcgtagctgctccgggcgtaccccttggtctgcctcctatctccgaacaggatgctaaggacatcatctttggctgcgaacaggatatggatttcgtagctgcttccttcatccagcgtccggatgatgttatcgccatccgcaagctcatcgaagagcacaatggccacatggaaattctgccgaagatcgaaaacctcgaaggtgttaagaacttcgatgcaatcctggaagtttccgacggcatcatggttgcccgtggtgacctgggcgtagaagttccggcagaagatgtgccccttattcagaaggaaatcatccgcaagtgcaacgctgctggcaagccggttatcgttgctacgcagatgctcgactccatggaacgcaacccgcgtccgacccgtgcagaagtttctgacgttggtaacgccatcctcgatggtacggatgccatcatgctgtccggcgaaacggcttccggtgactatccggtagaagcagttgccacgatgaaccgcattgcacagcgcatggaaagctcccttgaatacaaggaactctatgtagaacgtggtctgcagcacatggaatcccgtacgcgtgctatcgctcatgctacggttcagatggcttatgagctcgatgctccggctattatcacgccgaccgaatccggttacacgacgaaggtcgtttccaagtatcgtccgaaggctgctatcgtagcttacacgccgagcgaaaaagttctgcgtcagctgaacctgcgttggggcgtatatccggtactcggcacccagtggagcgatgtggatgaaatgatcagcaatgcaacggctgctgctgttaaggaagacctcgtacagcgcggcgacctcaccatcatcacctccggtgtgaagatggaatcccgtacgcgtgctatcgctcatgctacggacatctaa

SEQ ID NO: 16761 - protein, 470 aa, Selenomonas ruminantium
MLKKTKIVCTQGPSTEKPGVIDALIANGMNCARFNFSHGDHEEHLGRINMVREAAKKAGKVISLILDTKGPEMRLGEFKDGKVMLEKGNKFTLTYDDEPGDETHVSVNHKGLYTEVKPGDTLLLSDGLVALKVDEIKGKDIVTTIQNSGKMSTRKRVAAPGVPLGLPPISEQDAKDIIFGCEQDMDFVAASFIQRPDDVIAIRKLIEEHNGHMEILPKIENLEGVKNFDAILEVSDGIMVARGDLGVEVPAEDVPLIQKEIIRKCNAAGKPVIVATQMLDSMERNPRPTRAEVSDVGNAILDGTDAIMLSGETASGDYPVEAVATMNRIAQRMESSLEYKELYVERGLQHMESRTRAIAHATVQMAYELDAPAIITPTESGYTTKVVSKYRPKAAIVAYTPSEKVLRQLNLRWGVYPVLGTQWSDVDEMISNATAAAVKEDLVQRGDLTIITSGVKMESRTRAIAHATDI

SEQ ID NO: 16762 - DNA, 1494 bp, Arabidopsis thaliana
  CDS (1)..(1494)
atggagatgttacttggtggacaagcaaccaatggagctcttcgttcaaagacgaagatagtttgtactcttggaccagcttcaagatcggtggagatgattgagaagcttctcaaggctggtatgaacgtagcccggttcaatttctcccatggttctcactcttaccatcaagaaactctcgataatctcagaaccgccatggacaacactggtatcctctgcgccgtcatgctcgacacaaagagtcctgtgatacgaaccgggtttctcaaagaaggcaaaccgatacagctaaagcaaggtcaagagatcaccatctcaattgattacaagatacaaggagattccaacactatctccatgagctacaagaaacttgcagaggatctcaaacctggtgacgtgatcctttgttcagacggaacaatctctctaaatgtcttgtcctgtgacaagtatctcggtcttgttcgttgccgatgcgagaactctgctcttcttggagaaagaaaaaacgttaatcttcctggaattgtagttgatctcccaacactcactgagaaagataaagaagatattatgcaatggggagttccgaacaaaatcgacattatcgctctctcttttgttcgtaaaggatctgacctaatccaagtaaggaaattacttggagagcactcaaagagcatcatgcttatgtcaaaggtggagaatcaagaaggagtaatgaatttcgataagatcctggagaattctgatgctttcatggtggctagaggagatcttgggatggagataccaatcgaaaagatgtttcttgctcagaaaacaatgatcaacaaggctaatgctcatgggaaaccagtggtcacagccacacagatgcttgaatccatgacagtctctcctcgcccgactagagctgaagctaccgacgtagcaaacgcggttcttgacgggacagattgcgttatgcttagcggagaaactgctgctggagctcaccctgagactgccgtgttaacaatgtcaaggatctgcaaagaagcagaggatttcatagattacgacattctccacaagaaaaccctaggaatggtttcgttaccgttatctccaatcgagagcttagctgcttcagctgtttcgactgcgcggagtgttttcgcgtccgcgatcgttgttctcactagaggcggttacacggcggagcttgtggctaaatacaggccaagcgttccgattctgtcggtgattatgccagagattgctgaatgctcggactcggtagctcatgtggcgagacgtggtttgatttaccgtgggattattccggtggtgggatgttcagctagagattcaacggaggagatgattagattagctataggatttgccaagacgaagggaatttgtaagactggagattccattgtggctttgcacaagattgatggttcatctattgtcaggatagtgagcgtcgagtaa

SEQ ID NO: 16763 - protein, 497 aa, Arabidopsis thaliana
MEMLLGGQATNGALRSKTKIVCTLGPASRSVEMIEKLLKAGMNVARFNFSHGSHSYHQETLDNLRTAMDNTGILCAVMLDTKSPVIRTGFLKEGKPIQLKQGQEITISIDYKIQGDSNTISMSYKKLAEDLKPGDVILCSDGTISLNVLSCDKYLGLVRCRCENSALLGERKNVNLPGIVVDLPTLTEKDKEDIMQWGVPNKIDIIALSFVRKGSDLIQVRKLLGEHSKSIMLMSKVENQEGVMNFDKILENSDAFMVARGDLGMEIPIEKMFLAQKTMINKANAHGKPVVTATQMLESMTVSPRPTRAEATDVANAVLDGTDCVMLSGETAAGAHPETAVLTMSRICKEAEDFIDYDILHKKTLGMVSLPLSPIESLAASAVSTARSVFASAIVVLTRGGYTAELVAKYRPSVPILSVIMPEIAECSDSVAHVARRGLIYRGIIPVVGCSARDSTEEMIRLAIGFAKTKGICKTGDSIVALHKIDGSSIVRIVSVE

SEQ ID NO: 16764 - DNA, 1920 bp, Lilium longiflorum
  CDS (145)..(1677)
cgcggggctggtcaattcttccctcaaacaagtgctcattccaccatcctcctcctcccccactgttttctcactgcgttcccaaaccaacagctccccctctcccccagatctagggttagggtttcagttccccatctcgccatggcgaacatcgacatcgagggcatcctgaaggagctcccggccgacggccgcgtcccgaagacgaaattggtctgcaccctcgggccgtcgtccagatccgtgccgatgctcgagaagctgctgcgcgccggcatgaacacggccagattcaacttctcccacggcacgcacgagtatcaccaggagacgctcgataacctccggatcgcaatgcagaacacgcagattctctgcgccgtcgtgctcgataccaagggtcctgagattcgcactgggtttctgaaggatggaaaggccgtccaaccaaaggagggtcaagaaatcatagtgagcactgattacgatctcaaaggcggcgggaatacaattactatgagttacaagaaacttcctgtggatatgaaacctggaggcacaatcctgtgtgcagatggcagcattagcttaactgtcctatcatgtgacccagatgccggaactgtgagatgccgctgtgagaatactgcacttttaggtgagagaaagaatgtcaatctgccaggtgttgttgtggatctccccacactgacagagaaggacaaggaagacattttggaatggggtgttcccaacaacattgatatgattgctctgtccttcgtgcgcaagggctccgatcttgtcaatgtccgacaggttcttggatctcatgcaaaaaacataaagttgatgtcaaaggttgagaaccaagagggtgtcgtaaacttcgatgaaatcttaaaagagacagatgccttcatggttgcccgtggtgatctgggcatggaaattcccgttgagaagatcttccttgctcagaagctgatgatatacatatgcaaccttgcgggcaagcctgttgtcactgccacccagatgcttgagtctatgataaaatcccctcgcccgacacgtgctgaagccactgatgtcgccaatgccgtcctcgatggcaccgactgcgtcatgcttagtggcgaaagtgcggcgggagcctatctagagatagccgtgaaggtcatggccaagatatgtatcgaggcagagtcatcccttgattatgatgccatcttcaaggagatgataaggtctgcgcctctccccatgagcccactggagagtcttgcgtcctcggctgtccgtactgcgaacaaggccaaggcggctctgattgttgtattgacccgtggtgggactacagccaagctggtagcgaagtaccgcccggcagtgccaatcctgtctgtggtggtgccagtgctgacaagcgattcgttcgactggaatgttagtgacgagtcaccagcaaggcatagcctcatctacagaggcctcatcccgctgctagcggagggttctgcgaaggcgactgatgccgagtcgacagaggtgatcctggaggctgcactcaagtcagcgacggcaaggaggctgtgcaaacctggtgactctattgttgcgctgcatcgcattggtgttgcttctgtcattaaaatttgcatagtgaaatgattaatgaatgagacccggcgactgtctgtcgagttactgctatttttatgaacgaaactcagttgttttgttatgcataaacagttatgacaaactcagtttgtaggtatgcaagttgtatacataaccagttgggtattggagaggggactccatattcttgtaaagcccgctgatgaagatttgtaccgattctggtattaaggttgattaaattctgtggttcttctagccaaaaaaaaa

SEQ ID NO: 16765 - protein, 510 aa, Lilium longiflorum
MANIDIEGILKELPADGRVPKTKLVCTLGPSSRSVPMLEKLLRAGMNTARFNFSHGTHEYHQETLDNLRIAMQNTQILCAVVLDTKGPEIRTGFLKDGKAVQPKEGQEIIVSTDYDLKGGGNTITMSYKKLPVDMKPGGTILCADGSISLTVLSCDPDAGTVRCRCENTALLGERKNVNLPGVVVDLPTLTEKDKEDILEWGVPNNIDMIALSFVRKGSDLVNVRQVLGSHAKNIKLMSKVENQEGVVNFDEILKETDAFMVARGDLGMEIPVEKIFLAQKLMIYICNLAGKPVVTATQMLESMIKSPRPTRAEATDVANAVLDGTDCVMLSGESAAGAYLEIAVKVMAKICIEAESSLDYDAIFKEMIRSAPLPMSPLESLASSAVRTANKAKAALIVVLTRGGTTAKLVAKYRPAVPILSVVVPVLTSDSFDWNVSDESPARHSLIYRGLIPLLAEGSAKATDAESTEVILEAALKSATARRLCKPGDSIVALHRIGVASVIKICIVK

SEQ ID NO: 16766 - DNA, 1413 bp, Vibrio marinus
  CDS (1)..(1413)
atgaaaaagactaaaattgtttgtacaattggtccaaaaactgaatcagtagagaaactaacagagcttgttaatgcaggcatgaacgttatgcgtttaaatttctctcatggtaactttgctgaacattcagtgcgtattcaaaatatccgtcaagtaagtgaaaacctgaataagaaaattgctgttttactggatactaaaggtccagaaatccgtacgattaaactagaaaacggtgacgatgtaatgttgaccgctggtcagtcattcacgtttacaacagacattaacgtggtaggtaataaagactgtgttgctgtaacatatgctggttttgctaaagaccttaatcctggtgcaatcatccttgttgatgatggtttaattgaaatggaagttgttgcaacaactgacactgaagttaaatgtacagtattaaatactggtgcacttggtgaaaataaaggcgttaacttacctaacatcagtgtaggtctacctgcattgtcagaaaaagataaagctgatttagcgtttggttgtgagcaagaagttgattttgttgctgcatcatttattcgtaaggctgatgatgtaagagaaattcgtgaaatcctatttaataatggtggcgaaaacattcagattatctcgaaaattgaaaaccaagaaggtgtagacaatttcgatgaaatcttagctgaatcagacggtatcatggttgctcgtggcgatctcggtgttgagatcccagttgaagaagtgatcatggcacagaagatgatgatcaaaaaatgtaataaagcaggtaaagttgtaattactgcaacacaaatgcttgattcaatgatcagtaacccacgtccaacacgtgcagaagcgggcgatgttgccaatgctgtgcttgacggtaccgacgcggtaatgctttctggtgaaactgcgaaaggtaaatacccagttgaagctgtgtctatcatggcaaacatctgtgaacgtactgataactcaatgtcttcggatttaggtgcgaacattgttgctaaaagcatgcgcattacagaagctgtgtgtaaaggtgcggtagaaacaacagaaaaattgtgtgctccacttattgttgttgcaactcgtggcggtaaatcagcaaaatctgttcgtaaatacttcccgaaagcaaatattcttgctatcacaacaaatgaaaaagcagcgcaacagttatgcctaactaaaggcgtaagcagctgcatcgttgagcagattgatagcactgatgagttctaccgtaaaggtaaagagcttgcattagcaactggtttagctaaagaaggcgatatcgttgttatggtatcaggtgcgttagtaccatcaggtacaacgaatacggcatctgttcaccaactttaa

SEQ ID NO: 16767 - protein, 470 aa, Vibrio marinus
MKKTKIVCTIGPKTESVEKLTELVNAGMNVMRLNFSHGNFAEHSVRIQNIRQVSENLNKKIAVLLDTKGPEIRTIKLENGDDVMLTAGQSFTFTTDINVVGNKDCVAVTYAGFAKDLNPGAIILVDDGLIEMEVVATTDTEVKCTVLNTGALGENKGVNLPNISVGLPALSEKDKADLAFGCEQEVDFVAASFIRKADDVREIREILFNNGGENIQIISKIENQEGVDNFDEILAESDGIMVARGDLGVEIPVEEVIMAQKMMIKKCNKAGKVVITATQMLDSMISNPRPTRAEAGDVANAVLDGTDAVMLSGETAKGKYPVEAVSIMANICERTDNSMSSDLGANIVAKSMRITEAVCKGAVETTEKLCAPLIVVATRGGKSAKSVRKYFPKANILAITTNEKAAQQLCLTKGVSSCIVEQIDSTDEFYRKGKELALATGLAKEGDIVVMVSGALVPSGTTNTASVHQL

SEQ ID NO: 16768 - DNA, 1524 bp, Oryza sativa
  CDS (1)..(1524)
atggaggagcagcaggagggagccgcgggggtgatgcggcggaggcccaagacgaagatcgtgtgcacgctggggccggcgtcgaggtcggtggagatgatcgggcggctgctccgcgccgggatgtgcgtcgcgcgcttcaacttctcccacggatcccacgagtaccaccaggagacgctcgacaacctccgcgccgccatggagagcaccggcatcctctgcgccgtcatgctcgacaccaaggggccagagatccgaactggatttctgaaagatggaaaacccgtacagttgaagaagggtcaagaaatcacagtttcaactgattatagcataaagggtgatgacaacatgatatcaatgagctacaagaagctagcggtggatctgaagccaggcagtgtaatattatgtgctgatggcaccatcactcttactgtccttcactgtgataaagagcaaggcttggttcgctgccgttgtgagaacactgctatgcttggtgagaggaagaatgttaaccttccaggagttattgttgatctcccgacacttactgagaaggacaaggaggatattcttaaatggggtgtcccaaacaagattgacatgattgctctgtcttttgttcgtaaaggctcagaccttgtagaggtcaggaaggtgcttgggaagcatgcaaagtcaataatgctgatgtcaaaggttgagaatcaagagggagtggctaactttgatgatatcctggcacaatctgatgcttttatggttgcaaggggtgatttgggaatggaaattccgatagagaagatcttttatgcacagaaggtgatgattttcaagtgcaatattcagggcaagccagttgtgactgcaacccagatgttggaatctatgatcaagtctccccgccctactagagcagaagcgactgatgttgccaatgcagttcttgatggcactgactgtgtcatgctcagtggtgagacagctgctggggcttacccggaactggctgtacggaccatggccaagatctgcctgcaagcggagtcatgcgtcgaccatgccgctgttttcaagtccattaccgcatcagctccaattcccatgagcccattggagagccttgcatcatcagctgtgcgtacagcgaactctgccaaggcggcgctcatcttggtcctgactaggggaggaacaactgctaggctggtggccaagtacaggccatccatgccgattctgtccgtcgtggttcctgagctgaaacagaccgactccttcgactggacctgcagcgacgaagctcctgcgcggcacagcctcatcgtcaggggagtgatcccgatgctgagtgcagccactgccaaggccttcgacaacgaagccactgaagaagctctcgggttcgccatcagcaacgccaaggcgatggggctctgcaactccggtgagtccgtcgtcgccctccaccggatcggaactgcatctgtcatcaagctcctgacagcgaactag

SEQ ID NO: 16769 - protein, 507 aa, Oryza sativa
MEEQQEGAAGVMRRRPKTKIVCTLGPASRSVEMIGRLLRAGMCVARFNFSHGSHEYHQETLDNLRAAMESTGILCAVMLDTKGPEIRTGFLKDGKPVQLKKGQEITVSTDYSIKGDDNMISMSYKKLAVDLKPGSVILCADGTITLTVLHCDKEQGLVRCRCENTAMLGERKNVNLPGVIVDLPTLTEKDKEDILKWGVPNKIDMIALSFVRKGSDLVEVRKVLGKHAKSIMLMSKVENQEGVANFDDILAQSDAFMVARGDLGMEIPIEKIFYAQKVMIFKCNIQGKPVVTATQMLESMIKSPRPTRAEATDVANAVLDGTDCVMLSGETAAGAYPELAVRTMAKICLQAESCVDHAAVFKSITASAPIPMSPLESLASSAVRTANSAKAALILVLTRGGTTARLVAKYRPSMPILSVVVPELKQTDSFDWTCSDEAPARHSLIVRGVIPMLSAATAKAFDNEATEEALGFAISNAKAMGLCNSGESVVALHRIGTASVIKLLTAN

SEQ ID NO: 16770 - DNA, 1533 bp, Arabidopsis thaliana
  CDS (1)..(1533)
atggagaagttacttgctggacaaacaaacaatggatccctcaagtcaaagacgaagatcgtctgtactctcggaccggcttcgagatcggttgagatggttgagaagcttctcaaagccggtatgaacgtagcccggttcaacttctcccatggttctcactcataccatcaagaaactcttgacaatctcagaaccgccatggagaacacttgtattccctgtgccgtcatgctcgacaccaagggtcctgagatccgaaccgggtttctcaaagaaggcaaaccggttgagctaattcaaggtcaagagattacaatctcaactgattacaccatggaaggagattcaaacacaatctcaatgagttacaagaaacttgctgaagatctcaagtccggtgacgtgattctctgttccgacggtacaatctctcttaccgtcttgtcttgtgacaagaatctcggtcttgttcgtgcccgttgcgagaactctgcagttcttggagaaagaaagaacgtgaacctccctggaatcgtagttgatcttccaacactcacagagaaggatcaagaggatattctccaatggggagttccgaataagatcgatatcatcgctctttcctttgttcgtaaaggatctgatctggtcgaggtcaggaagttgcttggagagaacgcaaagagtatcatgctcatgtcaaaggtggagaatcaagaaggagtgatgaattttgacaagattctggaatattctgatgcattcatggtggctagaggtgatttaggaatggagattccgattgaaaagatgtttcttgctcagaagatgatgattcagaaggctaatgctcttgggaagccaatcgtcacagccacacagatgcttgagtcaatgaccaaatctcctcgtccaactagagcagaagccaccgatgtagctaacgctgtccttgacggcactgattgcgtcatgctcagtggagaaaccgccgccggagctcaccctgaaaccgccgtgctaacaatgtcaagaatctgtaaggaagcagaggatttcatcgattacgacacaatgcacaagaagattcaagatatcgtttcgttgcctttatctcctattgagagcttggccgcttcagccgtttcgacggcgaggagtctttgtgcggctgcgattgtcgttctaaccaagggaggttacacggtggagcttgtggccaagtacaggcctagtgttccgattctgtccgtaattgtgccggagattactcgtacggatgatttcgagtggtcgtgctctgaatctgcggctcatgtggcaagacgtggtttgatctaccgtggaattgttcctgtgatggcgacgggagcatccgctaggtcttcgaacaaggactcgacggaggagacgattcaattcgccattgaattcgcgaagaagaagggaatatgtaagacaggagactcgattgtggcgttgcacaagatcgatggctcctctgttgtcaagattttgaacgtggagtag

SEQ ID NO: 16771 - protein, 510 aa, Arabidopsis thaliana
MEKLLAGQTNNGSLKSKTKIVCTLGPASRSVEMVEKLLKAGMNVARFNFSHGSHSYHQETLDNLRTAMENTCIPCAVMLDTKGPEIRTGFLKEGKPVELIQGQEITISTDYTMEGDSNTISMSYKKLAEDLKSGDVILCSDGTISLTVLSCDKNLGLVRARCENSAVLGERKNVNLPGIVVDLPTLTEKDQEDILQWGVPNKIDIIALSFVRKGSDLVEVRKLLGENAKSIMLMSKVENQEGVMNFDKILEYSDAFMVARGDLGMEIPIEKMFLAQKMMIQKANALGKPIVTATQMLESMTKSPRPTRAEATDVANAVLDGTDCVMLSGETAAGAHPETAVLTMSRICKEAEDFIDYDTMHKKIQDIVSLPLSPIESLAASAVSTARSLCAAAIVVLTKGGYTVELVAKYRPSVPILSVIVPEITRTDDFEWSCSESAAHVARRGLIYRGIVPVMATGASARSSNKDSTEETIQFAIEFAKKKGICKTGDSIVALHKIDGSSVVKILNVE

SEQ ID NO: 16772 - DNA, 2693 bp, Drosophila melanogaster
  CDS (351)..(2585)
attttattcgtttttgacaggtaacactacattttatttttgtttcggtgtatcaaaatttattcaaaattcatccatacgcaagaatccttagtccagggtccacagtgcccatatgttccacttgcctgttaaacctaagatatcgctgctatgccagcaaatgcaagaaagagaagaaaccaccgaagttccgactggaccgcggaccattcgcctcccagttggattaccagtcgcgactgcagtaccaagcacctgccctgagtatccccctcagcagcatcatatgcaccattggaccctcatccaacagcccagaaaagctattggagctcatccgggctgggatgcgggtcgtgcgtatgaacttctctcacggctctcacgagtatcactgccagacaatacaggcggctcgtaaggccatcgccatgtacgtggagcaaacgggtctgcccagaacattggcaattgctctggacaccaagggtccagagatccggacgggcaaactggccggtggcaatgatagggctgagatagagctcaagaccggagacaaagtgacattgagcaccaagaaggagatggcagacaagagtaacaaggataatatctatgtggattatcagaggctacctcaactggtcaaaccaggaaatcgggtatttgtagacgacggattgattgcattgatcgtgaaggaatcaaagggagatgaagtgatctgtcaggtggagaacggtggcaagctgggctcccacaagggaatcaatttgccaggagttccggtagatcttcccagcgtaacggagaaggataagcaggatcttaaatttggggccgagcaaaaggtggacatgatcttcgcatcgttcatacgagacgcaaatgctctgaaggaaatccgccaagtacttggaccggctggagcgtgtataaagatcatctctaagattgaaaaccaccaaggtctggtaaacatagacgacattatccgtgaatcagatggcataatggtggcccgaggtgatatgggcattgagatacccacggaggatgttcccctagcccagaaatcgattgtggctaagtgcaacaaggtgggcaagcctgtgatctgtgccacccagatgatggagtcgatgacgaacaagccgcgacccactcgtgccgaagcctcggatgtggccaacgctattttcgatggctgcgatgccgtaatgctgtccggtgaaacggccaagggcaagtatccggtggagtgcgtccagtgcatggccaggatctgtgccaaagtagaagcagttctatggtacgaaagcctgcagaacagccttaaaagggaaatccggaccagtgctgccgaccacatttcggcagttaccacggcgatcgcggaggcggccacggtgggccaagcccgggcaattgtggtggccagtccgtgctccatggtggcccaaatggtcagtcacatgaggccgccatgtccaattgtcatgctcacgggtaacgaatccgaggcggcccagtctctgctctttcgcggcatctacccactcctcgttgaggaaatggttattggcagctttaactttcgacgcatcatgcagtcgggcctgaagctgatgggcaagatggacatcttggagccgggtcagaaaggatcggtggtgctggttaatgccatgtcggcagaaaagatcaccttccggctgttcactatccgtcagcagaccaaggaagaacgcgatcaggatgagcgatgccgaaaattggccctagagcagagctgcaaggagagggctgaaaaggaggaatgcagaaagctccagcaagcggaagaatgtcagaagcaaaaactggccaaaaaatgtaaacagttcgaagagaagcaaaaggtctgccccaaaaagaatgatactccgaagaatgattgtccgaagaaagattgtccgaagaaagaatgtcccaagcaagatgacgaaatctcaaagtgcaggcaaatgcaagaagcggaagctgaagaaaggaagtgcaaagaagagtttgaacagatgtgcaaattagctgaagaaaaaaggaaagaagctgaaaaatgcaggaaagcggacgaagaacgaaggaaagaggaagctgaaaagtgcaggaaattggaagaagataggaaatgcaaattggctgaagagaagaaaaggaatgaagaagaacttaagataatagaagcagaagtggccaaactggaagctgctgagaaggccaagcgtttgaaggaggaagagaaaaagaaggaagaactaatgaagtgcaagcaacgaaatgaagcgaaaaaaaagagggaagaggctgaaaggtgcaagagaaaggaaagagaaagggagctagctgaaatggaaaacaaatggaaacaggttgcggagaaaagaaagagaaagaaggcagcagagatgtgcaggaaaatagaggatgcaaaagaaaaagccgcggcagaatcggctgataagattctgaaagctgtgtgcgaaaaactaaagcaatctctctcggatccggacaaatcaaaaaagggcaagaaataaagtgaaagctaatggcagatttatatggaacattttaacttttaatacggtgttacacaccgaattccaaattattatataaaactattggaattttttaaattttct

SEQ ID NO: 16773 - protein, 744 aa, Drosophila melanogaster
MRVVRMNFSHGSHEYHCQTIQAARKAIAMYVEQTGLPRTLAIALDTKGPEIRTGKLAGGNDRAEIELKTGDKVTLSTKKEMADKSNKDNIYVDYQRLPQLVKPGNRVFVDDGLIALIVKESKGDEVICQVENGGKLGSHKGINLPGVPVDLPSVTEKDKQDLKFGAEQKVDMIFASFIRDANALKEIRQVLGPAGACIKIISKIENHQGLVNIDDIIRESDGIMVARGDMGIEIPTEDVPLAQKSIVAKCNKVGKPVICATQMMESMTNKPRPTRAEASDVANAIFDGCDAVMLSGETAKGKYPVECVQCMARICAKVEAVLWYESLQNSLKREIRTSAADHISAVTTAIAEAATVGQARAIVVASPCSMVAQMVSHMRPPCPIVMLTGNESEAAQSLLFRGIYPLLVEEMVIGSFNFRRIMQSGLKLMGKMDILEPGQKGSVVLVNAMSAEKITFRLFTIRQQTKEERDQDERCRKLALEQSCKERAEKEECRKLQQAEECQKQKLAKKCKQFEEKQKVCPKKNDTPKNDCPKKDCPKKECPKQDDEISKCRQMQEAEAEERKCKEEFEQMCKLAEEKRKEAEKCRKADEERRKEEAEKCRKLEEDRKCKLAEEKKRNEEELKIIEAEVAKLEAAEKAKRLKEEEKKKEELMKCKQRNEAKKKREEAERCKRKERERELAEMENKWKQVAEKRKRKKAAEMCRKIEDAKEKAAAESADKILKAVCEKLKQSLSDPDKSKKGKK

SEQ ID NO: 16774 - DNA, 1413 bp, Salmonella typhimurium
  CDS (1)..(1413)
atgaaaaagacgaaaattgtttgtactatcggtccgaaaaccgaatccgaagagatgttaagcaaaatgctggacgcgggcatgaacgtgatgcgtctgaacttctctcatggcgattatgcagaacacggtcagcgtatccagaacttgcgcaacgtgatgagcaaaactggtaaaaaagctgctattctgcttgatactaaaggaccagaaatccgcaccattaaactggaaggcggtaacgacgtttcgctgaaagcgggccaaacctttacttttaccaccgacaaatccgtggtcggtaataatgaaatcgttgccgtcacctatgaaggcttcaccagcgacctgagcgttggcaacaccgtcctggttgacgatggtctgatcggtatggaagtgaccgccatcgaaggcaataaagtcatttgtaaggtgctgaacaacggcgatctgggcgagaacaaaggcgttaacctgccgggcgtttctattgctctgccggcgctggctgaaaaagacaaacaggacctgatcttcggttgcgaacagggcgttgactttgttgctgcgtcctttatccgtaaacgttctgacgttgtcgaaattcgcgagcatctgaaagcccacggcggcgaaaacatccagattatctctaagatcgaaaaccaggaaggcctgaacaacttcgatgaaattctcgaagcttccgacggcatcatggttgcgcgtggcgacctgggcgtagaaatcccggttgaagaagtgatctttgcgcagaaaatgatgatcgaaaaatgtatccgcgcacgtaaagtcgtgatcaccgcgactcagatgctggattctatgatcaaaaatccgcgtccgacccgcgcagaagcaggcgatgttgcaaacgccatcctcgacggtacggatgcggttatgctgtccggcgaatccgcaaaagggaaatacccgctggaagccgtttctatcatggcgaccatctgcgaacgtaccgaccgcgtcatgaacagccgtctggactacaacaacgacagccgtaaactgcgcattacggaagcggtatgccgcggcgcggtagaaaccgccgaaaaattggaagcgccgctgatcgtggtagcgacccagggcggtaaatccgctcgcgccgtgcgtaaatacttcccggacgccaccatcctggcattgaccaccaatgaagtgaccgcccgtcagttagtactgagcaaaggcgtggtatcgcagctggtgaaagaaatcaattctactgatgatttctaccgtctgggcaaagatgtcgccctacaaagcggcctcgcccagaaaggcgacgtcgtagtgatggtctccggcgcgctggttccaagcggcaccactaacaccgcctctgttcacgtactgtaa

SEQ ID NO: 16775 - protein, 470 aa, Salmonella typhimurium
MKKTKIVCTIGPKTESEEMLSKMLDAGMNVMRLNFSHGDYAEHGQRIQNLRNVMSKTGKKAAILLDTKGPEIRTIKLEGGNDVSLKAGQTFTFTTDKSVVGNNEIVAVTYEGFTSDLSVGNTVLVDDGLIGMEVTAIEGNKVICKVLNNGDLGENKGVNLPGVSIALPALAEKDKQDLIFGCEQGVDFVAASFIRKRSDVVEIREHLKAHGGENIQIISKIENQEGLNNFDEILEASDGIMVARGDLGVEIPVEEVIFAQKMMIEKCIRARKVVITATQMLDSMIKNPRPTRAEAGDVANAILDGTDAVMLSGESAKGKYPLEAVSIMATICERTDRVMNSRLDYNNDSRKLRITEAVCRGAVETAEKLEAPLIVVATQGGKSARAVRKYFPDATILALTTNEVTARQLVLSKGVVSQLVKEINSTDDFYRLGKDVALQSGLAQKGDVVVMVSGALVPSGTTNTASVHVL

SEQ ID NO: 16776 - DNA, 1425 bp, Agrobacterium vitis
  CDS (1)..(1425)
atgttcattcgcagcaaccgccgcgccaagatcgtcgcaacagtcggccctgcctcaagttcaccggcaatactgaggtcgctgttcctggcaggcgtcgatacgttccggctcaatttcagccatggaagccgcgacgaccatgccgccgcctaccgccacatccgcgcgctggaaaaggagctgggaacctcgatcggcatccttcaggacctgcagggcccgaagatccgcatcggcgtgcttcacgaaggccggctgcagctgacgaaggacgcggaaatccgcttcgtgtgcgggaccgaaccagggcgcgggctgatggacattccccttccccatcgcgagatcttcgcggcagtcaagccgggcgacgatctgctgatcgacgatggacgggtgcgagtgcgggcgctgggcgtcagcgacgaattcatcgatgcaaaagtcatcgtcgctggaccgatatccaaccgcaagggtgtcaacctgccgggaaccgtcctcgatatttcccctctcaccccgaaggatcgcaaggatctcgaattcgggctggaactcggcgtcgactggatcgccctatcattcgtgcagactgcccgcgacatgatcgaagcccgatcgctggtcagcgacagggccgggctgatcgccaagatcgaaaaaccctcggcactggacgagatcgacgacatcgtagcgctttccgacgccatcatggtggcgcgcggcgatcttggtgtggaaatcccgcccgaggatgtgccgggccgtcagaaggaactcatccgcgcctgccgtatcgccgccaaaccggtgatcgtcgccacgcagatgctcgactcgatggtgacctcgccgacgccgacgcgcgcagaagcctcggacgtggcgggagcgatctatgacggcgccgacgccgtgatgctctcggcggagtctgcaacgggcgccttcccggtcgaaacggtggagatcatgagccgtatcatcgaaaagaccgaaaaacataaattctaccggccgatcctcgaagcgaccgaaccacagattgcccatacccctccgcacgcagtcgccaccgccgcggcagatgtcgcccttgccctgaaggcccctgttatcgtcgcgtttacggtcagcggcacgaccgcttccagaatcagccgggcacggccaccgctcccgatcctcgccctgacgccatccgaacagaccgcgcgtcagctcggactgatgtggggcgtcgtcagcctgctttcgccgacagtcgacacctatgaacaatccgtcgatcgcgccacccaggccgccgtacaaaccggcctggcggagaaaagcgatcagatcgtcgtggtgacgggatttccctttgcgaccgcgggcagcaccaacaaccttcgcgtcacccaggcgggttga

SEQ ID NO: 16777 - protein, 474 aa, Agrobacterium vitis
MFIRSNRRAKIVATVGPASSSPAILRSLFLAGVDTFRLNFSHGSRDDHAAAYRHIRALEKELGTSIGILQDLQGPKIRIGVLHEGRLQLTKDAEIRFVCGTEPGRGLMDIPLPHREIFAAVKPGDDLLIDDGRVRVRALGVSDEFIDAKVIVAGPISNRKGVNLPGTVLDISPLTPKDRKDLEFGLELGVDWIALSFVQTARDMIEARSLVSDRAGLIAKIEKPSALDEIDDIVALSDAIMVARGDLGVEIPPEDVPGRQKELIRACRIAAKPVIVATQMLDSMVTSPTPTRAEASDVAGAIYDGADAVMLSAESATGAFPVETVEIMSRIIEKTEKHKFYRPILEATEPQIAHTPPHAVATAAADVALALKAPVIVAFTVSGTTASRISRARPPLPILALTPSEQTARQLGLMWGVVSLLSPTVDTYEQSVDRATQAAVQTGLAEKSDQIVVVTGFPFATAGSTNNLRVTQAG

SEQ ID NO: 16778 - DNA, 1449 bp, Agrobacterium vitis
  CDS (1)..(1449)
atgttcatacgcaacaaccggcgatcaaagatcgtcgcgacggtcggaccggcgtcaagttcgcccgacatgcttcgctcactgtttctcgccggtgtcgatacgttccgcctgaatttcagccatggtgcccgggccgatcacgcggaagtctataggaacatccgggctctcgagcaggagcatgatgctgctatcgccgtgctgcaggatcttcagggtccgaagatccggatcggagttctggcacatggcaggctcgatctcgcacgtggatccaccatcggatttatccttggccgtgagggtggtgaaggaatgaacgatattccgctacctcatcgggaaatcttcgaggtggcggtgcccggaatggacctcctgatcgacgacggtagaataaaagtccggatcatggaggtgatggacgggcggcttgtttgcgaggtcctcaatggaggcgccttgtcgaaccgcaagggtgtcaacgtgcccggcgctgtcctggacatttccccgctcacggcgaaagatcgtgaggacctggaattcgggctcgagcttggcgtcgactgggtcgcactttctttcgttcagcgggcacgcgacatgatcgaagcccggtccctcgttggagacagggctggcctcattgccaagatcgagaagccgtctgccctcgatgacatcgaggatattgtcaggctttcggacagcgtcatggttgcgcgaggtgatctcggcgtggagatcccgccggaggacgttccgggcaagcagaaggaaatcatccgtgcatgccggctagcggccaagcccgtgattgtcgccacacagatgctcgactcgatggtgagttcgccaacgccgacgcgcgctgaagcttcggacgttgccggtgccatctatgatggggcagatgccgtcatgctttccgccgagaccgcaacaggcgcctacccggtggaggcggtcgaaattatgaaccggatcatcgagaagacggagaagcacaagcactaccggccgatccttgaggcaacggaacccgatgtcgctcaatcaccgccgcatgcagttgccactgcagcagccaacgttgccgtggctctgggatcgccggttgtggtggcctatacatcgagcggaacaaccgcggccagaatttcgcgtgccagaccggcattgccaattctggctctcactccgtccgaacaagtcgcgcgccggctcaacatgttctggggggttgtcggcgtgcgatcacaagatgtccacacctatgaggcgtcgctgattcatgcgcaacaggcggtgcaggaagcaaagctggcaagtccctccgatcacattgtcatcgtggcgggatttccatttgcgcaacagggcagcaccaacaatctccgcgtcgttcagatcgccgcaaccgacaacctagagattgcgtag

SEQ ID NO: 16779 - protein, 482 aa, Agrobacterium vitis
MFIRNNRRSKIVATVGPASSSPDMLRSLFLAGVDTFRLNFSHGARADHAEVYRNIRALEQEHDAAIAVLQDLQGPKIRIGVLAHGRLDLARGSTIGFILGREGGEGMNDIPLPHREIFEVAVPGMDLLIDDGRIKVRIMEVMDGRLVCEVLNGGALSNRKGVNVPGAVLDISPLTAKDREDLEFGLELGVDWVALSFVQRARDMIEARSLVGDRAGLIAKIEKPSALDDIEDIVRLSDSVMVARGDLGVEIPPEDVPGKQKEIIRACRLAAKPVIVATQMLDSMVSSPTPTRAEASDVAGAIYDGADAVMLSAETATGAYPVEAVEIMNRIIEKTEKHKHYRPILEATEPDVAQSPPHAVATAAANVAVALGSPVVVAYTSSGTTAARISRARPALPILALTPSEQVARRLNMFWGVVGVRSQDVHTYEASLIHAQQAVQEAKLASPSDHIVIVAGFPFAQQGSTNNLRVVQIAATDNLEIA

SEQ ID NO: 16780 - DNA, 2006 bp, Solanum tuberosum
  CDS (99)..(1631)
cctggcaaaagcacaagaaacaaacagtagcactaaaatcttgaaggggtggtttagcttgatctgtagcttttgttagtgactgataaatagaagaaatggccaacatagacatagctggaatcatgaaggatctcccaaatgatggccgtattccaaagaccaagattgtttgcacgttagggccatcttctagaacagtgccaatgctggagaagcttctccgtgctggcatgaacgttgccaggtttaacttttctcatgggacccatgagtaccatcaggagacattggacaatcttaagattgctatgcagaatactcagatcctgtgtgctgtcatgcttgacaccaaggggcctgagattcgtactggtttcttaacagatggaaaaccgattcagcttaaggaaggtcaagaaatcactgtatccacagactataccataaaaggaaatgaagaaatgatctcaatgagctataagaagttggtaatggacttgaagcccggcaataccattttgtgtgcagatggtaccataacccttactgttttgtcatgtgatccaccgtctggaacggtgagatgtcgctgcgagaatactgccaccttaggagagaggaagaatgtaaaccttccaggtgtggttgtggaccttccaacacttacagagaaggataaagaagatatactagagtggggtgttcctaacaacattgatatgatagcgctttcgtttgtgcgtaagggttcagatcttgtcaatgttcgcaaggttcttggtccacatgccaagcgcattcaactaatgtcaaaggttgaaaaccaagaaggggtaatcaactttgatgaaatccttcgtgagacagattcttttatggttgctcgaggtgatctcggaatggaaattccagttgagaagattttcttggctcagaaaatgatgatatacaagtgtaatcttgctggcaaagctgtggtaactgccactcagatgcttgaatcaatgatcaagtctccagcacccacccgtgctgaggctactgatgtggctaatgctgtcttggatggcactgattgtgttatgttaagtggggagagtgcagctggtgcttatcctgagctggcagtaaaaatcatgtcacgaatctgcattgaggcagagtcttcacttgacaacgaggctatcttcaaggaaatgatcaggtgtaccccactgccaatgagcccattggagagtcttgcatcatcagctgtccgtacggctaacaaagctagagcaaaactcattgttgtcctgacacgtggcgggagtacagcaaagctggttgccaagtataggcctgcagttcctattctgtcagtagtcgtgcctgttttgaccacagactctttcgattggtccatcagcgacgagaccccagctagacacagtttggtatataggggcttgattccacttcttggtgaaggttctgcaaaggccactgattctgaatcaactgaggtaatccttgaagcggccctgaagtctgccgtaacgagagggctatgcaaacctggtgatgctgtcgtggcacttcatcgtattggttctgcatccgttatcaagatttgcgtcgtgaagtaatcgtcgtgtcacataacatacaaatcttgaactccctccacctgagctcagactgattttcatttatgctttctggtcttgataatgcattattaatatgctgattttgtcacaatgtcttaggatatctagtattatcaccaaggattactatatttcatgttatatttcatatctgcttcaaacactggatttaaaataaatattcctttggtgcagcaatatctttatgttgttgtatgtggtgtaggtgggggtgataaaggctgtttttttgaactttcttgaggaatttttaatgtaggacactggaaagagtttccattggcaactgatttaccatgttccaatggttctttcattttggataaaaag

SEQ ID NO: 16781 - protein, 510 aa, Solanum tuberosum
MANIDIAGIMKDLPNDGRIPKTKIVCTLGPSSRTVPMLEKLLRAGMNVARFNFSHGTHEYHQETLDNLKIAMQNTQILCAVMLDTKGPEIRTGFLTDGKPIQLKEGQEITVSTDYTIKGNEEMISMSYKKLVMDLKPGNTILCADGTITLTVLSCDPPSGTVRCRCENTATLGERKNVNLPGVVVDLPTLTEKDKEDILEWGVPNNIDMIALSFVRKGSDLVNVRKVLGPHAKRIQLMSKVENQEGVINFDEILRETDSFMVARGDLGMEIPVEKIFLAQKMMIYKCNLAGKAVVTATQMLESMIKSPAPTRAEATDVANAVLDGTDCVMLSGESAAGAYPELAVKIMSRICIEAESSLDNEAIFKEMIRCTPLPMSPLESLASSAVRTANKARAKLIVVLTRGGSTAKLVAKYRPAVPILSVVVPVLTTDSFDWSISDETPARHSLVYRGLIPLLGEGSAKATDSESTEVILEAALKSAVTRGLCKPGDAVVALHRIGSASVIKICVVK

SEQ ID NO: 16782 - DNA, 1599 bp, Agaricus bisporus
  CDS (1)..(1599)
atgtatcccgtcgatggcatccgttctcagatcgagtggaacaccactcttaacgtctctgatgctcctgtcccgactgagaccactaaatatcatcgcaagacagctatcattgcgaccattgggcctaaaatcaataccgtcgaaaagctcactgacgttcgcctagctggtgtaaacatcgttcgcatgaatttctcgcacggcacccatgagtaccatcagagtgttattgataacaccaggcaaatgatcaaaaacgacccacatgggcgccccgtagctattgctttggataccaaaggtcccgaaattcggaccggtcagacgagggatggcaatgactatcccattaaggctggggatgaatttatcgtcaccacagatcccaagtatagtgatatatgcgacaataaagttttgttcgttgactacgccaatcttgcaagcgtcactgcccctggcaaactgatctatattgatgatggtatcatctctcttctcattctctctattgatggtatgaacctccatgttcgtgctctcaataatgggaccctctcctctcgcaagggtgtaaatttgcccaaaacggacgtcgaccttccaccactttccgagaaagacaaagatgatctgcgtttcgggattcgtaatggagtcgatatgatcttcgcgtcttttatccgccgtggtgaggacgtaagacagatccgtgaagttctcggccccgatggtgccagcatcaaaattatcgtcaagattgaaaatgagcaaggtgtcgctaactttgatgagattttaaaggaggccgacggtgtcatggttgctcgcggcgatttgggaattgaaattcctgcaagtcaagtattccttgctcagaagatgatgatcgccaagtgcaacattgttgggaagccagtgatcgtcgcaactcaaatgcttgagtccatgacgtacaacccccggcctactcgtgcggaagttagtgacgtcgcaaatgctgtccttgatggctctgattgtgtcatgttgtcgggagagactgctaagggatcttatcccgttcaatctgtcctgatgatggcggagacttgcttgcttgcggaaactgctatttgctacccgcctctatatgacgacctccgcgctgtccaggctcggccaacagaaactgcggagactgttgctatcgccgctgttgctgctgcagccgaacaggatgccaaagcactacttgtcctatcaacaagtggggagactgcccgtctcgtttccaagtatcgccccaagatcccgatcatcactgtcacccgtaatgagcaaaccgcaagacaaatccacttgcatcgcggttgctatcctttctggtaccctgaacctcgaggtgtccaaaaccatcaatggcagactgatgtggacaaccgcatccggtttggtcttcgcaacgctttggcactcaatgtcatccaacctggcgccagtattatcgcagtgcagggttggaagggcggtcttggtcacaccaatacgcttcgcattctgacagtgcccactgaccctgccgaccttgagcttcagcctctgggttctctataa

SEQ ID NO: 16783 - protein, 532 aa, Agaricus bisporus
MYPVDGIRSQIEWNTTLNVSDAPVPTETTKYHRKTAIIATIGPKINTVEKLTDVRLAGVNIVRMNFSHGTHEYHQSVIDNTRQMIKNDPHGRPVAIALDTKGPEIRTGQTRDGNDYPIKAGDEFIVTTDPKYSDICDNKVLFVDYANLASVTAPGKLIYIDDGIISLLILSIDGMNLHVRALNNGTLSSRKGVNLPKTDVDLPPLSEKDKDDLRFGIRNGVDMIFASFIRRGEDVRQIREVLGPDGASIKIIVKIENEQGVANFDEILKEADGVMVARGDLGIEIPASQVFLAQKMMIAKCNIVGKPVIVATQMLESMTYNPRPTRAEVSDVANAVLDGSDCVMLSGETAKGSYPVQSVLMMAETCLLAETAICYPPLYDDLRAVQARPTETAETVAIAAVAAAAEQDAKALLVLSTSGETARLVSKYRPKIPIITVTRNEQTARQIHLHRGCYPFWYPEPRGVQNHQWQTDVDNRIRFGLRNALALNVIQPGASIIAVQGWKGGLGHTNTLRILTVPTDPADLELQPLGSL

SEQ ID NO: 16784 - DNA, 1581 bp, Aspergillus niger
  CDS (1)..(1581)
atggccgccagctcttccctcgaccacctgagcaaccgcatgaagttggagtggcactccaagctcaacactgagatggtgccctccaagaacttccgccgcacctccatcatcggaaccatcggccccaagaccaactccgtggagaagatcaactctctccgcactgccggtcttaacgttgttcgcatgaacttctcccacggttcttatcagtaccaccaatctgttatcgacaacgcccgcgaggccgccaagacccaggtcggacgtcctctcgccattgctcttgataccaaaggacccgagatccgtaccggaaacacccccgatgataaggatatccctatcaagcagggccacgagctcaacatcaccaccgacgagcaatatgccaccgcctccgacgacaagaacatgtacctcgactacaagaacatcaccaaggtgatctctcctggcaagctcatctatgttgatgacggtatcctttccttcgaggtcctcgaagtcgtagatgacaagaccatccgcgtccggtgcttgaacaacggcaacatctcttcccgcaagggtgttaacttgcccggcactgacgttgacctccccgccctttccgagaaggacattgccgatctcaagttcggtgttaggaacaaggtcgacatggtcttcgcttctttcatccgccgcggtagcgacattcgccacatccgtgaggttctgggtgaggagggcaaggagatccagatcattgccaagattgagaaccagcagggtgtcaacaacttcgacgagatcctcgaagagactgacggtgtcatggttgcccgtggtgaccttggtatcgagatccccgcccccaaggtcttcatcgcccagaagatgatgatcgccaagtgtaacatcaagggtaagcccgtcatctgtgccactcagatgctcgagtccatgacatacaaccctcgtcctactcgtgccgaggtgtccgatgttgccaacgccgtccttgacggtgccgactgtgtcatgctgtcgggagagaccgccaagggtaactaccccaacgaggccgtcaagatgatgtccgagacctgcctgctcgccgaggttgccatcccccacttcaatgtgttcgatgagctccgcaaccttgctcctcgccccaccgacactgtcgagtccatcgccatggctgccgttagcgccagtctggaactcaacgctggtgccattgtcgtcttgactaccagcggtaaaactgctcgctacctttccaagtaccgccccgtctgccccattgtcatggttacccgtaaccccgctgcctcccggtactctcacctgtaccgtggtgtctggcccttcctcttccccgagaagaagcccgacttcaacgtcaaggtctggcaggaggatgttgaccgccgtctcaagtggggtatcaaccacgctcttaagctcggcatcatcaacaagggtgacaacatcgtctgtgtccagggatggcgcggcggtatgggccacaccaacaccgtccgtgtggtccctgctgaggagaaccttggcctggctgagtaa

SEQ ID NO: 16785 - protein, 526 aa, Aspergillus niger
MAASSSLDHLSNRMKLEWHSKLNTEMVPSKNFRRTSIIGTIGPKTNSVEKINSLRTAGLNVVRMNFSHGSYQYHQSVIDNAREAAKTQVGRPLAIALDTKGPEIRTGNTPDDKDIPIKQGHELNITTDEQYATASDDKNMYLDYKNITKVISPGKLIYVDDGILSFEVLEVVDDKTIRVRCLNNGNISSRKGVNLPGTDVDLPALSEKDIADLKFGVRNKVDMVFASFIRRGSDIRHIREVLGEEGKEIQIIAKIENQQGVNNFDEILEETDGVMVARGDLGIEIPAPKVFIAQKMMIAKCNIKGKPVICATQMLESMTYNPRPTRAEVSDVANAVLDGADCVMLSGETAKGNYPNEAVKMMSETCLLAEVAIPHFNVFDELRNLAPRPTDTVESIAMAAVSASLELNAGAIVVLTTSGKTARYLSKYRPVCPIVMVTRNPAASRYSHLYRGVWPFLFPEKKPDFNVKVWQEDVDRRLKWGINHALKLGIINKGDNIVCVQGWRGGMGHTNTVRVVPAEENLGLAE

SEQ ID NO: 16786 - DNA, 1446 bp, Buchnera aphidicola
  CDS (1)..(1446)
atgttaaatcgtgttagaagaacaaaaattgtagcaactttaggaccttctacagataaagcaaataatcttgaaaagattattttatctggagcaaatgttcttcgtttaaatttttctcatggttcatctgaagaacataaaaaaagagcgaaaaaagcaaaagaaataatgtttaaattaaattgtcatattgctttattaggtgatttacaaggaccaaaaatcagaatttctaaatttaaaaaaaacagtatttttttaaaagttaatgacgtttttatattagatgcaaatttaaatgaaaaaaatggaaacaatgaaagagtcggaattgattataaaaaattaccaaatgacctaaatgtaaatgatatcttgttgttagacgacggaagaatacaattaaaagtaataaaaattgaaaaatgtgcaatatttacaaaagttattataggtggcattctatctaataataagggtattaataaattaggtggtggtttatcagcagatgcattaacagaaaaagataaaaaagatataattcttgcttctgaaattgatgtagattatttggccgtatcgttccctcgttgtgctgatgatttaataaaagccagagagttattaaaaaaatctggtagtaacgctcaaattatagctaaaatagaaagagccgaagctgtatttgatcaaaatgctatagaaaatataatattgtcttcagatgcaattatgattgctagaggagacttaggtgtcgaaattggtgatgcagaattggtaggtattcaaaaaaaattaattagaactgctagaaaattaaataaggtagcaattactgcaacacaaatgatggaatcaatgattttaaatccgttacctactcgtgcagaagttatggatgtagccaatgctgtgttagatggaagcgatgcagtcatgctgtctgcggaaactgcatctggaaaatatccatctgaaactgtgataagtatggctaaagtttgcaaaggggcagaaaaagttcctagtattaatgtttctagacatcgtcttaatgtagaatttcaaagcattgaggaagccattgctatgtcatcaatgtatgcggcgaatcacttaaaaggaattacagcaattattactatgacagaatctggtaaaacagcattaatgacttctagaattacttctggactaccgatttttgctttatcaaaacataaaaaaactttaaatttaactgctctctatagaggtgtgattcctatttattttgatagtgataaggatggtgttgaagctgctaatgaagcaataattcttttgtgcaagaaaaaatttctatttaataatgatttagtcattgtcactcaaggtgacataatggggaaaataggtaaaacgaataccagtagaattttaagagttacatattaa

SEQ ID NO: 16787 - protein, 481 aa, Buchnera aphidicola
MLNRVRRTKIVATLGPSTDKANNLEKIILSGANVLRLNFSHGSSEEHKKRAKKAKEIMFKLNCHIALLGDLQGPKIRISKFKKNSIFLKVNDVFILDANLNEKNGNNERVGIDYKKLPNDLNVNDILLLDDGRIQLKVIKIEKCAIFTKVIIGGILSNNKGINKLGGGLSADALTEKDKKDIILASEIDVDYLAVSFPRCADDLIKARELLKKSGSNAQIIAKIERAEAVFDQNAIENIILSSDAIMIARGDLGVEIGDAELVGIQKKLIRTARKLNKVAITATQMMESMILNPLPTRAEVMDVANAVLDGSDAVMLSAETASGKYPSETVISMAKVCKGAEKVPSINVSRHRLNVEFQSIEEAIAMSSMYAANHLKGITAIITMTESGKTALMTSRITSGLPIFALSKHKKTLNLTALYRGVIPIYFDSDKDGVEAANEAIILLCKKKFLFNNDLVIVTQGDIMGKIGKTNTSRILRVTY

SEQ ID NO: 16788 - DNA, 1440 bp, Buchnera aphidicola
  CDS (1)..(1440)
atgatacgtcgttttagacgaacaaaaattgttgctacattaggtccgtcaactgataatcatattattttagagaatatgattaaatctggtgttaatgtttttcgtttaaacttttcacatggaacacgagaagaacatatttatagagcaaaactcgtaacaagtattgcaaaaagattaaattgtcacattgctcttttaggtgatttacaaggtcctaaaattcgaatttgtaaatttcaagataaaaaagtttttttaaaagtaaataattatttcatattagacgctaatttaaatgaaaatttagggacatcggaaagagttggaatagattataagaatttacctaaagacgtaaaaaaatgtgatattctcttattagatgatggaaaaatacaattaaaggttattaatatagtagatcaagaaatatttactaaaataattataggtggtgtgttatctaataataagggaattaacaaattaggaggaggtttatcagcaaggattttaactaaaaaagataaaagagatattatcacttcgattgatattggggtagattatttagctgtttcatttccgagatatggaagtgatttagatcatgcacgtaagtgtgcagtaaaatttggtagtaaagcaaaaataattgctaaaatagaaagagctgaagcagtcaaagatttaaaaataattgatgaaataatattagcatctgatgcaataatggtagcacgaggagatttaggtgtagaaataggagaatctgaattagctggaatacaaaaaacattgataaggcgagcacgccaattaaatcgagtagttataactgctacacaaatgatggaatctatgatcaataatcctatgccaactcgtgctgaagtcatggatgttgctaatgctgtattagatggtagtgatgctgttatgttatcagcggaaactgcgtcaggaaaatatcctattgagactattaaagttatgtctaaagtttgtatgggggcagaaaaaatgcctagcatcaatgtttctcagcataggattcatgacaaatttcatgatattgaagaagctattgctatgtctgcaatgtatgctgcaaatcatttaagtggtattactgctattattactatgactgaatctggcaaaacatctttaatgacttctagaattacttctggtttaccaattttcgcgttatcttcacatatacaaacgctgaaattaactgcgttatatcgaggagttacgccaattttttttaatagtagcaaagaaggtgtttctgctgctaatgaagttattaacttattagtaaaaaggggttttttagaacctggaaatttagttattattactcaaggagatattatgggaaaagtaggaaaaactaatacaagtagaattttaaaagtgtga

SEQ ID NO: 16789 - protein, 479 aa, Buchnera aphidicola
MIRRFRRTKIVATLGPSTDNHIILENMIKSGVNVFRLNFSHGTREEHIYRAKLVTSIAKRLNCHIALLGDLQGPKIRICKFQDKKVFLKVNNYFILDANLNENLGTSERVGIDYKNLPKDVKKCDILLLDDGKIQLKVINIVDQEIFTKIIIGGVLSNNKGINKLGGGLSARILTKKDKRDIITSIDIGVDYLAVSFPRYGSDLDHARKCAVKFGSKAKIIAKIERAEAVKDLKIIDEIILASDAIMVARGDLGVEIGESELAGIQKTLIRRARQLNRVVITATQMMESMINNPMPTRAEVMDVANAVLDGSDAVMLSAETASGKYPIETIKVMSKVCMGAEKMPSINVSQHRIHDKFHDIEEAIAMSAMYAANHLSGITAIITMTESGKTSLMTSRITSGLPIFALSSHIQTLKLTALYRGVTPIFFNSSKEGVSAANEVINLLVKRGFLEPGNLVIITQGDIMGKVGKTNTSRILKV

SEQ ID NO: 16790 - DNA, 2354 bp, Gallus gallus
  CDS (81)..(1673)
agcggcggcggcgctcgggcaggacaggctttgggcacggcggcggaagcagcagcaggagacaccgaactccagtaaccatgtcgaagcaccacgatgcagggaccgctttcatccagacccagcagctgcacgctgccatggcagacacctttctggagcacatgtgccgcctggacatcgactccgagccaaccattgccagaaacaccggcatcatctgcaccatcggcccagcctcccgctctgtggacaagctgaaggaaatgattaaatctggaatgaatgttgcccgcctcaacttctcgcacggcacccacgagtatcatgagggcacaattaagaacgtgcgagaggccacagagagctttgcctctgacccgatcacctacagacctgtggctattgcactggacaccaagggacctgaaatccgaactggactcatcaagggaagtggcacagcagaggtggagctcaagaagggcgcagctctcaaagtgacgctggacaatgccttcatggagaactgcgatgagaatgtgctgtgggtggactacaagaacctcatcaaagttatagatgtgggcagcaaaatctatgtggatgacggtctcatttccttgctggttaaggagaaaggcaaggactttgtcatgactgaggttgagaacggtggcatgcttggtagtaagaagggagtgaacctcccaggtgctgcggtcgacctgcctgcagtctcagagaaggacattcaggacctgaaatttggcgtggagcagaatgtggacatggtgttcgcttccttcatccgcaaagctgctgatgtccatgctgtcaggaaggtgctaggggaaaagggaaagcacatcaagattatcagcaagattgagaatcacgagggtgtgcgcaggtttgatgagatcatggaggccagcgatggcattatggtggcccgtggtgacctgggtattgagatccctgctgaaaaagtcttcctcgcacagaagatgatgattgggcgctgcaacagggctggcaaacccatcatttgtgccactcagatgttggaaagcatgatcaagaaacctcgcccgacccgcgctgagggcagtgatgttgccaatgcagttctggatggagcagactgcatcatgctgtctggggagaccgccaagggagactacccactggaggctgtgcgcatgcagcacgctattgctcgtgaggctgaggccgcaatgttccatcgtcagcagtttgaagaaatcttacgccacagtgtacaccacagggagcctgctgatgccatggcagcaggcgcggtggaggcctcctttaagtgcttagcagcagctctgatagttatgaccgagtctggcaggtctgcacacctggtgtcccggtaccgcccgcgggctcccatcatcgccgtcacccgcaatgaccaaacagcacgccaggcacacctgtaccgcggcgtcttccccgtgctgtgcaagcagccggcccacgatgcctgggcagaggatgtggatctccgtgtgaacctgggcatgaatgtcggcaaagcccgtggattcttcaagaccggggacctggtgatcgtgctgacgggctggcgccccggctccggctacaccaacaccatgcgggtggtgcccgtgccatgagctgccggcgcccccgcctcttccacccccgcgccccttccccatgcattaggccagcagtcgcttgcgatgttctcctcgtccctagcgtggatttaggttgctcaacaccaccgagtgcagcagcgggggaagagaccttaaatcactcagaatacttgaagtgtgtagttgtttccagacctctctccctgtagttagccatgtcagagcggggccctgtgctccccacgtccccctagcttagcactgccctcagggtgtggctgtgcctctccttgccccggctgtggggtgatggggaaggagtgggcgcttatggtaacggttctgctgctgcacaccgcagctcccccaggttggtgccctctgtccatgaggggttataggttgtcccctctgggcttacactccaaaggtgtgctccacggttcctacaagaatcccaaaccagggtgctgctcgttgtccccctgggtgcaggtggagtcctgcgggttgttggggtgcaggatgggtgggggacgcacgcttcatctccatgcagccacctgcccttctatggtgtctgtctgtgttgtcgcctttcctgagagcgttccttttgtctgggcgccctgtttgctccggtgggtgtattgggttgtggagcaccactgtgcacgtcaataaagagctgag

SEQ ID NO: 16791 - protein, 530 aa, Gallus gallus
MSKHHDAGTAFIQTQQLHAAMADTFLEHMCRLDIDSEPTIARNTGIICTIGPASRSVDKLKEMIKSGMNVARLNFSHGTHEYHEGTIKNVREATESFASDPITYRPVAIALDTKGPEIRTGLIKGSGTAEVELKKGAALKVTLDNAFMENCDENVLWVDYKNLIKVIDVGSKIYVDDGLISLLVKEKGKDFVMTEVENGGMLGSKKGVNLPGAAVDLPAVSEKDIQDLKFGVEQNVDMVFASFIRKAADVHAVRKVLGEKGKHIKIISKIENHEGVRRFDEIMEASDGIMVARGDLGIEIPAEKVFLAQKMMIGRCNRAGKPIICATQMLESMIKKPRPTRAEGSDVANAVLDGADCIMLSGETAKGDYPLEAVRMQHAIAREAEAAMFHRQQFEEILRHSVHHREPADAMAAGAVEASFKCLAAALIVMTESGRSAHLVSRYRPRAPIIAVTRNDQTARQAHLYRGVFPVLCKQPAHDAWAEDVDLRVNLGMNVGKARGFFKTGDLVIVLTGWRPGSGYTNTMRVVPVP

SEQ ID NO: 16792 - DNA, 1425 bp, Clostridium perfringens
  CDS (1)..(1425)
atgcaaaaaacaaaaatgatatttacaattggtccttcaagtgattcagaagaaattttaagagagttcataagaattggtatgaatgcagctagattaaacttctcacatggagaccatgcaagtcataaagaaaaaatagaacttattaagagacttagaaaagaagaaaaatcagctacagctatcttattagacattaagggtcctaaaataagaacatataattttaaaaatggcgaagctgaattaaaaaatggtgatgaattcacattctcttgcggagatgaaatattaggtgataacactaaatgttcaatctcttataaagaactatatgaagacataaaacctggtggatcaatacttgttgatgatggacttttagaatttaaagtaaaggaagtccgtggaactgatataatatgtgaagttattgaaggaggtactataaaagaccataaaggtgtaaatgtacctaatgtaccaatcaaactccctgcagtaactgaaaaggatagatctgacttaatatttggttgcgagatggaagtagactttgtagcagcttctttcataagaaaaccagaggatgtacttgaagttagagaaattctagactctcatggtggaaaagatataaaaataatatcaaaaatagaaagccaagaaggtgtagataacataaaagaaataattaaagttactgatggtgtaatggttgctagaggtgatatgggagtagaaattcctatagaaaatgtacctataattcaaaaaaatataattaagaaatgtaatcaagcagggaaaatagttataacggcaactcaaatgttagattctatgataagaaatccaagacctactagagctgaagcttctgacgtatgtaatgccatatttgatggtacagatgccataatgcttagtggagaaagtgcttctggtagcttccctatagaggcagcaatgacaatgtctagaatagcaaaaaaagcagaagctaacttagactataattatcttttaagaagattaaaagatccaaatccaaatcccgatgcctttgcagatgccataagttattcagcatcaaaaacagctagcaaattccctacaaaagctatagtagcagccactcagactggttcaactgctaagatattatcaaaatataaacctagctgtccaataatagctattactccatatgaaaaagttagaagaagcttagctttaaactttggaataatttctaagaaatgtgcttattttaatagtacagatgaaattatagaggaagctagaaaagtagctaaagaatttgaaatagctgaaactggagataatataatggtagctgctggattcccaacatcaataactggtggaacaaacatgctaaaaattgaaaaaatataa

SEQ ID NO: 16793 - protein, 474 aa, Clostridium perfringens
MQKTKMIFTIGPSSDSEEILREFIRIGMNAARLNFSHGDHASHKEKIELIKRLRKEEKSATAILLDIKGPKIRTYNFKNGEAELKNGDEFTFSCGDEILGDNTKCSISYKELYEDIKPGGSILVDDGLLEFKVKEVRGTDIICEVIEGGTIKDHKGVNVPNVPIKLPAVTEKDRSDLIFGCEMEVDFVAASFIRKPEDVLEVREILDSHGGKDIKIISKIESQEGVDNIKEIIKVTDGVMVARGDMGVEIPIENVPIIQKNIIKKCNQAGKIVITATQMLDSMIRNPRPTRAEASDVCNAIFDGTDAIMLSGESASGSFPIEAAMTMSRIAKKAEANLDYNYLLRRLKDPNPNPDAFADAISYSASKTASKFPTKAIVAATQTGSTAKILSKYKPSCPIIAITPYEKVRRSLALNFGIISKKCAYFNSTDEIIEEARKVAKEFEIAETGDNIMVAAGFPTSITGGTNMLKIEKI

SEQ ID NO: 16794 - DNA, 1425 bp, Corynebacterium efficiens
  CDS (1)..(1425)
atggaaagacgaactaagattgtatgcaccctcggtccggcggtcgccagcgcggatgggatcctccgactggttcaggacggcatggatgtggcccgcctgaacttctcgcacggcgatcaccccgaccatgaacagaactacaagtgggtccgtgaagccactgacaagaccggtcgcgcggtcggcatcctcgccgacctgcagggccccaagatccgtctcggacggttcaaggagggctcaaccgtatgggagaccggtgagacggtccgcatcacggtggatgatgtcgaaggcacccatgaccgtgtctccaccacctacaagaacctggccaaggatgcccgtccgggggaccgtctgctggtcgatgacggcaaggtcggcctcgtctgcgtctccgtcgagggcaacgatgtcatctgtgaggtcaccgaaggtggccccgtctccaacaacaagggtgtctccctgcccggcatggacatctccgtgccagccctatccgagaaagacatcaaggatcttcgtttcgccctgaagctcggcgttgacttcatcgccctgtccttcgtccgctccccagcggacgtcgaactcgtccatgccatcatggatgaggagggacgtcgcgtcccggtgatcgccaagctggagaagccggaggcggtcgcagcactcgagtccatcgtgctggcgttcgacgcgatcatggtcgcccgtggagacctcggcgtggaggtcccgctcgaggaggtcccgctcgtgcagaagcgggcgatccagatcgcccgggagaacgccaagccggtcatcgtggccacccagatgctcgattcgatgattgagaattcccgtccgacccgtgcggaggcctccgatgtggccaacgccgttctcgatggtgccgatgccgtcatgctctccggtgagacctccgtgggtaaggatccccacaatgtggtccgcacgatgtcccgtatcgtccgcttcgccgagaccgacggccgggttccggatctcacgcacattccgcgcaccaagcgtggcgtgatctcctattccgcccgcgacatcgccgagcgactcaatgcccgcgccctggtcgccttcaccacctcgggggacaccgccaagcgtctggcccgtctgcactcccatctgccgctgctggtcttcacccctgatccgagcgtccgctcccagctggcgctcacctggggtgcccagaccttcctgtgcccgaaggtggatgacaccgatggcatgatgcgtgaggttgaccgtgcgctgctggccatggacgagtatcagaaggatgacatgatggtggtcgtcgccggttcccctccgggggtcacgggaaacaccaacatgatccacgttcacctgctgggtgaggatacccggattcccaagtag

SEQ ID NO: 16795 - protein, 474 aa, Corynebacterium efficiens
MERRTKIVCTLGPAVASADGILRLVQDGMDVARLNFSHGDHPDHEQNYKWVREATDKTGRAVGILADLQGPKIRLGRFKEGSTVWETGETVRITVDDVEGTHDRVSTTYKNLAKDARPGDRLLVDDGKVGLVCVSVEGNDVICEVTEGGPVSNNKGVSLPGMDISVPALSEKDIKDLRFALKLGVDFIALSFVRSPADVELVHAIMDEEGRRVPVIAKLEKPEAVAALESIVLAFDAIMVARGDLGVEVPLEEVPLVQKRAIQIARENAKPVIVATQMLDSMIENSRPTRAEASDVANAVLDGADAVMLSGETSVGKDPHNVVRTMSRIVRFAETDGRVPDLTHIPRTKRGVISYSARDIAERLNARALVAFTTSGDTAKRLARLHSHLPLLVFTPDPSVRSQLALTWGAQTFLCPKVDDTDGMMREVDRALLAMDEYQKDDMMVVVAGSPPGVTGNTNMIHVHLLGEDTRIPK

SEQ ID NO: 16796 - DNA, 2172 bp, Drosophila melanogaster
  CDS (317)..(1918)
tgtcgggctaccgacattctgagcgctttttctgcggctaggaaaatttccgcttgccaaaaaatctgtgtggcagtcgaactttttgtctcgtcctcgccgcgtccgattttccatatatcccgattttcgtctcaaacttggaagatatattgccaaaatattgcattcggctagccgctgcgttgtgtgtgttgttgtgcgtggagttgcgtgtgcagttgcaagaagatatagtcgtctatatcgtcagaccgatctcgatcccaagtgcgattcccgttggttacatactacccgttcggtaggcaacaaaatggtgaacgtaaccatctacgatgaggcaccgcagctgaagcccaacgaagtaccccaaaacatggccgcaggagctgatacccaactggagcacatgtgccgtctgcagttcgactcgccagtgccccatgtgcgtctgtccggaatcgtgtgcaccatcggacctgcctccagcagcgtggagatgctggagaagatgatggccaccggcatgaacatcgcgcgcatgaacttctctcacggatcgcacgagtaccatgccgccaccgtggccaatgtgcgccaggcggtgaagaactactcggccaagctgggctacgaacaccccgtggccattgccctggacaccaaggggcccgagatccgtaccggtctgatcggaggcagcggcaccgccgagattgagctgaagaagggcgagaagatcaagctgaccaccaacaaggaattcctggagaagggctctctggagattgtgtacgtggactacgagaacattgtcaatgtggtgaagcccggcaaccgggtgttcgtcgatgacggtctgatctcactgattgtccgcgaggtaggcaaggattccctcacctgcgaggtggagaacggcggctctctgggttcccgcaagggtgtgaacctgccaggcgtgcccgtcgatctgcctgccgtctccgagaaggataagagcgatctgctgttcggtgtggagcaggaagtggacatgatctttgcttcgttcatccgcaacgccgctgctttgaccgagatccgtaaggttcttggcgagaagggcaagaacatcaagatcatttccaagatcgagaaccagcagggcatgcacaacctggacgagatcatcgaggccggtgatggcattatggtggcccgtggagatctgggtattgagattcccgccgagaaggtgttcctcgcccagaaggccatgattgcccgctgcaacaaggctggcaagcctgtgatctgcgccactcagatgttggagtcaatggtgaagaagccacgtcccactcgcgctgagatctctgatgtggccaacgctgtgctcgatggtgctgattgcgtcatgttgtctggtgagaccgccaagggcgagtacccgctggagtgcgtcctgaccatggccaagacctgcaaggaggccgaggctgccctctggcaccagaacctctttaacgacttggttcgcggcgctggtaccatcgatgcctctcacgcggctgccatcgctgccgttgaggctgccaccaaggccaaggcctccgccatcgtggtgatcaccaccagcggcaagtcggccttccaggtgagcaagtaccgcccacgctgccccatcatcgcggtcacccgtttcgcgcagaccgcccgacaggcccatctctaccgtggactggtgccactcatctacaaggagcccggtcttggtgactggctgaaggacgtggacgtgcgcgtgcagttcggtctgcaggtcggaaagaagaacggcttcatcaagaccggcgattccgtcgtggtggttaccggctggaagcagggctccggcttcaccaacaccatccgcattgtcaccgtcgaataaattctgccgctcaggaagtacctggatgcgtcgcagctgccgcgggcgtcgcgttgattactgttaataaccaagttaatttattaattacacaatattcggaatattggaaactgcaggaggctgctggaaccgctgtcagaagcgccgaaggccggcccgggcctcaaacagacacacaaatatactataccattgttgaataatagagatttcttcgaaaattataataaagtcatcactgtatttatgta

SEQ ID NO: 16797 - protein, 533 aa, Drosophila melanogaster
MVNVTIYDEAPQLKPNEVPQNMAAGADTQLEHMCRLQFDSPVPHVRLSGIVCTIGPASSSVEMLEKMMATGMNIARMNFSHGSHEYHAATVANVRQAVKNYSAKLGYEHPVAIALDTKGPEIRTGLIGGSGTAEIELKKGEKIKLTTNKEFLEKGSLEIVYVDYENIVNVVKPGNRVFVDDGLISLIVREVGKDSLTCEVENGGSLGSRKGVNLPGVPVDLPAVSEKDKSDLLFGVEQEVDMIFASFIRNAAALTEIRKVLGEKGKNIKIISKIENQQGMHNLDEIIEAGDGIMVARGDLGIEIPAEKVFLAQKAMIARCNKAGKPVICATQMLESMVKKPRPTRAEISDVANAVLDGADCVMLSGETAKGEYPLECVLTMAKTCKEAEAALWHQNLFNDLVRGAGTIDASHAAAIAAVEAATKAKASAIVVITTSGKSAFQVSKYRPRCPIIAVTRFAQTARQAHLYRGLVPLIYKEPGLGDWLKDVDVRVQFGLQVGKKNGFIKTGDSVVVVTGWKQGSGFTNTIRIVTVE

SEQ ID NO: 16798 - DNA, 1901 bp, Eimeria tenella
  CDS (57)..(1652)
ctgcgtcgaagagaaactgtggctcattgtagcttgtgcactccccactaggcaagatggcgaatcctacacactctcaagtcgtcgcagctccggacagttccggacggctgctccgcctagttagcgccagctcagtcatgatgcagcttttgggcaaaagtacgaatatccgcatgtcccagatcctggaacaccacgaagatgaggacttcagtgcgcaccgcacgaagattgtgtgcacgatgggccccagctgctgggatgtggacaagatggtgcagttgatcgatgccgggatgaacgtgtgccgtcttaacttctctcatggtgatcatgaggcacatggccgtgtggtcaagaaccttcaggaggctctcaagcagcgcccagggaagcgggttgccttgttgctcgacacgaagggtcctgaaatcaggacgggcatgctggagggtgacaagccaatcgagcttcacgcgggggacatgctcaagatcgtcaccgactacagctttgtaggcaacaagagctgcatcgcctgctcatacgagaaactgcccagctctgtcaagccaggaaataccattctcattgctgatggctccctatccgttgaagtcgtggagtgtggcaaggattacgtcatgactagggttatgaacccggccatcattggcaacaagaagaacatgaaccttcccggcgttaaggtcgacttgcccgttattggcgagaaggacaagaatgacattctgaattttggcattcctatgggctgcaacttcattgccgcgtccttcgtgcagtctgcagacgacgtgcgctatatccgcagcattcttggcaccaaggggcgcaacatcaagatcattcccaagattgaaaatgttgagggtctcctcaacttcgatgaaattcttcaggaggcagacggcattatgattgccagaggcgatctcggtatggagatcccacctgaaaaggtcttccttgcccagaagatgatgatctcaaaatgtaatgttgctggaaagcccgtcatcacggcaacgcagatgcttgagtcgatgacgaagaacccacgcccgacgcgtgccgaagctgcagatgtggcgaatgctgtccttgatggcactgattgcgtcatgctctccggggagacggcgaacggaagcttccctgttcaggctgtcactgtcatgtcccgtgtctgcttcgaggccgaaggctgcattgactatcagcaggtgttcagagccacttgccaagctaccatgactcctattgacacccaggaggcagtggctcgtgctgctgttgagacagctcagtcaatcaacgcatcgctcatcctcgcccttactgaaactggccgcactgctcgcctgatcgcgaagtataggccaatgcagccaattctggctttgagcgcttcggaggaaaccatcaagcagctgcaggtcattcgcggcgttacaacattcttggtgccgactttccagggcacggaccagctgattcgcaacgcactttctgcagccaaggagctgcagctggtcagcgaaggcgacagcattgtcgcagtgcacggaatcaaggaggaggttgcaggatggtccaacctcctgaaggttcttgtcgtcgagtaggcgacttgtcagcgttcgcctttcggggtgtaacagcggctgacgcgtggaattcttggctcagccatgagccgctgctgtcgcgcgagcaggcagtggatgcgcgaacgttcgctgcctctgcttaaccgccgttcggtggaactcgggcttttagctccattttaatagaccgcgaggcggtgtgctgcggcgttttctaaggacttctgcgttaggtcgttgtgaagctaaaaaaaaaaaaaaaaa

SEQ ID NO: 16799 - protein, 531 aa, Eimeria tenella
MANPTHSQVVAAPDSSGRLLRLVSASSVMMQLLGKSTNIRMSQILEHHEDEDFSAHRTKIVCTMGPSCWDVDKMVQLIDAGMNVCRLNFSHGDHEAHGRVVKNLQEALKQRPGKRVALLLDTKGPEIRTGMLEGDKPIELHAGDMLKIVTDYSFVGNKSCIACSYEKLPSSVKPGNTILIADGSLSVEVVECGKDYVMTRVMNPAIIGNKKNMNLPGVKVDLPVIGEKDKNDILNFGIPMGCNFIAASFVQSADDVRYIRSILGTKGRNIKIIPKIENVEGLLNFDEILQEADGIMIARGDLGMEIPPEKVFLAQKMMISKCNVAGKPVITATQMLESMTKNPRPTRAEAADVANAVLDGTDCVMLSGETANGSFPVQAVTVMSRVCFEAEGCIDYQQVFRATCQATMTPIDTQEAVARAAVETAQSINASLILALTETGRTARLIAKYRPMQPILALSASEETIKQLQVIRGVTTFLVPTFQGTDQLIRNALSAAKELQLVSEGDSIVAVHGIKEEVAGWSNLLKVLVVE

SEQ ID NO: 16800 - DNA, 1437 bp, Haemophilus influenzae
  CDS (1)..(1437)
atgtctagaagactaagaagaacgaagattgtatgtactatgggcccatcaactgaccgtgataacaatcttgaaaaaattatcgcagcgggcgcaaacgtagttcgtatgaacttctctcacggtacacctgatgaccatatcggacgtgctgaacgtgtacgttctattgcgaaaaaattaggtaaaaccgtggcaatcttaggtgatttacaaggtcctaaaattcgtgtttctacttttaaagacggtaaaattttcttaaacgttggcgataaattcattcttgatgcagagttaccaaaaggcgaaggcactcaagaatccgttggtttagactataaaacgcttcctcaagatgttgtgccgggcgatattcttttattagatgatggccgtgttcaattaaaagtattatcaactgatggtgcaaaagttttcactgaagttactgttggtggtccattatcaaataataaaggtatcaataaattaggtggcggtttatctgcggatgccctaacagaaaaagataaagccgacattattaccgctgcacgcattggtgttgatttcttagccgtttctttccctcgttcaagtgcagatttaaattatgcacgtgaacttgctcaacaagcaggtttaaatgcaaaaatcgttgctaaagttgaacgtgcagaaaccgttgctaatgatgaagccatggacgatattattttagcctctgatgtaattatggttgcacgtggtgacttaggtgtagaaatcggcgatcctgaattagtcggtgtacagaaaaaattaatccgtcgttcacgtcaattaaatcgtgctgtaattacagcgactcaaatgatggaatcaatgattagtaacccaatgccaactcgtgctgaagtaatggacgttgcaaacgcagtattagatggaactgatgcagttatgctttctgcagaaacagcagctggtcaatatccttctgaaacagtggcagcaatggctagcgtatgtttaggtgcagaaaaaatgccaagcattaacgtttctcgtcaccgtatggataaagaatttgaaactattgaagaatctgttgcgatgtctgcaatgtatgcagcaaaccacatgaaaggtgtagcggcaatcgtcactttaagtagcacaggccgtactccattattaatgtcacgcattagctctggcttaccaatctttgctttatctcgtaatcaagaaaccctaaacctttgtgcactataccgcggtgtaacaccaatttatcacggcgaagaaagtcgtacagaagctggtgcaaaagcagcacctcaatcattaaaagaaaaaggttatttatctactggcgatttagtgctggtaacccaaggtggtcaaggtgcgacacaaactaacgtatgtcgtacattaattgttgaataa

SEQ ID NO: 16801 - protein, 478 aa, Haemophilus influenzae
MSRRLRRTKIVCTMGPSTDRDNNLEKIIAAGANVVRMNFSHGTPDDHIGRAERVRSIAKKLGKTVAILGDLQGPKIRVSTFKDGKIFLNVGDKFILDAELPKGEGTQESVGLDYKTLPQDVVPGDILLLDDGRVQLKVLSTDGAKVFTEVTVGGPLSNNKGINKLGGGLSADALTEKDKADIITAARIGVDFLAVSFPRSSADLNYARELAQQAGLNAKIVAKVERAETVANDEAMDDIILASDVIMVARGDLGVEIGDPELVGVQKKLIRRSRQLNRAVITATQMMESMISNPMPTRAEVMDVANAVLDGTDAVMLSAETAAGQYPSETVAAMASVCLGAEKMPSINVSRHRMDKEFETIEESVAMSAMYAANHMKGVAAIVTLSSTGRTPLLMSRISSGLPIFALSRNQETLNLCALYRGVTPIYHGEESRTEAGAKAAPQSLKEKGYLSTGDLVLVTQGGQGATQTNVCRTLIVE

SEQ ID NO: 16802 - DNA, 3479 bp, Lactobacillus delbrueckii
  CDS (1277)..(3046)
aagctttaggccaaagaaagagcctggacttcaaaatttgggacatgaagcaggtaaatttgcgctgaaaacgacttgaccaatttgcttttttgaaaaaaatctctcctagtgaaataaataataaacgccaggctgggatttgtaagccctaacaggttgaaagtctaaaaaaatctaatttaaaccaaattttacaagactttatgcgggaaaaatgttatgatttacatgatgtgagatattacacaatttaaatcatgaatgaggtgaattcatgaaacggattggtattttgactagcggcggtgacgcccctggtatgaatgcagccgtaagagccgtaaccagagtcgcgatcgcgaacggtttggaagttttcggtatcagatacggttttgcaggtttggttgcgggcgacattttcccattggaaagtgaagacgtagcccacttgatcaatgtttccggtaccttcctctactctgcgcgttatcctgaatttgcagaagaagaaggacagctggctggtattgaacaattgaagaagcacggcatcgatgctgttgtcgttattggtggggatggttcctaccatggcgccctgcagctgacccgccacggcttcaactcaattggcctgccaggcacgatcgacaacgatatcccttacacggatgccacgatcggctatgacacggcctgcatgacggcaatggacgcgatcgacaagatccgtgacactgcttctagccaccaccgcgtcttcattgtcaacgtaatgggccgcaactgtggtgacatcgctatgcgcgtcggcgtagcctgcggggcggacgcgatcgtcattcctgaaagaccatatgatgtcgaagaaatcgccaaccggctcaagcaagcccaggaaagcggcaaggaccacggtttggtagttgttgctgaaggcgtaatgaccgctgaccaattcatggctgaactgaagaagtatggtgacttcgacgtccgggccaatgttttgggtcacatgcagcggggcggcacgccaactgtttctgaccgggtgctggcttccaagctgggcagcgaagccgttcaccttcttttggaaggcaagggcggcctggctgtcggcattgaaaacggcaaggttacttcacacgacatccttgatttatttgatgagtctcacaggggtgactatgacttgttaaagctcaacgcagatttatcaagatagttgtttctatagtttttgatttagggagattttttcaagatgaaaaaaacaaagattgttagtactttagggccagcttcagacgatattgaaactattaccaagttagccgaagcaggcgcaaacgtattccgtttcaacttctcacacggtaaccacgaagaacacttggcaagaatgaacatggttcgtgaagttgaaaagaagactggcaagcttttgggcatcgctttggacaccaagggtgctgaaatcagaaccactgaccaagaaggcggcaagttcactatcaacactggtgacgaaatccgcgtgtcaatggacgcaaccaaggccggcaacaaggacatgatccacgttacctacccaggtctgttcgacgacactcacgtaggcggcactgtattgatcgacgacggtgctgttggtttgactatcaaggccaaggacgaagaaaagcgcgaattggtttgtgaagctcaaaacactggtgtcatcggctcaaagaagggtgttaacgctccaggtgttgaaatccgcctcccagggattactgaaaaggacactgacgacatccgctttggtttgaagcacggtattaacttcatctttgcttcatttgtacgtaaggctcaagacgttcttgacattcgcgcactttgcgaagaagctaacgcatcatacgttaagatcttcccaaagattgaatcacaagaaggtattgacaacatcgacgaaatcttgcaagtttcagatggtttgatggttgcccgtggtgacatgggtgttgaaatcccattcatcaacgtgccatttgttcaaaagactttgatcaagaagtgcaacgctttgggcaagccagttatcactgctactcaaatgctggactcaatgcaagaaaacccacgtccaacccgtgccgaagtaactgacgttgctaacgccgttcttgacggtactgacgcaactatgctgtcaggtgaatcagcaaacggtttgtacccagtacaatcagttcaagctatgcacgacatcgatgttcggactgaaaaggaattggacacccggaacactctggctctgcaacgctttgaagaatacaagggctcaaacgttactgaagctatcggtgaatcagttgtccgcactgctcaagaactgggcgttaagactatcatcgctgctactagctccggctacacagctcgtatgatctccaagtaccgtccagacgcaaccatcgttgccttgactttcgacgaaaagatccaacactcattgggtatcgtttggggcgttgaaccagttttggcaaagaaaccttcaaacactgacgaaatgttcgaagaagctgcccgcgtagctaaggaacacggtttcgttaaggatggcgacctggtaatcatcgttgccggcgtaccattcggccaatcaggtactactaacttgatgaagctgcaaatcatcggcaaccaacttgctcaaggtttgggcgtaggcactggctcagttatcggcaaggctgttgttgcgaacagcgctgaagaagccaacgctaaggttcacgaaggcgacatcctggtagctaagactactgacaaggactacatgccagctatcaagaaggccagcggtatgatcgttgaagcttccggcttgaccagccacgcagctgttgtcggcgtatcactcggcattccagttgttgtcggtgttgctgacgcaacttcaaagatcgctgacggctcaactttgactgttgacgcacgtcgcggcgcaatttaccaaggtgaagtttcaaacctgtaatctaggattgcaagtctgacaaccacagaagaaagagttcaatcaatcgattgagctcttttcctttgccaattttttctctgctttctttaatgattgccttgaatatagctaaggcagaagaggtattttaaactgctgagccgctttaaatcacctgcaaacttaatctacccaaaaagcatagccgaccttagaagaccgatatgggctgtttagcagggaggaaaaagcgcattaaaaactccagctgagctagagttaaattatcacttttttaattgttaagctgcaaggtcatcttcacctaagatgatctgcaaggtgtcgtggacgatcttgtccttggccagttgggcctggtcatcgtcttggtcgcggaagtcgttgatcatttctgccgcgatgggttggtttttgatgacccagatcc

SEQ ID NO: 16803 - protein, 589 aa, Lactobacillus delbrueckii
MKKTKIVSTLGPASDDIETITKLAEAGANVFRFNFSHGNHEEHLARMNMVREVEKKTGKLLGIALDTKGAEIRTTDQEGGKFTINTGDEIRVSMDATKAGNKDMIHVTYPGLFDDTHVGGTVLIDDGAVGLTIKAKDEEKRELVCEAQNTGVIGSKKGVNAPGVEIRLPGITEKDTDDIRFGLKHGINFIFASFVRKAQDVLDIRALCEEANASYVKIFPKIESQEGIDNIDEILQVSDGLMVARGDMGVEIPFINVPFVQKTLIKKCNALGKPVITATQMLDSMQENPRPTRAEVTDVANAVLDGTDATMLSGESANGLYPVQSVQAMHDIDVRTEKELDTRNTLALQRFEEYKGSNVTEAIGESVVRTAQELGVKTIIAATSSGYTARMISKYRPDATIVALTFDEKIQHSLGIVWGVEPVLAKKPSNTDEMFEEAARVAKEHGFVKDGDLVIIVAGVPFGQSGTTNLMKLQIIGNQLAQGLGVGTGSVIGKAVVANSAEEANAKVHEGDILVAKTTDKDYMPAIKKASGMIVEASGLTSHAAVVGVSLGIPVVVGVADATSKIADGSTLTVDARRGAIYQGEVSNL

SEQ ID NO: 16804 - DNA, 1941 bp, Leishmania mexicana
  CDS (112)..(1611)
atactgacacacactgcacgctctgtgcttcactttgttgttttcaagcagctgtttctcaattcactttactcatatttccaacctcttatcctcctcttacgtaacaacatgtcccagttagcgcacaatctgacgctctcgatcttcgacccggttgcgaactaccgggccgcccggatcatctgcactatcggccccagcacgcaaagtgtggaggcgctgaaggggctgattcagagtggcatgtctgtggcgcgtatgaacttctcgcatgggtcacacgagtatcaccagacgacgatcaacaatgtgcgccaggcggccgcggagctcggtgtgaatatcgcgattgcgctggacacaaaggggcccgagattcggacgggacagttcgttggtggtgatgctgtgatggagcgaggagcgacgtgctatgtgacgacagaccctgcgtttgcggacaagggcaccaaggacaagttctacatcgactaccagaacctgtcgaaggtggtgcgccccggcaactacatctacatcgacgacggcatcctgatcctgcaagtgcagagccacgaggacgagcagacgctggagtgcacagtcaccaactcgcacacgatatctgaccggcgcggtgtgaacctgccggggtgcgacgtggacctgcccgctgtgtcggcgaaagaccgcgtggacctgcagttcggtgtcgaacagggtgtggacatgatcttcgcgtcgttcatccggagcgcggagcaggtgggtgatgtgcggaaggcgctcggaccgaagggccgagacatcatgatcatctgcaagatcgagaaccaccagggcgtgcagaacattgactctatcattgaggagagcgacggcatcatggttgcgcgcggcgacctcggcgttgagattccagcagagaaggtggtggttgcgcagaagattctgatcagcaagtgcaacgttgctggcaagccggtgatctgcgcgacgcagatgctggagagcatgacgtacaacccccgcccgacgcgcgctgaggtatcggacgtcgctaacgctgtcttcaacggtgccgattgcgtgatgctgtctggtgagacggcgaaaggcaagtatccgaatgaggtggttcagtacatggcgcgtatctgcctagaggcacagagcgcgcttaacgaatatgtcttcttcaacagcatcaaaaagctgcagcacatcccgatgagtgctgatgaggctgtttgcggcagtgctgtcaactccgtgtctgagaccaaagccaaggcaatggtggtgctgagcaacacaggcgcaggcgctcgactggtggcgaagtaccgtccgaactgcccgattgtgtgtgtgacgacgcgcctgcagacgtgccgccagctgaacatcacacagggcgtggagagtgtcttctttgatgcagataagctcggccacgacgagggcaaggagcatcgcgtggcagcaggtgttgaattcgccaagtcgaagggctatgtgcaaactggtgactactgcgttgtgattcatgccgatcacaaggtaaagggctatgccaaccagacgcgcatacttctcgtcgaatgaggccagatcccattcgcatatgcgcgccactttgtcctatacggaaaagggactctctgaggtattatatcctttggtttgtctccgcgcccttcgaactttcgacatgtgcttgcggttagcgtgatcggtggcatgttgctgcctctgccccttttgtttgtgtgatttgtcgtaccattcacgaatggcgaatgctgtttttttttctgttttttgctgttctcctggaccacctttcgtctatacacttcttgagctgccagctaccgcctttgtcggcgcacgggatcgtgggctgtgtatttgcgttgaggggagtggaggcag

SEQ ID NO: 16805 - protein, 499 aa, Leishmania mexicana
MSQLAHNLTLSIFDPVANYRAARIICTIGPSTQSVEALKGLIQSGMSVARMNFSHGSHEYHQTTINNVRQAAAELGVNIAIALDTKGPEIRTGQFVGGDAVMERGATCYVTTDPAFADKGTKDKFYIDYQNLSKVVRPGNYIYIDDGILILQVQSHEDEQTLECTVTNSHTISDRRGVNLPGCDVDLPAVSAKDRVDLQFGVEQGVDMIFASFIRSAEQVGDVRKALGPKGRDIMIICKIENHQGVQNIDSIIEESDGIMVARGDLGVEIPAEKVVVAQKILISKCNVAGKPVICATQMLESMTYNPRPTRAEVSDVANAVFNGADCVMLSGETAKGKYPNEVVQYMARICLEAQSALNEYVFFNSIKKLQHIPMSADEAVCGSAVNSVSETKAKAMVVLSNTGAGARLVAKYRPNCPIVCVTTRLQTCRQLNITQGVESVFFDADKLGHDEGKEHRVAAGVEFAKSKGYVQTGDYCVVIHADHKVKGYANQTRILLVE

SEQ ID NO: 16806 - DNA, 1452 bp, Methylobacterium extorquens
  CDS (1)..(1452)
atgatggaggcccctttgaagcgctcgcgccgcaccaagatcgtcgccaccctcggcccggcatccgacacgccggagatgatcgagaagctgttccacgccggtgcggacgtgttccgcatcaacatgagccatctggctcgcgagaagctgcctgaacgcatcgaggtgattcgcaccatcgagcgggagggcaagcgccccatcggcatcctcgtcgaccttcagggcccgaagctgcggctcggcaccttcgtcggcgacgcggccgtgctggagaacggccagaccttcgtgctcgattcggatccgacgccgggcgataccgaccgcgtcttccttccccatcctgagatcctgtcggcgctggagcccagccacggcatcctgatcgacgatggcaagcttcgcctcatcgtcacggaggtgagcgaggggcgtgccgtcacccgcgtcgaggtcggcggtcgcatctcgaatcgcaagggcgtgtcgctgccccacaccgcgctgccggtgccggcgatgaccgagaaggatcgcggtgatctggaagcgggcctcgcggccggcgccgactggatcgcggtgtccttcgtgcagcgcccggaagacgtggcggaggtcaagaaggtcgccgccgggcgcgccctggtgatggccaagatcgagaagccgcaggcgctcacccgcctcgatgagatcatcgagatctccgacggcatcatggtcgcccgcggcgacctcggcgtcgagatgccgctcgaacaggtgccgggcgtgcagaagcgcatcacccgcgtcgcccgccggctcggcaagccggtcgtcgtcgcgacgcagatgctcgaatcgatgatcacctcaccggtgccgacccgcgccgaggtgtcggacgtggccaccgccgtctacgagggcgcggatgcggtgatgctctcggccgaaagcgccgccggcgactttccggtcgaggcgatcggcaccatgaaccgcatcgccgaacaggtggagcgcgacgcgctctactggtcgatcctgatggcgcagcgttccgagccggagccgaccgcttccgacgccatcgcggccgcggcccaccagatcgtcgaggcgctgagcctgcgctcgatcatggcctggacccattccggttcaacggtgctgcggctggcgcgcgcccggcccaatgccagcgtcatcgcgctgacgccgaagcgcgagacggcgcggcgcctcaccatggcctggggcgtgcacccgatcgtcaccaaggatgccagcgacgtggacgacatggccttccgcgccgcgaagttcgcggtgcgcgagcgcttcgccgagatcggcgaccgagtgatcatcgtggccggcgtgccgttcggcattccgggggcgaccaacatggtgcgcatcgccttcgtcacccgcgagcacgccgagcgggcctga

SEQ ID NO: 16807 - protein, 483 aa, Methylobacterium extorquens
MMEAPLKRSRRTKIVATLGPASDTPEMIEKLFHAGADVFRINMSHLAREKLPERIEVIRTIEREGKRPIGILVDLQGPKLRLGTFVGDAAVLENGQTFVLDSDPTPGDTDRVFLPHPEILSALEPSHGILIDDGKLRLIVTEVSEGRAVTRVEVGGRISNRKGVSLPHTALPVPAMTEKDRGDLEAGLAAGADWIAVSFVQRPEDVAEVKKVAAGRALVMAKIEKPQALTRLDEIIEISDGIMVARGDLGVEMPLEQVPGVQKRITRVARRLGKPVVVATQMLESMITSPVPTRAEVSDVATAVYEGADAVMLSAESAAGDFPVEAIGTMNRIAEQVERDALYWSILMAQRSEPEPTASDAIAAAAHQIVEALSLRSIMAWTHSGSTVLRLARARPNASVIALTPKRETARRLTMAWGVHPIVTKDASDVDDMAFRAAKFAVRERFAEIGDRVIIVAGVPFGIPGATNMVRIAFVTREHAERA

SEQ ID NO: 16808 - DNA, 1439 bp, Mycobacterium intracellulare
  CDS (1)..(1419)
atgagtagacgcgggaagatcgtctgcacccttgggcctgcgaccaattcggacgagttgatcttggcgctggttgaggcgggaatggacgtcgcccggttgaacttcagccacggtgattacgccgatcacaaagcggcctacgaacgggtccgggtggcctccgacgccaccggccgtgccgtcggcgtgctcgccgatttgcagggccccaagatcaggctgggacgcttcgcgaccggcccaacctactgggccgacggtgagaccgtccggatcaccgtcgccgactgcgagggcagccacgaccgggtgtcgaccacctacaagaaactggccgaggacgccgccgtcggtgaccgggttctggtcgacgacggcaaggtctgcctggtggtcgatggcatcgagggcgacgacgtcatctgcacggtcgtcgagggcggcccggtcagcaacaacaagggaatctcgttgccgggcatgaacgtgtcggcaccggccttgtcggagaaggacatcgaggacctcaccttcgccctggacctcggcgtcgacctggtcgccctgtccttcgtgcgctcgccggccgacgtcgagctggtgcacgaggtgatggaccgggtcgggcgacgggttccggtgatcgccaagctggaaaagcccgaagccgtcgacaatctggaaaccatcgtgctggccttcgacgccatcatggtggcccgcggcgacctcggcgtcgagctgccactggaagaggttccgctggtgcagaagcgggccatccagatggcccgggagaacgcgaaaccggtcatcgtggccacccagatgctcgattccatgatcgagaactcacgcccgacccgcgccgaggcctccgacgtcgccaacgccgtcctcgacggcgccgacgcggtgatgctgtccggggagacgtcggtgggcaagtatccgatggctgccgtgcggaccatgtcgcgcatcatctgcgcggtcgaggacaattccacggccgccccgccgctgacccacgtgccgcgcaccaaacgcggcgtgatctcctatgcggcccgcgacatcggcgagcggctcgacgccaaagccctggtcgccttcacccaatccggcgacacggtcaagcggctcgcgcgcctgcacaccccgctgccgctgctggccttcaccgcctggcccgaggtgcgcagccagctcgccatgacctggggcaccgaaacgttcatcgtcccgatgatgacctccacgggcggcatgatccgccaggtcgacaagtcactgctcgaactcggtcgctacaagcgcggcgacctggtggtcatcgtcgccggcgcgccacctggcacagtagggtcgaccaacctgatccacgtgcaccggatcggggaggacgacgtctaacgcccggacccgaaggagag

SEQ ID NO: 16809 - protein, 472 aa, Mycobacterium intracellulare
MSRRGKIVCTLGPATNSDELILALVEAGMDVARLNFSHGDYADHKAAYERVRVASDATGRAVGVLADLQGPKIRLGRFATGPTYWADGETVRITVADCEGSHDRVSTTYKKLAEDAAVGDRVLVDDGKVCLVVDGIEGDDVICTVVEGGPVSNNKGISLPGMNVSAPALSEKDIEDLTFALDLGVDLVALSFVRSPADVELVHEVMDRVGRRVPVIAKLEKPEAVDNLETIVLAFDAIMVARGDLGVELPLEEVPLVQKRAIQMARENAKPVIVATQMLDSMIENSRPTRAEASDVANAVLDGADAVMLSGETSVGKYPMAAVRTMSRIICAVEDNSTAAPPLTHVPRTKRGVISYAARDIGERLDAKALVAFTQSGDTVKRLARLHTPLPLLAFTAWPEVRSQLAMTWGTETFIVPMMTSTGGMIRQVDKSLLELGRYKRGDLVVIVAGAPPGTVGSTNLIHVHRIGEDDV

SEQ ID NO: 16810 - DNA, 1629 bp, Yarrowia lipolytica
  CDS (1)..(1629)
atgatttacaccgccaattcgtccccttccaccaacctgcagtggctcagtaccctgaacacggatgacattcccaccaagaactaccgaaagtcgtccatcattggtactatcggtcccaacacaaactccgccgagatgatctccaagcttcgacaagctggtctcaacattgttcgaatgaacttctcccacggctcgtacgagtaccaccagtccgtcattgagaacgcccgagagtccgagcagcggttccgaggccgacccctagccattgctctcgacaccaagggccccgagatccgaaccggtgtcaccaaggacgacaaggactgggacgtcaaggccggccatgtcatgctcttctccaccaaccccaagtacaaggaccagtgcgacgataagatcatgtacattgactacaccaacattgtcaagcagattgacattggcaagatcatcttcgttgacgacggtgttctgtccttcaaggttctcgagaagattgacggcgagaccctcaaggtcgagactctcaacaacggtaagatctcttctcgaaagggtgtcaacctccctggcaccgatgtcgatctccccgctctgtccgagaaggacaaggccgatctcaagtttggtgttgagcacggtgtcgacatgatttttgcctctttcgtccgaaccgccaacgacgtccaggccatccgagacgtgctcggcgagaagggcaagggcatccaggtcatctccaagattgagaaccagcagggtgtcaacaactttgacgagattctgaaggagaccgacggtgtcatggttgcccgaggagacttgggtatcgagatccccgccccccaggttttcattgcccagaagcagctgatcgccaagtgtaacctggccggaaagcccgtcatctgtgccacccagatgctcgattccatgacctacaacccccgacccacccgagccgaggtctctgatgtcggtaacgccgtccttgatggtgctgactgtgtcatgctgtctggtgagacggccaagggaacctaccccattgagtccgtcaagatgatgcacgagacctgtctggttgccgagaaggccattgcctatgctcctctgttcaatgagatgcgaaccctgactgtccgacccaccgagaccgtcgagaccattgctatctccgccgtgtctgcttctttcgagcagcaggcccgagctattattgtgctgtccacatcgggaacctccgcccgactgtgttccaagtatcgacccaactgtcccattcttatggtgactcgaaacgcacaggccgctcgattctcccatctgtaccgaggcgtctaccccttcatctaccacaaggcccgagcttccaaccctgccgagtggcagcacgatgttgaggagcgactcaagtggggtatggacgaggctgttgctcttggtattcttaacaagggcgatgttgttgtcgccatccagggatggaccggtggtctggccacaccaacactctccgagttctcgagtgtgtctaaactttttaacacaaacctattagattataaaacatacagcatggtgattaagtcggtgaacggaggggttttgtacaagtag

SEQ ID NO: 16811 - protein, 542 aa, Yarrowia lipolytica
MIYTANSSPSTNLQWLSTLNTDDIPTKNYRKSSIIGTIGPNTNSAEMISKLRQAGLNIVRMNFSHGSYEYHQSVIENARESEQRFRGRPLAIALDTKGPEIRTGVTKDDKDWDVKAGHVMLFSTNPKYKDQCDDKIMYIDYTNIVKQIDIGKIIFVDDGVLSFKVLEKIDGETLKVETLNNGKISSRKGVNLPGTDVDLPALSEKDKADLKFGVEHGVDMIFASFVRTANDVQAIRDVLGEKGKGIQVISKIENQQGVNNFDEILKETDGVMVARGDLGIEIPAPQVFIAQKQLIAKCNLAGKPVICATQMLDSMTYNPRPTRAEVSDVGNAVLDGADCVMLSGETAKGTYPIESVKMMHETCLVAEKAIAYAPLFNEMRTLTVRPTETVETIAISAVSASFEQQARAIIVLSTSGTSARLCSKYRPNCPILMVTRNAQAARFSHLYRGVYPFIYHKARASNPAEWQHDVEERLKWGMDEAVALGILNKGDVVVAIQGWTGGLATPTLSEFSSVSKLFNTNLLDYKTYSMVIKSVNGGVLYK

SEQ ID NO: 16812 - DNA, 1827 bp, Mus musculus
  CDS (42)..(1766)
agtctgtgcttcttgcagccccagtcccacactttggaagcatgtctgtccaagagaacgagctaccccagcagctctggccctggatctttaagtcccaaaaagacttagcaaagtctgctttaagtggggctccaggagggccagcaggatacctgcgacgtgccagtgtggcccagctgacccaggagctgggcactgccttcttccagcagcagcaactgcccgcagctatggcggacaccttcctggaacacctctgccttctggatatcgactcagagcctgtggccgctaggagcaccagcatcattgccaccatcgggccggcgtcacgctctgtggaccgcctcaaggagatgatcaaggcagggatgaacattgcacgactcaacttctcccatggctcccatgagtaccatgcagagtccatcgccaacattcgggaggcggctgaaagttttgcaacctccccactcagctacagacccgtggccatcgccctggacaccaagggtcccgagatacgcactggagtcctgcaggggggtccagagtcggaggtggaaattgtgaagggttcacaggtgctggtgaccgtggatccgaagttccggacaaggggcgatgcaaagacagtgtgggtggactaccacaatatcacccaggtcgttgcagtggggggccgcatctacattgacgacgggctcatctccttagtggtgcggaaaattggcccagagggactggtgaccgaagtggaacacggtggtttcttgggcaacaggaagggtgtgaacttgccaaatgccgaggtggacctgcctgggctatcagagcaagatcttttggatctgcgcttcggggtggagcattatgtggacatcatctttgcctcctttgtacgaaaagccagtgatgtggtggcagtccgagatgccctagggccagaaggacggggcatcaaaattatcagcaaaatcgagaaccatgaaggcgtgaagaagtttgatgagatcctagaagtgagcgatggcatcatgatggctcggggtgaccttggcattgagatcccagcagagaaggttttcttggctcagaagatgatgattggacgctgcaacctggctggcaagcctgtcgtttgtgccacacagatgctggagagcatgatcactaaggctcgaccaactcgggcggagacaagcgatgtggccaatgctgtgctggatggggctgactgtatcatgctgtctggagagaccgccaaaggcagtttccccgtggaggctgtaaagatgcaacatgcgattgcccgggaggcagaggccgctgtgtaccaccgccagttgtttgaggagctacgccgggcagcgccgctgagccgtgacccaaccgaggtcactgcaattggagccgtggaggcttccttcaagtgctgtgccgcagccatcattgtgctgacaaagactggccgctcagctcagcttctgtctcgctaccgacctcgggctgctgtcattgctgtgactcgttctgcccaggctgcccgacaggtccacctgtcccgaggagtcttccccttgctctaccgtgagcctccagaggctgtctgggcagatgatgtggaccgaagggtccaatttggcatcgaaagtggaaagcttcgtggcttcctccgagttggtgatctggtgattgtggtgacaggctggcgacctggctctggctataccaacattatgcgggtgctgaccatatcctgaaacgcctctcccctttctgaccttagttgcaccccatttctttcaacccacacccctccca

SEQ ID NO: 16813 - protein, 574 aa, Mus musculus
MSVQENELPQQLWPWIFKSQKDLAKSALSGAPGGPAGYLRRASVAQLTQELGTAFFQQQQLPAAMADTFLEHLCLLDIDSEPVAARSTSIIATIGPASRSVDRLKEMIKAGMNIARLNFSHGSHEYHAESIANIREAAESFATSPLSYRPVAIALDTKGPEIRTGVLQGGPESEVEIVKGSQVLVTVDPKFRTRGDAKTVWVDYHNITQVVAVGGRIYIDDGLISLVVRKIGPEGLVTEVEHGGFLGNRKGVNLPNAEVDLPGLSEQDLLDLRFGVEHYVDIIFASFVRKASDVVAVRDALGPEGRGIKIISKIENHEGVKKFDEILEVSDGIMMARGDLGIEIPAEKVFLAQKMMIGRCNLAGKPVVCATQMLESMITKARPTRAETSDVANAVLDGADCIMLSGETAKGSFPVEAVKMQHAIAREAEAAVYHRQLFEELRRAAPLSRDPTEVTAIGAVEASFKCCAAAIIVLTKTGRSAQLLSRYRPRAAVIAVTRSAQAARQVHLSRGVFPLLYREPPEAVWADDVDRRVQFGIESGKLRGFLRVGDLVIVVTGWRPGSGYTNIMRVLTIS

SEQ ID NO: 16814 - DNA, 1799 bp, Xenopus laevis
  CDS (11)..(1606)
atcagagaacatggcgcagctgatgcaggacctgggaccggctttcgtccaacggcagcagctgaatgcctcaatggccgacaccttcctggatcacatgtgtctgttggacattgactcggagcccataacggccagaaacaccagcattgtctgtaccatcggtccagcctcgcgctctgtggaaatgctgaaggagatgataaaggctgggatgaacatcgctcgtctgaacttctctcacgggagccatgagtaccacgctgggtctattcacaatattcgggaagccaccgagagctttgcctcaaatcccattcactaccggcctgtggctatcgctctggacaccaaggggccagaaatccgaactggggtcatcaagacgggggagaacacagaggtggagctgatgaaaggctcaattatgaaagtgactaatgacgagtccttcaaggataagtgtgacgagaagatcctgtgggtggattataagaacatctgtaaagttgtgaaggtcggaggcaggatttttgtggacgatggactgatttctctgttggttagagagattggccctgattactgcatggctgaagtggagaatgggggtaacctgtgcagtaagaaaggggtgaatttgcctggggctccggtggaccttcctgcattatcggagagagattgcctggacttgaagtttgggattgagcagggagtagacatggtatttgcttccttcattcgcaaggcgcaagatgtacacaccattcgcaaggaactgggagaaaaaggtcggaatattcgcatcatcagcaaaatagaaaatcatgagggagtcaagaggttcgatgagattctcgaggccagtgatgggataatggtggcccggggtgatctcggcattgaaattccagcagagaaggttttcttggcacagaaaatgatgattggacgttgcaacagagccgggaagccagtgatctgtgccacgcagatgttggagagtatgatcaagaagcctcgtccgacccgtgcggagagcagtgatgtggccaatgctgtgctggatggagctgactgtatcatgttgtctggagagactgccaagggcctgtacccagtggagtctgtacacatgcagcatgcgattgcccgggaggctgaggcagcgatctacaatcgccagctgtttgaggaactcagacgagtgaccccactgacccaggatcccacagaggtgactgccataggggctgtagaggcctcgtttaaatgctgtgctggagccatcattgttctgaccacgtctggccggtctgcgcaactcctttctcgttaccgccctcgtgctcccatcattgcagtgacacgtagtgcccaggtggggcgccaggctcatctcaaccgcggggtcttccctgtcctgtaccaggaggcgcagctggaagtttgggctgatgatgtggatcgtagggtgcagtttgccatttccattggaaaagtccgtgggttcctgagcaaagacgacattgtgattattgtgactggctggaggcctgggtctggctacaccaatatcatgcaggtggtgagggtgccgtaagcctggcagtacaacactactcacaccctgtacctggggtcccctgtacaagtgggggtttccctgtatgtacccagtattttatcaatgcaggtttcctttatctgcttcccattccatattaaacatgggccaaagcttcaaaaaaaaaaaaaaaaaaaaaaaaaaaaaaaaaaaaaaaaaaaaaaaaaaa

SEQ ID NO: 16815 - protein, 531 aa, Xenopus laevis
MAQLMQDLGPAFVQRQQLNASMADTFLDHMCLLDIDSEPITARNTSIVCTIGPASRSVEMLKEMIKAGMNIARLNFSHGSHEYHAGSIHNIREATESFASNPIHYRPVAIALDTKGPEIRTGVIKTGENTEVELMKGSIMKVTNDESFKDKCDEKILWVDYKNICKVVKVGGRIFVDDGLISLLVREIGPDYCMAEVENGGNLCSKKGVNLPGAPVDLPALSERDCLDLKFGIEQGVDMVFASFIRKAQDVHTIRKELGEKGRNIRIISKIENHEGVKRFDEILEASDGIMVARGDLGIEIPAEKVFLAQKMMIGRCNRAGKPVICATQMLESMIKKPRPTRAESSDVANAVLDGADCIMLSGETAKGLYPVESVHMQHAIAREAEAAIYNRQLFEELRRVTPLTQDPTEVTAIGAVEASFKCCAGAIIVLTTSGRSAQLLSRYRPRAPIIAVTRSAQVGRQAHLNRGVFPVLYQEAQLEVWADDVDRRVQFAISIGKVRGFLSKDDIVIIVTGWRPGSGYTNIMQVVRVP

SEQ ID NO: 16816 - DNA, 2404 bp, Brachydanio rerio
  CDS (37)..(1635)
gtcagcgagagcaggatattaccagtctcctccacgatgtctcaaactaaagctcaggatatgggctctgccttcatccagacgcagcagctcaatgctgccatggccgacactttcctggagcacatgtgtctgctggacatcgactccgagcccaccatcgctcgcaacactggaatcatctgcaccatcggaccggcctcccgctcagtggacacactgaaggagatgatcaagtctggcatgaacatcgctcgcatgaacttctctcacggctcacacgagtatcatggagaaactattaaaaatgtacgtgaggcttgtgccagcttcaagccgggcagcatccagtacaggccagtgggcatcgccctcgacaccaaaggaccagaaatccgaactgggctcattaaagggagtggcacagctgaggtggagctgaagaagggaaataagatcaaggtgaccttagacgactccttcatggagaactgtgatgaagataccctctggctggactacaagaacatcaccaaggtggtggaggtgggcagtaaagtctacatcgatgacggactcatctctctccaggttctgcagatcgggtctgactatctgatctgtgagattgagaatggaggatctctgggcagtaagaagggtgtgaatctgccgggagccgcagtggatctgcctgcagtctcagagaaggacatcaaggatctgcagttcggtgtggagatgggtgtcgatatgatcttcgcctccttcatccgcaaggccgctgatgtgcaggcagtccgaaaagtgctgggagaaaagggcaaaaacatcaagattatcagcaagctggagaaccatgagggagtgcgcaggtttgatgagattatggaggccagcgacggcatcatggtggctcgtggtgatctaggaattgaaatccccacggaaaaggtgtttctggctcagaagatgatgattggtcgttgcaacaaggcaggaaagccaatcatctgtgccacacagatgttggagagcatgatcaagaagcctcgtcctacacgtgcggagggcagtgatgtggccaatgcagttctggacggagccgactgcattatgctgagcggagagacagctaaaggagattaccctctggaggccgtccgcacacagcacatgatcgctcgggaggcagaggctgccatgtttcatcggcaggtgtttgaggacctgcggcgctgtttgccactctccaccgaccccgccgaggccatcgccatcggggcagtggaggcctcctttaaaatcctgtcctcagcgtttatagtgctcactgggtccggcaggtctgctcatctgatctctcggtatcgtcctcgcgctccaatcctagcggtgacacgtaatgaacagacagctcgacaggctcatctttaccgtggtattttccccatatactacaacagcccatctaatgatgtgtgggccgaggacgtggacctgagggtcaacttcgccatggatgtcggtaaagctcgtggattcttcaaggctggtgatgtggtgatcgttctgactggctggcgtcccggctctggatacaccaacaccatgcgtgtcgtcccagtgccgtaaaaccgttaaaacccctctgctgttcatacatcactcctccatacatcacacaaaccccactccagcagaaaacacaaggccagtggaccaccctgttatcttctccccctgattggtcagtggatcatcatcctctctcctgattggttggtgtcccatcatcctctcatttgattggttgttctcacctgttttgtttttttatttcatctataatctcctgtttatctcacacacacatgaaacccgagctgtctgtctggtttgtgtctgtctgtccgcatggtgaagcgcagggatgggtggcgaatgctcaatcagctgtaacctgtaacggttatattagtagtgtttctctgtctgtgtgcttttatttgtgttcacactcctgacgatgttacattgtgtgtttgcactcgaccctgagatcgttatatattcatatattttctgaaatgtttggatgtctcgcgtccgcctcatttcagctgtggagtaaaggaggggtgaatattaatcattcccagcatcctctgctgtataaccccgtctctgctgctcacgtgtgtgtgtgtgtttgatgaatgaatgagagtgtgtgtttagatctacctgctttgtgtcgctagagtgcaagatgtactaactataagagtaatctatagtctcattctgaagtgttgtattattggagactgaattaataaaggagacgagcacttgaaaaaaaaaaaaaaaaaaaaaaaaaaaaaaaaaaaaaaaaaaaaaa

SEQ ID NO: 16817 - protein, 532 aa, Brachydanio rerio
MSQTKAQDMGSAFIQTQQLNAAMADTFLEHMCLLDIDSEPTIARNTGIICTIGPASRSVDTLKEMIKSGMNIARMNFSHGSHEYHGETIKNVREACASFKPGSIQYRPVGIALDTKGPEIRTGLIKGSGTAEVELKKGNKIKVTLDDSFMENCDEDTLWLDYKNITKVVEVGSKVYIDDGLISLQVLQIGSDYLICEIENGGSLGSKKGVNLPGAAVDLPAVSEKDIKDLQFGVEMGVDMIFASFIRKAADVQAVRKVLGEKGKNIKIISKLENHEGVRRFDEIMEASDGIMVARGDLGIEIPTEKVFLAQKMMIGRCNKAGKPIICATQMLESMIKKPRPTRAEGSDVANAVLDGADCIMLSGETAKGDYPLEAVRTQHMIAREAEAAMFHRQVFEDLRRCLPLSTDPAEAIAIGAVEASFKILSSAFIVLTGSGRSAHLISRYRPRAPILAVTRNEQTARQAHLYRGIFPIYYNSPSNDVWAEDVDLRVNFAMDVGKARGFFKAGDVVIVLTGWRPGSGYTNTMRVVPVP

SEQ ID NO: 16818 - DNA, 1806 bp, Oryza sativa
  CDS (75)..(1721)
gcatcgcatcctccgccgccgccgccgccatcaccctcctctccgccgcattagcagtagaatcctaagccataatggcaacctccgccgccgccgccgcgagcaccttgccttacctcgtcgccgccgcctcctcctccgcggcggcgcgccgccgcggggcccaccggatccgggcgtcgtcggcggcggcggaggtggagggggcgatggacgtggtgtcggaggcggagctgcgggagaaggggttcatggggctccggaagacgaagctggtgtgcacggtggggcccgcttgcgtgggggctttgccggcgctggcgcgcggcgggatgggcgtggcgcgggtcaacctgtgccacgggggccgcggctggcaccgcgccgtgatgcgcgaggtgcggaggctcaacgaggaggaaggcttctgcgtctccctcatggtcgacaccgaggggtcccagctcctcgtcgccgaccacggcggcgccgcctccgtcaaggccgaggatggctctgaatggctatttacaagtaaaagaaccgatgaatctcatccattcacaatgcatgttaactttgataagttttctgaagacattctagttggtgatgagcttgtaattgatggaggaatggcaacatttgaagttattgagaaggtcggaaatgatttgcgctgtaagtgcacagacccaggtttgcttcttcctcgagccaaactgtcattctggaggaatggaaaattagttgaaaggaactttgggcttcctacattgtcagcaaaggattgggctgacattgaatttgggatagctgaaggagttgattgcatcgctctttcatttgtaaaagatgctaatgacatcaagtatctcaagacttacctctccagaaaatcattagaacacatcaaaatattcgcgaaggttgagagtcttgaatcactcaagaaccttaaagacatcatagaggcatctgatggagttatggtagcacgtggtgatcttggagttcagattcctttagaacaaatcccagccatccaagaggcaattgttgatctttgtcgacggttgaacaagccagtgatagttgcctctcagcttcttgaatcaatggttgagtatccaacaccaactcgtgcagaggtagcagacgtttctgaagcagtacggcaatatgctgatgccgtaatgttatcggcagagtcagctataggtgcatatccccagaaagctctagcagtcctccgtgctgctagtgagaggatggaatcatggagccgtgaggaaaacatgcagaaacttcttccacaacatcagcttgcaatagctttgcctgataggatctcagagcaaatttgcaccagtgctgcagaaatggcaaacaaccttgcggtggatgccatctttgtttacacaaagtatggtcacatggcgtcgcttctttcgcgcaaccggcccaaccctcccatttttgctttcactgataatgccaactcaagaaagagcatgaacctctactggggagtaattccacttcagctaccactgtcaaataacatggaagataacttcaatcaaaccatcaagcttatgaagtcgaagggttcagtgaaatctggagacacagtcttggtcgtcgccgactctgatctgaaccgaccccgtgctgctacctcagttttccaatccattcaagttcgaatagtggactaggttagtcattgctgagctagttgctagcagctgcagatctggatggatatttacaaattatacgatgattcttgaaattgttctg

SEQ ID NO: 16819 - protein, 548 aa, Oryza sativa
MATSAAAAASTLPYLVAAASSSAAARRRGAHRIRASSAAAEVEGAMDVVSEAELREKGFMGLRKTKLVCTVGPACVGALPALARGGMGVARVNLCHGGRGWHRAVMREVRRLNEEEGFCVSLMVDTEGSQLLVADHGGAASVKAEDGSEWLFTSKRTDESHPFTMHVNFDKFSEDILVGDELVIDGGMATFEVIEKVGNDLRCKCTDPGLLLPRAKLSFWRNGKLVERNFGLPTLSAKDWADIEFGIAEGVDCIALSFVKDANDIKYLKTYLSRKSLEHIKIFAKVESLESLKNLKDIIEASDGVMVARGDLGVQIPLEQIPAIQEAIVDLCRRLNKPVIVASQLLESMVEYPTPTRAEVADVSEAVRQYADAVMLSAESAIGAYPQKALAVLRAASERMESWSREENMQKLLPQHQLAIALPDRISEQICTSAAEMANNLAVDAIFVYTKYGHMASLLSRNRPNPPIFAFTDNANSRKSMNLYWGVIPLQLPLSNNMEDNFNQTIKLMKSKGSVKSGDTVLVVADSDLNRPRAATSVFQSIQVRIVD

SEQ ID NO: 16820 - DNA, 2023 bp, Oryza sativa
  CDS (324)..(1688)
gaacgcctcgtctgaacacaaaaccccgtaaaaatctccgcctccgccaccgccaccgccgccgacgccgccatggccgccaccgccgccgcggcccacaccctcctccacctcgcggccccgaggaagccctccgcggggcccccactcccgcccgccacccaaccccaacgggatcctcgtcgcatatcgatgttgacgtggcgacggaggccgacctgagggagaacgggttccggagcacgcggcgcaccaagctcgtctgcaccgtggggcccgcctcctgcggcgccgacgagctggaggcgctcgccgtcggcgggatgaacgtcgcgcgcgtcaacatgtgccacggggaccgggagtggcaccggggcgtcatccgcgcggtgcggaggctcaacgaggagaaggggttcgccgtcgccgtcatgatggacaccgaggggagcgagatccacatgggggacctcggcggcgccgccgccgccaaggcggaggatggagaaatatggacatttagcgtaagatcctttgaggcacctcccccagaacgaactattcatgtgaactacgaaggcttcgctgaagatgtgagagttggtgatgagcttcttgttgatggtggcatggctcggtttgaggtggttgagaaattaggaccagatgtcaagtgccgttgcacagatcctggtttgttgctgccacgtgccaatcttacattttggcgggatggtagtattgtccgtgagaggaacgctatgctacctaccatttcatcaaaggattggcttgacatagactttggaatttctgaaggcgtagattttattgcagtttcgtttgtcaaatctgcagaagtaattaaccatctgaaaagctatatagctgcaaggagccgtggcagcgatatagcagtcattgccaagatcgagagcattgactctttgaagaacttggaggagataatccgtgcttcagatggtgccatggtagcccgaggggatatgggtgcacaaattcccttggagcaagtcccctcagtacaacaaaagatagttaaactgtgcaggcagctcaacaagccagtcattgttgcgtcgcagcttcttgaatcgatgattgagtatcctacgcccaccagggccgaggttgctgatgtttctgaagcagttcgtcagcgtgcagatgcgcttatgctttcaggtgagtcagcaatggggagatatccagagaaagctcttagtgtcctccggagtgttagcctaaggattgagaagtggtggagagaggagaagcgccatgaggaactggaacttaaagatgtttcatcttccttctctgacaaaatatcagaagaaatctgcatttcggccgctaaaatggccaacaaattggaggtagatgccgttttcgtctacacaaacactggccacatggcctcactgctctcgcggtgccgtcctgactgcccgatcttcgccttcacgacctcgacatctgtgaggagacgattgaacctccaatggggcctcatccccttccgcctcagcttctcggacgacatggagagcaacctgaaccgtaccttctcgctgctcaaggccaggggcatgatccagtccggcgaccttgtcatcgcgctctccgacatgctgcagtccatccaggtcatgaacgtaccttgagaatcatcatgctcccctctcgtgtttgtttgttctgcccaaaacggaacacggctttagttgacatcatcttaggggcggttttctggtttgaaatttattcgtttgttctccattgtgttagacgacagaaccagagaatgttacaacaataatgctgcaacttccagcgcgttgtaaactctatgctatttagcctgatgtataaggccatgaactgttttgtcgcttactatgataggctatgtatttaccaataaacccttctatttaagctatgtaagaattttcctcatcagaaattactccttgctagagcccagtaaagattcttt

SEQ ID NO: 16821 - protein, 454 aa, Oryza sativa
MNVARVNMCHGDREWHRGVIRAVRRLNEEKGFAVAVMMDTEGSEIHMGDLGGAAAAKAEDGEIWTFSVRSFEAPPPERTIHVNYEGFAEDVRVGDELLVDGGMARFEVVEKLGPDVKCRCTDPGLLLPRANLTFWRDGSIVRERNAMLPTISSKDWLDIDFGISEGVDFIAVSFVKSAEVINHLKSYIAARSRGSDIAVIAKIESIDSLKNLEEIIRASDGAMVARGDMGAQIPLEQVPSVQQKIVKLCRQLNKPVIVASQLLESMIEYPTPTRAEVADVSEAVRQRADALMLSGESAMGRYPEKALSVLRSVSLRIEKWWREEKRHEELELKDVSSSFSDKISEEICISAAKMANKLEVDAVFVYTNTGHMASLLSRCRPDCPIFAFTTSTSVRRRLNLQWGLIPFRLSFSDDMESNLNRTFSLLKARGMIQSGDLVIALSDMLQSIQVMNVP

SEQ ID NO: 16822 - DNA, 25 bp, Primer
atgaaaaagaccaaaattgtttgca

SEQ ID NO: 16823 - DNA, 23 bp, Primer
ttacaggacgtgaacagatgcgg

SEQ ID NO: 16824 - DNA, 2250 bp, Escherichia coli K12
  CDS (163)..(1566)
aatgcacccgctgtgtgaaataaacagagcgccttcggggcgtttttttacatggcacgaaagaccaaacatttgttatcaaatggtaaataataagtgagctaaaagttgcttaacgaaagcaaaacagaaagaaaaaattaatcaggtgaggagcaggtcatgaatacagtacgcagcgaaaaagattcgatgggggcgattgatgtcccggcagataagctgtggggcgcacaaactcaacgctcgctggagcatttccgcatttcgacggagaaaatgcccacctcactgattcatgcgctggcgctaaccaagcgtgcagcggcaaaagttaatgaagatttaggcttgttgtctgaagagaaagcgagcgccattcgtcaggcggcggatgaagtactggcaggacagcatgacgacgaattcccgctggctatctggcagaccggctccggcacgcaaagtaacatgaacatgaacgaagtgctggctaaccgggccagtgaattactcggcggtgtgcgcgggatggaacgtaaagttcaccctaacgacgacgtgaacaaaagccaaagttccaacgatgtctttccgacggcgatgcacgttgcggcgctgctggcgctgcgcaagcaactcattcctcagcttaaaaccctgacacagacactgaatgagaaatcccgtgcttttgccgatatcgtcaaaattggtcgtactcacttgcaggatgccacgccgttaacgctggggcaggagatttccggctgggtagcgatgctcgagcataatctcaaacatatcgaatacagcctgcctcacgtagcggaactggctcttggcggtacagcggtgggtactggactaaatacccatccggagtatgcgcgtcgcgtagcagatgaactggcagtcattacctgtgcaccgtttgttaccgcgccgaacaaatttgaagcgctggcgacctgtgatgccctggttcaggcgcacggcgcgttgaaagggttggctgcgtcactgatgaaaatcgccaatgatgtccgctggctggcctctggcccgcgctgcggaattggtgaaatctcaatcccggaaaatgagccgggcagctcaatcatgccggggaaagtgaacccaacacagtgtgaggcattaaccatgctctgctgtcaggtgatggggaacgacgtggcgatcaacatggggggcgcttccggtaactttgaactgaacgtcttccgtccaatggtgatccacaatttcctgcaatcggtgcgcttgctggcagatggcatggaaagttttaacaaacactgcgcagtgggtattgaaccgaatcgtgagcgaatcaatcaattactcaatgaatcgctgatgctggtgactgcgcttaacacccacattggttatgacaaagccgccgagatcgccaaaaaagcgcataaagaagggctgaccttaaaagctgcggcccttgcgctggggtatcttagcgaagccgagtttgacagctgggtacggccagaacagatggtcggcagtatgaaagccgggcgttaatctgcaacatacaggtgcagccgtggaatgatcaaacgaagcggctgcgcctgaggtttataacggtgctgcacattgtcggcatcgtaatttaacaactcaccaacgtccggcacgcccgcgccattatcccgattaatcagtgcaatcagtggtgtagggcaggcgtgttggacttgtttttgatctcctttgtaccagacgcgggcaatcggctgcaccttcaccggacgtttgatttttaacttcgcgttctgtggcagggcagcgatatcctgatactctcgctccagttttctttgccactcctcgcgcgtccacggtgcgacactgcgtggtgatttcaggcttttttccagctgtgccaggacttcatcacgatgtaaattcttaatgatatgtttattagcccaaccaaagcgtaaagtggcggggtcgtgcagaacggtgagcgtgcggtaagcattaagggtgatcacgcccggcaaatgacgatgcacccattcaaaacgtgccgcggtggggatttctgattcaaccgtgacgatatgctcgaacgtggcttcgagtttattgatgtgctgaatatgactgaccaacgctgcttgcgaaaggttatccgaaccggaacacaacagccaggcagacggacagtggccttgctgctgcgattcggactgttgt

SEQ ID NO: 16825 - protein, 467 aa, Escherichia coli K12
MNTVRSEKDSMGAIDVPADKLWGAQTQRSLEHFRISTEKMPTSLIHALALTKRAAAKVNEDLGLLSEEKASAIRQAADEVLAGQHDDEFPLAIWQTGSGTQSNMNMNEVLANRASELLGGVRGMERKVHPNDDVNKSQSSNDVFPTAMHVAALLALRKQLIPQLKTLTQTLNEKSRAFADIVKIGRTHLQDATPLTLGQEISGWVAMLEHNLKHIEYSLPHVAELALGGTAVGTGLNTHPEYARRVADELAVITCAPFVTAPNKFEALATCDALVQAHGALKGLAASLMKIANDVRWLASGPRCGIGEISIPENEPGSSIMPGKVNPTQCEALTMLCCQVMGNDVAINMGGASGNFELNVFRPMVIHNFLQSVRLLADGMESFNKHCAVGIEPNRERINQLLNESLMLVTALNTHIGYDKAAEIAKKAHKEGLTLKAAALALGYLSEAEFDSWVRPEQMVGSMKAGR

SEQ ID NO: 16826 - DNA, 1770 bp, Arabidopsis thaliana; identical to SEQ ID NO: 16286
  CDS (84)..(1559)

SEQ ID NO: 16827 - protein, 491 aa, Arabidopsis thaliana; identical to SEQ ID NO: 16287

SEQ ID NO: 16828 - DNA, 1512 bp, Arabidopsis thaliana; identical to SEQ ID NO: 16288
  CDS (1)..(1479)

SEQ ID NO: 16829 - protein, 492 aa, Arabidopsis thaliana; identical to SEQ ID NO: 16289

SEQ ID NO: 16830 - DNA, 1500 bp, Arabidopsis thaliana; identical to SEQ ID NO: 16290
  CDS (1)..(1500)

SEQ ID NO: 16831 - protein, 499 aa, Arabidopsis thaliana; identical to SEQ ID NO: 16291

SEQ ID NO: 16832 - DNA, 1865 bp, Solanum tuberosum; identical to SEQ ID NO: 16292
  CDS (66)..(1547)

SEQ ID NO: 16833 - protein, 493 aa, Solanum tuberosum; identical to SEQ ID NO: 16293

SEQ ID NO: 16834 - DNA, 1616 bp, Arabidopsis thaliana; identical to SEQ ID NO: 16294
  CDS (44)..(1576)

SEQ ID NO: 16835 - protein, 510 aa, Arabidopsis thaliana; identical to SEQ ID NO: 16295

SEQ ID NO: 16836 - DNA, 1647 bp, Bradyrhizobium japonicum
  CDS (22)..(1485)
actgcctatatagaggagcacatgaagaggccgcgcggcatttcgcgcggcggaatggatgtgctcatggccaaatctgcacgcacgaagaccgctcgccccgcgacccgcaccgagaccgacagtttcggtcccatcgaggtcccctccgatcgctattggggcgcgcagaccgaacgttcgcggcagaatttccgcatcggcacggatcgcatgccgatctcgctcgtgcatgcgctcggcatcgtcaagctcgccgcggcgcagtccaaccgcgagctcggcctgctcgaccagcgccgcgccagtgccatcatccgcgccgcgcgcgaggtatcgacggcagacctcgacgatcatttcccgctcgtcgtgtggcagaccggctcgggcacgcagaccaacatgaacctcaacgaggtgatcgccaaccgcgccaatgagctgctcggcggcgagctcggcgccaagaagccggtgcatccgaacgatcacgtcaacatgagccagtcgtcgaacgactcttttcccaccgcaatgcatatcgcggcggctagccgcatcaccgccgatctcgttcctgcccttggcgaactgctccgcgcgctgcgcaagaaggagaaggagttcgccaagatcgtcaagatcggccgcacccacacccaggacgcgacgccgctgacgctcggccaggaattctccggctatgccgcgcaggtcgaacgcgggatcgcgcgactgaaggtcgcggtgaaggagctctatccgctggcgcagggcggcaccgccgtcggcaccggcctcaacgcgaagccgcgctttgcaagactgttcgcaaagcacgttgccggaatcaccaaactgcccttcaccagcgccgccaacaaattcgaggcgctggcctcgaacgatgcttatgtgctggcgcacggcgccatcagttcggtcgcgacaggcctgttcaagatcgccaacgacatccgcctgctcggatcgggtccgcgctcagggctcggcgagctgatcctgccggagaacgaaccgggctcgtcgatcatgccgggcaaggtcaatccgacgcagtgcgaggcgatgaccatggtgtgctgccaggtgttcggcaatcacaccgcgatcacggtcgccggcagccagggccatttcgagctcaacgtctacaagcccgtgctggcctacaacatgctgcactcgatccgcctgatggccgatgccgcgcgctccttcaccgaacattgcgtcagcggcatccgcgccgacgaaaagcgcataagtgagctgatgcagcgctcgctgatgctggtgaccgcgctcgcaccgaagatcggctacgacaacgccgccaaggtcgcgaagacggcgcatgccaacggcaccacgctgaaggaggaagcgctgcggctcggcttcgtcacagcggacgagttcgaccgtttggtgcagccggagaagatgacgaaaccgtagtaattcctaattccgatagtcatccgtaatgatacggagccaaaaagctcataattgtaaggcttaaaggagaggatttgattaccgtcaatgttccggaaagacggcgtgctacgaagctattctgcccttggcggggcgaaattcatcgtttgatggcca

SEQ ID NO: 16837 - protein, 487 aa, Bradyrhizobium japonicum
MKRPRGISRGGMDVLMAKSARTKTARPATRTETDSFGPIEVPSDRYWGAQTERSRQNFRIGTDRMPISLVHALGIVKLAAAQSNRELGLLDQRRASAIIRAAREVSTADLDDHFPLVVWQTGSGTQTNMNLNEVIANRANELLGGELGAKKPVHPNDHVNMSQSSNDSFPTAMHIAAASRITADLVPALGELLRALRKKEKEFAKIVKIGRTHTQDATPLTLGQEFSGYAAQVERGIARLKVAVKELYPLAQGGTAVGTGLNAKPRFARLFAKHVAGITKLPFTSAANKFEALASNDAYVLAHGAISSVATGLFKIANDIRLLGSGPRSGLGELILPENEPGSSIMPGKVNPTQCEAMTMVCCQVFGNHTAITVAGSQGHFELNVYKPVLAYNMLHSIRLMADAARSFTEHCVSGIRADEKRISELMQRSLMLVTALAPKIGYDNAAKVAKTAHANGTTLKEEALRLGFVTADEFDRLVQPEKMTKP

SEQ ID NO: 16838 - DNA, 1383 bp, Chlamydophila pneumoniae, Chlamydia pneumoniae
  CDS (1)..(1383)
atgcgacaagaaaaggatagtttaggaatcgtagaagttcctgaggataagttatatggagctcaaactatgcgttctaggaattttttttcttggggacctgagttgatgccttatgaggtaatacgagctctcgtatggattaaaaaatgtgctgctcaggcgaatcaagatttaggatttttggattccaagcattgcgatatgattgttgctgctgccgatgagattttagagggaggttttgaagagcatttccctttaaaagtttggcagacagggagcggcacacaatctaatatgaatgtgaatgaggtgattgcgaatcttgccattcgtcatcacggaggggtgttaggcagtaaggatcctatccatcctaatgatcatgtgaataagtcccaatcgtccaatgatgttttccctacagcaatgcatatcgctgctgtgattagtttaaaaaataagttaattccagctttagatcatatgattcgggtgttagatgctaaagtggaagaatttcgtcatgatgtaaagataggacggacccatcttatggatgcggtgcctatgacgttgggtcaggaattttctggttatagcagtcaattgcgtcactgcttagagagtatagcattttctttagctcatttatatgaacttgcgattggagctactgctgtagggactgggttgaatgttcctgaagggttcgtggaaaagatcatccattatttaaggaaggaaacagatgaaccgtttattccagcttccaattatttttcagcactgtcttgtcacgatgctttagtagatgcccatgggtctttagcaactttagcatgtgctttaactaagatagctacggatttgagctttttaggttcaggacccaggtgtgggttgggtgagttatttttccctgaaaatgaaccaggatcttctatcatgcctggtaaagtcaatcctacgcagtgtgaagctctccaaatggtttgtgctcaagttcttgggaataatcaaacagtgattattggaggaagtcgaggaaattttgagcttaatgtgatgaagcctgtgatcatctataatttcctgcagtctgtggatctcctttctgaggggatgagggctttctctgaattctttgtgaaaggattaaaagtaaataaagctcgtttacaagataatatcaataattctttgatgttggttacagctttagctcctgtattaggttacgacaagtgttcgaaagcagcactgaaagcatttcatgaatctatatctttgaaggaggcgtgtctagctttgggatatctttctgagaaggaatttgatcgtttagtggttcctgagaatatggtgggaaaccattag

SEQ ID NO: 16839 - protein, 460 aa, Chlamydophila pneumoniae, Chlamydia pneumoniae
MRQEKDSLGIVEVPEDKLYGAQTMRSRNFFSWGPELMPYEVIRALVWIKKCAAQANQDLGFLDSKHCDMIVAAADEILEGGFEEHFPLKVWQTGSGTQSNMNVNEVIANLAIRHHGGVLGSKDPIHPNDHVNKSQSSNDVFPTAMHIAAVISLKNKLIPALDHMIRVLDAKVEEFRHDVKIGRTHLMDAVPMTLGQEFSGYSSQLRHCLESIAFSLAHLYELAIGATAVGTGLNVPEGFVEKIIHYLRKETDEPFIPASNYFSALSCHDALVDAHGSLATLACALTKIATDLSFLGSGPRCGLGELFFPENEPGSSIMPGKVNPTQCEALQMVCAQVLGNNQTVIIGGSRGNFELNVMKPVIIYNFLQSVDLLSEGMRAFSEFFVKGLKVNKARLQDNINNSLMLVTALAPVLGYDKCSKAALKAFHESISLKEACLALGYLSEKEFDRLVVPENMVGNH

SEQ ID NO: 16840 - DNA, 1392 bp, Campylobacter jejuni
  CDS (1)..(1392)
atggaatacagagttgaacatgataccatgggtgaagttaaggttccaaatgacaaatattggggagctcaaactgaaagaagttttgaaaatttcaaaatcggttgtgagaaaatgccaaaggttttaatctatgcttttgcaaatcttaaaaaatctttagctttggtcaataacaaacttggcaaacttgatgatgctaagaaaaatgctatagttcaagcttgcgatgagattatcgcaggtaaatttgatgataattttccacttgcgatttggcaaacaggttcaggcacacaaagcaatatgaatatgaatgaagttattgcaaatcgtgccactgaaatcatgggcggggattttcgcaaagaaaagcttgtacatccaaatgatcatgttaatatgagtcaaagttcaaatgatacttttccaacagctatgagtatcgttgcggttgagcaagtagagaaaaagcttatccctgcgcttgatgagcttattgcaacttttgaaaaaaaagtaaaagaatttgatggtattatcaagataggacgcacgcatttacaagatgctactccacttactctagcgcaagaatttagtggatatctttctatgcttttacattcaaaagagcaaatcatcgcttctttaccaactttaagagaacttgccataggaggaaccgcagtgggaacagggcttaatgcacatccagaattaagccaaaaagtaagtgaagagctaactcaacttataggtacaaaatttatttcaagtccaaataaatttcatgctttaacaagtcatgatgcgattaattttactcatggagctatgaaaggtttggctgcaaatttaatgaaaattgcaaatgatataagatggttagcttcaggcccaagatgcggtcttggtgagcttatcatccctgaaaatgagccaggaagttcgattatgccaggtaaggtaaatcctacccagtgtgaagctgttactatggttgctgtacaagtgatgggaaatgatgtagctatcggatttgcagcaagtcaaggaaattttgaacttaatgtgtttaagcctgtgattatttataatttcttgcaaagtcttgatttgttggctgattctatgcattcattcaatatccattgtgctgtaggcatagaaccaaatcgtgcaaaaatcgatcataatcttcataattctttaatgctagttaccgctctaaatccacacataggttatgaaaacgctgctaaagtagccaaaaatgcccataaaaaaggtatttctttaaaagaaagcacaatggagcttggtttggttagcgaagaagatttcaataaatttgttgatcctactaaaatgataggcccaaaagcctag

SEQ ID NO: 16841 - protein, 463 aa, Campylobacter jejuni
MEYRVEHDTMGEVKVPNDKYWGAQTERSFENFKIGCEKMPKVLIYAFANLKKSLALVNNKLGKLDDAKKNAIVQACDEIIAGKFDDNFPLAIWQTGSGTQSNMNMNEVIANRATEIMGGDFRKEKLVHPNDHVNMSQSSNDTFPTAMSIVAVEQVEKKLIPALDELIATFEKKVKEFDGIIKIGRTHLQDATPLTLAQEFSGYLSMLLHSKEQIIASLPTLRELAIGGTAVGTGLNAHPELSQKVSEELTQLIGTKFISSPNKFHALTSHDAINFTHGAMKGLAANLMKIANDIRWLASGPRCGLGELIIPENEPGSSIMPGKVNPTQCEAVTMVAVQVMGNDVAIGFAASQGNFELNVFKPVIIYNFLQSLDLLADSMHSFNIHCAVGIEPNRAKIDHNLHNSLMLVTALNPHIGYENAAKVAKNAHKKGISLKESTMELGLVSEEDFNKFVDPTKMIGPKA

SEQ ID NO: 16842 - DNA, 1398 bp, Yersinia pestis
  CDS (1)..(1398)
atggcaactacccgcagtgaaaaggattctatggggtctatcgatgtacctgcaaaccaattatggggggcgcaaactcaacgttcattggcgcattttcgaatttcacaagaaaaaatgccaacagagctaattcatgcattggctctgaccaaacgagcggcagctcaagtgaatatggacctaggcttgctgccagccgagcgtgcaaaagcgattatgcgggccgcagatgaagttctggatggcgctcatccaaccgagttccctctcgccatctggcaaaccgggtcgggtactcagacgaatatgaatatgaatgaggtactggcaaaccgtgcgagtgagttgctcgggggggcgcgggggaataaccgtttggttcatcccaatgatgatgtcaataaaagccaaagttcaaatgatgtcttcccaacggcgatgcatgtcgctgcagtgatgggggtgagtgaacatcttcttcctgaactgaaggtgttacagaaaaccttggccgacaaagcagaagcttatcgcgatattgtaaaaattggccgtacacatttacaagatgcgacccctttaacgttggggcaggaaatttccgggtgggcggcaatgttatctcacagtgtgcggcatattgaggcgacccttcctcacctgtgtgaattagcgcttgggggaacagcggtggggactggcctcaatacgcatcctgaatatgctgtacgagtagctaatgaaatagccacactgacacgccaaccgtttatcactgccccgaataaatttgaatcattgggaacctgcgatgcattggttcatggtcacggtgcgctaaaaggcttagcggcatccctgatgaaaattgccaatgatgtccgttggttatcatcaggccctcgctgtggtattggcgaaatatctattccggaaaatgagccaggcagttctatcatgccaggcaaagtgaatccaacacagtgtgaagcgatgaccatgctatgtgctcaagttatgggtaatgatgtggctatcaatatcggtggggcgtccggcaactttgaattaaacgtgttccgtccattggtcatccataacttcctgcaatctgttcgtttgttggctgatggaatgcgtggttttaatgagcactgcgctttgggaattgaacccaaccgcgaccgtattacgcaattgctcaatgaatcgctgatgttagttaccgcgctcaatacccatattggctacgataaagcagctgaaatcgccaaaaaggcgcataaagaggggctaacactgaaagcagcagctatggcattgggttatcttaccgatgcagagtttgatgaatgggttcgaccggaagatatggtcggcagtatgaagaaatag

SEQ ID NO: 16843 - protein, 465 aa, Yersinia pestis
MATTRSEKDSMGSIDVPANQLWGAQTQRSLAHFRISQEKMPTELIHALALTKRAAAQVNMDLGLLPAERAKAIMRAADEVLDGAHPTEFPLAIWQTGSGTQTNMNMNEVLANRASELLGGARGNNRLVHPNDDVNKSQSSNDVFPTAMHVAAVMGVSEHLLPELKVLQKTLADKAEAYRDIVKIGRTHLQDATPLTLGQEISGWAAMLSHSVRHIEATLPHLCELALGGTAVGTGLNTHPEYAVRVANEIATLTRQPFITAPNKFESLGTCDALVHGHGALKGLAASLMKIANDVRWLSSGPRCGIGEISIPENEPGSSIMPGKVNPTQCEAMTMLCAQVMGNDVAINIGGASGNFELNVFRPLVIHNFLQSVRLLADGMRGFNEHCALGIEPNRDRITQLLNESLMLVTALNTHIGYDKAAEIAKKAHKEGLTLKAAAMALGYLTDAEFDEWVRPEDMVGSMKK

SEQ ID NO: 16844 - DNA, 1368 bp, Listeria monocytogenes
  CDS (1)..(1368)
atggaacgaatagagcgagatacgcttggagaaatttctgtagatgcgacgaaatattggggagcgcaaacagaacgaagtaaaaggaattttgctattggtgataatcctatgccgatagaaattatatatgcttttgctcagttaaagaaagccactgcaaaagtgaacgcagcagaaggaaaactagccgaagaaaaagcgatagcgattggccaggtttgtgatcaaatcattcaaggagaactagatgagcattttcctttagtcgtttggcaaacaggaagcggaacgcagagcaacatgaatgtcaatgaagttatcgcacacgttgccaacttaactttaggcgaaggacaaattcatccaaatgatgatgttaacatgtcacaaagctcgaacgacacatttccaacagcgatgcacattgccgcatacggggctttagtaacaaaacttttaccagaaataactaaaatggaagctgttttgacagagaagaaaaataaatatatgcatctcgttaaaattggtagaacgcatttacaagatgcaactcctttaacacttggtcaagaaattagtggctgggaagcatgtcttacaaataataaaaactatcttgaaacaagtatgaaagcaattttgccacttgcaattggcgggactgcagttggaacgggcttaaatgcctcacgtgattttggtgataaggttgccgaagaattgatgaaacaaacgggatatccttttacttctgattccaataagtattttgctttaactagtcatagtccgattaattttgttcatggcgccattcgtagccttgcttcggatctaatgaaaattgctaatgatatccgtttattagcaagtggaccacgtagcggcataggtgagctagagataccagctaatgaaccaggaagctctattatgcccgggaaagtaaaccctacccaatgtgaagcaattacgatggtagcggctcaagtcatgggaaatgatgtgacaattaatgttgccgcaagccaagggaactttgagttaaatgtctacaagccggttatcatttttaatttcctagaatctatcaaacttcttgcagatagcatgcgttcgttccgagtgcattgtttggaaggacttactgcgaatgaaaaagttattgaaacaaaagtaaatgactccctaatgcttgttacagcattgaatccgcatatcggctatgaaaaagctgctaaaattgccaaactggcttttgatgaaaatacgacattaaaagaagcggcaatcaaaaccggctttgtgacagaaaaagaatttgatttgtggataaatccattgaaaatgactaatttgtaa

SEQ ID NO: 16845 - protein, 455 aa, Listeria monocytogenes
MERIERDTLGEISVDATKYWGAQTERSKRNFAIGDNPMPIEIIYAFAQLKKATAKVNAAEGKLAEEKAIAIGQVCDQIIQGELDEHFPLVVWQTGSGTQSNMNVNEVIAHVANLTLGEGQIHPNDDVNMSQSSNDTFPTAMHIAAYGALVTKLLPEITKMEAVLTEKKNKYMHLVKIGRTHLQDATPLTLGQEISGWEACLTNNKNYLETSMKAILPLAIGGTAVGTGLNASRDFGDKVAEELMKQTGYPFTSDSNKYFALTSHSPINFVHGAIRSLASDLMKIANDIRLLASGPRSGIGELEIPANEPGSSIMPGKVNPTQCEAITMVAAQVMGNDVTINVAASQGNFELNVYKPVIIFNFLESIKLLADSMRSFRVHCLEGLTANEKVIETKVNDSLMLVTALNPHIGYEKAAKIAKLAFDENTTLKEAAIKTGFVTEKEFDLWINPLKMTNL

SEQ ID NO: 16846 - DNA, 1395 bp, Deinococcus radiodurans
  CDS (1)..(1395)
atgaccaaaacccgccaagaaaccgacacgatgggcaagatggacgtggacgccagccgctactggggcgcacagaccgagcgcagcatccacaacttcccgattgggcgcgacaccttcgtgtggggccgccccgtcatccgggcgctgggcatcctgaaaaagggcgcggcgcaggccaacgccgaactcggtgaactgcccgccgacgtggccgacctcatcgtgaaggccgccgacgaagtgattgccggcaaactcgacgaacactttccgctggtagtgttccagaccggctcgggcacccagagcaacatgaacgccaacgaggtgatttccaaccgcgccatcgaactcgccggcggcgaaatgggcagcaagaagccggtccaccccaacgaccacgtgaaccgcggccagagctccaacgacaccttccccactgccatgcacatcgcggtggtgctggaactcaacgagcggctgtacggcgcggtcggcaagctgcgcgacaccctgcacgccaaggccgagcagtacaaggacctcgtgaaagtgggccgcacccacctgcaagacgccacgcccatcacgctggggcaggaaatcggcggctgggtggcgcaactcgactacgcgctgtccgaagtcaagcacgcgggcgaaggcctgctcgacctcgccatcggcggcaccgccgtgggcaccggcctgaacgcgcaccccaaattcggtgatctggccgccaagaagtacgaagaagaaaccggctaccacttccgcagcgccgagaacaagttcgccgccctgagcgcccacgacgcgctggtgcagacctcggcggccctgcgtaccctggccggcgccctgatgaagatggcgaacgacgtgcgctggctggcgagcggcccgcgcaacggcatcggcgaaatcaccattcccgagaacgagcccggctccagcatcatgcccggcaaggtgaaccccacccagagtgaggccatgacgatggtcgccacccgcgtgttcggcaacgacgccaccgtcgcttttgccggcagccagggcaacttccagctgaacgtgttcaagccagtgatggttcacgccgtgctggaaagcattcgcctgatttccgacgcctgcctggccttcaacgaccactgcgcggtgggcatccagcccaacgaggccaagatcaaggaaaacctcgacaagaacctgatgcaggtgaccgccctcaatcgccacatcggctacgacaaggctgccgcgattgccaagaaggcccacaaggaaggcaccagcctcaaggacgccgcgctggccctgggctacgtgaccgaggacgaattcgcccagtgggtcgtgccgctgggcatgactcacaactga

SEQ ID NO: 16847 - protein, 464 aa, Deinococcus radiodurans
MTKTRQETDTMGKMDVDASRYWGAQTERSIHNFPIGRDTFVWGRPVIRALGILKKGAAQANAELGELPADVADLIVKAADEVIAGKLDEHFPLVVFQTGSGTQSNMNANEVISNRAIELAGGEMGSKKPVHPNDHVNRGQSSNDTFPTAMHIAVVLELNERLYGAVGKLRDTLHAKAEQYKDLVKVGRTHLQDATPITLGQEIGGWVAQLDYALSEVKHAGEGLLDLAIGGTAVGTGLNAHPKFGDLAAKKYEEETGYHFRSAENKFAALSAHDALVQTSAALRTLAGALMKMANDVRWLASGPRNGIGEITIPENEPGSSIMPGKVNPTQSEAMTMVATRVFGNDATVAFAGSQGNFQLNVFKPVMVHAVLESIRLISDACLAFNDHCAVGIQPNEAKIKENLDKNLMQVTALNRHIGYDKAAAIAKKAHKEGTSLKDAALALGYVTEDEFAQWVVPLGMTHN

SEQ ID NO: 16848 - DNA, 1389 bp, Neisseria meningitidis
  CDS (1)..(1389)
atgagcacccgtaccgaacacgacacgatgggcaatgtcgaagtcccatccgaagcctattggggcgcgcagacccagcgcagccgcaacaatttcaaaatcggtggcgaaaccctgccgcagccgttgatttatgctttggcattggtgaaaaaagccgccgctgccaccaatgtttccctcggtaggattaagcctgaacaggcggatttgattacgcaggcggcggatgatgtgttgagcggcaagctcgacgggcagttcccattggtagtgtggcagaccggttccggcacgcagtccaatatgaacatgaacgaagtgctggcaaaccgcgccaacgaaatcgccggtacgggtttggcggcttatcagcccgtccatcccaacgaccatgtgaaccacgcgcaatcgaccaacgacgcattcccgaccgctatccacgttgccgccgcgattgaaatcaaccgccacctcatccccgccgtaaaagccctgcgcgacacgttggacaaaaaagcccaagctttcgcccctatcgtcaaaatcggccgcacccacttgcaagacgcgacgccgctgactttgggacaggaattttccggctacgtttcccagcttgatcacggtttaggccgtctgaacgatgcgcttaaagacttgtatgaacttgctttgggcggtacggcggtcggcacgggtttgaacagccatcccgaatacgccgaaaaagccgccgccaaactcgccgaattgtccggcttgccgtttgtcagcgcgccgaacaaatttgaagccctgggcggacgcgatgccgccgttgccgcttcgggcgcattgaaaacgctggcggcaagcctgaacaaaattgccaacgacatccgttggctggcaagcggcccgcgttgcggtttgggcgaaatcaaaatccccgaaaacgagccgggttcgtccattatgccgggcaaagtcaacccgacccaatgcgaagcaatgacgatggtgtgctgccaagtgttcggcaacgacgttaccatcggtatggcgggcgcgtcgggcaatttcgagctgaacgtctatatgcccgttatcgcctacaacctcttgcaatccatccacctgttgggcgacgcgtgcaacagcttcaacgaacactgcgccatcggcatcgaacccgtgccggaaaaaatcgactatttcctgcaccattccctgatgctggttaccgcattaaaccgtaaaatcggttacgaaaacgccgccaaagtcgccaaaaccgcctacaaaaacaacaaatcgttgcgcgaaaccgccgttgagttgggcttgctgacgggcgaagaatttgacgaactggtcgttcctgccgatatggttcatccgcgctaa

SEQ ID NO: 16849 - protein, 462 aa, Neisseria meningitidis
MSTRTEHDTMGNVEVPSEAYWGAQTQRSRNNFKIGGETLPQPLIYALALVKKAAAATNVSLGRIKPEQADLITQAADDVLSGKLDGQFPLVVWQTGSGTQSNMNMNEVLANRANEIAGTGLAAYQPVHPNDHVNHAQSTNDAFPTAIHVAAAIEINRHLIPAVKALRDTLDKKAQAFAPIVKIGRTHLQDATPLTLGQEFSGYVSQLDHGLGRLNDALKDLYELALGGTAVGTGLNSHPEYAEKAAAKLAELSGLPFVSAPNKFEALGGRDAAVAASGALKTLAASLNKIANDIRWLASGPRCGLGEIKIPENEPGSSIMPGKVNPTQCEAMTMVCCQVFGNDVTIGMAGASGNFELNVYMPVIAYNLLQSIHLLGDACNSFNEHCAIGIEPVPEKIDYFLHHSLMLVTALNRKIGYENAAKVAKTAYKNNKSLRETAVELGLLTGEEFDELVVPADMVHPR

SEQ ID NO: 16850 - DNA, 1506 bp, Caenorhabditis elegans
  CDS (1)..(1506)
atgtctgcagtctctatgttacagggagaaatgcttgctcgtggaggcgccgtcattgcccgcggagcgtctcttgccactgcccgcaatttttcgcgcaccactgttccaatggctaagattcgtaaggaacgagatactttcggagagctcgaggttccagccgacaaatactatggagcccagaccgcccgttcccagatgaacttcaagattggaggaccagaagagcgtatgccaatcccagttatccacgctttcggaatcttgaagaaggccgccgcccttgtcaacaccgagttcggattagacaaaaaactggctgacgcgatttcccaagctgctgatgaggttgttgacggcaagctcgacgagcacttcccacttgttacatggcagactggttcaggaactcagtccaacatgaatgtcaatgaggttatctcgaatcgtgctatcgagatcctcggaggagagctcggatcgaagaagccagttcatccaaatgatcatgtgaatatgtcccaatcatcaaatgacacattcccaactgctatgcacattgccgtcggacgtgaagtcaactctcgtcttcttccagctctcaagaagcttcgcactgcccttcacaacaaggctgaagagttcaaagatatcatcaagattggacgtactcacacccaagatgctgttccactcactcttggacaagagttctcagcttacgtcacacagcttgataactctattgctcgtgttgaatcgactcttccacgactttatcaattggctgccggtggaaccgctgttggaactggactcaacacgcgcaagggattcgctgagaaggttgccgccactgtttctgaacttaccggattgccattcgttaccgctccaaacaaatttgaagccctcgccgcccatgatgctctcgttgaggttcacggagccctgaacacagtcgcagtttccttcatgaagattggaaacgatatcagatttttgggatctggaccaagatgcggactcggagagttatcactcccagaaaacgaaccaggaagctccatcatgccaggaaaggtcaacccaactcaatgtgaagccatcacaatggttgccgctcaagttatgggaaatcaagttgcagtcagtgtaggaggatctaatggacatttcgagttgaatgttttcaagccacttatcgttcgtaatgttcttcaatcaacacgtcttcttgctgacagcgctgtgagcttcactgatcattgtgtcgacggaatcgttgctaacaaagacaatattgccaagattatgcgtgaatcacttatgcttgtcactgctctcaacccacacattggctacgacaacgccgccaagattgctaagactgctcacaagaacggcaccacccttgtccaggaagccgtgaagctgggaatccttaccgaggagcagttcgctcaatgggtcaagccagaaaacatgctcggacctaagtaa

SEQ ID NO: 16851 - protein, 501 aa, Caenorhabditis elegans
MSAVSMLQGEMLARGGAVIARGASLATARNFSRTTVPMAKIRKERDTFGELEVPADKYYGAQTARSQMNFKIGGPEERMPIPVIHAFGILKKAAALVNTEFGLDKKLADAISQAADEVVDGKLDEHFPLVTWQTGSGTQSNMNVNEVISNRAIEILGGELGSKKPVHPNDHVNMSQSSNDTFPTAMHIAVGREVNSRLLPALKKLRTALHNKAEEFKDIIKIGRTHTQDAVPLTLGQEFSAYVTQLDNSIARVESTLPRLYQLAAGGTAVGTGLNTRKGFAEKVAATVSELTGLPFVTAPNKFEALAAHDALVEVHGALNTVAVSFMKIGNDIRFLGSGPRCGLGELSLPENEPGSSIMPGKVNPTQCEAITMVAAQVMGNQVAVSVGGSNGHFELNVFKPLIVRNVLQSTRLLADSAVSFTDHCVDGIVANKDNIAKIMRESLMLVTALNPHIGYDNAAKIAKTAHKNGTTLVQEAVKLGILTEEQFAQWVKPENMLGPK

SEQ ID NO: 16852 - DNA, 1413 bp, Halobacterium sp. NRC-1
  CDS (1)..(1413)
atgagcgaggattaccgcacggagcaggacagcctcggcgagatgcaggttcccgctgacgcctactggggggcacagacccagcgcgcgatcgagaacttcccgatctcggggatcgcgttcgggcggcggttcgtgcgcgcgctcggcgtcgtcaagaaggccgccgcgcaggcgaaccgcgacctcggcctcgttgacgacgagcgcgccgacgccatcgtcgcggccgccgacgaggtcatcgccggcgagcacgacgaccagttcccggtcgacgtcttccagaccgggtccgggacgtcctcgaacatgaacgccaacgaggtcatcgcgaaccgcgccgcggagctcctcggcgaggagatcggggatcgcgtcgtgcaccccaacgaccacgtgaactatggccagtccagcaacgacgtgatcccgaccgcgatgcacgtggcgagcctcgacgcgctcgtcaacgacgtcaaacccggcctggagacgctggcagcggaactcgacgacaaagcggacgcgttcgacggcgtcgtgaagaccgggcgcacgcacttgcaggacgccacgccggtgcggttgggccaggagttcggcggctaccgcacccaagtcgagaagggcatcgaccgcatcgaggccgttgccccgcgcctctcggagctcgcgctcggcggcaccgccgtcggcaccgggctgaacacccaccccgagttcccggagacggcggccggctacatcagcgaggagaccggcgttacgttccgtgaggcggacaaccacttcgaggcgcaggccgcccacgacgccatgaacgaggcccacggcgcgctgcgcacggtcgcggggtcgctgaacaagatcgccaacgacctccggctgcttgcctccggcccccgcaacgggctgggggagatcgagcagcccgagaaccagcccggctcctcgatcatgcccgggaagatcaaccccgtggtggcggaggcggtcaaccaggtccacaagcaggtcgtgggcaacgacgccgccatcgccgcgggggccgcggaggggcagatcgacttgaacctctacaagcccgtgctggcgcacaacttcctgcagtccgcggacatgctcgccaacgcgagcgctgccttcggcgagaagttcgtcgccaagctcgaagccaacgaggccgcctgcgaggcgcaggtcgagcgctcgatggcgctggcgaccgcgctcaaccccacgatcggctacgacaaggccagcgaggtcgcgaaggccgcgctgaaggaggggaaaacagtcacggaggtcgtcgtcgagaagggatacctctcggaggcggaggccgctgacgtgctcgaccccgaggggatgacccaccggggcatcctctccggcgacgacacgtag

SEQ ID NO: 16853 - protein, 470 aa, Halobacterium sp. NRC-1
MSEDYRTEQDSLGEMQVPADAYWGAQTQRAIENFPISGIAFGRRFVRALGVVKKAAAQANRDLGLVDDERADAIVAAADEVIAGEHDDQFPVDVFQTGSGTSSNMNANEVIANRAAELLGEEIGDRVVHPNDHVNYGQSSNDVIPTAMHVASLDALVNDVKPGLETLAAELDDKADAFDGVVKTGRTHLQDATPVRLGQEFGGYRTQVEKGIDRIEAVAPRLSELALGGTAVGTGLNTHPEFPETAAGYISEETGVTFREADNHFEAQAAHDAMNEAHGALRTVAGSLNKIANDLRLLASGPRNGLGEIEQPENQPGSSIMPGKINPVVAEAVNQVHKQVVGNDAAIAAGAAEGQIDLNLYKPVLAHNFLQSADMLANASAAFGEKFVAKLEANEAACEAQVERSMALATALNPTIGYDKASEVAKAALKEGKTVTEVVVEKGYLSEAEAADVLDPEGMTHRGILSGDDT

SEQ ID NO: 16854 - DNA, 1392 bp, Caulobacter crescentus
  CDS (1)..(1392)
atgaccgccacgcgtatcgagaccgacacctttggcccgatcgaagtcgccgccgaccgctactggggcgcgcaagctcagcgcagcctgggcaacttcaagatcggctgggaaaagcagcccctgcccgtcgtccgcgccctgggcatcgtcaagcgcgccgccgccgaggccaacctcgccttgggcaagctggacccgaagatcgccgagacgatcatcgccgccgccaacgaagtgatcgagggcaagctgaacgaccacttcccgctggtggtctggcagaccggctcgggcacccagtcgaacatgaacgccaacgaggtgatctcgaaccgcgccatcgagatgctgggcggtgagatgggcagcaagaagcccgtccaccccaacgaccacgtcaatatgagccagtcgtcgaacgacaccttcccgacggccatgcacatcgcctgcgccgaacaggtggtccacgacctgctgcccgcgctgaagcacctgcacaaggccctggccgccaaggccgccgagtggaaggacatcatcaagatcggccgcacccacacccaggacgccaccccgctgacgctgggccaggagttcggcggctacgctcagcagatcgagaacggcatcgctcgtatcgagatgaccctgccgatgctgatgcaactggcccagggcggcaccgccgtcggcaccggcctgaacgcccccgtgggcttcgccgagctggtcgccgagcagatcgccggcatcacgggcctaggcttcaccacggccccgaacaagttcgaggccctggccgcccacgacgccatggtcttcacccacggcgccatcaacacggtggccgccagcctgttcaagatcgccaacgacatccgcttcctgggctctggcccgcgcgccggtctcggcgagctttccctgccggaaaatgagccgggcagctcgatcatgccgggcaaggtcaatccgacccagtccgaagccctgacccaggtctgcgcccaggtgttcggcaaccactcgaccctgaccttcgccggcagccagggccatttcgagctgaacgtcttcaacccggtgatggcctataacttcctgcagtcggtccgtctggtcgccgacgcggcgatcagcttcaccgacaactgcgtggtcggcatcgagccgcgtgtcgacaacatcaagaagggcgtcgagaacagcctgatgctggtcacggccctgaacggcaagctcggctacgacgcctgcgccaagatcgccaagaccgcgcacaagaacggcaccaccctgcgcgaggaggccgtcggcggcggctatctgacgaacgaagagttcgaacagtacgtccgccccgaaaagatgatctcgccgggctga

SEQ ID NO: 16855 - protein, 463 aa, Caulobacter crescentus
MTATRIETDTFGPIEVAADRYWGAQAQRSLGNFKIGWEKQPLPVVRALGIVKRAAAEANLALGKLDPKIAETIIAAANEVIEGKLNDHFPLVVWQTGSGTQSNMNANEVISNRAIEMLGGEMGSKKPVHPNDHVNMSQSSNDTFPTAMHIACAEQVVHDLLPALKHLHKALAAKAAEWKDIIKIGRTHTQDATPLTLGQEFGGYAQQIENGIARIEMTLPMLMQLAQGGTAVGTGLNAPVGFAELVAEQIAGITGLGFTTAPNKFEALAAHDAMVFTHGAINTVAASLFKIANDIRFLGSGPRAGLGELSLPENEPGSSIMPGKVNPTQSEALTQVCAQVFGNHSTLTFAGSQGHFELNVFNPVMAYNFLQSVRLVADAAISFTDNCVVGIEPRVDNIKKGVENSLMLVTALNGKLGYDACAKIAKTAHKNGTTLREEAVGGGYLTNEEFEQYVRPEKMISPG

SEQ ID NO: 16856 - DNA, 1392 bp, Rickettsia conorii
  CDS (1)..(1392)
atgaaaaattacagaaccgaaagtgattcttttggagaaattcaaatagaagaaaaattttattggggggctcaaactcaaagatctttagaaaattttaaaataggcaagcaaaaaatgcctgaaattttaattcgtgctcttgctattttaaaaaaatgtgcagcacaggttaatcatgagtttggtgatttagaagctaaaatcgctataagtatagataaagcaacggatagaatcttagaaggcgaatttgaggataattttcctttagtagtttggcaaacaggttcaggaacgcaaacaaacatgaatatgaacgaggttattgcctctattgccaacgaagaattaacaggcaagaaaggcggcaaatctccggtacatcctaacgatcatgttaataaaggacaatcatccaacgactcttttccaaccgctatgcatatagcaaccgtacttgcaactaaacagcaactgataccagctttgaataatatactgacctctttgcaggataagtcaaaagattgggacaaaatcataaaaataggacgtacccacttgcaggatgcaactcctttaactcttaaacaggaattctccggatatattacacaaatagagtatgctttagaacgcatagaaaatgcactacaaaaagtttatctacttgcccaaggaggcacagcagtcggtacaggtattaactcaaaaataggctttgatataaaatttgccgagaaagtggcagagtttactaaacaaccctttaagacggctcctaataaatttgaaagtctagctgctcacgacgcactagtagaattttcaggaactcttaatactatagcagttagcttaatgaaaatagcaaatgatataagactgctcggctccggtccaagatgcggtcttggtgagctacatttacctgaaaatgaacctggttcttctattatgcccggtaaagtaaaccctacacaagtcgaagctttaacaatggtgtgcagtcaggtgatggggaatcatgttacggttactattgccggctcaaacggacatcttgaacttaacgtatttaaacccgtaataatatacaatatcctacaatctatagagctgttatccgatagcgtaaatagctttgttactcactgtgttaaaggattagaacccaatatagcacgcattaatgatttacgtgataaatctctaatgcttgttacagctcttaatccacatataggctatgataatgctgcaaaaattgctaaagaagcacataagcacggaatcactttaaaagaagcagctaaaaaactcaatcttctatcggaagcaaaatttgataaaatagtagtacctgaaaaaatggttagtcaatcttag

SEQ ID NO: 16857 - protein, 463 aa, Rickettsia conorii
MKNYRTESDSFGEIQIEEKFYWGAQTQRSLENFKIGKQKMPEILIRALAILKKCAAQVNHEFGDLEAKIAISIDKATDRILEGEFEDNFPLVVWQTGSGTQTNMNMNEVIASIANEELTGKKGGKSPVHPNDHVNKGQSSNDSFPTAMHIATVLATKQQLIPALNNILTSLQDKSKDWDKIIKIGRTHLQDATPLTLKQEFSGYITQIEYALERIENALQKVYLLAQGGTAVGTGINSKIGFDIKFAEKVAEFTKQPFKTAPNKFESLAAHDALVEFSGTLNTIAVSLMKIANDIRLLGSGPRCGLGELHLPENEPGSSIMPGKVNPTQVEALTMVCSQVMGNHVTVTIAGSNGHLELNVFKPVIIYNILQSIELLSDSVNSFVTHCVKGLEPNIARINDLRDKSLMLVTALNPHIGYDNAAKIAKEAHKHGITLKEAAKKLNLLSEAKFDKIVVPEKMVSQS

SEQ ID NO: 16858 - DNA, 1422 bp, Xylella fastidiosa
  CDS (1)..(1422)
atggagatgcagatgagcaacagtgatcgttacagaattgaacacgacagtatgggtgatctacgggtgccgatcgatgcgttgtggggtgcgcagacgcaacgtgctatcgagaactttccgatttccgggcggtcaatgcctcagggatttatccacgcattggggtttatcaaggcggctgcggcgaaggttaacgctgagctggggttgttaccaaagccaatggccaaggagattgaggccgctgcattggatgtcgctgcgggccgttatgatgcggattttccagtcgatatttaccagactggctcaggaacctcgtcgaatatgaacgctaatgaggtgattgcgacgctggccatgcgtgccaccaaggagcctatccaccccaacgaccatgtcaaccttggccaaagttctaatgatgtggttccaacagcgattcggatttccgcaacgttggcggttcagggacgattattaccggcgctcaagcatttacggaaaatgattaacaagcgtgcccgtggtttgggcagtgtggtgaagaccggccgtacccacctgatggatgcgatgccgctgacgttcgctcaagaattcggtgcctggtcggcacaaattgtctctgcggaggcgcgcttgaatgacaccctgaaacggttgcatcggctgccattgggagggacagcaattggtaccggtatcaatacggatccacatttcggccgcaatgcggtgaaggtactgtcagcattaacagggattcactttgagagtgcgaacaataagttcgagggattggcagcgcaagatgatttggttgagttatccggccagttcaatgcgttagcagtggcgttgatgaagattgctaatgatctacgctggatgaacgctggaccacttgctggcttgggagagattgagttgcccgcgttgcagccgggaagttcgatcatgccaggtaaggtaaatccggtgattccggaagctgtggtgatggtcgcctcgcaagtgattggccatcacactgcagtgaccgtggctgggcagagtggcaattttcagttgaatgtgacgttaccgctgattgcttacaacctattggagtctgcgacgttgcttggaaatgtggtgatgctgttggctgataaagtcatcgttggtctgaaggtgcgtcaggatcgagtgcaggaggtgctggagcggaatccgattttggtgacagcgttgaatccgatcattggctatgagaaagctgcggtgattgctaagcgtgcttataaggagcaccggccagtgcttgaggtcgcctgcgaggagagcaacctaaaccctgtggagttggcgcgcttactggatccgactgcgttgactgagggtgggatttatgtcgtcgggggaggtggtggataa

SEQ ID NO: 16859 - protein, 473 aa, Xylella fastidiosa
MEMQMSNSDRYRIEHDSMGDLRVPIDALWGAQTQRAIENFPISGRSMPQGFIHALGFIKAAAAKVNAELGLLPKPMAKEIEAAALDVAAGRYDADFPVDIYQTGSGTSSNMNANEVIATLAMRATKEPIHPNDHVNLGQSSNDVVPTAIRISATLAVQGRLLPALKHLRKMINKRARGLGSVVKTGRTHLMDAMPLTFAQEFGAWSAQIVSAEARLNDTLKRLHRLPLGGTAIGTGINTDPHFGRNAVKVLSALTGIHFESANNKFEGLAAQDDLVELSGQFNALAVALMKIANDLRWMNAGPLAGLGEIELPALQPGSSIMPGKVNPVIPEAVVMVASQVIGHHTAVTVAGQSGNFQLNVTLPLIAYNLLESATLLGNVVMLLADKVIVGLKVRQDRVQEVLERNPILVTALNPIIGYEKAAVIAKRAYKEHRPVLEVACEESNLNPVELARLLDPTALTEGGIYVVGGGGG

SEQ ID NO: 16860 - DNA, 1389 bp, Bacillus halodurans
  CDS (1)..(1389)
atgaacacacgaattgagcgagatacgctaggagaaatgcacgttccacaagacaaattatggggggcacaaacgcagcgaagctatgagaatttccatattgggacagaaaaaatgccgatggaaattatttatgcctttgccttgctaaaaaaagcagcagcaaacgtcaacaaaaagcttggacaactgtctgccgaaaaagcagatgccattacctgggctgcaaatgaagtgctagctggcaaacacgatgatcatttcccgcttttcgtttggcaaaccggtagcggcacgcagtcgaacatgaacatgaatgaagtccttgcccgcaggggaaaccagcttctgcaagaaaaagggctagatgttacaattcacccgaacgatgacgtgaaccgatcgcaaagctccaacgacacatttcctaccgccatgcatattgcggcttataataaactggacgatcacttactgcctacactccaaatgttcaaacaaacactccaccaaaaagcaaagcaatttgatgatgtgattaaattaggacgaacacacttacaggatgcgacccccttaaccctcggccaagaaattagtggctgggctcggatgctcgaaaagaccgagcaaatgatccgtgagagcatgatttatttgcaggaattagctatcggtggtacggctgtcggtacaggggttaacgcccatcccaagttcggagaaatggtggccgccgatatcgcaaatgaaaccgggaaacctttcaaatcagccgctaataaatttcacgcgctcacaagtcatgacgaactagtacacactcacggcgccctaaaagcgcttgctgccgatttgtttaaaattgcgaatgatattcgttggcttgcaagtgggcctaggggcggactaggagaactgatcattcctgctaatgagccgggaagctcaattatgccaggaaaggtcaatccaacacagagcgaggcattaacaatgatcacgtcgcaagtaatcggaaatgatgccacgatcgcttttgctgcaagtcaagggaactttgaactgaacgtatttaagccggtcattatttacaatttccttcagtccacaacgctgttaactgatggactccggacgttccatgacaaatgcttaatcggccttgaggcaaacgaaacgatcattaaaaagcatttaaatgagtcactcatgctcgtgacagcactcaaccctcacatcggttatgagaacgcagcaaaaattgcgaaaaaagcacatgccgaaggcttaactcttaaagaagccgcgatgcaaagcggcttgctaaccgaagaggagtttgaaaaaatggtcgatccggcaaaaatggttcacccacaaggctaa

SEQ ID NO: 16861 - protein, 462 aa, Bacillus halodurans
MNTRIERDTLGEMHVPQDKLWGAQTQRSYENFHIGTEKMPMEIIYAFALLKKAAANVNKKLGQLSAEKADAITWAANEVLAGKHDDHFPLFVWQTGSGTQSNMNMNEVLARRGNQLLQEKGLDVTIHPNDDVNRSQSSNDTFPTAMHIAAYNKLDDHLLPTLQMFKQTLHQKAKQFDDVIKLGRTHLQDATPLTLGQEISGWARMLEKTEQMIRESMIYLQELAIGGTAVGTGVNAHPKFGEMVAADIANETGKPFKSAANKFHALTSHDELVHTHGALKALAADLFKIANDIRWLASGPRGGLGELIIPANEPGSSIMPGKVNPTQSEALTMITSQVIGNDATIAFAASQGNFELNVFKPVIIYNFLQSTTLLTDGLRTFHDKCLIGLEANETIIKKHLNESLMLVTALNPHIGYENAAKIAKKAHAEGLTLKEAAMQSGLLTEEEFEKMVDPAKMVHPQG

SEQ ID NO: 16862 - DNA, 1386 bp, Vibrio cholerae
  CDS (1)..(1386)
atgactcgcgaataccgaattgaaaaagacagcatgggtgaggtcaaagtccctgctgatgcgctttatcaagcacaaactcaacgtgccgtagataactttacgttaagccgctacaccatgcctagcgcgtttattgctgccctcgcctacattaaacaagcggcggcgatgaccaatgcgcagttaggtcatttagaaggggacatcgcccaagcgattgccaatgcatcgcaagcggtgattgatggccagtatgcaaaacagttcccgattgatgttttccagacaggttcaggcaccagctccaatatgaacgccaatgaggtgattgccaccctcgcctcgcgtgaattgggctatgcggtgagtccaaacgatcatgtcaacatgggacaaagcagtaatgatgtgatcccaacagcaatccaagtcagtgcggccatcaatattgagcagcaactgctccccgccttggcgcatttaagtcaaactctcgcggataaacagtcagagctggctgatgtggtcaaaactggccgcacccatttgatggatgcgatgcccgtgactttcgcacaagaactgggtggatggaaaagccaaatcgaccacgccgcgcaaggcatcagccatgcgctttcccccatcaaagccttggcgcaaggcggcacagcggtcggcacaggcattaatgcggatccgcgttttgcacgtatttttgccgataacctcagtcaattgagtcatgttgcttttcagcccagcgacaattttttctataacctaagcagccaagactgcgtggtcggcctttctggtcagttgaaaaccgccgcggtcgcgctgatgaaaatcgctaacgatttgcgctggatgaactctggccctttggcggggttaggggaaattgagctgcaaggcttacaaccgggctcctcgatcatgccgggaaaagttaaccctgtgatcccggaagccgtgactatggtcgctgcgcaagtgattggcaatgacactaccattaccgtggctggccaatccggtaatttccagcttaatgtgatgctgcctgtgatcgcgcacaacctactggaatcaatagaattattgacaaatgcctgccatgcgctcgccgataaagccatcgcaacctttaaagttcgtcatgacaatctggaaaaagccttggctaaaaacccgattctcgtcaccgccttgaatcctgtcattggttatctcaaagcggctgatattgccaaaaaagcctaccagcaaggtcgcgcgattttggatgtcgctgcggaagagacggaccttgatcgcgccacgcttgaagcgctgcttgacccgaaaaagctcacacaaggtgggattgcccattaa

SEQ ID NO: 16863 - protein, 461 aa, Vibrio cholerae
MTREYRIEKDSMGEVKVPADALYQAQTQRAVDNFTLSRYTMPSAFIAALAYIKQAAAMTNAQLGHLEGDIAQAIANASQAVIDGQYAKQFPIDVFQTGSGTSSNMNANEVIATLASRELGYAVSPNDHVNMGQSSNDVIPTAIQVSAAINIEQQLLPALAHLSQTLADKQSELADVVKTGRTHLMDAMPVTFAQELGGWKSQIDHAAQGISHALSPIKALAQGGTAVGTGINADPRFARIFADNLSQLSHVAFQPSDNFFYNLSSQDCVVGLSGQLKTAAVALMKIANDLRWMNSGPLAGLGEIELQGLQPGSSIMPGKVNPVIPEAVTMVAAQVIGNDTTITVAGQSGNFQLNVMLPVIAHNLLESIELLTNACHALADKAIATFKVRHDNLEKALAKNPILVTALNPVIGYLKAADIAKKAYQQGRAILDVAAEETDLDRATLEALLDPKKLTQGGIAH

SEQ ID NO: 16864 - DNA, 1809 bp, Pseudomonas aeruginosa
  CDS (433)..(1809)
gaagaaaacaataatcaatctcattatcgtctggtgaggttgccatgtccttcgaggcgcacgacccgcaagcattggatcactggtactggctgggcacgcagatccgctgcgcgctcgatcccgacgaaccgcgcctgctcgaccagtacctcggcgaggcgcgctatctcgccggttgggaaggtgtggccgcctggccgctgttcgagaaagcctacaacctcctgctcgataccggtcgcgatccgatattgccctggcactggcgcagcctctgcctcgactacgcctaccggcccctctgcgaacttcagcgactgaccaccaacggcagccagcgacgccggctgcgccagctctccgtacgaatggccaggcaggacctggcgccgtcgatgagcttcgatcacccgcaacaaggaaaccaagatgactgacacccgcatcgaacgcgacagcatgggcgaactggcggtcccggcgaccgccctctatggcgcccagacccagcgcgcggtgaacaacttcccggtcagcggccaacgcatgccccaggccttcgtccgcgccctgctgctggccaaggccgcggcggcgcgggcgaacgtctccctgcagcaactggatgcaccgatgggcgaggcgatcgccgacacctgcctgcaactgctgcaggaggacttcatgcagcatttcccggtggatgtgttccagaccggctccggcaccagttccaacatgaacgccaacgaagtggtggcgaccctggccagtcgtcgcctgggcggcaaggtcaatccgaacgaccatgtgaactgcgggcagagcagcaacgacatcattccctcgaccatccacatcagtgccgccctcgagatcagcgaacgcctgctgccggcgctgcgccacctggagcagactatccagagcaaggccggcgaagtgcatgcctatgtgaagaccggccgcacccacctgatggatgcgatgccggtacgcatgagccaggtgctcggtggctgggcgcagcaggtgcgacaggccggcgtgcacatcgagagcgtacttcctgccttgcagcagttggcacagggcggcaccgcggtgggcaccgggatcaacgcccatcctcggttcgccgaacgtttcagccaggagctgaacgacctgaccgggctggcgttccgccccggcgacgacttcttcgccctgatcggttcgcaggacaccgcggtcgctgcgtccggccagttgaagaccctggcggtgaccctgatgaagctggccaacgacctgcgctggatgaactccgggccgcttgccgggctcggcgagatcgagctggaagcgctgcaaccaggctcctcgatcatgcccggcaaggtcaacccggtgatcccggaggccaccgcgatggtcgccgcccaggtgatcggcaatgacgctgccattgccgtcgccggccaatcgggcaacttcgaactgaacgtgatgctgccgctggtggcggacaacctgttgcacagcatccagttgctggccaacgtcagccggctgctggcggacaaggccatcgccagcttcaaggtcaaccagggcaagctcagcgaggcgttggcgcgcaacccgatcctggtcactgcgctgaacccgatcattggctaccagaaggctgcggaaatcgccaagcaggcctatcgcgagggacggccgatcatcgatgtggcgctggaaaacaccgatctggaccgtgcgcgcctggaggtgttgctggatccggaaaaactcacggctggcggcctctga

SEQ ID NO: 16865 - protein, 458 aa, Pseudomonas aeruginosa
MTDTRIERDSMGELAVPATALYGAQTQRAVNNFPVSGQRMPQAFVRALLLAKAAAARANVSLQQLDAPMGEAIADTCLQLLQEDFMQHFPVDVFQTGSGTSSNMNANEVVATLASRRLGGKVNPNDHVNCGQSSNDIIPSTIHISAALEISERLLPALRHLEQTIQSKAGEVHAYVKTGRTHLMDAMPVRMSQVLGGWAQQVRQAGVHIESVLPALQQLAQGGTAVGTGINAHPRFAERFSQELNDLTGLAFRPGDDFFALIGSQDTAVAASGQLKTLAVTLMKLANDLRWMNSGPLAGLGEIELEALQPGSSIMPGKVNPVIPEATAMVAAQVIGNDAAIAVAGQSGNFELNVMLPLVADNLLHSIQLLANVSRLLADKAIASFKVNQGKLSEALARNPILVTALNPIIGYQKAAEIAKQAYREGRPIIDVALENTDLDRARLEVLLDPEKLTAGGL

SEQ ID NO: 16866 - DNA, 1425 bp, Mycobacterium tuberculosis
  CDS (1)..(1425)
atggccgttgacgccgacagcgccaattaccgcatcgagcacgacaccatgggcgaagtccgggtgccggcaaaagcgttgtggcgcgcgcaaacccagcgcgcggtggagaacttcccgatatccggccgcgggttggagcgcacccagatccgcgcgctaggcctgctgaaaggcgcctgcgcgcaggtgaactccgacctcgggttgctggcgccggagaaagccgacgccatcatcgccgcggccgccgagatcgccgacggtcaacacgacgaccagtttcccatcgacgtcttccagaccggctcgggcaccagctccaacatgaacaccaacgaggtgattgcgtccatcgcggccaagggcggggtcacgttgcatcccaacgacgacgtgaacatgtcgcagtcgtccaacgacaccttcccgacggccacccacatcgcggccaccgaggccgcggtcgctcatctcatcccagcgctgcagcagctgcacgacgcattggccgccaaggctcttgattggcacacggtggtgaagtcgggccgaacgcatctgatggacgccgttccggtgacactcggccaggagttcagcggatatgcccgccagatcgaggccggcatcgagcgggtgcgcgcgtgtctgcccaggctgggcgagctggcgatcggcggcaccgcggtgggtaccggcctcaacgctcccgacgacttcggcgtcagagtggtcgcggtgctggtcgcgcagaccggtctgtcggaattgcgtacggcggctaattctttcgaagctcaggctgcccgcgacgggctggtggaggcgtccggggcgctgcgcacgatcgcggtatcgctgaccaagatcgccaacgacatccgctggatgggatcgggcccattgaccggcctggccgagatccaactgccagatctgcagccgggcagctcgatcatgccgggaaaggtgaatccggttctgccggaggcggttacgcaggtcgccgcgcaggtgatcggaaacgacgccgccatcgcctggggtggggccaacggcgcattcgaactcaacgtctacatcccgatgatggcccgcaacatcctcgagtccttcaagctgctgaccaatgtgtcacggctgttcgcccagcgctgcatagcagggctgaccgccaacgtcgagcacctgcggcggctggccgagtcctcaccgtcgatcgtgacaccgttgaattcggccatcggctacgaggaggcggccgccgtcgccaagcaagcactcaaggaacgcaaaacgattcgccaaaccgtgatcgaccgtggcctgatcggcgacaggctgtcgatcgaggatctggaccgccgtctggacgtgctggcaatggccaaggccgagcagctcgacagcgatcggctatga

SEQ ID NO: 16867 - protein, 474 aa, Mycobacterium tuberculosis
MAVDADSANYRIEHDTMGEVRVPAKALWRAQTQRAVENFPISGRGLERTQIRALGLLKGACAQVNSDLGLLAPEKADAIIAAAAEIADGQHDDQFPIDVFQTGSGTSSNMNTNEVIASIAAKGGVTLHPNDDVNMSQSSNDTFPTATHIAATEAAVAHLIPALQQLHDALAAKALDWHTVVKSGRTHLMDAVPVTLGQEFSGYARQIEAGIERVRACLPRLGELAIGGTAVGTGLNAPDDFGVRVVAVLVAQTGLSELRTAANSFEAQAARDGLVEASGALRTIAVSLTKIANDIRWMGSGPLTGLAEIQLPDLQPGSSIMPGKVNPVLPEAVTQVAAQVIGNDAAIAWGGANGAFELNVYIPMMARNILESFKLLTNVSRLFAQRCIAGLTANVEHLRRLAESSPSIVTPLNSAIGYEEAAAVAKQALKERKTIRQTVIDRGLIGDRLSIEDLDRRLDVLAMAKAEQLDSDRL

SEQ ID NO: 16868 - DNA, 1392 bp, Helicobacter pylori
  CDS (1)..(1392)
atgcaatttagaattgaacatgacacgatgggcgaaatcaaagtagatgacagccaatattggggggctcaaacgcaacgcagtcttgaaaactttaagatcggcactgaaaaaatgcctaaagaactcattggcgcgttcgccaaactcaaaaggagtttagcggttgtcaatcacaagttagggaaattaagcctggaaaaatcgcaagccattatcaaagcgtgcgattgcattttaaaaggcgagttgtgcggcgaattccccctagcgatatggcaaacagggagcgggactcaaacgaacatgaacctcaatgaagtcattgccaataaggctaccgaaattttagggggtaattttagggagaaaaaactcatccaccctaacgatgatgtgaacatgtctcaaagctccaacgacactttccctaccgcaatgcacgttgtgagcgtgctagaaatcacgcataaactgctgcctagtttagagaatctgttaaaaacctttaaagaaaaaagccaacaatttaaagagattgtcaaaatcgggcgcacgcatttacaagacgctacgcctttaactttggggcaagaatttagcgggtatgcgagcatgctagagcattctaaacaacaaattttagagagtttggagcatttaagggaattagccataggcgggactgccgtaggcacagggctaaacgctcataaggaattgagcgaaaaagtggctgaagaattgagccagtttagcggcgtgaaattcatctctgcacccaataaattccacgcgctcactagccatgacgctatcgcttatgcgcatggggcttttaaggctttagcggcgaatttaatgaaaatcgctaacgatattagatggcttgcgagcgggccgcgctgtggtttgggcgagcttaatatccctgaaaacgagccgggcagttctattatgcccggtaaagtcaatcccacgcaatgcgaagcgatgacaatggtagccgtgcaagtgatggggaatgataccgctattggcattgcggccagtcagggtaattttgaattgaatgtgttcaagccggtgattatttataacttcttgcaaagtttaaggctattgagcgacagcatggaaagtttcaatatccattgcgcgagcggtattgagcctaataaagaaaaaattgattattacttgcaccattctttaatgctagtaaccgcccttaatccgcatgtaggctatgaaaacgccgctaaaatcgctaaaaacgcccacaaaaaaggcatttctttaaaagaaagcgcgctggaactgaaactcttgagcgctgaagactttgaccaattcgtggtgcctgaaaagatgatcggacctaaggcttga

SEQ ID NO: 16869 - protein, 463 aa, Helicobacter pylori
MQFRIEHDTMGEIKVDDSQYWGAQTQRSLENFKIGTEKMPKELIGAFAKLKRSLAVVNHKLGKLSLEKSQAIIKACDCILKGELCGEFPLAIWQTGSGTQTNMNLNEVIANKATEILGGNFREKKLIHPNDDVNMSQSSNDTFPTAMHVVSVLEITHKLLPSLENLLKTFKEKSQQFKEIVKIGRTHLQDATPLTLGQEFSGYASMLEHSKQQILESLEHLRELAIGGTAVGTGLNAHKELSEKVAEELSQFSGVKFISAPNKFHALTSHDAIAYAHGAFKALAANLMKIANDIRWLASGPRCGLGELNIPENEPGSSIMPGKVNPTQCEAMTMVAVQVMGNDTAIGIAASQGNFELNVFKPVIIYNFLQSLRLLSDSMESFNIHCASGIEPNKEKIDYYLHHSLMLVTALNPHVGYENAAKIAKNAHKKGISLKESALELKLLSAEDFDQFVVPEKMIGPKA

SEQ ID NO: 16870 - DNA, 1395 bp, Pseudomonas aeruginosa
  CDS (1)..(1395)
atgagccggaccgaaaccgatagcctgggcaccatcgaggtgcccgacgacgcctactggggcgcccagacccagcgttcgctggagaacttcgccatcggcggccagcgcatgccgctcgccgtgatccacgccctggcgctgatcaagaaagccgccgcgcgggtcaacgaccacctcggcgaactgccgccggaagtcgcccggctgatcgaacaggccgccgacgaagtcctcgcaggccgccacgacgaacacttcccgctggtggtctggcagaccggcagcggcacccagaccaacatgaacgtcaacgaggtgatcgctggccgcgccaacgaactggccggcaatccgcgtggcggcaagtcgccggtgcatcccaacgaccacgtcaaccgcgcgcagagttccaacgacagcttccccaccgccatgcacatcgccgccgccaaggccgtgcacgaacaattgctgccggccatcgccgagctttccggcggtctcgccgaacagtcggcgcggcacgccagcctggtcaagaccgggcgcacccacctgatggacgccacgccgatcaccttcggccaggaactctcggccttcgtcgcccagctcgactacgccgagcgcgccatccgcgcggcgctgccggcggtctaccagttggcccagggcggcaccgcggtgggcaccgggctcaacgcgccgaagggcttcgccgacgccatcgccgcggaaatcgccgccgaatcgggcctgcccttcgtcgccgcgccgaacaagttcgccgccctggccggccacgagccgctggtcatcctctccggcgccctgaagagcctggcggtggccctgatgaagatcgccaacgacctgcgcctgctcggttccggcccacgcgccggcttcgccgaggtgaagctgccggccaacgagccgggcagctcgatcatgcccggcaaggtcaacccgacccagtgcgaggcgctgtcgatgctggcctgccaggtcatgggcaacgacagcacgatttccttcgccgccagccagggccatctgcaactcaacgtgttcaagccggtgatcgtctacaacctgctggagtccatccgcctgctcgccgacggctgccgcaacttcaacaagcattgcgtcgccggcctggagccggacgcccagcgcatggccgacctgctggagcgcggcctgatgctggtcaccgcactgaacccgcacatcggctacgacaaggccgccgaaatcgccaagaaggcctacgccgaaggcaccaccctgcgcgccgcggcgctgcagctgggctacctggacgaagcgcagttcgacgaatgggtacggccggagcagatgctggaggccggccaccatggttga

SEQ ID NO: 16871 - protein, 464 aa, Pseudomonas aeruginosa
MSRTETDSLGTIEVPDDAYWGAQTQRSLENFAIGGQRMPLAVIHALALIKKAAARVNDHLGELPPEVARLIEQAADEVLAGRHDEHFPLVVWQTGSGTQTNMNVNEVIAGRANELAGNPRGGKSPVHPNDHVNRAQSSNDSFPTAMHIAAAKAVHEQLLPAIAELSGGLAEQSARHASLVKTGRTHLMDATPITFGQELSAFVAQLDYAERAIRAALPAVYQLAQGGTAVGTGLNAPKGFADAIAAEIAAESGLPFVAAPNKFAALAGHEPLVILSGALKSLAVALMKIANDLRLLGSGPRAGFAEVKLPANEPGSSIMPGKVNPTQCEALSMLACQVMGNDSTISFAASQGHLQLNVFKPVIVYNLLESIRLLADGCRNFNKHCVAGLEPDAQRMADLLERGLMLVTALNPHIGYDKAAEIAKKAYAEGTTLRAAALQLGYLDEAQFDEWVRPEQMLEAGHHG

SEQ ID NO: 16872 - DNA, 1374 bp, Pseudomonas aeruginosa
  CDS (1)..(1374)
atgactgacacccgcatcgaacgcgacagcatgggcgaactggcggtcccggcgaccgccctctatggcgcccagacccagcgcgcggtgaacaacttcccggtcagcggccaacgcatgccccaggccttcgtccgcgccctgctgctggccaaggccgcggcggcgcgggcgaacgtctccctgcagcaactggatgcaccgatgggcgaggcgatcgccgacacctgcctgcaactgctgcaggaggacttcatgcagcatttcccggtggatgtgttccagaccggctccggcaccagttccaacatgaacgccaacgaagtggtggcgaccctggccagtcgtcgcctgggcggcaaggtcaatccgaacgaccatgtgaactgcgggcagagcagcaacgacatcattccctcgaccatccacatcagtgccgccctcgagatcagcgaacgcctgctgtcggcgctgcgccacctggagcagactatccagagcaaggccggcgaagtgcatgcctatgtgaagaccggccgcacccacctgatggatgcgatgccggtacgcatgagccaggtgctcggtggctgggcgcagcaggtgcgacaggccggcgtgcacatcgagagcgtacttcctgccttgcagcagttggcacaggccggcaccgcggtgggcaccgggatcaacgcccatccgcggttcgccgaacgtttcagccaggagctgaacgacctgaccgggctggcgttccgccccggcgacgacttcttcgccctgatcggttcgcaggacaccgcggtcgctgcgtccggccagttgaagaccctggccgtgaccctgatgaagctggccaacgacctgcgctggatgaactccgggccgcttgccgggctcggcgagatcgagctggaagcgctgcaaccaggctcctcgatcatgcccggcaaggtcaacccggtgatcccggaggccaccgcgatggtcggcgcccaggtgatcggcaatgacgccattgccgtcgctggccaatcgggcaacttcgaactgaacgtgatgctgccgctggtggcggacaccctgttgcacagcatccagttgctggccaacgtcagccggctgctggcggacaaggccatcgccagcttcaaggtcaaccagggcaagctcagcgaggcgttggcgcgcaacccgatcctggtcactgcgctgaacccgatcatcggttaccagaaggctgcggaaatcgccaagcaggcctatcgcgagggacggccgatcatcgatgtggcgctggaaaacaccgatctggaccgtgctcgcctggaggtgttgctggatccggaaaaactcacggctggcggcctctga

SEQ ID NO: 16873 - protein, 457 aa, Pseudomonas aeruginosa
MTDTRIERDSMGELAVPATALYGAQTQRAVNNFPVSGQRMPQAFVRALLLAKAAAARANVSLQQLDAPMGEAIADTCLQLLQEDFMQHFPVDVFQTGSGTSSNMNANEVVATLASRRLGGKVNPNDHVNCGQSSNDIIPSTIHISAALEISERLLSALRHLEQTIQSKAGEVHAYVKTGRTHLMDAMPVRMSQVLGGWAQQVRQAGVHIESVLPALQQLAQAGTAVGTGINAHPRFAERFSQELNDLTGLAFRPGDDFFALIGSQDTAVAASGQLKTLAVTLMKLANDLRWMNSGPLAGLGEIELEALQPGSSIMPGKVNPVIPEATAMVGAQVIGNDAIAVAGQSGNFELNVMLPLVADTLLHSIQLLANVSRLLADKAIASFKVNQGKLSEALARNPILVTALNPIIGYQKAAEIAKQAYREGRPIIDVALENTDLDRARLEVLLDPEKLTAGGL

SEQ ID NO: 16874 - DNA, 1317 bp, Sulfolobus solfataricus
  CDS (1)..(1317)
atgaaatataccgatactgcgcccaagctttttatgaatactggaaccaaatttcctagaagaattatctggtctatgggagttttaaagaagtcctgtgctaaagtcaacgcagatcttggattattagataaaaaaattgcggattcaattattaaggcatctgacgatttaattgatggaaaattagatgataagatagtgcttgatgtatttcaaacgggttcagggaccggacttaatatgaacgtaaatgaggttatagcagaagtagcttctagctattctaatcttaaagtacatccaaatgatcatgtaaattttggtcagtcctcaaacgatactgtgccaacagctataagaattgcagcagtagctgaggtaacaaataggctactgcctgcattacagcaaataatatcctctttaaataagaaggctgaggagtacaaggatgttataaaggctggtagaacccatttaagagacgcattaccagtaactttaggtcaagaactttcagcctacgcagacgctttccagcatgaacatgaacaagttatgaatattttggaatatgtgaaggaattgccaattggaggtactgcgactggtactgggctaaatagccacccagaattccaagaaagagttataaacgaaataaacagaattaccggtttaggatttaagccagctaataggtttagagcaatgagattgctcaccgatctcttattattaagcggagcactgaggaatattgcagtagacctatatagattagggcaagatataaggttaatgttttccggtcccttaactgggttaaatgaaattgatttacctacacaagaggagatagctggtagctcaataatgcctggtaaaactaatccagttacggttgaggctactttactaatctcagcacaagttgtgggattagatcatgcaaaccaattcgcatcaatgttaggcgaatttgagttatcaatgggaattccattagttggttataatatcgtaacccaagttaatttcatctcagaggctttagagaagatgtcaagattagtgattgatggaatggtagcaaatgtagagaagatgaagagatatgctgaatcctctccttcacttataaccatagtatctccagtaataggctatgataaagcaacagaaataggaaagaagttaaataagggaatgtccatacgtgaagcattaagggaattaggatatagcgataatgagataaataaaatattagacttaagcaaactagttaaaccagggttcacagctaaatga

SEQ ID NO: 16875 - protein, 438 aa, Sulfolobus solfataricus
MKYTDTAPKLFMNTGTKFPRRIIWSMGVLKKSCAKVNADLGLLDKKIADSIIKASDDLIDGKLDDKIVLDVFQTGSGTGLNMNVNEVIAEVASSYSNLKVHPNDHVNFGQSSNDTVPTAIRIAAVAEVTNRLLPALQQIISSLNKKAEEYKDVIKAGRTHLRDALPVTLGQELSAYADAFQHEHEQVMNILEYVKELPIGGTATGTGLNSHPEFQERVINEINRITGLGFKPANRFRAMRLLTDLLLLSGALRNIAVDLYRLGQDIRLMFSGPLTGLNEIDLPTQEEIAGSSIMPGKTNPVTVEATLLISAQVVGLDHANQFASMLGEFELSMGIPLVGYNIVTQVNFISEALEKMSRLVIDGMVANVEKMKRYAESSPSLITIVSPVIGYDKATEIGKKLNKGMSIREALRELGYSDNEINKILDLSKLVKPGFTAK

SEQ ID NO: 16876 - DNA, 1401 bp, Synechocystis sp
  CDS (1)..(1401)
atggtaaattcccaccgccttgaaaccgacagtatggggtccctggaagtccaagccgatcgcctgtggggagcgcaaacccaacgttccctgatgttttttgacattggtagcgatgtgatgccgccggatttaattcgggcctttgccatactcaaaaaggcagccgccattaccaatcaggatttgggtaaattaccagcggacaaggcagagttaatcattacggcagcggacgaaatcattgccgggcagtggttagaccatttccctctaaggatttggcaaacgggcagtggcactcaaaccaacatgaacgtgaacgaagtgattgccaatcgggcgatcgccatttgtgggggagaattgggcagtaaaaatcccatccatcccaatgaccacgtcaacatgtcccagtcgtctaacgatacttttcctacggcgatgcacattgcggcggtggcaggtttacaaaccaagttgattcccagtttgcaagctctgagagatagcctgaatgaaaaagcggaatgttttgcaggcatcactaaaattggccgcacccatttgatggacgcagtgcccctaacgttagggcaggaattttccggttacgtggcccagttagaccaagggctgacccaaattaattattgtttacccggtcttttggaattggccctggggggaacggcggtgggtacagggttaaatagtcatccccaatttgctaaaaaagtggccgaagaaattgcccagttaactggttataccttcatttctgcccccaacaaattcgccgccctagctggccacgaggcgatcgcctttgccagtggcgtgctgaaaagtattgccgcttccctgatgaaaattgccaatgatttgcgctggatggggtctgggccccgctgcggcttgggggaattagccttaccagccaatgaaccaggttcttcgatcatgcccgggaaagtaaaccccacccaatgcgaagccatgaccatggtttgtgtgcaggtaatggggaacgatgccaccattggttttgcggccagccaaggtaattttgagctcaatgtttttaagccagtgattattcataatttcctccattcgttacatttactcagcgatgcttgtgctagttttcgccaacatttagtggtgggattacaagtaaacgaaagcaaggttaaagactttttggacacctctttaatgttagtcaccgccctcaatccccacattggctacgacaatgcggccctcgtggctaaaactgcctttgcccaaggcattaccctcaaacaagccgcggtggatttaggtttactcaccccagcccagttcgacgcttgggtcgttccagagcagatgattgccccgattgctgactag

SEQ ID NO: 16877 - protein, 466 aa, Synechocystis sp
MVNSHRLETDSMGSLEVQADRLWGAQTQRSLMFFDIGSDVMPPDLIRAFAILKKAAAITNQDLGKLPADKAELIITAADEIIAGQWLDHFPLRIWQTGSGTQTNMNVNEVIANRAIAICGGELGSKNPIHPNDHVNMSQSSNDTFPTAMHIAAVAGLQTKLIPSLQALRDSLNEKAECFAGITKIGRTHLMDAVPLTLGQEFSGYVAQLDQGLTQINYCLPGLLELALGGTAVGTGLNSHPQFAKKVAEEIAQLTGYTFISAPNKFAALAGHEAIAFASGVLKSIAASLMKIANDLRWMGSGPRCGLGELALPANEPGSSIMPGKVNPTQCEAMTMVCVQVMGNDATIGFAASQGNFELNVFKPVIIHNFLHSLHLLSDACASFRQHLVVGLQVNESKVKDFLDTSLMLVTALNPHIGYDNAALVAKTAFAQGITLKQAAVDLGLLTPAQFDAWVVPEQMIAPIAD

SEQ ID NO: 16878 - DNA, 1401 bp, Thermus aquaticus
  CDS (1)..(1401)
atggaataccgggttgagcgggacaccatgggagaggtcaaggttccggcggaccgctactggggggcccagacccaacgctctctggagcacttccggatcggggcctggcgcttccggatgccgctggagatcatccgggcctacgggatgctgaagaaggccgccgccagagccaacctggagctgggggagctacccgaggagatcgccagggccatcatccaggcggccgaggaggtcatcgccgggaagctggacgaccacttccccctggtggtcttccagaccgggtccggaacccagaccaacatgaacgtcaacgaggtcatcgccaaccgggcctcggagatcctgggcaagcccctggggagcaagtacgtccaccccaatgaccacgtgaaccggggccagagctccaacgacaccttccccaccgccatgtacgtggccaccgtcttggctcttcaccagcacctttacccggcggtggagggcctcatcgccacctttgaggaaaaagccagggcctttgacggcatcgtcaaggtgggccgcacccacctcatggacgccgtccccatcaccctgggccaggaggtggggagctgggccgcccagcttaggaacaccctggccatggtcaaggaggcggaaaagggcctctacaacctggccatcggcggcaccgccgtgggcacgggcctcaacgcccacccccgcttcggggagctggtggcccggtatctggcggaggagaccggcctccccttccgggtggcggaaaaccgcttcgccgccctggccgcccacgacgagctggtccacgtcatgggggctctaaggaccctggccggggccctgatgaagatcggcaacgacatccgctggctggcctcggggccctacgggggtatcggcgagatcttcatccctgccaacgagcccgggagctccatcatgccgggcaaggtgaaccccacccaggtggaggccctaccatgggtggtggtgcgggtctttggcaacgaccaggccgtggccttcgccgggagccagggcaacttccagctcaacgtctacaagccggtcatggtggacgccgccttggagtccatcaagcttctgggcgacgctgtggcctcctttgaccagcacctggcccaggggattgagcccaacctggagcgcatagaggagcacctcaacaagaaccccatgctggccaccgccctcaacaaggccatcggctacgacaaggcggcggagatcgtcaagaaggccatcaaggagaagaagtccctgaagcaggcggccctggagctgggttacctcaccgaggaggagtttgaccggatcgtggtgcccatgcgcctggccaagccccacgaaaacgcttag

SEQ ID NO: 16879 - protein, 466 aa, Thermus aquaticus
MEYRVERDTMGEVKVPADRYWGAQTQRSLEHFRIGAWRFRMPLEIIRAYGMLKKAAARANLELGELPEEIARAIIQAAEEVIAGKLDDHFPLVVFQTGSGTQTNMNVNEVIANRASEILGKPLGSKYVHPNDHVNRGQSSNDTFPTAMYVATVLALHQHLYPAVEGLIATFEEKARAFDGIVKVGRTHLMDAVPITLGQEVGSWAAQLRNTLAMVKEAEKGLYNLAIGGTAVGTGLNAHPRFGELVARYLAEETGLPFRVAENRFAALAAHDELVHVMGALRTLAGALMKIGNDIRWLASGPYGGIGEIFIPANEPGSSIMPGKVNPTQVEALPWVVVRVFGNDQAVAFAGSQGNFQLNVYKPVMVDAALESIKLLGDAVASFDQHLAQGIEPNLERIEEHLNKNPMLATALNKAIGYDKAAEIVKKAIKEKKSLKQAALELGYLTEEEFDRIVVPMRLAKPHENA

SEQ ID NO: 16880 - DNA, 2489 bp, Saccharomyces cerevisiae
  CDS (830)..(2296)
taatcacttctacgagtctagtagatctcttctccttcctataagtggttaatgtattcttcgagaagctcatcatttttttttttcattttttttttttttttcagttttctacaatttcatcaaatcaatggttaaaccgggcagaaaaactaccaagcgttacttttactgatgttagtactactaccgcagttattgcgactactacattaactataactatacaagaaaaaaagtaaagagggctcgtaaagcaaagcttggtatctcctacatagtcaatacatagtagtgagtcgcctatagccattctgtaatgccatttgttaagacgtgtccttaaacccttccgaatcgccgcgggcgacatcataatgtcagtacctaataatggttattattcgtaccctgtggttagagagctatggaagctagcagtaaatgtctctagttcttgctatcactaccatattggagaggcttcaggcccctcccctgagccgatcctcggaatgactaccccgattcccggaatgggcgttcgatgattggctctttcctgtaaagcctttttgcgtttcttataggctatatataatcttcatcactgttgtagacgttaaacaagcatccaacaggaggccggaccgaacacacgggggagtgactctagctctttcttctgggatattcatatcgtttctccattacatacagtcatttttttgcatttttaaattcgtgacttttagtactgcagctgttttttttctcacgtcaagaaattccataaagtctaactattaaacggataagagatacaatcatgttgagatttaccaattgtagttgcaagactttcgtaaaatcgtcatataagcttaatataagaagaatgaactcctcgttcagaactgaaaccgatgcatttggtgagatacacgtgcctgctgataagtactggggtgcccaaactcaaagatcctttcaaaacttcaagattggtggcgctcgtgaaagaatgccattgcctttggtgcatgcatttggtgttttgaagaaatctgccgcgattgtgaatgagtctctggggggattggatcccaagatctccaaggctattcaacaggccgctgacgaagtggcttctggtaagctagacgaccactttccattggttgttttccaaacgggttccggtacccagtctaacatgaatgctaatgaagttatttccaatcgtgccattgagatcctaggaggcaagattggatctaaacaagtccatccaaacaatcattgcaaccaatctcaatcatccaatgatactttccccactgtcatgcatatcgctgccagtttgcaaattcaaaacgagttgatacctgagttgaccaatttaaagaacgcccttgaagccaaatccaaggaatttgaccatattgtgaagatcggtagaacacacttgcaagatgccacgcctttgacactaggtcaagagttttccggttacgtgcaacaagttgagaacggtatccaaagagtggcacattctttgaaaacattgagtttcctggcacaaggtggtactgccgttggtacagggttgaacaccaagcccggattcgatgtcaagatagccgagcaaatttccaaagaaactggactaaagtttcaaaccgcccctaataagttcgaggctttggctgctcacgacgccattgtcgaatgtagcggtgctctaaacacccttgcttgttctcttttcaaaatagcgcaagatataagatacttagggtccgggccacgttgcggctaccatgaactaatgctgccagagaatgaaccaggttcctcaatcatgcctggtaaagttaacccaacccaaaacgaggcattgactcaagtgtgtgtgcaagtcatgggtaacaatgcagctatcacgtttgccggctctcaaggtcaattcgagttaaatgtcttcaagccagtcatgatcgccaatctattgaattcgatcaggttaattactgatgccgcatattcatttagagtgcactgtgttgaaggtatcaaagccaatgagcctcgtattcatgagttgttgactaaatctttaatgttagtcaccgctttgaaccctaagatcggttatgatgccgcttccaaggtcgccaagaatgctcataagaagggcattaccttgaaggaaagtgcattggaattgggtgtattgactgaaaaggaatttgatgaatgggttgttcctgaacacatgctaggtcctaaataaacgagctaaatacctaataatatacaagttttttatgtcttattatatgaaggaaaataaggaagtggagagaatttgtgattcagcaatggtccctccgctaaggtcccgcctctggccagttatgtcagaagaggagcataggcatacattccatttttgatggcttaatggggcccataaatttacatca

SEQ ID NO: 16881 - protein, 488 aa, Saccharomyces cerevisiae
MLRFTNCSCKTFVKSSYKLNIRRMNSSFRTETDAFGEIHVPADKYWGAQTQRSFQNFKIGGARERMPLPLVHAFGVLKKSAAIVNESLGGLDPKISKAIQQAADEVASGKLDDHFPLVVFQTGSGTQSNMNANEVISNRAIEILGGKIGSKQVHPNNHCNQSQSSNDTFPTVMHIAASLQIQNELIPELTNLKNALEAKSKEFDHIVKIGRTHLQDATPLTLGQEFSGYVQQVENGIQRVAHSLKTLSFLAQGGTAVGTGLNTKPGFDVKIAEQISKETGLKFQTAPNKFEALAAHDAIVECSGALNTLACSLFKIAQDIRYLGSGPRCGYHELMLPENEPGSSIMPGKVNPTQNEALTQVCVQVMGNNAAITFAGSQGQFELNVFKPVMIANLLNSIRLITDAAYSFRVHCVEGIKANEPRIHELLTKSLMLVTALNPKIGYDAASKVAKNAHKKGITLKESALELGVLTEKEFDEWVVPEHMLGPK

SEQ ID NO: 16882 - DNA, 1395 bp, Acinetobacter sp
  CDS (1)..(1395)
atgcaaactcgaattgaacacgacaccatgggtgaggttgaggtcccaaacgatgcactttggggagctcagacgcaacgcagtttgcaaaattttaagatcggtcaggaaagactcccacgagcgatgattcgtgcaatgggacttgtcaagaaggcagcagcgattaccaatgcagaactcgggcagttgccagaggatctgagccaatatatcgttggtgcggcagaagaagtaattgcaggtgactgggactcgcaatttcctttggtggtctggcaaacgggttcaggcacacaaagtaatatgaattgtaatgaagtgattgccaatattgcgaaccaaaaattaggaaatgctttaggttctcaatcacctgtgcatccgaacgatcatgtcaatcgtgctcagtcgacaaacgattctttcccaactgccatacatgttgctgcatcattacaaatcaacgaattgcttattcccgctgtaaaaagcctaaaagagaccttgaagaaaaaatcagatgaattttctgatattgtcaaaattggtcgcacgcatttacaggatgcaacaccgttaacattagggcaagagtttagtgggtatgtatcgcagctcgatcatgggttaaagcgattacagcaagcgcttgagggtttatacgagcttccgttaggtggaacggctgtgggtacaggtttaaatgcacatcctgattatgcagtgaatgcagctcaacaacttgctaaactgacaagtctgccattcgttacggcacctaataaatttgaagctttagctggacgtgatgctgcggtatttgcatctggtgcactgaaaactctcgctgtaagcttaaacaaaattgcaaatgatattcgttggctggcaagtggtccgcgttgcggatttggtgaaattcgtattccagaaaacgaaccaggctcaagcattatgccaggcaaagtaaatccaacgcaaagtgaagctatgacgatggtggttgcgcaggtgttaggcaatgatacaacgatcaatgttgcaggtgcttctggtaactttgaactgaatgtcttcatgcctgtaatcgcatttaatcttcttcagtcaattcagcttctaggtgatgcttgtaatagttttaacgaacattgtgcagtaggtatcgagccaaatagagaaaagattgattattttctgcataattcattaatgttggtgacggcattgaatcctgttattggttatgaaaacgctgcaaaagtagcaaaaacggcttacaaagaaaataaaacgttaaaacaggttgctgtagaactaaatttagtcacagaacagcagtttgatgaaatcgttcgtcctgaaaagatggtatctccaaataccaagtaa

SEQ ID NO: 16883 - protein, 464 aa, Acinetobacter sp
MQTRIEHDTMGEVEVPNDALWGAQTQRSLQNFKIGQERLPRAMIRAMGLVKKAAAITNAELGQLPEDLSQYIVGAAEEVIAGDWDSQFPLVVWQTGSGTQSNMNCNEVIANIANQKLGNALGSQSPVHPNDHVNRAQSTNDSFPTAIHVAASLQINELLIPAVKSLKETLKKKSDEFSDIVKIGRTHLQDATPLTLGQEFSGYVSQLDHGLKRLQQALEGLYELPLGGTAVGTGLNAHPDYAVNAAQQLAKLTSLPFVTAPNKFEALAGRDAAVFASGALKTLAVSLNKIANDIRWLASGPRCGFGEIRIPENEPGSSIMPGKVNPTQSEAMTMVVAQVLGNDTTINVAGASGNFELNVFMPVIAFNLLQSIQLLGDACNSFNEHCAVGIEPNREKIDYFLHNSLMLVTALNPVIGYENAAKVAKTAYKENKTLKQVAVELNLVTEQQFDEIVRPEKMVSPNTK

SEQ ID NO: 16884 - DNA, 1452 bp, Candida glabrata
  CDS (1)..(1452)
atgttgagggctagcagtagggcaaagacatcgctcatcgggtacagcgcgcggatgatgcattacagagtagagacggacactttcggcgagatcaaggtacccgcggacaagtactggggcgcgcagacgcagcggtcgttccagaacttcaagatcggcggcgcgcgcgagcgcatgccggagcccatcgtgagggcgttcggtgtgctgaagaagtcagccgccatagtcaacgagaagctcgggacgctagacagcgagatcgcggggcccatccagcaggccgctgacgaggtcgccaagggcaagctcaacgaccacttccccttggtggtgttccagaccgggtcaggcacgcagtctaacatgaacgccaacgaggtcatctccaacagggcgattgagctgatcggcggcgagctcggctccaagaagatccacccaaacaaccactgcaatcaggcgcagtcctccaacgacactttcccctcggtgatgcacatcgccgcggtcacggagatcaccaactccctcttgccggagatcacccagctgaaggacgccctccacaagaaggccgaggagttccaggacatcgtcaagatcggcagaacacacctgcaggacgccacaccgctgaccctcggacaggaattcagcggctacgtccagcagctcgtcaacggcatcgcaagaatcgagaacaccctgccacacctgaagtacctcgcacaaggtggtaccgctgtcggcacagggctgaacacgaaggagggcttcgacaagctgatcgccgagcagatctccaaggaaacgggcatcgacttcaaaaccgcccctaacaagttcgaagctctcgcagctcacgacgcgatcgtcgaggccagcggtgccctgaacaccgtggcttgctctctgttcaagatcgcacaggacatcaggtacctgggctccggccctcgttgcggctacggtgaactgcacttgccagagaacgagccaggttcctccatcatgcctggtaaggtcaacccaacacagaacgaggccatgacccaggtctgtgtccaggtcatgggtaacaacgcagctgtgaccttcgcgggcgccaacggtcagttcgaactgaacgtcttcaagccggtcatgatctcaaacttgttgagctccatcagattgctggcagacgcttgccactccttcagagtccactgtgtcgaaggcatcgaggcaaaccgcgagaagatcaaccacaacttgcacaactcattgatgctggtcaccgctctgaacccaaagatcggctacgacgccgcctccaagatcgcaaagaacgctttcaagaagaacatcaccttgaaagagtccgccttggagttgaaatacttgacctcagaagagttcgacgaatgggtcattcctgaaaacatggttggaccaaccaagtaa

SEQ ID NO: 16885 - protein, 483 aa, Candida glabrata
MLRASSRAKTSLIGYSARMMHYRVETDTFGEIKVPADKYWGAQTQRSFQNFKIGGARERMPEPIVRAFGVLKKSAAIVNEKLGTLDSEIAGPIQQAADEVAKGKLNDHFPLVVFQTGSGTQSNMNANEVISNRAIELIGGELGSKKIHPNNHCNQAQSSNDTFPSVMHIAAVTEITNSLLPEITQLKDALHKKAEEFQDIVKIGRTHLQDATPLTLGQEFSGYVQQLVNGIARIENTLPHLKYLAQGGTAVGTGLNTKEGFDKLIAEQISKETGIDFKTAPNKFEALAAHDAIVEASGALNTVACSLFKIAQDIRYLGSGPRCGYGELHLPENEPGSSIMPGKVNPTQNEAMTQVCVQVMGNNAAVTFAGANGQFELNVFKPVMISNLLSSIRLLADACHSFRVHCVEGIEANREKINHNLHNSLMLVTALNPKIGYDAASKIAKNAFKKNITLKESALELKYLTSEEFDEWVIPENMVGPTK

SEQ ID NO: 16886 - DNA, 1389 bp, Bartonella quintana str
  CDS (1)..(1389)
atggttgaaacacgtcaggaaacagatagctttggaacgatttcagtacgtcaagatcgttattggggagcacaaactgaacgttctctgcataattttaatattggcacagaaaaacaacctctcaccatcatctatgccttaagccttatcaaaaaagctgcagctgttgtcaatatggaaaaaggcaagcttgcacaaaacatcggaaaagcaatcattactgccgccgatgaagtgctcgcaggagcatttgatacgcattttccactttctgtctggcaaactggttctggcacacaaagtaatatgaacgtcaatgaagtcatcgccaaccatgccagcatgcttttgggaggaaaacttggcagtaaagcacccgttcaccccaatgatcacgtaaatatgagccaatcgtcaaacgattcctttcccacagcacttcacattgccaccacactccaaacacgccaacacttatttcccatccttgacgctcttattactactttaagaaaaaaagaagaagaatttgccgatatcatcaaaatcggacgcacccatacccaggatgcaacacctctgacattaggacaggaattttcaggttatcgcgcagcactagaagccaaccgccaacgcattgaaagtgcgcttgccgatgtccaaatgcttgcccaaggagggacagctgttggaacaggactcaatgcaccgcaaggttttgacgttgcttttgcgcaaacaatcagcaccctcacaggaataacctttaagactgccagcaataaatttgaagcactcgcccatcatggagcccttgcacattttcatggaagcttgaatgcattagcagctgatctgtttaaaattgccaatgacattcggtttttgggatccggtccacgctcagggttgggtgaactaagccttccagaaaatgaaccaggatcttccattatgccaggcaagatcaatcccacgcagtgtgaagcaatgactatggttgcttgccaggttttcggcaatcataccagtataacatttgccgcaagccagggacattttgaactcaatgtttataaacctgttattggctataatgttttacagtcgattacgcttcttggtgattgcatgcgttcttttgacatgcattgcattcaaggattacgtgccaatcgagtccatattcactctctcatggaacgctctctcatgttaataacagctcttgcaccggaaattggctatgaaaaagctgccgaaattgctaaagcagcacataaaaatgacacgactttgcgtactgaagctatcaaagcgggagtttctggagatgattatgatcggctggttgatcccaaaaagatgatccacccgcaataa

SEQ ID NO: 16887 - protein, 462 aa, Bartonella quintana str
MVETRQETDSFGTISVRQDRYWGAQTERSLHNFNIGTEKQPLTIIYALSLIKKAAAVVNMEKGKLAQNIGKAIITAADEVLAGAFDTHFPLSVWQTGSGTQSNMNVNEVIANHASMLLGGKLGSKAPVHPNDHVNMSQSSNDSFPTALHIATTLQTRQHLFPILDALITTLRKKEEEFADIIKIGRTHTQDATPLTLGQEFSGYRAALEANRQRIESALADVQMLAQGGTAVGTGLNAPQGFDVAFAQTISTLTGITFKTASNKFEALAHHGALAHFHGSLNALAADLFKIANDIRFLGSGPRSGLGELSLPENEPGSSIMPGKINPTQCEAMTMVACQVFGNHTSITFAASQGHFELNVYKPVIGYNVLQSITLLGDCMRSFDMHCIQGLRANRVHIHSLMERSLMLITALAPEIGYEKAAEIAKAAHKNDTTLRTEAIKAGVSGDDYDRLVDPKKMIHPQ

SEQ ID NO: 16888 - DNA, 1389 bp, Bartonella henselae
  CDS (1)..(1389)
atggttgaaacacgtcaagaaacggatagctttgggacgatttcagtccgtcaagaccgttattggggcgcacaaactgaacgctcattgcataattttaatattggcatagaaaaacaacccctcaccatcatctatgccttaagccttatcaaaaaagcagcagctgttgtgaatatggaaaaaggcaaactcgcaaaaaacattggaaaagccatcattactgctgccgatgaagtgctttccggtgcatttgacacgcatttccccctttctgtttggcaaacaggttctggaacacaaagcaatatgaacgtcaatgaagtgatcgccaatcatgccaatatgcttttgggaggaaaattgggtagcaaaacacctgtgcatcccaatgatcacgtcaatatgagccaatcgtcaaacgattcctttcccacagcacttcacattgctactaccctacaaacgcgccaacacctctttcctatccttgacgcacttattaccactttaaagaaaaaagaagaagaatttgccgatatcatcaaaattggacgtactcatacccaggatgccacacccttaactttagcgcaagaattttcgggctatcgcactgcactcgaagccaaccgccaacgcattgaaaatgctctttgtgatgttcaaatgcttgcccaaggaggtacagctgttggaacagggctgaacgcaccgcaaggctttgacatagcttttgcgcaaacaatcagtacatttacaggaataccctttaaaaccgctagcaataaatttgaagccctcgctcatcatggagctcttgcgcatttccatggtagcttaaatgcattagcagctgatctgtttaaaattgccaatgacattcggtttttgggatccggtccacgctcaggcttgggggaactaagcttaccagaaaatgaaccaggatcttccatcatgccaggcaaggttaaccccacacagtgtgaagcaatgaccatggttgcttgccaagtctttggcaatcataccagtgtaacatttgccgcaagccaagggcattttgaactcaacgtttataaacctgtcattggctacaatgttttacaatcgattacgcttcttggggattgcatgcgctcttttgatcttcattgtattcaaggattacgcgccaatcgagttcacattcattctctcatggaacgttctctcatgttggtgacagcgcttgcaccagaaattggctatgaaaaagctgccgcaattgccaaagcagcgcataaaaatgacacaactttgcgtaccgaagcactcaaactaggagtttctggagaagattatgatcggttggttgatcccaaaaagatgatccatccacaataa

SEQ ID NO: 16889 - protein, 462 aa, Bartonella henselae
MVETRQETDSFGTISVRQDRYWGAQTERSLHNFNIGIEKQPLTIIYALSLIKKAAAVVNMEKGKLAKNIGKAIITAADEVLSGAFDTHFPLSVWQTGSGTQSNMNVNEVIANHANMLLGGKLGSKTPVHPNDHVNMSQSSNDSFPTALHIATTLQTRQHLFPILDALITTLKKKEEEFADIIKIGRTHTQDATPLTLAQEFSGYRTALEANRQRIENALCDVQMLAQGGTAVGTGLNAPQGFDIAFAQTISTFTGIPFKTASNKFEALAHHGALAHFHGSLNALAADLFKIANDIRFLGSGPRSGLGELSLPENEPGSSIMPGKVNPTQCEAMTMVACQVFGNHTSVTFAASQGHFELNVYKPVIGYNVLQSITLLGDCMRSFDLHCIQGLRANRVHIHSLMERSLMLVTALAPEIGYEKAAAIAKAAHKNDTTLRTEALKLGVSGEDYDRLVDPKKMIHPQ

SEQ ID NO: 16890 - DNA, 1389 bp, Bacillus thuringiensis serovar konkukian str
  CDS (1)..(1389)
atggagtacagaattgaaagagatacattaggagaaataaaagttccagctgataaattatgggcagcacaaacacaacgtagtaaagaaaacttcccgattggaacagagcaaatgccgcttgaaattgtaaaagcatttgcaattttaaagaagagtgcagcacttagcaatcaaaaattaggaaagttatcagaagaaaaagcagaagcaattgtggcagcagctgacgaagtgattgcagggaaatggaatgaacattttccgcttgtcgtgtggcaaacaggtagtggtacacaatcaaacatgaatgtgaatgaagtaattgcaaatcgtgggaatcaaattttgaaagaaaagggatctgacgtacatattcatccgaatgatgatgtgaacatgtcccaaagttcaaatgatacatttccaacagcgcttcatgtagcatgtgtaatagcagtagaaaatcacgtattaccagctattacgaaattaaaagaaacgttagcagaaaaagtaactgcatttgaacatattataaaaattggtcgtacacatttacaagatgcgacaccgttaacattaggacaagaaattagtggatggcaccgtatgcttgaaaaaacagagcgtatgattgcagagagcaatacatatatgaaagagcttgcgattggtggtacagcagttggaacaggtattaacgctcatcctaaatttggtgagatggtatcagaggaaattagccaatttacaggtaaacaatttatttctgcaccaaataagttccacgcattaacgagccatgatgaagttgtgtatacgcatggtgcattaaaagcattagcagcggatttaatgaagatcgctaacgatgtacgttggcttgcaagtggtccacgtagtggtcttggagaaattattattccagcaaatgaaccgggaagctctattatgccaggtaaagtaaatccaacgcaaagtgaagcattaacgatggttgtagcgcaagtgatgggaaatgacgcaacaatcggatttgctgcgagtcaaggtaattttgagttgaacgtatttaaacctgttattgcatataacttcttacaatccgctcacttattagcagatgcaattgtttcatttaatgataattgtgcagttggtattgaagctgatgaagaagtcattaaagagaatgtgaatcgttcattaatgcttgttacagcattaaacccgcatatcggatatgaaaatgcagcgaaaattgcgaagcatgctcataaagaagggttaactttaaaagaagcagcattgcaatctggactactaacagaagagcaatttgatgaaattgtcgatccgaaaaaaatgattgctccgaaagagtaa

SEQ ID NO: 16891 - protein, 462 aa, Bacillus thuringiensis serovar konkukian str
MEYRIERDTLGEIKVPADKLWAAQTQRSKENFPIGTEQMPLEIVKAFAILKKSAALSNQKLGKLSEEKAEAIVAAADEVIAGKWNEHFPLVVWQTGSGTQSNMNVNEVIANRGNQILKEKGSDVHIHPNDDVNMSQSSNDTFPTALHVACVIAVENHVLPAITKLKETLAEKVTAFEHIIKIGRTHLQDATPLTLGQEISGWHRMLEKTERMIAESNTYMKELAIGGTAVGTGINAHPKFGEMVSEEISQFTGKQFISAPNKFHALTSHDEVVYTHGALKALAADLMKIANDVRWLASGPRSGLGEIIIPANEPGSSIMPGKVNPTQSEALTMVVAQVMGNDATIGFAASQGNFELNVFKPVIAYNFLQSAHLLADAIVSFNDNCAVGIEADEEVIKENVNRSLMLVTALNPHIGYENAAKIAKHAHKEGLTLKEAALQSGLLTEEQFDEIVDPKKMIAPKE

SEQ ID NO: 16892 - DNA, 1368 bp, Picrophilus torridus DSM 9790
  CDS (1)..(1368)
atgagaacagagcacgatgttataggcagtgttgagcttgatgattctgtttactatggcataaatacatacagggccatgaacaattttaaaatatcaggaataaaggaggatgatgaccatataaaggcaatagcaatggtcaagaaggcagctgcctatggaaaccatagagccgggaagcttaacgatgagctttacagtgcaatagaccaggcgtgtgacctggttatatcaggaaaatacaatgaccagtttgttatagatgtttaccaggcaggtgcaggaacctcatttaacatgaacgcaaacgaggttattgccaatatagcactggaaaaacttggccataaaaagggcgattataagataatacatccaaatgacactgtaaatatgagccagtcaacaaatgatatatacccaacaatgatgcgtgttgcaataatgataaaggctcctgaccttctggaatcaatgaaccagctgataatgtctctgaacaggaagggcgaggaattctcaaagatatacaaaacaggaagaacacacctgcaggacgccgttcgtgttacacttggcgatgagttccgtgcctgggcctatgcccttgcaaaggatatgaaggaaataaaaaatgccctggattacatattagaattaaacataggcggaacggctgttggaaacggcgccaatacacctgatggatacagggattacgccgttgaggcactttcaaatatgttaaaggtgaactttagaacctctggaaacatgatgggtgttatgcagtttatgactgatttttccaggttcatgaactctcttgcgaacactgcaatagaccttggcaagatctctgatgatttaaggcttctatactcgggacctggagccggaatccgtgagatactgttgccggcagtgcagcaggggtcatcaataatgcctggaaagataaatccatcaataccggaggcaatgaacatgatatgcaattccgtacttggtgcccagcaggcggtaaacatgtcggcaaaggcagggcagcttgaattaaacgtctttatgccaaatatagattatgagataacaagatcaataacaatacttaaaaatggcatggacatgctcagggaaagggccatagatggtataaaaccggatttaaagcactgcaggatgcatctgcagaacagctttggatctgccgcattgcttaatccataccttggctatgataccgttgctgcaatagttgaaagggcccttgaaaccggcgagaatatcagggatcttgtcctgcaaacaggaaaaataactgaggagcagtacgataaaatattctcgttcatgaatgaatga

SEQ ID NO: 16893 - protein, 455 aa, Picrophilus torridus DSM 9790
MRTEHDVIGSVELDDSVYYGINTYRAMNNFKISGIKEDDDHIKAIAMVKKAAAYGNHRAGKLNDELYSAIDQACDLVISGKYNDQFVIDVYQAGAGTSFNMNANEVIANIALEKLGHKKGDYKIIHPNDTVNMSQSTNDIYPTMMRVAIMIKAPDLLESMNQLIMSLNRKGEEFSKIYKTGRTHLQDAVRVTLGDEFRAWAYALAKDMKEIKNALDYILELNIGGTAVGNGANTPDGYRDYAVEALSNMLKVNFRTSGNMMGVMQFMTDFSRFMNSLANTAIDLGKISDDLRLLYSGPGAGIREILLPAVQQGSSIMPGKINPSIPEAMNMICNSVLGAQQAVNMSAKAGQLELNVFMPNIDYEITRSITILKNGMDMLRERAIDGIKPDLKHCRMHLQNSFGSAALLNPYLGYDTVAAIVERALETGENIRDLVLQTGKITEEQYDKIFSFMNE

SEQ ID NO: 16894 - DNA, 1392 bp, Parachlamydia sp
  CDS (1)..(1392)
atggactatcgaacagaaaaagacaccttaggagaagttagagtttctgcagactgttattatggagctcaaacgaagcgttcctacgataatttttcgattggaatagaaaaaatgcctaaggaagtaattcatgcgcttgctctaatcaagaaagcggccgccttaactaacgaacagcttggtttattaccaaaaaataaacaactcgtgatttgtgaagtttgcgacgaaattttatctggctgcttagatgatcaatttccgttatctgtttggcagacagggtctggaacgcaaacaaacatgaacctcaatgaagtgattagtaatagggccattgaaaagctgggtggggtgcttggttctaaatatccgatccatcccaatgatgatgtcaacttatctcaatcgtctaatgatgtgtttccttcagccatgcatattgcggtgatgtttgatatatctaagaagttgttaccaagtttaagagaactaaaagaaactttagaagcgaaagttgaagcttttaaagatattgtaaaaattgggcgtacgcatttaatggatgcgacccctttaacacttggacaagaattttcggggtatgtcagccaaatagagcatggaatacaagctctaaaaaatacgtttgcgcatctttctgaattggccttgggagcaactgctgtgggaacgggaatgaatacgcatcccaactacgcaaaattagtggctgaaaaaattagtgagttgtccggatttaattttgtttctgccaggaataaatttgagtcgctcgcgactaatgacgctcttgtagaagttagcggggctttaaaaagggtggccgtttcagtgtttaaaattgccaatgatattcggtggctttcttcaggccctagatgtgccataggagaaatcgttattcctgctaatgaaccaggctcatcgattatgccaggaaaagttaatcctacacaaagtgaagccttaatgatgattgccattcaagtaatggggaatgatgggatcattggttttgcaggttcgcaaggcaatctagaattgaatgtttttcgccctcttattatttataacttaattcaatctattcgattattgagcgatgctatttctaattttaaccaaaaatgtgttgtcggaatagaggctaaccaaacaagaattgcagaacatctgaatcgttccttaatgttagcaactgctcttaatcatgcaattggttatgatcgtgcaagtcaaattgtaaaaaaagcatacttagaaaatataacattaaaagaagctgcactagctttagcctttttaaccgaagatgaatttgatcagattatggatcctaaaaaaatgattgggccaatgacttaa

SEQ ID NO: 16895 - protein, 463 aa, Parachlamydia sp
MDYRTEKDTLGEVRVSADCYYGAQTKRSYDNFSIGIEKMPKEVIHALALIKKAAALTNEQLGLLPKNKQLVICEVCDEILSGCLDDQFPLSVWQTGSGTQTNMNLNEVISNRAIEKLGGVLGSKYPIHPNDDVNLSQSSNDVFPSAMHIAVMFDISKKLLPSLRELKETLEAKVEAFKDIVKIGRTHLMDATPLTLGQEFSGYVSQIEHGIQALKNTFAHLSELALGATAVGTGMNTHPNYAKLVAEKISELSGFNFVSARNKFESLATNDALVEVSGALKRVAVSVFKIANDIRWLSSGPRCAIGEIVIPANEPGSSIMPGKVNPTQSEALMMIAIQVMGNDGIIGFAGSQGNLELNVFRPLIIYNLIQSIRLLSDAISNFNQKCVVGIEANQTRIAEHLNRSLMLATALNHAIGYDRASQIVKKAYLENITLKEAALALAFLTEDEFDQIMDPKKMIGPMT

SEQ ID NO: 16896 - DNA, 1401 bp, Bdellovibrio bacteriovorus
  CDS (1)..(1401)
atgatggcagagggcggattcagaatcgaaaaagacaccatgggtgaagtgaaagttcccgcagacaagttctggggagcacagacccaaaggtccacagaaaacttccgcatcgggggcgatcgtttcccgcgcgagatgatccgggccttgggtgtcttgaagaagtccgccgctatcaccaacgaaaaactgggtctgcttgatccgaaaaaagcctcggtcatcgtgaaagccgccgatgaagtgatcgtcggcaaactcgacgcccatttcccgctggtggtgtggcagacgggttcaggcacacagaccaacatgaatgccaacgaagttatcgccaatcgtgcgatggacatgatgggcatcaaacttcccagcaaggaagttcatcccaatgatgatgtgaacaagggccagtcttcgaatgacactttccccaccgccatgcacattgctgtgggcgagcagattcatcatcgcctgattccgatgctggaaaagctgcacaaagctctggaaaacaaacagaaagaatttaaagacatcgtgaaaatcggtcgcacccatttgatggatgcaacccccctgaccctggggcaggagttttccggttacagcacccaggtgaaacactccatccagcgcgtgaaaaacaccttgccgcatctgtacgagctggcattgggcgggacggcggtgggaacgggtttgaacacgcatccgaaatttgcggttgaagccgctgcggaaatcgctcgcgagacggggattgcctttgtttcggctgaaaacaagtttgaagccctggcggcccatgacgctttggtggaagtcagcggggcgctgaactcggtcgcggtgtccctgatgaaaattgcgaacgacatccgcctgctgggttccggcccgcgctgcgggatcggggagcttcatttgcccgaaaatgaaccgggaagctccatcatgccgggcaaagtgaatcccacccagagcgaggctatgaccatggtctgtgcccaggtgatgggaaatcacgtggccgccacaattggcggggcgacggggcattttgagctgaacgtgtttaagcccgtgattgtgttcaatgttctgaattccgtgcgcctgttggcggacgcggcagaatccttcaccgatcactgtgtggtgggcattgaagccaaccgtaaacagattcagaagcatctggagcagtctttgatgctggtgacggcactgaatcctcacattggctatgacaacgcagccaaaattgccaaaactgcccataaaaacggcacaacactgcgcgaagaagccatcaatcttggactgctctctggcgaagaatttgataagatagtaaaaccggaaaacatggtcggccccagccgatag

SEQ ID NO: 16897 - protein, 466 aa, Bdellovibrio bacteriovorus
MMAEGGFRIEKDTMGEVKVPADKFWGAQTQRSTENFRIGGDRFPREMIRALGVLKKSAAITNEKLGLLDPKKASVIVKAADEVIVGKLDAHFPLVVWQTGSGTQTNMNANEVIANRAMDMMGIKLPSKEVHPNDDVNKGQSSNDTFPTAMHIAVGEQIHHRLIPMLEKLHKALENKQKEFKDIVKIGRTHLMDATPLTLGQEFSGYSTQVKHSIQRVKNTLPHLYELALGGTAVGTGLNTHPKFAVEAAAEIARETGIAFVSAENKFEALAAHDALVEVSGALNSVAVSLMKIANDIRLLGSGPRCGIGELHLPENEPGSSIMPGKVNPTQSEAMTMVCAQVMGNHVAATIGGATGHFELNVFKPVIVFNVLNSVRLLADAAESFTDHCVVGIEANRKQIQKHLEQSLMLVTALNPHIGYDNAAKIAKTAHKNGTTLREEAINLGLLSGEEFDKIVKPENMVGPSR

SEQ ID NO: 16898 - DNA, 1434 bp, Rhodopseudomonas palustris
  CDS (1)..(1434)
atgatcatggcccgcacgccccgctctccccgccccgcgcgttctgccgccacgcgaagcgagaccgatagtttcggtccgatcgatgtcgccgccgaccgttactggggcgcgcagaccgagcgttcgcggcaaaacttccgcatcggcaccgagcggatgccgatcggcatcatccgggcgctggcaatcgtgaaactggccgcggccgagaccaacaaggagctcggcctgctcgacaaccgccgcgccggcgccatcgtccgcgccgcccgcgaagtgatcgacggcacccatgacgatcacttcccgttggtggtgtggcagaccggctccggcacccagaccaacatgaacctcaacgaggtaattgctaatcgcgccaacgaactgctcggcggcgagcggggatcgaagaagccggtacatcccaacgatcacgtcaacatgagccagtcgtcgaacgactcgttcccgaccgcgatgcatatcgccgccgcgcaagcgattacggccgacctgatcccagcgctgacgctgctgcacgatgcgttacgcaagaaggagaaggcgttcgccaagatcgtcaagatcggccggactcacacccaggacgccaccccgctgacgctcggccaggaattttccggctacgcggcacagctcgccagcggcatcgcgcggatcaaatcggcgctgaaggagctgtatccgctggcgcagggcggcaccgcggtcggcaccggactgaacacgcatccgaaattcgccaaggcgttcgccaagcgcgccgcggcgattaccaagctgccgttcgtcaccgcgccgaacaaattcgaagcgctcgccgccaacgacgcctacgtgttcgtgcacggcgcactgaacgccgccgccaccgcgctgtttaagatcgccaacgacatccgcctgctcggctccggcccgcgctccgggcttggcgaactgatcctgccggagaacgagcccggctcatcgatcatgcccggcaaggtcaacccgacccagtgcgaggcgatgaccatggtgtgctgccaggtgttcggcaatcagaccaccctcaccgtcgccggcagccagggtcacttcgaactcaacgtctacaagccggtgatggcgcaggcgatgctgcagtcgatcgggctgctcgccgatgccgcacgctcgttcacgaccaactgcgtcgatggcatccgcgccgacgagcagcggatcggcgaactgatgcagcgctcgctgatgctggtgaccgcgctggcgccgagcatcggctacgacaatgccgccaagatcgccaaggcggcgcatcagcgtggtacgaccttgaaggacgaagcggtgcgttcggaactgatcagcgccgccgaattcgaccggctggtgcggccggacaaaatgacgcatccgggctga

SEQ ID NO: 16899 - protein, 477 aa, Rhodopseudomonas palustris
MIMARTPRSPRPARSAATRSETDSFGPIDVAADRYWGAQTERSRQNFRIGTERMPIGIIRALAIVKLAAAETNKELGLLDNRRAGAIVRAAREVIDGTHDDHFPLVVWQTGSGTQTNMNLNEVIANRANELLGGERGSKKPVHPNDHVNMSQSSNDSFPTAMHIAAAQAITADLIPALTLLHDALRKKEKAFAKIVKIGRTHTQDATPLTLGQEFSGYAAQLASGIARIKSALKELYPLAQGGTAVGTGLNTHPKFAKAFAKRAAAITKLPFVTAPNKFEALAANDAYVFVHGALNAAATALFKIANDIRLLGSGPRSGLGELILPENEPGSSIMPGKVNPTQCEAMTMVCCQVFGNQTTLTVAGSQGHFELNVYKPVMAQAMLQSIGLLADAARSFTTNCVDGIRADEQRIGELMQRSLMLVTALAPSIGYDNAAKIAKAAHQRGTTLKDEAVRSELISAAEFDRLVRPDKMTHPG

SEQ ID NO: 16900 - DNA, 1458 bp, Rhodopseudomonas palustris
  CDS (1)..(1458)
atggcgagcgagactgtgacaccgaccctgcgtgacgtgccgatcggcctcacggcgacaggccagcgccgcgaattcgacagcatgggcagcgtcgacgttccggcggatcgttattggggcgcgcagacgcagcgctcgttgcagcatttctcgatcggcggcgaccgcatgccgaaagcggtgtaccacgcctatggctacgtcaagaaagcctgcgcgctggtcaaccacgccgcgggccggctgccggcctggaagaccgaggccatcgtccgcgcagccgacgagacgatctcgggcgcgctggacgatcactacccgctgttcgtttggcagaccggctccggcacccagagcaacatgaacgtcaacgaagtcgtctccaaccgggcgatccagctgctcgggggtacgctcggcacgcagcagccggtcggccccaatgacgacgtcaatatgggtcagtcgtcgaacgacaccttcccgaccgccatgcacatcgcggcggtgacagcgatcgacgatcaggtcgtgccgcggctttccaagctgatcgagattatcgaacagaaagccgacggctggatggacgtggtcaagatcggccgcacccatctggaagacgccgtgccgctgacggtcggccaggaatggcacggctgggccggtcaattgcgcgacgcccgcgatgcgatcgaagccagccgcgccggcctgtatcagctcgcggtcggcggcaccgcggtcggcaccggcctcaacgcccccaagggcttcgctgccgacgttgctgccaggatcgccgagctgaccggcaagccgttcgtcaccgcaccgaacaagtttgccgcgcagggctcgctcgacgcgatggtccgcgcccacggcgcgctgcgcgatctcgcggtggcgctgatgaagatcgccaacgacatgcgctggctcgcttctggtccgcgctgcggcttcggcgaattgctgctgccgagcaacgagcccggctcctcgatcatgcccggcaaggtcaacccgacgcaatgcgaggcgatggtgatgatctgcatccaggtgatgggcaacgacagcgccgtcgccttcgccggcagccagggcaatttcgaactcaacgcgatgcggccggtgatcatcaacaacttcctgcattcggcgcgcatcctcgccgacggctgtgagaagttccggacctattcggtcgagggcaccgagctcaaccgcgatcgtgtcgcgcagtacgtcgaaggcagcgtgatgctggtcaccgcgctgtcaccggtgatcggctatcagaacgccgcgcatatcgccgaagatgcgatcgccaagaatctcacgctgaagcaggcggcactcgcctccggcaaggtcgacgaggcgacgttcgaccgcatcgtccggccgatcgacatggtcggcagcggtcttgcgggcgcctga

SEQ ID NO: 16901 - protein, 485 aa, Rhodopseudomonas palustris
MASETVTPTLRDVPIGLTATGQRREFDSMGSVDVPADRYWGAQTQRSLQHFSIGGDRMPKAVYHAYGYVKKACALVNHAAGRLPAWKTEAIVRAADETISGALDDHYPLFVWQTGSGTQSNMNVNEVVSNRAIQLLGGTLGTQQPVGPNDDVNMGQSSNDTFPTAMHIAAVTAIDDQVVPRLSKLIEIIEQKADGWMDVVKIGRTHLEDAVPLTVGQEWHGWAGQLRDARDAIEASRAGLYQLAVGGTAVGTGLNAPKGFAADVAARIAELTGKPFVTAPNKFAAQGSLDAMVRAHGALRDLAVALMKIANDMRWLASGPRCGFGELLLPSNEPGSSIMPGKVNPTQCEAMVMICIQVMGNDSAVAFAGSQGNFELNAMRPVIINNFLHSARILADGCEKFRTYSVEGTELNRDRVAQYVEGSVMLVTALSPVIGYQNAAHIAEDAIAKNLTLKQAALASGKVDEATFDRIVRPIDMVGSGLAGA

SEQ ID NO: 16902 - DNA, 1404 bp, Corynebacterium diphtheriae
  CDS (1)..(1404)
atgactgagcagcagtaccgcatcgagcacgacaccatgggtgaagttaaggtgcctatcgacgccctctggcgcgcacagacccagcgcgctgttgagaacttcccaatttctggccgtggcctcgaagccgcacagatccgcgctatggggctgctcaaggccgcttgtgctcaggttaataaggaccgcggacttctggctccagagcaggctgatgcaatcatcgccgcagctaccgaggtagccgagggcaagcacgacgaccagttccctatcgacgtcttccagaccggttccggcacctcgtcgaacatgaactccaacgaggttatcgcctcgatcgctaaggctaacggcgttgaggttcaccctaacgaccacgtcaacatgggccagtcctccaacgacaccttcccaactgctactcacatcgccgcaactgaggccgccgtcaaggacctcattccaggtctgaaggttctccatgcctccctagccaagaaagctgccgagtgggagaacgttgtaaagtccggccgtacccacctaatggatgccgttccagttaccttgggccaggagttctccggctacgctcgccagattgaggctggcatcgagcgcgtcgaggcatgcttgccacgtcttggcgagctctccatcggcggcaccgctgtaggcaccggcctgaacaccccagcagacttcggccagaaggtcactgccgagctcgttaagctgaccggggtttctgaacttcgcgagtgcgtgaaccactttgaggctcaggcaagccgcgacggcctcgtcgagttctccggcgcaatgcgcaccatcgctgtgtctttgaccaagattgctaacgacatccgctggatgggatccggcccgctgactggcctcggcgagatccacttgccagacctgcagccaggttcttccatcatgccaggcaaggtcaacccagttctgtgcgaaaccgcaactcaggtggcagctcaggttattggtaacgacgcagccatcgctttcggcggcgcacagggcgcattcgagctcaacgtcttcattccaatgatggcccgcaacgtcctcgagtcctctcgcctgttggctaacaccgcccgcgtattcgcagagcgtcttgtcgacggcatccatccaaatgaggagcgcatgcgcaccttggccgagtcttccccatcgatcgttaccccactgaactccgctatcggctatgaagctgcagcgaaggtggcaaagaccgcgctaaaggaaggcaagaccatccgccagactgtcatcgacttgggctttgttgatggcgaaaagctcaccgaggaagagctggacaagcgcctcaacgttctcgcaatggccaacaccgatcgcgacaagtaa

SEQ ID NO: 16903 - protein, 467 aa, Corynebacterium diphtheriae
MTEQQYRIEHDTMGEVKVPIDALWRAQTQRAVENFPISGRGLEAAQIRAMGLLKAACAQVNKDRGLLAPEQADAIIAAATEVAEGKHDDQFPIDVFQTGSGTSSNMNSNEVIASIAKANGVEVHPNDHVNMGQSSNDTFPTATHIAATEAAVKDLIPGLKVLHASLAKKAAEWENVVKSGRTHLMDAVPVTLGQEFSGYARQIEAGIERVEACLPRLGELSIGGTAVGTGLNTPADFGQKVTAELVKLTGVSELRECVNHFEAQASRDGLVEFSGAMRTIAVSLTKIANDIRWMGSGPLTGLGEIHLPDLQPGSSIMPGKVNPVLCETATQVAAQVIGNDAAIAFGGAQGAFELNVFIPMMARNVLESSRLLANTARVFAERLVDGIHPNEERMRTLAESSPSIVTPLNSAIGYEAAAKVAKTALKEGKTIRQTVIDLGFVDGEKLTEEELDKRLNVLAMANTDRDK

SEQ ID NO: 16904 - DNA, 1338 bp, Thermoproteus tenax
  CDS (1)..(1338)
atggactttgaagagagggcgaggagggtctatctggacactggaactaagttccagaggcctattatctggagcatggggctcatcaagtacgcggccgcctacgccaacgccgagctgggcctcctgccccggaggctggccgccgccatcatgggggcctccctggaggtaatggagggggtccacgacgctgaggtttatgtggacgtctttcagaccggctctggcacaggtctcaatatgaacatcaacgacgtgattgcgcggagagcctcggagatcgcaggctccagagttcatcctaacgaccacgttaatatgggccagtcctccaacgacgtagtgccgagcgccgtcagaatcgccgcgatcaagacggcggaggacgagctgatgcctgcgttgagcgccttgataggccgcttgagcgagaaatcggccgagttctccaaagtagtcaagcccggcagaacccacttaagagacgccttgcccgtcacgctcggccaagagctgggcgcctatgcggacgctcttgctcacggctgtcgggagctacgagacgtactcgcctatgtcggagagataccgctggggggcactgccgtcggcacaggtttcgggacgcatccccgcttcagacgtctggctattgacgccataaacaagacctcgggcctgcggctctccgaggggaacacgttcagaggaatgaggctcttgaccgatgtattgtatctatccgcagcgctccggaacatcgcggtagagctcatgagactagcgcaagacgtaagactcatgttctccggtcctactgcgggcctcgccgagatcgacctcccctcgcaggctgaagtgccagggagctctatgatgcccggcaaaataaacccagtcacggccgaggccgttatgttggccgcggcccagatcgtcggactggaccacgcgaaccaagccgccgccggcctaggcgagtttgagctcgccatgggcatcccgttgatagggtacaacgtagtggcccagattaacctcctatctgaagcatcgggaaagctctcagagctcgtaatagccgatatgaagccgcggagagaccgcttgagggacctcgcagagaggtcgcccgcgttggccacagctctggcgccagcgttgggatacgagggggtctcccaggttgtaaggaagatttccgagggcaaatccatcagagtggccttagaggaggtgggccgcccggatctggcgcaggagatccccgacgtcgataatatggcgcaggctccggaggcggagaggcggatcgattgtgatagctacaaatag

SEQ ID NO: 16905 - protein, 445 aa, Thermoproteus tenax
MDFEERARRVYLDTGTKFQRPIIWSMGLIKYAAAYANAELGLLPRRLAAAIMGASLEVMEGVHDAEVYVDVFQTGSGTGLNMNINDVIARRASEIAGSRVHPNDHVNMGQSSNDVVPSAVRIAAIKTAEDELMPALSALIGRLSEKSAEFSKVVKPGRTHLRDALPVTLGQELGAYADALAHGCRELRDVLAYVGEIPLGGTAVGTGFGTHPRFRRLAIDAINKTSGLRLSEGNTFRGMRLLTDVLYLSAALRNIAVELMRLAQDVRLMFSGPTAGLAEIDLPSQAEVPGSSMMPGKINPVTAEAVMLAAAQIVGLDHANQAAAGLGEFELAMGIPLIGYNVVAQINLLSEASGKLSELVIADMKPRRDRLRDLAERSPALATALAPALGYEGVSQVVRKISEGKSIRVALEEVGRPDLAQEIPDVDNMAQAPEAERRIDCDSYK

SEQ ID NO: 16906 - DNA, 1368 bp, Listeria monocytogenes str
  CDS (1)..(1368)
atggaacgaatagagcgagatacgcttggagaaatttctgtagatgcgacgaaatattggggagcgcaaacagaacgaagtaaaaggaactttgctattggtgataatcctatgccgatagaaattatatatgcttttgctcaattaaagaaagccactgcaaaagtaaacgcagcagaaggaaaactatccgaagaaaaagcgatagcgattggccaggtttgtgatcaaatcattcaaggagaactagatgagcattttcctttagtcgtttggcaaaccggaagcggaacgcagagcaacatgaatgtcaatgaagttatcgcacatgttgccaacttaactttaggcgaaggacaaattcatccgaatgatgatgtcaacatgtcgcaaagctcgaacgacacatttccaacagcgatgcatatcgctgcatacggggctttagtaacaaaacttttacctgaaataactaaaatggaagctgttttggcagagaagaaaagtaaatacatgcatctcgttaaaattggcagaacacatttgcaagacgcaaccccattaacacttggccaagaaattagtggctgggaagcatgtcttacaaataataaaaactatcttgaaacaagtatgaaagcaattttgccacttgcgattggtgggacggcagttggaactggcttaaatgcctcacgtgattttggtgataaggttgccgaagaattgatgaaacaaacgggatatccttttacttctgattccaataagtattttgctctaactagtcatagtccgattaattttgttcatggatccattcgtagccttgcttcggatctaatgaaaattgctaatgatatccgtttattagcaagtggaccacgtagcggcataggtgagttaacgatcccagttaatgaaccaggaagctccattatgccaggaaaagtaaatcctactcaatgtgaagcaatgacgatggtagcggctcaagtcatgggaaatgatgtgacaattaatgttgctgccagccaaggaaactttgaactcaatgtctacaagccagttatcatttttaatttcttagaatctgtcaaactgctttcagatagcatgcgttcgttccgattgcattgtttggaaggactcactgcgaatgaaaaagttattgaaacaaaagtaaatgactccctaatgcttgtgacagcattgaatccgcatatcggctatgaaaaagctgccaaaattgccaagctggcttttgatgaaaatacgacattaaaagaagcggcaatcaaaaccggttttgtgacagaaaagcaatttgatttatggattgatccgttaaaaatgactaatttgtaa

SEQ ID NO: 16907 - protein, 455 aa, Listeria monocytogenes str
MERIERDTLGEISVDATKYWGAQTERSKRNFAIGDNPMPIEIIYAFAQLKKATAKVNAAEGKLSEEKAIAIGQVCDQIIQGELDEHFPLVVWQTGSGTQSNMNVNEVIAHVANLTLGEGQIHPNDDVNMSQSSNDTFPTAMHIAAYGALVTKLLPEITKMEAVLAEKKSKYMHLVKIGRTHLQDATPLTLGQEISGWEACLTNNKNYLETSMKAILPLAIGGTAVGTGLNASRDFGDKVAEELMKQTGYPFTSDSNKYFALTSHSPINFVHGSIRSLASDLMKIANDIRLLASGPRSGIGELTIPVNEPGSSIMPGKVNPTQCEAMTMVAAQVMGNDVTINVAASQGNFELNVYKPVIIFNFLESVKLLSDSMRSFRLHCLEGLTANEKVIETKVNDSLMLVTALNPHIGYEKAAKIAKLAFDENTTLKEAAIKTGFVTEKQFDLWIDPLKMTNL

SEQ ID NO: 16908 - DNA, 1407 bp, Desulfovibrio vulgaris
  CDS (1)..(1407)
atgatgacaccggccgtacgcatcgaacatgacagcatgggggctgtggaggttcccgccgaccgctactggggggcccagacgcagcgcgcactggagcatttccgcatcggcacggaacggatgccgcaggagatggtgcaggcgctagggctcatcaagagggcggcggccgagaccaatgccgcgttggagctcctgccccggcagactgcggacgccgtggcgcgtgccgccaccgaggtggcgtccggtgcactgcccaaccattttcccctctgtgtgtggcagacaggtagcggcacccagaccaacatgaatgtcaacgaggtggtggccaaccgtgcatgtgaactgctgggcggtgtgcgtggcgaccggaaactcgtgcaccccaacgaccacgtcaacctctgccagtcgtccaacgatgtctttcctgcggccatgcacatcgcagcggcgctgggcctgcgcagcatgctgctgccctcgcttcaagcgctggaggccgaactggaggcacgggcacacgagttcgcgggtctggtgaaggtgggccgaacccacttgcaggacgcggttcccctcactctggggcaggaattctcggggtatgcggctcagcttgcgttgtgccgccgtcaactggagggcatgatgcccctcttgtgcgccctcgcgctggggggcactgccgtgggcaccgggctcaatgcccatcccgagttcgcgcggcgtgccgtggcgcgtctggcggggtacaccggcctgccgttcctgccagtggacaatcctttcgccgctcttgcggggcacgaggcccttgtggcctatagcggtgccctgcgtacgctggcagtggcccttttcaaggtgggcaacgacatccggttgctggcgtccggcccgcgctgcggtatcggtgaactggaactgcctgccaacgaacccggttcttccatcatgcccggcaaggtgaaccccacccagtgcgaggccctgaccatggtggcggtgcaggtcatgggtctggacaacgccgtgggcatcgccggttcgcaagggcatctcgaactcaacgtgttcaagccactcatcgcgagaaatgtgctcgaatcggcgcgtctgctggccgacagcatgcgttcattccgtatgcatgcggtgcgggggctgcgggcggtgcccgaacgcatcgcctcgcatgtcgaccggtcgctcatgctcgtcacggccctgtcgcggcatgtgggctatgaccgggcggcagaggtcgcccatcttgcccatgccgagggactgacgctacgggaggcgtgcctgcgccttggcctcatggacggcgaagccttcgacagggccgtcgaccctgtccggatggcgcacccgcacgacatgggctga

SEQ ID NO: 16909 - protein, 468 aa, Desulfovibrio vulgaris
MMTPAVRIEHDSMGAVEVPADRYWGAQTQRALEHFRIGTERMPQEMVQALGLIKRAAAETNAALELLPRQTADAVARAATEVASGALPNHFPLCVWQTGSGTQTNMNVNEVVANRACELLGGVRGDRKLVHPNDHVNLCQSSNDVFPAAMHIAAALGLRSMLLPSLQALEAELEARAHEFAGLVKVGRTHLQDAVPLTLGQEFSGYAAQLALCRRQLEGMMPLLCALALGGTAVGTGLNAHPEFARRAVARLAGYTGLPFLPVDNPFAALAGHEALVAYSGALRTLAVALFKVGNDIRLLASGPRCGIGELELPANEPGSSIMPGKVNPTQCEALTMVAVQVMGLDNAVGIAGSQGHLELNVFKPLIARNVLESARLLADSMRSFRMHAVRGLRAVPERIASHVDRSLMLVTALSRHVGYDRAAEVAHLAHAEGLTLREACLRLGLMDGEAFDRAVDPVRMAHPHDMG

SEQ ID NO: 16910 - DNA, 1389 bp, Bacillus cereus
  CDS (1)..(1389)
atggagtacagaattgaaagagacacattaggagaaattaaagttccagctgataaattatgggcagcacaaacacaacgtagtaaagaaaactttccgattggcacagagcaaatgccgcttgaaattgtaaaagcatttgccattttaaagaagagtgcagcacttactaataaaaaattaggaaagttatcagaagaaaaagcagaagcaattgtgacagcagctgacgaagtgattgcagggaaatggaatgaacattttccacttgtcgtatggcaaacaggtagtggtactcagtcaaatatgaatgtgaatgaagtaattgcaaaccgagggaatcaaattttgaaagagaagggatttgacgtacatattcatccgaatgatgatgtgaacatgtctcaaagttcaaatgatactttcccaactgcgcttcatgtagcatgtgtactcgcagtagaaaatcacgtgttaccagcaattacgaaattaaaagaaacgttagcagaaaaagtaaaagcatttgaaaatattataaaaattggtcgtacacatttacaagatgcgacaccgttaacattaggacaagaaattagtggatggcaccgtatgcttgaaaaaacagagcgtatgattgcagagagcaatacatatatgaaagagcttgcgattggtggtactgcagttggaacaggtataaacgcccatcctaaatttggtgagatggtatctgaggaaattagccaatttacaggtaagcaatttatttctgcaccaaataaattccatgcattaacgagtcatgatgaagttgtatatacacatggggcattaaaagcattagcagcggatttaatgaagatcgctaacgatgtgcgctggctggcaagtggtccacgtagtgggctaggagaaattattattccagcaaatgagccaggaagctctattatgccaggaaaagtaaatccaacgcaaagtgaagcgttaacgatggttgtagcacaagtgatgggaaatgacgcaacaattggatttgcagcgagccaaggcaattttgagttaaatgtatttaaacctgttattgcatataacttcttacaatctgctcacttattagcagatgcaattgtttcatttaatgataattgtgcagttggtattgaagcagatgaagaagtcattaaagagaatgtgaatcgttcattaatgcttgttacagcattaaacccgcatatcggatatgaaaatgcagcgaaaattgcgaagcatgctcataaagaagggctaactttaaaagaagcagcgttgcaatctggactactaacagaagtacaatttgatgaaattgtcgatccgaaaaaaatgattgctccgaaagagtaa

SEQ ID NO: 16911 - protein, 462 aa, Bacillus cereus
MEYRIERDTLGEIKVPADKLWAAQTQRSKENFPIGTEQMPLEIVKAFAILKKSAALTNKKLGKLSEEKAEAIVTAADEVIAGKWNEHFPLVVWQTGSGTQSNMNVNEVIANRGNQILKEKGFDVHIHPNDDVNMSQSSNDTFPTALHVACVLAVENHVLPAITKLKETLAEKVKAFENIIKIGRTHLQDATPLTLGQEISGWHRMLEKTERMIAESNTYMKELAIGGTAVGTGINAHPKFGEMVSEEISQFTGKQFISAPNKFHALTSHDEVVYTHGALKALAADLMKIANDVRWLASGPRSGLGEIIIPANEPGSSIMPGKVNPTQSEALTMVVAQVMGNDATIGFAASQGNFELNVFKPVIAYNFLQSAHLLADAIVSFNDNCAVGIEADEEVIKENVNRSLMLVTALNPHIGYENAAKIAKHAHKEGLTLKEAALQSGLLTEVQFDEIVDPKKMIAPKE

SEQ ID NO: 16912 - DNA, 1395 bp, Wolbachia pipientis wMel
  CDS (1)..(1395)
atggatagaaagacgagaatagaatcagacagcttaggggaagtaaaagtaccaagtgaacattactggggagcacagactcagcgttctttagaaaattttaagattggcacagaaaaaatgccagagcctctgattaaagcattagcaatagtaaaacttgcagcagcgcgtgttaatatgaaacatggtgttatagatgatagggtaggggacgcaatttgcacagccgcgagggaagtaatagatggcaaatttaataatgaatttccgcttgttgtttggcaaaccggatccggaacgcagactaatatgaatatgaatgaagtgatcagcaatcgtgcaatagagattttaggtggtaatttgggtagtaaatctccaatacatccaaatgatcatgtgaattatggtcagtcgtcaaatgacacctttccaacagcaatgcatatagcagcagcagagcaaataaactgcttgcttattccaaatcttgaaaaattgcataaggtgctggataataaggttcaggaatttaaagatataataaaagtaggacgtactcatctgcaagatgcaacgcccctaacactaggacaggagttttctggctatgcagcccagattaaaaaggggatagagagagtaaaatcaactttaagtggtatatacgagcttgcacaaggtggcactgcggttggcacgggactcaatactaaaaagggttttgctgaagattttgcaaagcaagttgcaggaattactaaccttccatttacttcagcaggcaataaatttgaagcgctagcagcaaatgatgctttagttgagctcagtggaacactcaatacagtagcagtcagtttaatgaaaattgcaaatgatataaggttgcttggttctggtccaagatgcggaattggggaaataatgttaccggaaaatgagcctggttcttcaattatgccaggtaaagtgaatccaactcagtgtgaagcggtgactatggtatgcactcaagttatgggaaatcatgttgctgtaaccattagtggttcaaacggtcattttgaattgaatgtgtttaagccagtgataatttacaatgttttgcagtctataagacttttagctgacgcaagtttaaattttacagaaaaatgtgtagttggtattaaagcaaatgaagagaggataaaagatttactgaatcagtcgttgatgttggtcactatattaaatacgcatatagggtacgacaatgcagcaaaaatagcgaagcttgcttataaagaaaatatcactctaaaggaagcagcagcaaaacttcaactgctcactgaggaagagtttgaaaggatagtgaaaccagaagaaatggtaaattatttgtaa

SEQ ID NO: 16913 - protein, 464 aa, Wolbachia pipientis wMel
MDRKTRIESDSLGEVKVPSEHYWGAQTQRSLENFKIGTEKMPEPLIKALAIVKLAAARVNMKHGVIDDRVGDAICTAAREVIDGKFNNEFPLVVWQTGSGTQTNMNMNEVISNRAIEILGGNLGSKSPIHPNDHVNYGQSSNDTFPTAMHIAAAEQINCLLIPNLEKLHKVLDNKVQEFKDIIKVGRTHLQDATPLTLGQEFSGYAAQIKKGIERVKSTLSGIYELAQGGTAVGTGLNTKKGFAEDFAKQVAGITNLPFTSAGNKFEALAANDALVELSGTLNTVAVSLMKIANDIRLLGSGPRCGIGEIMLPENEPGSSIMPGKVNPTQCEAVTMVCTQVMGNHVAVTISGSNGHFELNVFKPVIIYNVLQSIRLLADASLNFTEKCVVGIKANEERIKDLLNQSLMLVTILNTHIGYDNAAKIAKLAYKENITLKEAAAKLQLLTEEEFERIVKPEEMVNYL

SEQ ID NO: 16914 - DNA, 1413 bp, Mycobacterium paratuberculosis
  CDS (1)..(1413)
atggccactgacgacggcgacaccgactaccgcatcgagcgcgacaccatgggcgaggtccgggtacccgcaaaagcgttgtggcgcgcgcaaacccagcgcgcggtcgagaacttcccgatctcgggccggggcctggaacgcacccagatccgcgccctgggcctgctgaagggcgcctgcgcgcaggtcaacaaggatctggggctgctggcgccggagaaggccgacgcgatcatcgccgcggccgccgagatcgccgacggtcgccacgacgaccagtttcccatcgacgtcttccagaccggctcgggcaccagctcgaacatgaacaccaacgaggtgatcgcgtccatcgcggccgccaacggggtgaccgtgcatcctaacgacgacgtcaacatgtcgcagtcgtcgaacgacaccttccccaccgcaacccacatcgcggccacggaagccgcagtgcgccatctgattccggcgctgcaggtgctgcacgacgccctggcgagcaaggcccgcgagtggcacaccgtggtcaagtcgggccgcacccacctgatggacgccgtgccggtgacactcggccaggagttcagcggctacgcccgccagatcgaggccggcatcgaacgggtgcgggccacgctgccccggctgggtgagctggcgatcggcgggaccgcggtgggcaccggcctcaacgctcccgacggcttcggcgccaaggtggtcgagacgctgatcgcctccaccggattgagcgaattgcgcacggcgacaaactcgttcgaggcccaggcggcgcgcgacgggctggtcgaggcctccggcgcgctgcgcaccatcgcggtgtcgctgaccaagatcgccaacgacatccgctggatgggctcggggccgctgaccggcctggccgagatcgcccttcccgatctgcagccgggcagctcgatcatgccgggcaaggttaatccggttatccccgaagcggttacgcaggtcgccgcgcaggtgatcggcaacgacgcggcggtggccgtcggcggcttgtcgggcgccttcgagctcaacgtgtacatcccgatgatggcccgcaacatcctggagtcgttcaagctgctgaccaacgtgtcgaggctgttcgccgagcgctgcatcagcgggctgagcgccaacgtggagcacctgcgcgagctcgccgaatcctcaccgtccatcgtgacgccgctgaactcggcgatcggctacgaggaggcggcggcggtggccaagcaggcgctcaaggagcgcaagacgattcggcagaccgtcatcgaccgcgggctgatcggcgacaagctgtcgctcgaggagctcgaccgccggctcgacgtgctggccatggccaaggtcaagccgcaggactga

SEQ ID NO: 16915 - protein, 470 aa, Mycobacterium paratuberculosis
MATDDGDTDYRIERDTMGEVRVPAKALWRAQTQRAVENFPISGRGLERTQIRALGLLKGACAQVNKDLGLLAPEKADAIIAAAAEIADGRHDDQFPIDVFQTGSGTSSNMNTNEVIASIAAANGVTVHPNDDVNMSQSSNDTFPTATHIAATEAAVRHLIPALQVLHDALASKAREWHTVVKSGRTHLMDAVPVTLGQEFSGYARQIEAGIERVRATLPRLGELAIGGTAVGTGLNAPDGFGAKVVETLIASTGLSELRTATNSFEAQAARDGLVEASGALRTIAVSLTKIANDIRWMGSGPLTGLAEIALPDLQPGSSIMPGKVNPVIPEAVTQVAAQVIGNDAAVAVGGLSGAFELNVYIPMMARNILESFKLLTNVSRLFAERCISGLSANVEHLRELAESSPSIVTPLNSAIGYEEAAAVAKQALKERKTIRQTVIDRGLIGDKLSLEELDRRLDVLAMAKVKPQD

SEQ ID NO: 16916 - DNA, 1407 bp, Lactobacillus johnsonii
  CDS (1)..(1407)
atggtgaaaaaaggttatcgtgttgaaagtgatacattaggcccagtagaaattcctaaaaaggcattgtggggtccacaaacacaaagaagtaaggataatttccatactggagcgttaatgccaattggtattattcgtgcgcttcttcaaataaagctagctgctgctcaagctaatattgaagcaggaactgaaacagaagaaaaaggacgtgccattattgaagcaattcatcaactacttgatttaaacaatgaagaattgcaaccatattttccattgcatgtctatcaaactggatcaggtacccaaactaatatgaatgttaatgaagtggtggctaatcttgctaataaaaatcatcccggtttagatattttacctaatgatgatgtgaacatgggacaatcatcaaatgatacttttccaactgcaatgaatttagttgcaacacaagcgttagatgacttaaaaccttctattaaacacttgattaaagaactaaaagtgaaacaagatgagtattggacaacggttaaagtaggaagaacccacttgcaagatgcggttccattgacttttggtcaggaactatcaggctatatttctgctcttaatcatgatttatcctacattaacgagttagaagaaacactttatgaattaccaattggaggaactgcggttggcactggacttaatgcagctcctggtatggcagaagatatcgctgagcgtttatcaagaaagtatggacataattttaaagttgatacaaataaattctttggtttagcaaatcactcaggcttaaatgttgtgcatggcgctttaaaagctttggcagctgatatgttcaaaattgctcaagatattcgtttcttaggatctggcccaagagctggtttaggagaacttaatttacctgcaaacgaacctggttcatcaattatgccaggtaaagtaaatccgactcaagcagaagctgttaccatggcatgtttgagagtctttggaaatgatacaactattactatggctgcatctcaaggaaactttgaaatgaatgtctttaagccagtgatgattgcagcatttttagagtctgccaatgttttatctggaactatttctggctttgcagataagatgattcatggtatgactgttaataaagaaagaatggctaaggatgtagcaaattcattaatgacagttactgcactttcaccacatattggttaccatgaagctgctactattgcacagactgcagctaaaaataatacgactttgcgtacagcggctttaaagagcggcttagttactaaagaacaatatgataagtggatgaaaccaattaccatgactaatgcaatgaatactaagccaattgatgattag

SEQ ID NO: 16917 - protein, 468 aa, Lactobacillus johnsonii
MVKKGYRVESDTLGPVEIPKKALWGPQTQRSKDNFHTGALMPIGIIRALLQIKLAAAQANIEAGTETEEKGRAIIEAIHQLLDLNNEELQPYFPLHVYQTGSGTQTNMNVNEVVANLANKNHPGLDILPNDDVNMGQSSNDTFPTAMNLVATQALDDLKPSIKHLIKELKVKQDEYWTTVKVGRTHLQDAVPLTFGQELSGYISALNHDLSYINELEETLYELPIGGTAVGTGLNAAPGMAEDIAERLSRKYGHNFKVDTNKFFGLANHSGLNVVHGALKALAADMFKIAQDIRFLGSGPRAGLGELNLPANEPGSSIMPGKVNPTQAEAVTMACLRVFGNDTTITMAASQGNFEMNVFKPVMIAAFLESANVLSGTISGFADKMIHGMTVNKERMAKDVANSLMTVTALSPHIGYHEAATIAQTAAKNNTTLRTAALKSGLVTKEQYDKWMKPITMTNAMNTKPIDD

SEQ ID NO: 16918 - DNA, 1467 bp, Ashbya gossypii
  CDS (1)..(1467)
atgctcagactaagcagaggttgtgtaggaagcagcgcagcgcgtaggttgatgtcgacagcaggagcgccacagcagttcagggtcgagacggacgccttcggggagatccgggtgccagcagacaagtactggggcgcgcagacacagcggtcgctggagaacttccggatcggcggagcgcgcgagcgcatgccggagccggtggtgcgcgcgttcggcgtgctcaagaagtctgcggcggtggtcaacgagcagctgggcacgctggagccgggcattgcgaaggcgatccagcaggcggcggacgaggtggcccagggccagctgatggagcacttcccgctggtggtgttccagaccgggtcgggcacgcagagcaacatgaacgccaacgaggtgatctcgaaccgcgcgattgagctgctgggcggagagctgggcagcaagcaggtgcaccccaacaaccactgcaaccaggcgcagtcgtcgaacgacacgttcccgtcggtgatgcacatcgcggcggtgacggagatcacgcgctcgctgctgccggagctggaggcgctgcgcgtgtcgttccagcgcaagacggacgagtttgcgcacatcgtcaagatcgggcgcacgcacctgcaggacgcgacgccgctgacgctgggccaggagttcagcggctacacacagcagatcgccaacggcatcgcgcgcgtcgagcacgcgcaggagagcctgcgcttcctcgcgcagggcggcaccgccgtgggcacgggcctcaacacgcgccgcggcttcgcggagcagatcgcggcccaggtgtcccgcgagaccggcctcgagttccgcaccgcgcccaacaagttcgaggcgctggccgcgcacgacgccgtcgtcgaggcctccggcgcgctcaacacgcttgcctgctcgctgttcaagatcgccaacgacatccgctacctcggctccggcccccgctgcggctacggcgagctctcgctgcccgagaacgagcccggctcctccatcatgcccggcaaggtcaacccgacccagaacgaggccctcacgcaggcctgcgtccaggtcatgggcaacaacgccgccatcaccttcgcgggcgcgtccggccagttcgagctcaacgtcttcaagcccgtcatgatcgccaacctgctcagctccgtccgcctgctcgccgacgccgcgcgctccttccgcgtccactgcgtcgacggcatccaggacaacgaggaccgcatcgccaagctgctgcacgagtcgctgatgctggtcacagctctgaaccccaagatcggctacgacgccgcctccgcggtcgccaagaacgcccacaagaagggcatcaccctccgcgcgtccgcgctcgagcttggcgtcctgaccgacgcggagttcgacgagtgggtcgtccccgagaagatgattggtccccgcgactaa

SEQ ID NO: 16919 - protein, 488 aa, Ashbya gossypii
MLRLSRGCVGSSAARRLMSTAGAPQQFRVETDAFGEIRVPADKYWGAQTQRSLENFRIGGARERMPEPVVRAFGVLKKSAAVVNEQLGTLEPGIAKAIQQAADEVAQGQLMEHFPLVVFQTGSGTQSNMNANEVISNRAIELLGGELGSKQVHPNNHCNQAQSSNDTFPSVMHIAAVTEITRSLLPELEALRVSFQRKTDEFAHIVKIGRTHLQDATPLTLGQEFSGYTQQIANGIARVEHAQESLRFLAQGGTAVGTGLNTRRGFAEQIAAQVSRETGLEFRTAPNKFEALAAHDAVVEASGALNTLACSLFKIANDIRYLGSGPRCGYGELSLPENEPGSSIMPGKVNPTQNEALTQACVQVMGNNAAITFAGASGQFELNVFKPVMIANLLSSVRLLADAARSFRVHCVDGIQDNEDRIAKLLHESLMLVTALNPKIGYDAASAVAKNAHKKGITLRASALELGVLTDAEFDEWVVPEKMIGPRD

SEQ ID NO: 16920 - DNA, 1323 bp, Anopheles gambiae str
  CDS (1)..(1323)
atgaagagcaggactgaacacgacagcttcggcgcaatcgccgtgccggccgatcggctgtggggagcccagacccagcgctccctgcagcacttcgacatctccggcgagcgccagccgatggcgctgatccacgccctggcccgcatcaagtcggcctgtgcccgggtcaaccacgccaacgggctgctgcccgcccgcacggcgcaggccatcatgagtgccgccgacgagatcctgtgcggccagcatgatgaggagttcccgctgcgggtatggcagaccggctcaggcacccagaccaacatgaacctcaacgaggtgctggccaaccgggccagcgagctgcttggcggcctgcgcggcgaggggcggctggtgcaccccaacgacgaggtgaacaagagccagtcgagcaatgacgtcttcccgagtgccatgaacctggcagccgtcacggccatcaccgggcacctgctgcccgccttgacgactctgagtaccaccctggccggcaaggcggcggctttcgacaacatcgtcaagataggccgcacccatctgcaggatgccaccccgctcaccctggggcaggagttctccggctgggtcgcccagctcgagcagggggagcgccatatccgggccgccctgccccatctgtgcgagctggccctcggcggcacagccgtcggcaccggcctcaacaccccgcccggcttcgccgaggcggtggccgccaccctggccgagcagaccggcctgccgctgacgctggctgcctccctcatgaagatcgctaacgacgtgcgctggctggcgagcggcccccgcagtgggctgggggagcttatcatcccggaaaacgagccaggctcatccatcatgcctggcaaggtcaatccgacccagtgcgaggcgctcaccatgctgtgcgcccaggtgatgggcaacgacgtggccatcaacatcggcggcgccagcggcaacttcgagctcaacgtgtttaggccgatgatcgcccacaacttcctgcagagcgtgcggctgctggcggacggcatgcagagcttccaccatcattgcgccgtcggcatcaccccgaaccggccccgcatcgacgagctgctggcccgctccctgatgctggtgacggcgctcaacccccatatcggctatgacaaggcggcagagatcgccaagcgggcccaccatgaggggctcagcctgcgggaggcggccatcgcctccggccacctgacggcgcagcagttcgatgcctgggtggtgccggccgacatggtgggtcggcgcggcggctga

SEQ ID NO: 16921 - protein, 440 aa, Anopheles gambiae str
MKSRTEHDSFGAIAVPADRLWGAQTQRSLQHFDISGERQPMALIHALARIKSACARVNHANGLLPARTAQAIMSAADEILCGQHDEEFPLRVWQTGSGTQTNMNLNEVLANRASELLGGLRGEGRLVHPNDEVNKSQSSNDVFPSAMNLAAVTAITGHLLPALTTLSTTLAGKAAAFDNIVKIGRTHLQDATPLTLGQEFSGWVAQLEQGERHIRAALPHLCELALGGTAVGTGLNTPPGFAEAVAATLAEQTGLPLTLAASLMKIANDVRWLASGPRSGLGELIIPENEPGSSIMPGKVNPTQCEALTMLCAQVMGNDVAINIGGASGNFELNVFRPMIAHNFLQSVRLLADGMQSFHHHCAVGITPNRPRIDELLARSLMLVTALNPHIGYDKAAEIAKRAHHEGLSLREAAIASGHLTAQQFDAWVVPADMVGRRGG

SEQ ID NO: 16922 - DNA, 1602 bp, Neurospora crassa
  CDS (1)..(1602)
atgcttcgatcgatgcgcactgccggccgcctggccaagcctcgggctgctgctgccgctgctagcacatgcctctctggcaccgcccgcgttgcttcaaatgccgccagctcctcctccaaggccgccgtcagcttctccgttgctcccaagaccactgctcgttacttctccagctcctccgccatggccaagaacaccagaatcgagaccgacgcctttggcgagattgaggtcgaggatgacaagtactggggcgcccagacccagcgctctctgagcaacttcaagatcaaccagccccaggaccgcatgccccctcccatcatcaaggctttcggtatcctcaagggcgctgccgccaaggttaacacgcgctacggccttgaccccaagattgccgaggccatccagcaggccgccaaggaggtcgccgacctcaagctcctcgaccacttccccctcgtcgtctggcagaccggctccggcacccagtccaacatgaacgccaacgaggtcatctccaaccgtgccattgagatcctcggcggcgtcaagggctccaagaagcctgtgcaccccaacgaccacgtcaaccgctccgcctcgtccaacgacaccttccctaccgtcatgcacatcgccgccgtcctcgaggtcgagggtgagctcctgcccgcgctcaagtccctccgcgacgccctccaggccaaggtggacgagttcgaggccaagaagatcatcaagatcggccgcacccacttgcaggacgccacccccttgactctcgcccaggagttctctggctacgttgcccagctcgacttcggcatcaagcgcgtcgaggagtccctccccgacctccgcctgctcgcccagggcggcaccgccgtcggcaccggcatcaacacgtacattggcttcgccgaggccattgccgaggaagtcaccaagatgaccggcaccgagttcaagacggcccccaacaagtttgaggctctcgccgcgcacgacgccctcgtccacgctcacggcgccctcaacaccctggctgcctctttgaccaagatcgcccaggacatccgctacctcggctccggcccgcgctgcggcctcggcgagctcaacctgcccgagaacgagcccggctcgtccatcatgccgggcaaggtcaaccccacccagtgcgaggccttgaccatggtctgcgcgcaggtgatgggcaaccacgtggccaccaccattggcggcatgaacggccagttcgagctgaacgtgtacaagcctctgatcatccgcaacttcttgcactctgtccgcctgttggccgatggcatgcgctccttcgagaagaacttggtccacggcttgacggccaacgaggagaggattgccaagatcatgaaggagagtctgatgctggttacttgcttgaaccccaagattggctacgacatggcgtccaaggtggccaagaacgcgcacaagaagggcttgacgctcaagcagtcggcgctcgagctgggtgcgttgacggaggaggagtttgatgccttggtgaagcccgagttgatgattggtcctcagccttacaagggttag

SEQ ID NO: 16923 - protein, 533 aa, Neurospora crassa
MLRSMRTAGRLAKPRAAAAAASTCLSGTARVASNAASSSSKAAVSFSVAPKTTARYFSSSSAMAKNTRIETDAFGEIEVEDDKYWGAQTQRSLSNFKINQPQDRMPPPIIKAFGILKGAAAKVNTRYGLDPKIAEAIQQAAKEVADLKLLDHFPLVVWQTGSGTQSNMNANEVISNRAIEILGGVKGSKKPVHPNDHVNRSASSNDTFPTVMHIAAVLEVEGELLPALKSLRDALQAKVDEFEAKKIIKIGRTHLQDATPLTLAQEFSGYVAQLDFGIKRVEESLPDLRLLAQGGTAVGTGINTYIGFAEAIAEEVTKMTGTEFKTAPNKFEALAAHDALVHAHGALNTLAASLTKIAQDIRYLGSGPRCGLGELNLPENEPGSSIMPGKVNPTQCEALTMVCAQVMGNHVATTIGGMNGQFELNVYKPLIIRNFLHSVRLLADGMRSFEKNLVHGLTANEERIAKIMKESLMLVTCLNPKIGYDMASKVAKNAHKKGLTLKQSALELGALTEEEFDALVKPELMIGPQPYKG

SEQ ID NO: 16924 - DNA, 1632 bp, Rhodopirellula baltica
  CDS (1)..(1632)
atgcagtctgcccacccaactttcggccgccgtgtcttgcgattcgtttcctacgattcgaccgaacgccagatagtagcagaaaccatcgcagagtttgggtttcgggcgtcgttcgcgccgtttcagtggattgctaccatgaccggcatcacggtttttgcttttgacgacccgtttttcctccttgttgatccagctatcgctatgaccgattttcgaaccgaacgcgactcgatgggcgaagtccgcgtgccgcaaaacgcttactacggtgcccagactcaacgtgcggtcgagaactttcctgtcagcggctggcaactcccgccgtcgatgatcgcggcgatgggacgcgtcaaattggcatgcgggatcgccaaccgcgatctcggaaagttgacgggttcgggcaagaacccgcttagcgatggtcaagtcgaatcgatgttgtcggcggccaaggaagtcgccgagggacagttggcggatcagttccccgtggacgtgttccagacgggcagcggcaccagcagcaacatgaacatcaacgaagtgctgtccaatcgcgcgatcgaaatcgatggcggcgaccggatggcggaggaaaagtcgatccaccccaacgatcacatcaacatggggcaatcgaccaacgacaccttcccaaccgcgattcatgttgcggccgcttacgaaatcgaaaatcgattgttgccagcattgcgacgcatgcacgaatcgctgacggaaaaagcccaggcttgggacaagatcatcaagatcggacgcactcacctgatggacgcaacgccgttgcgattgggacaggagtttggcggatttgctcgtcaaattgaattgtcgatcgcccgcgccgaagcggcccgcgacgcggtgctggaattgcccgtcggtggcacggcggttggcagcggtatcaacactcaccctgaatttggtgctcgcgtcgcggccagcttgtcagagcaaaccggcatcgctttcatcgaagcggtcaaccatttcgaaggcaacgcgaaccgcgatggtttggtggattcacacggtggattgaagtgcgtcgctcaaacgttgctcggtctggcgaacaacatccgctggctgggcagcggacctcgttgcggtttttatgaagtcaaactgccgactcgccaaccgggaagctcgatcatgcccggaaaggtcaatccggtgatgtgcgagtcgctgatgcaggtcgccgcccgcgtgatcggcaacgacacttgcatgacggtcagcggaggctgcggcggcaacttccagctcaacatcatgatgcccgtgatggctcacaccatcttggagtccatcgagttgttggccggtggtgtcaccgcgttcatcgatttctgcttggatggcatggaacccaacgaagaagcttgcgaagcctcggtggagcagagcctctccatgtgcaccagtctgaacccgttgatcggatacgaacaagccgctgcgctggccaaggaagcgttcaagtccggtcaaacgattcgcgaactgtgcaaagaaaaagggatcttggccgacgacgttctgaccgaagcgttggatccttggaaaatgaccgagccgcaagcatag

SEQ ID NO: 16925 - protein, 543 aa, Rhodopirellula baltica
MQSAHPTFGRRVLRFVSYDSTERQIVAETIAEFGFRASFAPFQWIATMTGITVFAFDDPFFLLVDPAIAMTDFRTERDSMGEVRVPQNAYYGAQTQRAVENFPVSGWQLPPSMIAAMGRVKLACGIANRDLGKLTGSGKNPLSDGQVESMLSAAKEVAEGQLADQFPVDVFQTGSGTSSNMNINEVLSNRAIEIDGGDRMAEEKSIHPNDHINMGQSTNDTFPTAIHVAAAYEIENRLLPALRRMHESLTEKAQAWDKIIKIGRTHLMDATPLRLGQEFGGFARQIELSIARAEAARDAVLELPVGGTAVGSGINTHPEFGARVAASLSEQTGIAFIEAVNHFEGNANRDGLVDSHGGLKCVAQTLLGLANNIRWLGSGPRCGFYEVKLPTRQPGSSIMPGKVNPVMCESLMQVAARVIGNDTCMTVSGGCGGNFQLNIMMPVMAHTILESIELLAGGVTAFIDFCLDGMEPNEEACEASVEQSLSMCTSLNPLIGYEQAAALAKEAFKSGQTIRELCKEKGILADDVLTEALDPWKMTEPQA

SEQ ID NO: 16926 - DNA, 1440 bp, Helicobacter hepaticus ATCC 51449; identical to SEQ ID NO: 16368
  CDS (1)..(1440)

SEQ ID NO: 16927 - protein, 479 aa, Helicobacter hepaticus ATCC 51449; identical to SEQ ID NO: 16369

SEQ ID NO: 16928 - DNA, 1422 bp, Xylella fastidiosa
  CDS (1)..(1422)
atggagatgcagatgagcaacagtgatcgttacagaattgaacacgacagtatgggtgatctacgggtgccgattgatgcgttgtggggcgcgcagacgcaacgtgctatcgagaactttccgatttccgggcggtcaatgcctcagggatttatccacgcattggggtttatcaaggcggctgcggcgaaggttaacgctgagctggggctgttaccaaagtcaatggccaaggagattgaggccgctgcattggatgtcgctgcgggccgttatgatgcggaatttccagtcgatatttaccagactggctcaggaacctcgtcgaatatgaacgctaatgaggtgattgcgacgctggccatgcgtgccaccaaggggcctatccaccccaacgaccatgtcaaccttggccaaagttctaatgatgtggttccaacagcgattcggatttccgcaacgttggcggttcagggacgattattaccagcgctcaagcatttacgcaaaatgattaacaagcgtgcccgtggtttgggcagtgtggtgaagaccggccgtacccacctgatggatgcgatgccgctgacgttcgctcaagaattcggtgcctggtcggcacaaattgtctctgcagaggcgcgcttgaatgacaccctgaaacggttgcatcggctgccattgggagggacagcaattggtaccggcatcaatacggatccacatttcggccgtaatgcggtgaaggtactgtcagcattgacagggattcactttgagagtgcgaacaataagttcgaaggattggcagcgcaagatgatttggttgagttatccggccagttcaatacgttagcagtggcgttgatgaagattgctaatgatctacgctggatgaacgctggaccgcttgctggcttgggagagattgagttgcccgcgttgcagccgggaagttcgatcatgccaggtaaggtaaacccggtgattccggaagcagtggtgatggtcgcctcgcaagtgattggccatcacactgcagtgaccgtggctgggcagagtggcaattttcagttgaatgtgacgttaccgctgattgcttacaacctattggagtctgcgacgttgcttggaaatgtggtgatgctgttggctgataaagtcatcgttggcctgaaggtgcgtcaggatcgagtgcaggaggtgctggagcggaatccgattttggtgacagcgttgaatccgatcattggctatgagaaagctgcggtgattgctaagcgtgcttataaggagcaccggccagtgcttgaggtcgcctgcgaggagagcaacctaaaccctgtggagttggcgcgcttacttgatccggctgcgttgactgagggtgggattcatgtcgtcgggggaggtggtggataa

SEQ ID NO: 16929 - protein, 473 aa, Xylella fastidiosa
MEMQMSNSDRYRIEHDSMGDLRVPIDALWGAQTQRAIENFPISGRSMPQGFIHALGFIKAAAAKVNAELGLLPKSMAKEIEAAALDVAAGRYDAEFPVDIYQTGSGTSSNMNANEVIATLAMRATKGPIHPNDHVNLGQSSNDVVPTAIRISATLAVQGRLLPALKHLRKMINKRARGLGSVVKTGRTHLMDAMPLTFAQEFGAWSAQIVSAEARLNDTLKRLHRLPLGGTAIGTGINTDPHFGRNAVKVLSALTGIHFESANNKFEGLAAQDDLVELSGQFNTLAVALMKIANDLRWMNAGPLAGLGEIELPALQPGSSIMPGKVNPVIPEAVVMVASQVIGHHTAVTVAGQSGNFQLNVTLPLIAYNLLESATLLGNVVMLLADKVIVGLKVRQDRVQEVLERNPILVTALNPIIGYEKAAVIAKRAYKEHRPVLEVACEESNLNPVELARLLDPAALTEGGIHVVGGGGG

SEQ ID NO: 16930 - DNA, 1386 bp, Vibrio parahaemolyticus
  CDS (1)..(1386)
atgaccaccgaatttcgtatcgaaaccgacagcatgggcgaagtaaaagtcccggcgaatgccttgtatcaagcgcaaactcagcgtgctatcgataacttcgcattcagccagcacaccatgccaagcggtttcatccaagctttggcccacatcaagcaaacggcagcgctgaccaacgcacaactagggttactggaaggtgatattgccaatgcgattgcagacgccgcgcaagccattattgatggccagcatctcgatcagttccctatcgacctgttccaaaccggttctgggacaagctccaacatgaacgccaatgaagtgattgccacgctcgcgtctgaattgcttggcggcaacgtcaccccgaatgaccacgttaacatgggtcaaagcagtaacgatgtggtgccgacggcgattcaagtcagctcagcacttgctattgaacacaagttgttgcctgcactggctcatcttagccaaagcctagaaaccaagaagcaagctttgcaaggtgtggtaaaaacaggccgaactcatttgatggacgccatgccaatcactttcgcgcaagagctgggcggctggcaattccagattgaacacgctaaacaagccattgaacaaacactgccgatggtgaaagcccttgctcaaggcggcactgccgttggcacagggatcaacgccgatccgcgttttgcctctctgtttgcagacaacctcactcagtccactcgagtcacctttacttcaagcgacaatttcttcttcaacctcagcagccaggatgcgatcgtcgcactgtctggacagctcaaaacagcagcagttgcgatcatgaagatcgcaaacgatcttcgctggatgaactctggcccattggctggcttgggtgaaatcgaactgcaaggcttacagccgggttcatcaatcatgccgggcaaagtaaacccggttattcctgaagccgcagccatggcgtcagcgcaagtgattggcaacgatgcaaccatcaccatcgcgggtcagtctggcaacttccagttgaatgttatgctacctgtgattgcgcataatattttggagagcattgagctcgttgcgaacagtgcgaccgcccttgccgataaggcgattgcgacctttgacgttcgacaagataacctcgatattgctttggccaagaatccgattttagtcaccgcactaaacccggtgatcgggtatttgaaagcggcagaagtcgcgaaaaaagcctacaaacaaggacgagccatcattgatgtggccgaagaggaaacggatttaaaccgcgaaacgcttgaaaggctgcttaatccagccaaattgactcaaggtggcgtggctgagtaa

SEQ ID NO: 16931 - protein, 461 aa, Vibrio parahaemolyticus
MTTEFRIETDSMGEVKVPANALYQAQTQRAIDNFAFSQHTMPSGFIQALAHIKQTAALTNAQLGLLEGDIANAIADAAQAIIDGQHLDQFPIDLFQTGSGTSSNMNANEVIATLASELLGGNVTPNDHVNMGQSSNDVVPTAIQVSSALAIEHKLLPALAHLSQSLETKKQALQGVVKTGRTHLMDAMPITFAQELGGWQFQIEHAKQAIEQTLPMVKALAQGGTAVGTGINADPRFASLFADNLTQSTRVTFTSSDNFFFNLSSQDAIVALSGQLKTAAVAIMKIANDLRWMNSGPLAGLGEIELQGLQPGSSIMPGKVNPVIPEAAAMASAQVIGNDATITIAGQSGNFQLNVMLPVIAHNILESIELVANSATALADKAIATFDVRQDNLDIALAKNPILVTALNPVIGYLKAAEVAKKAYKQGRAIIDVAEEETDLNRETLERLLNPAKLTQGGVAE

SEQ ID NO: 16932 - DNA, 1377 bp, Pseudomonas syringae pv
  CDS (1)..(1377)
atgagtaatacccgtatcgaacgcgacagcatgggccaattacaggtcccggccgaggccctttacggcgcgcagactcagcgtgcggtggaaaattttccgatcagccatcagcgtatgcccaggctgttcattcgcgcgctactgctggccaaagcggccgctgcacaggcgaaccttgagctggagcagatcagcgaagggcagagccaggcgattgtcggtgccgtgaaagagctgttggccagcgactacatgactcatttcccggtcgatatcttccagaccggttccggcaccagcaccaacatgaacgccaacgaagtgctcgcaacgctggcaacgcggttactgggcgaagaggtcaaccccaacgatcacgtcaactgcgggcaaagcagcaacgacatcatcccgaccacgattcacgtcagcgccgcgctggcactccatgaacaactgctgccagcgcttgcgcatctggtgcaggtcaccgagcacaaggccgtgcaagtccacgccttcgtcaagaccggccgcacacacctgatggacgccatgcccgtgcgcatgagccaggtgctcaatggctgggcgcagcagattcgcgccaacatcgaacatctgcagggtttgcagcccagcctgcaagcactggctcagggcggcacggcggttggcaccggaatcaatgcgcatcccgagtttgcagcacgcttcagtcgccaattgagcacattgaccggcgtgcagttcgcaccgggcaaggacctttttgcgctgatcggctcgcaagacacagcggtagcagtgtctggtcagctaaaggccacggcggtgtcgctgatgaaaattgccaacgacctgcgctggatgaactccgggccgctggcagggctgggtgagatcgagcttgaggccctgcaaccgggctcgtcgatcatgcccggcaaggtcaacccggtgatccccgaggcgactgcgatggtggccgcgcaggtcatcggcaacgacgcgaccatcaccgtggcggggcagtccggcaactttgagctgaacgtgatgctgccgatcatcgcccagaacctgctcagcagcatcgagctgttggccaacgccagccggcttctggcggacaaggcagttgccagcttcaaggtcaatgaatccaggctccaggaagcgctgtcacgtaacccgattctggtcaccgcgctcaacccgatcatcggttatcagaaggccgccgaaatcgccaaggccgcttacaagcagggtcgcccggtgattgacgtcgctctggagcacaccgatttgcagcgcagcgagctggaagtgttgctcaatcccgaaaaactcaccgctggcggcatctga

SEQ ID NO: 16933 - protein, 458 aa, Pseudomonas syringae pv
MSNTRIERDSMGQLQVPAEALYGAQTQRAVENFPISHQRMPRLFIRALLLAKAAAAQANLELEQISEGQSQAIVGAVKELLASDYMTHFPVDIFQTGSGTSTNMNANEVLATLATRLLGEEVNPNDHVNCGQSSNDIIPTTIHVSAALALHEQLLPALAHLVQVTEHKAVQVHAFVKTGRTHLMDAMPVRMSQVLNGWAQQIRANIEHLQGLQPSLQALAQGGTAVGTGINAHPEFAARFSRQLSTLTGVQFAPGKDLFALIGSQDTAVAVSGQLKATAVSLMKIANDLRWMNSGPLAGLGEIELEALQPGSSIMPGKVNPVIPEATAMVAAQVIGNDATITVAGQSGNFELNVMLPIIAQNLLSSIELLANASRLLADKAVASFKVNESRLQEALSRNPILVTALNPIIGYQKAAEIAKAAYKQGRPVIDVALEHTDLQRSELEVLLNPEKLTAGGI

SEQ ID NO: 16934 - DNA, 1380 bp, Pseudomonas putida
  CDS (1)..(1380)
atgatgagtgatacccgtatcgagcgtgacagcatgggtgagctgcaggtgccggcccaggccctctacggcgcccagacccagcgcgcggtcgacaacttcccgatcagcggccagcgtatgccggcccagttcattcgtgccttgttgctggccaaggccgctgcggccaaggccaacgtcgaactggagcaactgtctgccgggcagggccaggctatcgtcaaggctgtcgagcaattgctggccgaggacttcatccagcacttcccggtggatgtgttccagacaggctctggcaccagttcgaacatgaacgccaatgaggtgatcgccaccttggctacccatgtactgggtgaggcggtcaatgccaatgaccacgtcaactgtggccagagcagcaatgacatcattccgaccaccatccatgtcagcgccgcgttggccctgcacgagcagttgctgccagccctggcgcacctggtacaggtgatcgaggtcaagtcggcacaagtacatcaatacgtgaagaccggtcgtactcacctgatggacgcgatgcccgtgcgcatgagccaggtgctggatggctgggctgcgcagatcaatgctgccaagtcgcacatcgaaggtgtgctgccgcacttgcaggcgctggcccagggcggaaccgccgtgggtaccggcatcaacgcccatccgcagttcgctgtcggtttcgctcgccagctcagtggcctgaccaaggtcgagttcacgcccggccagaacctgttcgcactgatcggctcgcaggacactgccgtggctttgtctggccagctcaagaccaccgctgtggcgttgatgaaaatcgccaacgatctgcgctggatgaactccggcccgctggccggtctgggcgaaatcgagctgcaagctctgcagccgggctcttcgatcatgccaggcaaggtcaacccggtgatcccggaggccactgccatggtcgccgcccaagtgattggcaacgacgcgaccatcgccgtcgcaggtcaagccggtaacttcgagctgaacgtgatgctgccggtgatcgcccgcaacctgctggaaagcatcgagctgatggccaatgtcagccgcttgctggccgacaaagccatcgccagcttcaaggtcaacgaagacaaactcaaggaagccctcgcgcgcaacccgattctggtcacggcgttgaatccgatcatcggctacctcaaggccgccgaaatcgccaagaccgcctacaagcagggtcgtccaatcatcgatgtggcgctggagcacaccgacctgtcccgcgaccagcttgaagcgctgctggacccggaaaaactcaccgccggcggtatctga

SEQ ID NO: 16935 - protein, 459 aa, Pseudomonas putida
MMSDTRIERDSMGELQVPAQALYGAQTQRAVDNFPISGQRMPAQFIRALLLAKAAAAKANVELEQLSAGQGQAIVKAVEQLLAEDFIQHFPVDVFQTGSGTSSNMNANEVIATLATHVLGEAVNANDHVNCGQSSNDIIPTTIHVSAALALHEQLLPALAHLVQVIEVKSAQVHQYVKTGRTHLMDAMPVRMSQVLDGWAAQINAAKSHIEGVLPHLQALAQGGTAVGTGINAHPQFAVGFARQLSGLTKVEFTPGQNLFALIGSQDTAVALSGQLKTTAVALMKIANDLRWMNSGPLAGLGEIELQALQPGSSIMPGKVNPVIPEATAMVAAQVIGNDATIAVAGQAGNFELNVMLPVIARNLLESIELMANVSRLLADKAIASFKVNEDKLKEALARNPILVTALNPIIGYLKAAEIAKTAYKQGRPIIDVALEHTDLSRDQLEALLDPEKLTAGGI

SEQ ID NO: 16936 - DNA, 1383 bp, Lactobacillus plantarum WCFS1
  CDS (1)..(1383)
atgacagaatatcgagttgaatcagatactttaggcgaagttaaaattcctgcgaacgccttatggggtgctcagacagaacggagtcgccataactttccgactggtacgaagatgccgttggaaatgattcgggcattacttcaaattaagcgggccgcagcgattgcgaataaagaagttgaagcaatgactgctgaaaaagctgatttaatcgtggctgccattgataagttattagcgctcgacgatgaagatttgcgtaaggactttccgctggttgtttaccaaactggttcggggacgcaaacgaatatgaacgttaatgaagtggtcgcacacatggctggtaagatcaatcctgatattgaaatcttgccgaacgacgatgttaaccatggtcaaagctctaacgatatcttcccaacggcgatgaacattacggccgcagttgccgtggataagctgattgccgcagcggaacacttattagcggaattgaagatcaaacaaaagaagtactggcgggtagtaaagattggccggacccatcttcaagatgcaacgccattaacttttggccaagaagtgagtggttgggccagtgcgattgaacatgatattgcctacttaaaacagttgaatccaacgttaggcgagcttgcaatgggtgggaccgccgttgggactggtctaaatgctgcccctcattttgctgaaaatattgcggcggcgatgagcaaattgtatgggattgaatttacggctgattccaataagttctatggtttggcccatcattctggtttaaacgtggttcacggggccatcaagaccctagcagccgatttgatgaagattgccaatgatgtgcggttcttggcaagcggtccacgggccggttatgacgaattaaacattccggctaacgaacccggctcatcaatcatgcctgggaaagttaacccaacccaagctgaagccatcactatggcagcggtacgagttatggggaatgacgtggtcgtcgatttagcttctagccaaggtaattttgaaatgaacgtttacaagaccgttttgattgatgctttccttgaatctgctgaattgttagctggaacgattaccggcttcactgaccgaatgattgctggtttgacggtcaaccaagaccggatggcagagttagtcgacagttccttgatgacggttacggcattgtcaccacatattggctatcatgatagtgcgatgattgctcaagcagctgaaaaagcggggacgacattgcgtgaagcagctatcaagtctggcaaagtaaccgcggaacaattcgatgaatggatggttccactggatatgacgaatattgatgattaa

SEQ ID NO: 16937 - protein, 460 aa, Lactobacillus plantarum WCFS1
MTEYRVESDTLGEVKIPANALWGAQTERSRHNFPTGTKMPLEMIRALLQIKRAAAIANKEVEAMTAEKADLIVAAIDKLLALDDEDLRKDFPLVVYQTGSGTQTNMNVNEVVAHMAGKINPDIEILPNDDVNHGQSSNDIFPTAMNITAAVAVDKLIAAAEHLLAELKIKQKKYWRVVKIGRTHLQDATPLTFGQEVSGWASAIEHDIAYLKQLNPTLGELAMGGTAVGTGLNAAPHFAENIAAAMSKLYGIEFTADSNKFYGLAHHSGLNVVHGAIKTLAADLMKIANDVRFLASGPRAGYDELNIPANEPGSSIMPGKVNPTQAEAITMAAVRVMGNDVVVDLASSQGNFEMNVYKTVLIDAFLESAELLAGTITGFTDRMIAGLTVNQDRMAELVDSSLMTVTALSPHIGYHDSAMIAQAAEKAGTTLREAAIKSGKVTAEQFDEWMVPLDMTNIDD

SEQ ID NO: 16938 - DNA, 1642 bp, Drosophila melanogaster
  CDS (73)..(1527)
cttttcctggcctgtacttttcggcctaaatatttcatttcgtaacacatatacacattaaaattttccaaaatgtctttcgatcagaaggagattttcagtttgatgtacaaactggctcggctaatagtgccggatactcgagttgaatatgattcgatgggtgccgtgcacattcctctcgatcgaatgttcggtccgcaaaccatgagatccctgatgaaatttccaattggcggagttgaggaacgaatgccacgacccctaataaaagccctgggcatagtgaagaaatcagctgcggagacgaacaaaatccattgtctggaggagcatctatgcgatgccatttccaaggcctgcgatgatgttatatcgggcaaactctatgacgaggaacactttccgttggttatatggcaggatggaagcggcgagcacacaaacatgaacgtaaacgaggttatatgcaatcgagccatcgaaattctgggcggtcagatgggctccaaggagccggtggatcccaatgaacatgtcaacatggcgcaaagttcccatgacaccttctcgacagccgtgcgcatcgccgtggccatgcagttgcaggagacgctgtatcccagcttaaggacctttattgatttgctgggcaagaagtcgaacgattggatggatttgatcaagattggtagaacgcatctgatggacgcagttcctctgtccctcggccaggagttcagtggctatcagcagcaacttgtgaacggaaggacgcgattggactgtgccatgtgccgattgtatcagttgcccatgggcggcaccagtgtgggcaccaaagtggacaccaaggcggaatattctgcgcagtgcatcaagcgtatagccgagctaacattcctaccctttgtcgagtccccgaacttttttgaatccatctccgcctgcgattgcctggtggaactgcacggtgaactcaacacgattgcagcgagtgtgatgaagatagcgaatgatatacgattccttggatcgggaccacgttgcggatttggtgaactacatctgccggagaacgaaccaggtagttccataatgcccggcaaagtgaatcccacgcaatgcgaggccatgtccatgatctgtgcccaggtgatgggcaaccatgtggccgtctccatgggtggttcctctggccactttcagctgaacacctttatgcccatgattgcctccaatgttttgcgctcgattacacttttgggcgatggcatgaagtccttttgcaccaattgcctcgagggcatcgagcccaataggagcaagattggtagcatcgtcaaggagtccctgatgctggtcactgccctcagtccacacattggctacgaacgatccgctgcgatcgccaaggcagcgcatcacaatggaaccactttggaacaggaggccatacttgatggcattcaacgggaggacttcagggagtgggtgcagcccagcaagatgctgggtcccgaatagtcgaaatggccacaaaacagtatcataatttaaataaattgtttcaattattatgtcgagctttaaaatttaataaatgcggtcaattggctctgtaaaaaaaaaaaaaaaaaaa

SEQ ID NO: 16939 - protein, 484 aa, Drosophila melanogaster
MSFDQKEIFSLMYKLARLIVPDTRVEYDSMGAVHIPLDRMFGPQTMRSLMKFPIGGVEERMPRPLIKALGIVKKSAAETNKIHCLEEHLCDAISKACDDVISGKLYDEEHFPLVIWQDGSGEHTNMNVNEVICNRAIEILGGQMGSKEPVDPNEHVNMAQSSHDTFSTAVRIAVAMQLQETLYPSLRTFIDLLGKKSNDWMDLIKIGRTHLMDAVPLSLGQEFSGYQQQLVNGRTRLDCAMCRLYQLPMGGTSVGTKVDTKAEYSAQCIKRIAELTFLPFVESPNFFESISACDCLVELHGELNTIAASVMKIANDIRFLGSGPRCGFGELHLPENEPGSSIMPGKVNPTQCEAMSMICAQVMGNHVAVSMGGSSGHFQLNTFMPMIASNVLRSITLLGDGMKSFCTNCLEGIEPNRSKIGSIVKESLMLVTALSPHIGYERSAAIAKAAHHNGTTLEQEAILDGIQREDFREWVQPSKMLGPE

SEQ ID NO: 16940 - DNA, 1699 bp, Drosophila melanogaster
  CDS (141)..(1544)
gcctttcaatgcccgagcacgcctcagttaacatcgagcagcagccgtcgtcgagtggtcgtcctctgatttgttcactctgattgccatagtctcaatttggcttcacttacttactatctgtcatatctgcatctgaaatggcctcccaggagtttcgcgtggagagcgacacctttggcgaactgaaggtgcccgcggataagtactatggcgcccaaacgatgcgatcccagatcaatttccccatcggcggagccaccgaacggatgcccaaacccgtggtccaggccatgggcatcctgaagaaggccgccgccgaggtgaacaaggagttcggactggacagcaaggttagcgaggcgatctcgaaggcggccgacgatgtgatctctggcaagctatacgacgaccacttcccgctggtcatctggcagacgggctcgggcacgcagagcaacatgaatgtgaatgaggtgatcagcaatcgtgccattgagctgctgggcggcaaactgggctccaagacgcccgtgcatcccaacgatcatgtgaacaaatcgcagagctccaacgataccttccccaccgccattcacatctcggtggcgctggagctgaacaacaaccttaagccggcgattaagacgctgcacgatgcgctgcgtgccaagtcggaggagttcaaggacattatcaagatcggacgcacgcatacgatggatgcggtgccattgacgctgggccaagagttcagcggctatgcccagcaattggcctacgcccaggagcgcatcgatgcctgtctgccgcgcgtctatgagctggctctgggcggcactgctgtgggtacgggtctgaacacacgcaagggattcgccgagaagtgcgctgcaaagatcgccgagctgaccagcctgcccttcgttaccgcgcccaacaagttcgaggcactggctgcccgcgatgccatggtggaggtgcatggtgtgctcaacacgatcgccgttagcctgatgaagattgccaacgatattcgtttccttggctccggaccgcgttgcggtttgggtgagctctcgctaccggagaacgagccaggtagctccatcatgcccggcaaggtgaatcccacgcaatgcgagtcgctgacaatgctctccgcccaggtgatgggcaatcaggtggcggtgaccatcggtggatccaatgggcacttcgagctgaatgtattcaagcccctgatcgtgtccaatgtgctgcgctccattcggctattgtctgatggcagcaggaccttcactgccaactgtgtgaatggcatccaggcgaaccgcgagaatattgccaagatcatgaacgagtcgctcatgctggtgaccgctctgaatccgcacattggttacgacaaggctgcgaaaattgcaaagacggcgcacaagaatggcaccacactcaaggaggaggccatcaatttgggttacctgacggagcagcagttcaacgactgggtgcgacccgaacagatgctgggacccaagtgaagtggagccaagtaggccgacgacgaaatccatcattcaatcatcgctgtcatcggaatcgcagtgtgattttctagatcagatcgttttgttgtatatgaatcgctcggaaacacagaaccaataataattgaaaatgctgaagcaaaacaatg

SEQ ID NO: 16941 - protein, 467 aa, Drosophila melanogaster
MASQEFRVESDTFGELKVPADKYYGAQTMRSQINFPIGGATERMPKPVVQAMGILKKAAAEVNKEFGLDSKVSEAISKAADDVISGKLYDDHFPLVIWQTGSGTQSNMNVNEVISNRAIELLGGKLGSKTPVHPNDHVNKSQSSNDTFPTAIHISVALELNNNLKPAIKTLHDALRAKSEEFKDIIKIGRTHTMDAVPLTLGQEFSGYAQQLAYAQERIDACLPRVYELALGGTAVGTGLNTRKGFAEKCAAKIAELTSLPFVTAPNKFEALAARDAMVEVHGVLNTIAVSLMKIANDIRFLGSGPRCGLGELSLPENEPGSSIMPGKVNPTQCESLTMLSAQVMGNQVAVTIGGSNGHFELNVFKPLIVSNVLRSIRLLSDGSRTFTANCVNGIQANRENIAKIMNESLMLVTALNPHIGYDKAAKIAKTAHKNGTTLKEEAINLGYLTEQQFNDWVRPEQMLGPK

SEQ ID NO: 16942 - DNA, 1404 bp, Xanthomonas campestris
  CDS (1)..(1404)
atgagcgagagtttcaggatcgaacacgacagcatgggcgagttgcaggtgcctgccgatgcgttgtggggtgcgcagacccagcgcgctgtgcagaacttcccgatttccggccagccgatgccgcgcggtttcattcgcgcgctggggttgatcaaggccgcggccgcaggcgtcaacgccgatctcgggctgctgtccaaatcggtggccaaggtggtgcaggaagccgccttgcaggtggcgcagggcgcgcacgatgcacatttcccgatcgatgtgtatcagaccggctctggtacgtcgtcgaacatgaatgccaacgaggtgattgccacgctggccacccgcgccggcaaggacgcggtgcaccccaatgaccacgtcaatctcgggcagagttccaacgacgtggtgcccaccgccattcgcgtctcggcattgctggcggtgcaggagcagctgcagccggcgctcaagcacctgcgcaagaccatcgacaagcgcgccaagggtctggacaagatcgtcaagaccggccgcacgcatctgatggatgcgatgcccctgacctttggtcaggagttcggcgcgtggtctgcgcagctcagttcagcgcaggagcgcatcgacgacagcctgaagcggctgcgccggttgccgctgggcggcactgcgattggcaccggcatcaacgccgatccgcgcttcggcggcaaggtggccaaggccttgtccacgttgagcagcgtcaagttcgaaagtgccgagaacaagttcgaaggcctggcggcgcaggatgatgcggtggaattgtcgggccagctcaatgcgctggcggtggccttgatcaagatcgccaacgacctgcgctggatgaatgccgggccgctggcagggctgggcgagatcgaattgccggcgctgcagccaggcagttcgatcatgccgggcaaggtgaatccggtgattcccgaagcgaccgtgatggtgtgcgcgcaggtcatcgggcaccacgccgcgatcacggtggccgggcagaccggcaattttcagttgaacgtggcgttgccgctgatcgccgcgaacctgctggattcgatcaacctgctcagcaacgtctcgcgcctgctcgccgataccgccattgccggattgaaggtgcgccaggagcgcgtgcgcgaggccctggaccgcaacccgatcctggtgaccgcgctcaacccgatcatcggctacgaaaaggctgccgcgatcgccaagcgcgcctacaaggagcagcgcccggtgctggatgtggccaaggaagacagcggtctgagcgaggcagagctgcgccgtttgctggatccggcggcgttgacacgcggcggcatccaggcgggtggcggtggtggcggctga

SEQ ID NO: 16943 - protein, 467 aa, Xanthomonas campestris
MSESFRIEHDSMGELQVPADALWGAQTQRAVQNFPISGQPMPRGFIRALGLIKAAAAGVNADLGLLSKSVAKVVQEAALQVAQGAHDAHFPIDVYQTGSGTSSNMNANEVIATLATRAGKDAVHPNDHVNLGQSSNDVVPTAIRVSALLAVQEQLQPALKHLRKTIDKRAKGLDKIVKTGRTHLMDAMPLTFGQEFGAWSAQLSSAQERIDDSLKRLRRLPLGGTAIGTGINADPRFGGKVAKALSTLSSVKFESAENKFEGLAAQDDAVELSGQLNALAVALIKIANDLRWMNAGPLAGLGEIELPALQPGSSIMPGKVNPVIPEATVMVCAQVIGHHAAITVAGQTGNFQLNVALPLIAANLLDSINLLSNVSRLLADTAIAGLKVRQERVREALDRNPILVTALNPIIGYEKAAAIAKRAYKEQRPVLDVAKEDSGLSEAELRRLLDPAALTRGGIQAGGGGGG

SEQ ID NO: 16944 - DNA, 1404 bp, Xanthomonas axonopodis
  CDS (1)..(1404)
atgagcgaacgtttcaggaccgaacacgacagcatgggcgaattgcaggtgcccgccgacgcgttgtggggcgcgcagacccagcgcgcggtgcagaatttcccggtgtccgggcagccgatgccgcgcggtttcattcgcgcgctgggcttgatcaaggccgcggcagccggcgtcaacgccgagcttggattgctgccgaagtcgatcggcaagaccgtgcaggccgctgcattgcaagtggccgagggcagcttcgatgcgcagtttcccatcgatgtgtaccagaccggttcgggcacctcgtccaacatgaatgccaatgaggtgattgccaccctggccacgcgtgccggcaaggatgcggtgcatcccaacgaccacgtcaatctgggccagagttccaacgatgtggtccccaccgccattcgcgtgtcggcattgctggcggtgcaggaacatctgcaaccggcgctcaagcatctgcgcaagaccatcgacaagcgcgccaaatcgcttgataagatcgtcaagaccggtcgcacgcatttgatggacgcgatgccgctcacctttggtcaggagttcggcgcgtggtcggcgcagctgagttcggcgcaggagcgtatcgacgacgcgctcaagcgcttgcgacgcttgccgctgggcggcacggcgatcgggaccggcatcaatgccgacccgcgcttcggtggcaaggtcgccaaggccttgtccaccctgagcggagccaggttcgagagcgcggaaaacaagttcgaaggactcgccgcgcaggacgatgcggtggagttgtctggccaactcaacgcgctggcggtggcactgatcaagatcgcaaacgacttgcgctggatgaatgccggcccgttggcgggcctgggcgaaatcgaactgccggcgctgcagcctggcagctcgatcatgccaggcaaggtcaatccggtgattcccgaagccaccgtgatggcgtgcgcgcaggtgatcggccaccacactgccatcaccatcgccgggcaaaccggcaacttccagttgaacgtgacgttgccgctgatcgcctacaacctgctggattcgatcaccttgctgggcaacgtttcgcgcctgttggccgacaccgccattgccggtctgaaggtgcgtcaggagcgcgtccgcgaggcgttggaccgcaaccccatcttggtgacggcactgaaccccatcatcggttacgaaaaggccgcggcgatcgccaagcgtgcctacaaggagcagcggtcggtactggatgtggccaaggaagacagcgggctcggcgaagcggaactgcggcgattgctcgacccgacggcattgacacgcggcggtatccatgccggcggcggtagcgggggctga

SEQ ID NO: 16945 - protein, 467 aa, Xanthomonas axonopodis
MSERFRTEHDSMGELQVPADALWGAQTQRAVQNFPVSGQPMPRGFIRALGLIKAAAAGVNAELGLLPKSIGKTVQAAALQVAEGSFDAQFPIDVYQTGSGTSSNMNANEVIATLATRAGKDAVHPNDHVNLGQSSNDVVPTAIRVSALLAVQEHLQPALKHLRKTIDKRAKSLDKIVKTGRTHLMDAMPLTFGQEFGAWSAQLSSAQERIDDALKRLRRLPLGGTAIGTGINADPRFGGKVAKALSTLSGARFESAENKFEGLAAQDDAVELSGQLNALAVALIKIANDLRWMNAGPLAGLGEIELPALQPGSSIMPGKVNPVIPEATVMACAQVIGHHTAITIAGQTGNFQLNVTLPLIAYNLLDSITLLGNVSRLLADTAIAGLKVRQERVREALDRNPILVTALNPIIGYEKAAAIAKRAYKEQRSVLDVAKEDSGLGEAELRRLLDPTALTRGGIHAGGGSGG

SEQ ID NO: 16946 - DNA, 1329 bp, Pyrobaculum aerophilum
  CDS (1)..(1329)
atgtattacgtcgcaaaagccagccagctttttatagagagcgggacgaaattccaacgcgatataatatgggcaatgggcgtcatgaaattcgccgcggccagggcaaacgccgaattaggcttgttgagctgggagaaggcgtatgcaattatggatgtggcgagggagattatggaggggcttcacgacgggcgtattgtcgtagacgtcttccagacgggatctggcacggggcttaacataaatgtaaacgaggtaattgcgcagagggctttggagaaattcggcatctccctccaccccaatgacgacgtaaatctcggccagtcctcaaatgacgtagtgccaactgccataaggctcgcggtgattaaggcatggagcgataaactgaggccaaagctaattaagttaattgacgcgttaggcgccaaggcggaggagtttaagactgttgtgaaggcggggcggacgcatttaagagacgccttgcccgtcaccttcggccaagagctctcaggataccgcgacgctttcgccagaaatctcaaggcccttgagtctttgggggagtttgtaaaggaggtgccaataggcggcactgcggtgggaactggcgtgaacacgcacccctccttcggggagagggttgtggagattataaacgccgagacgggcttggcgataaagaggggaaacccctttactgaaatgaagcttttgacagatatcctcctcttctccggcggcttgagggcgctggctgtggatctgttacggctctgccaagacttaaggcttatgttctccgggccttacacaggcttgggggagatcgaactgccctcgcaagaggaggtgcccggctctagcgccatgccgggcaagactaatcccgtcacgcttgaggctacaatgcaagccgttgtttacgtgctggggcttgacgaaacagtgaaatgggccgcgtcgcttggggagttcgagctggccatggggatacctgtggccggctgggccacggtaagggaggtggaggtgctggccgaggctttggggaaaattactgatctcgtgattctgaatatgaagcctaaagtggacatcatgaagagttacgccgagagatccgcggcgctaatcactttactcgcgccgataatggggtacgacaaggccagggaggtggcggggagatcaattagagatgtgttgagagaaatgggattagacgagtcagaaattgaaaaattgcttgatcccgcgaatttgactactccaggttttaaggttaggcgacggcataaaaacggctctcagagctaa

SEQ ID NO: 16947 - protein, 442 aa, Pyrobaculum aerophilum
MYYVAKASQLFIESGTKFQRDIIWAMGVMKFAAARANAELGLLSWEKAYAIMDVAREIMEGLHDGRIVVDVFQTGSGTGLNINVNEVIAQRALEKFGISLHPNDDVNLGQSSNDVVPTAIRLAVIKAWSDKLRPKLIKLIDALGAKAEEFKTVVKAGRTHLRDALPVTFGQELSGYRDAFARNLKALESLGEFVKEVPIGGTAVGTGVNTHPSFGERVVEIINAETGLAIKRGNPFTEMKLLTDILLFSGGLRALAVDLLRLCQDLRLMFSGPYTGLGEIELPSQEEVPGSSAMPGKTNPVTLEATMQAVVYVLGLDETVKWAASLGEFELAMGIPVAGWATVREVEVLAEALGKITDLVILNMKPKVDIMKSYAERSAALITLLAPIMGYDKAREVAGRSIRDVLREMGLDESEIEKLLDPANLTTPGFKVRRRHKNGSQS

SEQ ID NO: 16948 - DNA, 1320 bp, Sulfolobus tokodaii
  CDS (1)..(1320)
atgatgaaatacactgagactgcaccaaaactttttatgaacacaggaactagatttcctagaaaaataatctgggctatgggacttataaaatacgcggcagcgaaagttaattctgatcttaaccagttagaaaaagaaatagctaaaggtattatgcaagcagcaaaagaagttatggaaggaaaacatgatgataaaatagttttagatgtatttcaaacaggctctggtactggactaaatatgaatattaatgaagtgatagcagaaagggcaactgaaatgattggaaaaaaagttcacccaaatgatcacgtaaatttagggcaatcatctaacgatactgttcctactgcaataagaatagcagcaacttcagcagttgaagaacaacttataccagcacttagtaaatttgtttctattcttaatagaaaaagtgaagaatttaaggatattgtgaaatctggaaggactcatttaagggacgcgttaccagttaccttaggtcaagagctttcagcatatgcagacgctttctaccacgatatgaccaatttacaacaagtactagaatatgttaaggagcttcctattggtggcactgcagtaggtactggattaaactcacatccagaatttcaactgagagttattcaagaggttaataatgaaactggattaggcttcaaaccagctaataagtttagaggattaaggcttttaacggacttacttagtctaagcggtattatgagaacaattgcggtagatctttacagacttggacaagatattagattaatgttttctggaccaatgactggtttcaatgaaatagatctacctactcaagaagaaatagctggaagtagtattatgccgggtaaaacaaacccagttactgtggaggcaacattattagtctcagctcaagtagtaggattagatcatgccaatcaatttgcatcaatgttaggcgagtttgagttagccatgggcgttcctttgattggatataatgtggttactcaaataaacttacttacagaggcattaaataaatttggagatttggtaattaatggtatggttcctaatatagaaagaatgaaaagatatgctgaaagcagtccttcattagttaccgtaatatcacctattattggttatgataaggctagcgaaatagggaagagattaagcaaaggaatgtctataagagaagcattaaaagagttaggctttaaggatgatgaaatagatagaatactagatttatcaaaattagttaagccaggttttcctgcaaaatga

SEQ ID NO: 16949 - protein, 439 aa, Sulfolobus tokodaii
MMKYTETAPKLFMNTGTRFPRKIIWAMGLIKYAAAKVNSDLNQLEKEIAKGIMQAAKEVMEGKHDDKIVLDVFQTGSGTGLNMNINEVIAERATEMIGKKVHPNDHVNLGQSSNDTVPTAIRIAATSAVEEQLIPALSKFVSILNRKSEEFKDIVKSGRTHLRDALPVTLGQELSAYADAFYHDMTNLQQVLEYVKELPIGGTAVGTGLNSHPEFQLRVIQEVNNETGLGFKPANKFRGLRLLTDLLSLSGIMRTIAVDLYRLGQDIRLMFSGPMTGFNEIDLPTQEEIAGSSIMPGKTNPVTVEATLLVSAQVVGLDHANQFASMLGEFELAMGVPLIGYNVVTQINLLTEALNKFGDLVINGMVPNIERMKRYAESSPSLVTVISPIIGYDKASEIGKRLSKGMSIREALKELGFKDDEIDRILDLSKLVKPGFPAK

SEQ ID NO: 16950 - DNA, 1374 bp, Thermoplasma volcanium
  CDS (1)..(1374)
atgagaactgaaagggatgtaattggagaaatacagcttgaagatactgtattttacggtataaatactgctagggccaaggaaaatttcaggataaccggcctgacctccgattctgaccacatcgtttctattgcacagataaaaaaagcagcagccatggctaatgcggaagctggtgcactggacaaggaaaaagctgaatttatagagaaagcgtgtgatgagatcataagtggaagataccacgaccaatttgttatagatgtttaccaggccggtgctggaacatctttcaacatgaacgcaaatgaggtaattgcaaacgttgcacttacattaatgggcaagaacaaaggagattactcagtaatacaccccaacgaccacgtcaacatgagccaatcaacaaatgacgtttatcctacaatgatgcggctaacggtgacgaaaaaagtgaagaaacttaaggaggccatttccgacttaatagaaagcctggaaaagaaatccaaggaacttaggggtataccaaaaccaggcaggacgcaccttcaggatgcagcacctgtaacggttggattggaattttctgcctacgcatatgcaataaaaaaggatagagatgaaattactgatgcccttgattatataatggaattaaacataggggggacggcagtcggcacgggcataaatacatcaaaaaattatcaggagaacgttgtaaagcatatagctgagataacgagggaaaatttcaggaagagcagcaatctgatgggaattatgcagtttatgactgatttttcgagagtgatgaatgctgttacgaacctagcactagatattgaaaagatagctaatgacataaggcttctctactcaggtcctgggacaggtatacatgaaataataatacccgcggtgcagcaaggttcgtccataatgcctggaaaaataaatccgtccatagcagaggcaatgaacatgatatgccattcggttataggtgcgcaacaggcagtaaacatgagcgtacaggccgggcaactggaactaaatgtaatgatgcctaatatagattacgagctaacgagatcaatcgacataatgagaaacggcctaataatgttcaaagaaaaactcatcgacgggatcaaggccaacgtaaacacatgcagagaacatctcgcaaatagctttggatccgctgcactcttgaatccataccttggctatgataatgttgcaaagatagtcagagaagccgtcgaaactggtaaatcaataaaatcattagtgttagcaactggtaaaatcacagaagagcagtatatgaaaattatggaaagtggagtcccaaaggattga

SEQ ID NO: 16951 - protein, 457 aa, Thermoplasma volcanium
MRTERDVIGEIQLEDTVFYGINTARAKENFRITGLTSDSDHIVSIAQIKKAAAMANAEAGALDKEKAEFIEKACDEIISGRYHDQFVIDVYQAGAGTSFNMNANEVIANVALTLMGKNKGDYSVIHPNDHVNMSQSTNDVYPTMMRLTVTKKVKKLKEAISDLIESLEKKSKELRGIPKPGRTHLQDAAPVTVGLEFSAYAYAIKKDRDEITDALDYIMELNIGGTAVGTGINTSKNYQENVVKHIAEITRENFRKSSNLMGIMQFMTDFSRVMNAVTNLALDIEKIANDIRLLYSGPGTGIHEIIIPAVQQGSSIMPGKINPSIAEAMNMICHSVIGAQQAVNMSVQAGQLELNVMMPNIDYELTRSIDIMRNGLIMFKEKLIDGIKANVNTCREHLANSFGSAALLNPYLGYDNVAKIVREAVETGKSIKSLVLATGKITEEQYMKIMESGVPKD

SEQ ID NO: 16952 - DNA, 1374 bp, Thermoplasma acidophilum; identical to SEQ ID NO: 16400
  CDS (1)..(1374)

SEQ ID NO: 16953 - protein, 457 aa, Thermoplasma acidophilum; identical to SEQ ID NO: 16401

SEQ ID NO: 16954 - DNA, 2112 bp, Helicobacter pylori
  CDS (658)..(2049)
tctaaatctttagccaaacccaaactaaaaagcagtaacaaggctgttaaaaggcgtattaaaacgccccccttataaaacacgcttataaaagatagcatgcacttataaatccaagcttgttttagcgcgataaactttgccttctttggatttaatatccaccctcacctgccatgtcccgttcatagaaagattggttttagcttcataaaggccgtttttttcactcacttgtgccatttctttcatcgctggcatgccgggcatttcaggcatcataaactgcaccctaacgatagctttttctaaagccttaccttttaaagtggggctgagtatgaaagtgttatcgcctttaatggggttacccacggatttgattttcacttccaagtcattggcttttagggtttgctcccatgcgtttaaactcataacccccaacacgctcattaaaaataaagcggctaactttttcatcgttttgacctttacattaagataacaagaaaattcttgttgcgaacggataataaccctcttttgtgtaaaaattgtggaaatggtttttaaaaaaatgggggttttaagtagaaggtataagagtttatgctatttttttaaggttttaaaatcaaatttcaaaggattagtatgcaatttagaatcgaacatgacacgatgggcgaaatcaaagtagatgatagccaatactggggggctcaaacgcaacgcagtcttgaaaactttaaaatcggcactgaaaaaatgcctaaagaactcattggcgcgtttgccaaactcaaaaggagtctggcggttgtcaatcaccagttagggaaattaagcttggaaaaatcgcaagccattatcaaggcgtgcgattgcattttaaaaggcgagctgtgcggcgagttccccttagcgatatggcaaacagggagcgggactcaaacgaacatgaatctcaatgaagtcattgccaataaggctaccgaaattttagggggtaattttagggagaaaaaactcatccaccctaacgatgatgtgaacatgtctcaaagctccaacgacactttccctaccgctatgcacattgtgagcgtgctagaaatcacgcataaactactgcccagtttagagaatttgttaaagacctttaaagacaaaagccaacaatttaaagagattgtcaaaatcgggcgcacgcatttacaagacgctacgcctttaactttggggcaagaatttagcgggtatgcgagcatgttagagcattctaaacaacaaattttagagagtttggagcatttaagggaattagccataggcgggacggccgtaggcacagggctaaacgctcacaaagaattgagccaaaaagtggctgaagaattgagcgagtttagcggcgtgaaattcatctctgcgcccaataaattccatgcgctcactagccatgacgctatcgcttatgcgcatggggcttttaaggctttagcggcgaatttaatgaaaatcgctaacgatattagatggcttgcgagcgggccgcgctgtggtttgggcgagcttaatatccctgaaaacgagccgggtagttctatcatgcccggtaaagtcaatcccacgcaatgcgaagcgatgaccatggtggccgtgcaagtgatggggaatgataccgctattggcattgcggccagtcagggtaattttgaattgaatgtgttcaagccggtgattatttataatttcttgcaaagtttgaggctactaagcgatagcatggaaagttttaatacccattgcgcgatcggcattgagcctaataaagaaaagattgattattacttgcaccattctttgatgctagtaaccgccctaaacccgcatgtaggctatgaaaacgccgctaaaatcgctaaaaacgcccacaaaaaaggcatttctttaaaagaaagcgcgctggaactgaagctcttgagcactgaagattttgacaaattcgtggtgcctgaaaagatgatcgggcctaaggcttgaaaaccttgggtgggcgtgcgagatgaatcctgaaaaagccactcatagcaaagagattcgtaa

SEQ ID NO: 16955 - protein, 463 aa, Helicobacter pylori
MQFRIEHDTMGEIKVDDSQYWGAQTQRSLENFKIGTEKMPKELIGAFAKLKRSLAVVNHQLGKLSLEKSQAIIKACDCILKGELCGEFPLAIWQTGSGTQTNMNLNEVIANKATEILGGNFREKKLIHPNDDVNMSQSSNDTFPTAMHIVSVLEITHKLLPSLENLLKTFKDKSQQFKEIVKIGRTHLQDATPLTLGQEFSGYASMLEHSKQQILESLEHLRELAIGGTAVGTGLNAHKELSQKVAEELSEFSGVKFISAPNKFHALTSHDAIAYAHGAFKALAANLMKIANDIRWLASGPRCGLGELNIPENEPGSSIMPGKVNPTQCEAMTMVAVQVMGNDTAIGIAASQGNFELNVFKPVIIYNFLQSLRLLSDSMESFNTHCAIGIEPNKEKIDYYLHHSLMLVTALNPHVGYENAAKIAKNAHKKGISLKESALELKLLSTEDFDKFVVPEKMIGPKA

SEQ ID NO: 16956 - DNA, 1616 bp, Drosophila melanogaster
  CDS (1)..(1413)
atgagctccaccaagaaggttgagacccgccaagagagcgacaccctgggacccatggaggtgcccatggatcgctattacggcgcccagacgatgcgctgcctcataaactttcgcattggcggcgaggaggagcgaatgccgcgccagataatccaggccatgggcatactgaagaaggcggcagccgaaacaaaccaagaattcggattggatcccaagttgagcacggccatctcgaatgcggccgacgatgtgatctccggaaagctttacgatgagggtcacttcccgctgcccatttggcagacgggttcgggcacccagagcaacatgaacagcaacgaggttatcgggaatcgtgccatcgagctgctgggcggacgtattggtaccaaggacccagtgcatcccaacgaccatgtgaacaagtcgcagagctccaacgacacctttccgtcggccattcacattgcggtggccactgcgctgaccaaggatctccgaccggcggtcaccgctctgcgggattcactgcaggccaagtcgaatgaatggaaggatatcattaagattggacgcactcacacccaggatgcagtgccgctaacgctgggccaggagttcagtggctatgcccaacagctgaccaacgggctgcagaggatcgatgcggtcctgccgcgagtttatcagctcgcactgggtggaaccgctgtgggaactggattgaatacccgccggggattcgccgagaagtgtgtcaagcggatcgcccagctcagtggattgcccttcgtggtggcgcccaattttttcgaggccctcgcctgtcgagatgccatggtggaggtgcatggagcgctcaatgtcctggctgttagcctgatgaaggtcaccaatgatatacgtttcctgggatcgggaccacgttgcggtctgggcgagctgtttctgccggagaatgagccgggcagttctattatgcccggcaaggtgaatcccacgcagtgcgaggccatgaccatgatctgcgcccaggtgatgggcaaccacgtggccgtctccgtcggcggtgccaatggacactttgagctcaacgttttcaagccactgatcgcatccaatgtgctccgctccatcaagctgctggctgatgggtgcatcagcttcaactgcaactgcgtcaagggcattaagcccaacaaggagaagctggcaaagatcgtgaatgagtcgctaatgctggtgacagccctcaatccgcacattggctatgacaagtccgcccagattgccaaggcggcccacaagaatggaactactctaaaggtggaggcattgaacgccggcatatcggagaaggatttcaacgagtgggtgcgtcccgagaagatgctgggtccttcttaggttttcctcccttgttccatgtgttacacattcataaattccatattgcaaaattttatcgttggaaatacaatcgagtgaagaaggatgtaaacagttttggtaacacaaggttgtgatgaaattcttgtggatatttttgttccaattaaatttcaaataaaaatagcaatcgccttaaaaatgtaagacgctactaaaaa

SEQ ID NO: 16957 - protein, 470 aa, Drosophila melanogaster
MSSTKKVETRQESDTLGPMEVPMDRYYGAQTMRCLINFRIGGEEERMPRQIIQAMGILKKAAAETNQEFGLDPKLSTAISNAADDVISGKLYDEGHFPLPIWQTGSGTQSNMNSNEVIGNRAIELLGGRIGTKDPVHPNDHVNKSQSSNDTFPSAIHIAVATALTKDLRPAVTALRDSLQAKSNEWKDIIKIGRTHTQDAVPLTLGQEFSGYAQQLTNGLQRIDAVLPRVYQLALGGTAVGTGLNTRRGFAEKCVKRIAQLSGLPFVVAPNFFEALACRDAMVEVHGALNVLAVSLMKVTNDIRFLGSGPRCGLGELFLPENEPGSSIMPGKVNPTQCEAMTMICAQVMGNHVAVSVGGANGHFELNVFKPLIASNVLRSIKLLADGCISFNCNCVKGIKPNKEKLAKIVNESLMLVTALNPHIGYDKSAQIAKAAHKNGTTLKVEALNAGISEKDFNEWVRPEKMLGPS

SEQ ID NO: 16958 - DNA, 1572 bp, Drosophila melanogaster
  CDS (1)..(1572)
atgctgaagcaaaacaatggtctgcatctggctaggcgcaatctctgggtggtttgcagtggcctccgtgccaaggattgcgacagtggcggtaagggcggcaagggcaaggagaatggcaagtttcgtacggagaaggacaccttcggggagctaaaggtgccggcggacaagctgtacggcgcacagacgatgcgctccaaattgaattttcccattggcgacataggcgaacgtatgccgatgccggtgatccaggccatgggcatactgaagaaggcatgtgccgaggtcaacaaggattacggactagatggcaaggtgtcggatgccgtatcctgcgcctgcgacgatgtcatttccggcaagctatacaaacagggtcacttcccattggtcatctggcaaaccggttcgggcacccagaccaatatgaacaccaacgaggtgatcagcaatgcggccattaagatgatgggcggcgaactgggcagcaagaagccggtgcatcccaacgatcatgtgaacaagtcgcagagctccaacgacaccttccccacggccattcacatttcggtgggcatggagctgaacgagcggcttgttccggcggttacacacttgagggatgccctcaagtccaagtcggatgagttcaaggacatcatcaagatcggacgcacccacttgatggacgcagttccgctgactttgggccaggaattcagcggttatacacagcagttgaccaacggtctggaaaggatcaagggctgtctgccgcgcgtctatgagctggctctgggcggcactgctgtgggtacgggtctgaacacacgcaagggattcgccgagaaggtggccaagcgcatttcggagctaacctgcttgcccttcgtgtcggcgcccaacaagttcgaggcactggctgcccgcgatgccatggtggaggtgcatggtgtgctcaacacgatcgccgtcagcctgatgaagatcgccaacgatatccgattgctgggatcgggtccgcgttgcggtctgggcgaactaatgctgccggagaacgagcccggtagctccatcatgcccggcaaggtgaatcccacgcaatgcgaatcaatgaccatgctgtgtgcccaggtgatgggcaatcaggtggcggtgaccatcggcggctccaacgggcacttcgagctaaatgtattcaaacccctggtcgtgtccaatgtgctgcgctccattcgcttgttgggtgagtcggaaatgtgttttccaagtggaaaaacatgcatacataaccttctcctcccagctgatggcagcatgaccttcagcaagaactgcgtggagggactgcaggccaacaaggagaggatcgacaagatcatgaacgagtccttgatgctggtgaccgcgctgaatccgcacattggctatgacaaggccgccctgatcgccaagacggcgcacaagaataagacgaccttgaaggaggaggcactgaagaccggaattaccgaagagcagttcaaggagtgggtcaatcccaaggagatgctgggaccgaagtga

SEQ ID NO: 16959 - protein, 523 aa, Drosophila melanogaster
MLKQNNGLHLARRNLWVVCSGLRAKDCDSGGKGGKGKENGKFRTEKDTFGELKVPADKLYGAQTMRSKLNFPIGDIGERMPMPVIQAMGILKKACAEVNKDYGLDGKVSDAVSCACDDVISGKLYKQGHFPLVIWQTGSGTQTNMNTNEVISNAAIKMMGGELGSKKPVHPNDHVNKSQSSNDTFPTAIHISVGMELNERLVPAVTHLRDALKSKSDEFKDIIKIGRTHLMDAVPLTLGQEFSGYTQQLTNGLERIKGCLPRVYELALGGTAVGTGLNTRKGFAEKVAKRISELTCLPFVSAPNKFEALAARDAMVEVHGVLNTIAVSLMKIANDIRLLGSGPRCGLGELMLPENEPGSSIMPGKVNPTQCESMTMLCAQVMGNQVAVTIGGSNGHFELNVFKPLVVSNVLRSIRLLGESEMCFPSGKTCIHNLLLPADGSMTFSKNCVEGLQANKERIDKIMNESLMLVTALNPHIGYDKAALIAKTAHKNKTTLKEEALKTGITEEQFKEWVNPKEMLGPK

SEQ ID NO: 16960 - DNA, 1392 bp, Agrobacterium tumefaciens
  CDS (1)..(1392)
atgacagccacacggacagaaaccgatacatttggccctattgaagttcaggccgatcgctactggggcgcgcaggcgcagcgctcgctcggcaacttcaagatcggctgggaaaagcagcccgcctctgtcgttcgtgcgctcggcatcgtcaagcaggccgctgcccgcgccaacatggcgcttgcaggtctcgaccccaaggtgggagatgccatcatcgccgccgcgcaggaagtcatcgacggcaagctgaccgagcatttcccgctcgtcgtctggcagaccggctccggcacccagtccaacatgaatgccaacgaggtgatttccaaccgcgcgatcgaaatgctcggcggcgaaatgggcaccaagaagcctgttcacccgaatgaccacgtcaatatgagccagtcctcgaacgacacctacccgacggcgatgcacatcgcctgcgtggaagagatcgttcaccacctgttgccggccctcaagcacctgcacacggcgctggaagccaaggtcaagcagttcgaaaagatcatcaagatcggccgtacccacacgcaggacgcgaccccgctgacgctcggccaggaattctccggttacgccgctcaggtcgcctcggcgatcgccaatatcgaactcacactgcccgcactgtcgaagctcgcccagggcggtacggcggttggcacgggcctcaatgcccctgttggttttgccgaaaaggtcgccgaggaaatctctgagattaccggcctttccttcgtcaccgcgccgaacaagttcgaagcgcttgcctcgcatgattccatggtcttctcgcacggcgcgatcaacgccgctgccgctgcactcttcaagatcgccaacgacatccgcttcctcggttccggcccgcgcgccggtctcggcgaattgtcgctgccggaaaacgagcccggctcgtcgatcatgccgggcaaggtcaacccgacgcagtcggaggcactgacgcaggtttgcgcccatatcttcggcaacaatgcagcgctttccttcgcaggctcgcagggccacttcgaactcaacgtctataatccgatgatggcctacaactttctgcagtcggtccagcttctgggcgatgcggccgtgtccttcaccgacaactgcgtcgtcggcatcgaggcgcgcgaagacaatatccggaagggcgtcgagaactcgctgatgctcgtcacggcgctcaacggcaagctcggctacgacatctgcgccaagatcgccaagaccgcccacaagaacggcacgacgctgcgcgaagaagccgttggtggtggatacctcaccaacgaggaattcgaccagtatgtgcgccccgaaaacatgatcggcccgaagtaa

SEQ ID NO: 16961 - protein, 463 aa, Agrobacterium tumefaciens
MTATRTETDTFGPIEVQADRYWGAQAQRSLGNFKIGWEKQPASVVRALGIVKQAAARANMALAGLDPKVGDAIIAAAQEVIDGKLTEHFPLVVWQTGSGTQSNMNANEVISNRAIEMLGGEMGTKKPVHPNDHVNMSQSSNDTYPTAMHIACVEEIVHHLLPALKHLHTALEAKVKQFEKIIKIGRTHTQDATPLTLGQEFSGYAAQVASAIANIELTLPALSKLAQGGTAVGTGLNAPVGFAEKVAEEISEITGLSFVTAPNKFEALASHDSMVFSHGAINAAAAALFKIANDIRFLGSGPRAGLGELSLPENEPGSSIMPGKVNPTQSEALTQVCAHIFGNNAALSFAGSQGHFELNVYNPMMAYNFLQSVQLLGDAAVSFTDNCVVGIEAREDNIRKGVENSLMLVTALNGKLGYDICAKIAKTAHKNGTTLREEAVGGGYLTNEEFDQYVRPENMIGPK

SEQ ID NO: 16962 - DNA, 1389 bp, Bacillus anthracis
  CDS (1)..(1389)
atggagtacagaattgaaagagatacattaggagaaataaaagttccagctgataaattatgggcagcacaaacacaacgtagtaaagaaaacttcccgattggaacagagcaaatgccgcttgaaattgtaaaagcatttgcaattttaaagaagagtgcagcgcttagcaatcaaaaattaggaaagctatcagaagaaaaagcagaagcaattgtggtagctgctgacgaaatcattgcagggaaatggaatgaacattttccgcttgtcgtgtggcaaacaggtagtggtacacaatcaaacatgaatgtgaatgaagtaattgcaaatcgtgggaatcaaattttgaaagaaaagggatctgacgtacatattcatccgaatgatgatgtgaacatgtcccaaagttcaaatgatacatttccaacagcgcttcatgtagcatgtgtactcgcagtagaaaatcacgtattaccagctattacgaaattaaaagaaacgttagcagaaaaagtaactgcatttgaacatattataaaaattggtcgtacacatttacaagatgcgacaccgttaacattaggacaagaaattagtggatggcaccgtatgcttgaaaaaacagagcgtatgattgcagagagcaatacatatatgaaagagcttgcgattggtggtacagcagttggaacaggtattaacgctcatcctaaatttggtgagatggtatcagaggaaattagccaatttacaggtaaacaatttatttctgcaccaaataagttccatgcattaacgagccatgatgaagttgtatatactcacggtgcattaaaagcattagctgcggatttaatgaaaatcgctaacgatgtacgttggctggcaagtggtccacgtagtggtttaggagaaattattattccggcgaatgagccaggaagctctattatgccaggtaaagtaaatccaacgcaaagtgaagcgttaacgatggttgtagcgcaagtgatgggaaatgacgcaacaatcggatttgctgcgagtcaaggtaattttgagttaaacgtatttaaacctgttattgcgtataacttcttacaatccgctcacttattagcagatgcaattgtttcatttaatgataattgtgcagttggtattgaagctgatgaagaaatcattaaagagaatgtgaatcgttcattaatgcttgttacagcattaaacccgcatatcggatatgaaaatgcagcaaaaattgcgaagcatgctcataaagaagggttaactttaaaagaagcagcattgcaatctggactactaacagaagagcaatttaatgaaattgtcgatccgaaaaaaatgattgctccgaaagagtaa

SEQ ID NO: 16963 - protein, 462 aa, Bacillus anthracis
MEYRIERDTLGEIKVPADKLWAAQTQRSKENFPIGTEQMPLEIVKAFAILKKSAALSNQKLGKLSEEKAEAIVVAADEIIAGKWNEHFPLVVWQTGSGTQSNMNVNEVIANRGNQILKEKGSDVHIHPNDDVNMSQSSNDTFPTALHVACVLAVENHVLPAITKLKETLAEKVTAFEHIIKIGRTHLQDATPLTLGQEISGWHRMLEKTERMIAESNTYMKELAIGGTAVGTGINAHPKFGEMVSEEISQFTGKQFISAPNKFHALTSHDEVVYTHGALKALAADLMKIANDVRWLASGPRSGLGEIIIPANEPGSSIMPGKVNPTQSEALTMVVAQVMGNDATIGFAASQGNFELNVFKPVIAYNFLQSAHLLADAIVSFNDNCAVGIEADEEIIKENVNRSLMLVTALNPHIGYENAAKIAKHAHKEGLTLKEAALQSGLLTEEQFNEIVDPKKMIAPKE

SEQ ID NO: 16964 - DNA, 1389 bp, Bacillus subtilis
  CDS (1)..(1389)
atggaatacagaattgaacgagacaccatgggagaagtaaaagttcctgctgataaattttggggcgcccaaacacagcgaagcaaggagaactttaagatcggttctgaaaaaatgccgatgcgtgttgtgaaggcgtttgcaattttaaaacgaagcactgctctagctaataaacgcctcggcaatctggacgctgaaaaagcagaagcgattgcagcggtttgtgatgatgtgctcaaaggcaagtacgatgacaacttcccgcttgtcgtatggcagaccggaagcggcacacaaagcaatatgaacatgaacgaagtggtagccaaccgtgcgactgctttattaaaagagaagaactctgatcaaacgattcatccaaatgatgacgtgaaccgaagccaaagctcaaacgacacattcccgactgcgatgcatgttgccgctgttttggctgtttacgagcagcttgtgccggcgcttgatcagcttcgcaatacactggatgaaaaagcaaaagcatacaatgatattgtcaaaatcggacgcacgcatcttcaggatgctacgccactgaccctcggacaggaaatcagcggatgggttcacatgctggaccgttcgaaggaaatgattttggaagcgacagataaaatgcgtgcgcttgcaattggtggaacggctgtcggaacgggtatcaacgcccacccagagtttggagagcttgtctcagaagagatcactaagctgaccggccaaacgttcagcagctcgccgaataaattccacgcgctgacaagccatgacgaaatcacttatgcgcatggcgcattaaaagcgcttgcggctgacttaatgaaaatcgcgaacgatgtcagatggctcgcaagcggaccccgctgcggcatcggggagatcgtcattcctgaaaatgagccgggaagctctattatgcctggtaaagtcaatccgacacaaagcgaagcgttaacaatgatcgcagcgcaaatcatggggaacgatgcgacaatcggctttgcggcgagtcaggggaactttgaactgaacgtgtttaagcctgttattatttacaacttcctgcaatctgtgcagctgctcagtgacggcatgaattcattccatgataaatgtgctgtcggtattgagcctaataaagaaaccattcaggaaaacctgtcaaattcattaatgcttgttacggcgctgaacccgcatatcggttatgaaaacgcggcgaaaatcgccaagcttgcccataaagagggattgacgctcaaagaagcagctttgaagcttgaattgctgacagaggagcaatttaacgaaatggttaagccggaagacatggtaaaaccaaaggcgtaa

SEQ ID NO: 16965 - protein, 462 aa, Bacillus subtilis
MEYRIERDTMGEVKVPADKFWGAQTQRSKENFKIGSEKMPMRVVKAFAILKRSTALANKRLGNLDAEKAEAIAAVCDDVLKGKYDDNFPLVVWQTGSGTQSNMNMNEVVANRATALLKEKNSDQTIHPNDDVNRSQSSNDTFPTAMHVAAVLAVYEQLVPALDQLRNTLDEKAKAYNDIVKIGRTHLQDATPLTLGQEISGWVHMLDRSKEMILEATDKMRALAIGGTAVGTGINAHPEFGELVSEEITKLTGQTFSSSPNKFHALTSHDEITYAHGALKALAADLMKIANDVRWLASGPRCGIGEIVIPENEPGSSIMPGKVNPTQSEALTMIAAQIMGNDATIGFAASQGNFELNVFKPVIIYNFLQSVQLLSDGMNSFHDKCAVGIEPNKETIQENLSNSLMLVTALNPHIGYENAAKIAKLAHKEGLTLKEAALKLELLTEEQFNEMVKPEDMVKPKA

SEQ ID NO: 16966 - DNA, 1392 bp, Bordetella pertussis
  CDS (1)..(1392)
atgaaaacccgcaccgaaaaagacactttcggcccgatcgaggtgcccgagcagcacctgtggggcgcgcagacccagcgctcgctgcatttcttcgcgatctcgaccgagaagatgccggtgccgctggtcgccgccatggcacgcctgaagcgcgccgccgccaaggtcaacgccgagctgggcgagctggatccgcaggtcgcagacgccatcatgcgggccgccgatgaggtgatcgccggcaagtggcccgacgagtttccgctgtcggtctggcagaccggctcgggcacgcagagcaacatgaacatgaacgaggtgctggccaaccgcgcctccgagctgctgggcggcgagcgcggcgaaggccgcaaggtgcaccccaacgaccacgtgaaccggggccagtcgtccaacgatacctttccgaccgccatgcacgtggccgccgcggtcgaggtcgagcaccgcgtgctgcccgccctgaaggcgttgcgcggcacgctggccgccaagagcgcggcgttctacgacatcgtcaagatcggtcgcacccatttgcaggacgccaccccgttgacgctgggccaggagatctccggctacgtggcgcagctggacctggccgagcagcagatccgcgcgacgctggccggcctgcaccagctggccatcggcggcacggcggtgggcaccggcctgaacgcgcatccgcagttcagcgccaaggtatcggccgaactggcccatgacacgggcagcgcgttcgtgtcggcgcccaacaagttccaggcgctggcttcgcacgaggcgctgctgttcgcgcacggcgccttgaagacgctggccgccggcctgatgaagatcgccaacgatgtgcgctggctggccagcggcccgcgctcggggctgggcgaaatcagcattcccgagaacgagccgggcagctccatcatgccgggcaaggtcaacccgacccagtgcgaagccgtcacgatgctggccgcgcaggtcatgggcaacgacgtggccatcaatgtcggcggggccagcggcaacttcgagctgaacgtcttcaagccgctggtgatccacaatttcctgcagtcggtgcgcctgctggccgacggcatggtcagcttcgacaagcactgcgcggccggcatcgagcccaaccgcgagcgcatcaccgagctggtcgagcgttcgctgatgctggtgactgcgctcaacccgcacatcggctacgacaaggccgcgcagatcgccaagaaggcgcacaaggaaaacctgtcgctgaaagaggcggcgctggcgctggggcacctgaccgaggcgcagttcgccgagtgggtggtgccgggcgacatgaccaacgcgcgccgctag

SEQ ID NO: 16967 - protein, 463 aa, Bordetella pertussis
MKTRTEKDTFGPIEVPEQHLWGAQTQRSLHFFAISTEKMPVPLVAAMARLKRAAAKVNAELGELDPQVADAIMRAADEVIAGKWPDEFPLSVWQTGSGTQSNMNMNEVLANRASELLGGERGEGRKVHPNDHVNRGQSSNDTFPTAMHVAAAVEVEHRVLPALKALRGTLAAKSAAFYDIVKIGRTHLQDATPLTLGQEISGYVAQLDLAEQQIRATLAGLHQLAIGGTAVGTGLNAHPQFSAKVSAELAHDTGSAFVSAPNKFQALASHEALLFAHGALKTLAAGLMKIANDVRWLASGPRSGLGEISIPENEPGSSIMPGKVNPTQCEAVTMLAAQVMGNDVAINVGGASGNFELNVFKPLVIHNFLQSVRLLADGMVSFDKHCAAGIEPNRERITELVERSLMLVTALNPHIGYDKAAQIAKKAHKENLSLKEAALALGHLTEAQFAEWVVPGDMTNARR

SEQ ID NO: 16968 - DNA, 1392 bp, Brucella melitensis
  CDS (1)..(1392)
atggccgccacgcgtaccgaaacagacactttcggaccgatcgatgttcccgcagaccgttattggggcgcacagacacagcgttccctgcaaaatttcaggatcggcggcgagcgcatgcccctgcccctggttcacgcgctgggcgtggtaaagcgcgcggcggcggaaaccaatatcgcgctcggcaagcttgatcccgtcctgggtcaggtgattgcggttgccgcttccgaagtcattgagggcaagctcgacgaccatttcccgctcgtagtctggcagacaggctccggcacgcaatcgaacatgaatgccaatgaagtgatctcgaaccgggctatcgagttgctcggcggggaaatgggctccaaaaagccgatccacccgaacgaccatgtcaatatgagccagtcttccaatgacagtttcccgacggcgatccacatcgccacggcggtcgaaaccgtcaaccggctctatcccgcgctcgaacacctcaccaaagccctgaaggtcaaggaagaagcattcaaggacatcatcaagattggccgcacccacacgcaggacgcaacacctgtgacgctggggcaggaattttcgggctaccgcgcggcacttgaatatgcccgccatcggctcgaacaatcgcttgccgacgtcttcctgctggcgcagggcggcacggctgtcggcaccggtctcaacgcacctgtcggtttcgacaagggctttgccgaagcggtgagcgagattaccgggctttccttcaagaccgcgccaaacaagttcgaggcgctggcaagccacggcgccgttctcaacttccacggcagcctgaatgcgcttgcagccgatctcttcaagatcgccaacgatatccggtttctcggttccggcccgcgttccggccttggcgagctttctctgccggaaaacgaacccggctcctccatcatgccgggcaaggtcaaccccacacaggccgaagccatgaccatggtggcaacccaggttttcggcaaccagaccgccgtaaccgtcgccgccagccaggggcatttcgagctgaacgtcttcaaaccggtcattgcctataatgtgctgcaatcgatccggcttttgagcgacaccatggtttcctttgccgatcattgcgtcgaggggattgaacccaatacggcccgcatcaaggaattgctggaacgctcgctcatgctcgtcacggcgcttgcgcctgccatcggctatgacaatgcggccaggatcgccaaaaccgcccataagaacggcaccacgcttcgcgaggaagcattggcaagcggcctcgtatcggaagaagattatgaccggctggtgcgcgccgagcggatgatcgccccacaatga

SEQ ID NO: 16969 - protein, 463 aa, Brucella melitensis
MAATRTETDTFGPIDVPADRYWGAQTQRSLQNFRIGGERMPLPLVHALGVVKRAAAETNIALGKLDPVLGQVIAVAASEVIEGKLDDHFPLVVWQTGSGTQSNMNANEVISNRAIELLGGEMGSKKPIHPNDHVNMSQSSNDSFPTAIHIATAVETVNRLYPALEHLTKALKVKEEAFKDIIKIGRTHTQDATPVTLGQEFSGYRAALEYARHRLEQSLADVFLLAQGGTAVGTGLNAPVGFDKGFAEAVSEITGLSFKTAPNKFEALASHGAVLNFHGSLNALAADLFKIANDIRFLGSGPRSGLGELSLPENEPGSSIMPGKVNPTQAEAMTMVATQVFGNQTAVTVAASQGHFELNVFKPVIAYNVLQSIRLLSDTMVSFADHCVEGIEPNTARIKELLERSLMLVTALAPAIGYDNAARIAKTAHKNGTTLREEALASGLVSEEDYDRLVRAERMIAPQ

SEQ ID NO: 16970 - DNA, 1347 bp, Candidatus Blochmannia floridanus
  CDS (1)..(1347)
atgatatgtaatagattatggggagatcaaacagaatcttctttaaaattttttaatatttctacagaaaaaatgccttgggaattaattaaagcattagctcaaataaaacgagtatcagctcaagtaaattatgatttaaaattacttgattatgaacgttctcaagctattattgcagcagtagatgaaatattatctggcaatcataaaaatgaatttccattatcagtgtggcaaactggatctggtactcaaagcaatatgaatatgaatgaagttttggcaaatagggcaaatgaattattaagaaaaaatcagataaatatagtcgtacatccaaacgatcatgtcaataaaagtcaaagttcaaatgatgtttttcctagtgcaatgcacattgcagcagtagttaatttaaaaacaaaactaatacctgtaattaaattattacaaaaaacttttttaaaaaaatctattgaatttcgtaatattataaaaattggacgtactcatttgcaggatgctattccattgactttagggcaagaaatttccggatgggattttatgttaaaaaataatacaaatcatattcaatcaactattcttgatttaagtgcattggcattaggaggaacggcagtagggacaggatttagcgctcatgtagaatatgcagaacgtgttgtattaggcttgtctaaactaattcatcactctttttttagcgctcctaataaatttgaatctttatctacgtgtgatgctatagtttatagtcatgggactttgaagggattagctatatccatgatgaagattgcaaacgatatacgtttgttatcatctggtcctcagtgtggtctgggagagttgattattcctgctaatgaacctggaagttctattatgcctggtaaagttaatcctacgcaatgtgagtctatgactatgtcatgttgccaagttatgggtaatgatttaagcattagtttgggaggttcatctggacagttacaattaaatacatataggcctttaattatttacaattttttacaatcaatacgattacttacagatagtataaaaaattttcatgattattgtattgtgggtatcagaccaaaattcaaaagaattgaaaaattgttaaacaaatctttaatgttagtaacagcattaagttctcatataggatatgataaatcagcacaaattgctcaaacagcttatttaaatggaattactttaaaagctgcatcgatacaatcgggttacgtaactgaaaaacagtttgatgattgggtttgtccagaaaatatgatttatcctgatatgtag

SEQ ID NO: 16971 - protein, 448 aa, Candidatus Blochmannia floridanus
MICNRLWGDQTESSLKFFNISTEKMPWELIKALAQIKRVSAQVNYDLKLLDYERSQAIIAAVDEILSGNHKNEFPLSVWQTGSGTQSNMNMNEVLANRANELLRKNQINIVVHPNDHVNKSQSSNDVFPSAMHIAAVVNLKTKLIPVIKLLQKTFLKKSIEFRNIIKIGRTHLQDAIPLTLGQEISGWDFMLKNNTNHIQSTILDLSALALGGTAVGTGFSAHVEYAERVVLGLSKLIHHSFFSAPNKFESLSTCDAIVYSHGTLKGLAISMMKIANDIRLLSSGPQCGLGELIIPANEPGSSIMPGKVNPTQCESMTMSCCQVMGNDLSISLGGSSGQLQLNTYRPLIIYNFLQSIRLLTDSIKNFHDYCIVGIRPKFKRIEKLLNKSLMLVTALSSHIGYDKSAQIAQTAYLNGITLKAASIQSGYVTEKQFDDWVCPENMIYPDM

SEQ ID NO: 16972 - DNA, 1386 bp, Chromobacterium violaceum
  CDS (1)..(1386)
atgacgaaaaccgtacgcagcgaaaccgacaccttcggtccgatcgacgtccccgccgctgcgctgtggggggcgcagacccagcgctcgctggcgcatttccgcatttccagcgagaagatgccgccggagctgatcctggcgctggctcgggtcaagcgcgcctgcgccgaggccaaccgcgggctgggcaagctggacgacgccaaggccgccgccatcgccggcgcggccgacgaggtgctggcgggccgacacgacggcgagtttccgctgtcggtgtggcagaccggctccggcacccagagcaatatgaatatgaacgaggtgctggccaaccgcgcgtcggagctgctgggcggccggcgcgggccgggccggctggtccatcccaacgacgacgtcaatctcggccagtcgtccaacgacatcttccccaccgcgatgcacgtcgccgccgccacgcaggtcaaggaacggctgctgccgtcgctggatctgctgcgccacgcgctcgaatccaaagccgaagccttcgccgacgtcgtcaagataggccgcacccatctgcaggacgccacgccgctgacgctgggccaggagatctccggctgggcggcgcaactggcgctgtccgaacaggcggtgcgcgcggcgctgcccatgctgtgccagctggcggtcggcggcaccgcggtgggcaccggcctcaacaccgatccaagcttcggcgccgcggtggcggcgcgcctggccgagcaaagcggcctgccattcgaaagcgccggcaacaaattcgccgcgctggccggccacgagccgctcgtgttcgcccacggcgcgctgaaaacgctggccgccgcgctgatgaagatcgccaacgacatccgctggctggcttccggcccgcgcagcggcctgggcgagctgtcgctgccggagaacgagccgggcagctccatcatgccgggcaaggtcaaccccacccagtgcgaagcgatgaccatgctgtgctgccaggtgctgggcaacgacgcggcgctggccatcggcgccgcgtccggcaatttcgaactgaacgtgttcaagccgctgatcgcgcacaacttcctgcaaagcgcgcggctgctggcagacggcatggacagcctgcgcgagcactgcgtggacggcatggaagccaaccgcgcgcgcatcgccgaactgatggcgcgctcgctgatgctggtcaccgcgctgaacccgcacatcggctacgacaaggcggccgccatcgccaaacacgcccatcgccacggcaccacgctgcgcgaggcggcgctggcgctgggccacctgagcgccgagcagttcgacgcctgggtgcggccggaagacatggtgtga

SEQ ID NO: 16973 - protein, 461 aa, Chromobacterium violaceum
MTKTVRSETDTFGPIDVPAAALWGAQTQRSLAHFRISSEKMPPELILALARVKRACAEANRGLGKLDDAKAAAIAGAADEVLAGRHDGEFPLSVWQTGSGTQSNMNMNEVLANRASELLGGRRGPGRLVHPNDDVNLGQSSNDIFPTAMHVAAATQVKERLLPSLDLLRHALESKAEAFADVVKIGRTHLQDATPLTLGQEISGWAAQLALSEQAVRAALPMLCQLAVGGTAVGTGLNTDPSFGAAVAARLAEQSGLPFESAGNKFAALAGHEPLVFAHGALKTLAAALMKIANDIRWLASGPRSGLGELSLPENEPGSSIMPGKVNPTQCEAMTMLCCQVLGNDAALAIGAASGNFELNVFKPLIAHNFLQSARLLADGMDSLREHCVDGMEANRARIAELMARSLMLVTALNPHIGYDKAAAIAKHAHRHGTTLREAALALGHLSAEQFDAWVRPEDMV

SEQ ID NO: 16974 - DNA, 1422 bp, Corynebacterium efficiens
  CDS (1)..(1422)
atgagtgatttcatgaccgagcaggaattccgtattgaacacgacaccatgggtgaagtgaaggtccccgcacaggctctgtggcgtgcacagacccagcgtgccgtggagaacttccccatctctggccgtggtctggaatccgcacagatccgcgcgatgggcctgctgaaggcagcctgcgcgcaggtgaacaaggactccggtgccctggatgccgccaaggccgacgccatcatcgccgccggcaaggagatcgccaccggcaagcatgatgccgagttcccgatcgacgtcttccagaccggttccggcacctcctccaacatgaacaccaacgaggtcatcgcctccatcgcgaaggccaacggcaccgaggtccaccctaacgacgatgtcaacatgggccagtcctccaatgacaccttccccaccgcgacccacgtcgccgccaccgaggcagccgtcaatgacctgatcccgggcctgaaggtgctgcacgagtccctggccaagaaggccaacgagtgggattccgtggtcaagtccggccgcacccacctcatggacgccgtcccggtcaccctgggccaggagttcggcggctacgcacgccagatccagctcggcatcgagcgcatcgaggccaccctgccacgtctgggtgagctggccatcggtggtaccgccgtcggcaccggcatcaacacctccgccgacttcggtggcaaggttgtcgccgagctcgtcgagctcaccggcgtcacccagctgcaggaggcagccaaccacttcgaggcacaggccaaccgcgacgccctcgtcgagttctccggcgcgatgcgcgttgtcgccgtctccctctacaagatcgccaacgacatccgcctcatgggctccggcccgctgaccggcctcggcgagatccagctgcccgacctgcagccgggttcctccatcatgccgggcaaggtcaaccccgtcctgtgcgagaccgccacccaggtctccgcccaggtcatcggcaacgacgccgctgtcgccttcgccggcagccagggccagttcgagctcaacgtgttcatccccgtgatggcccgcaacgtccttgagtccgcccgcctgctggccaacaccgcgcgcgtgttcgccacccgcctggttgacggcattgttcccaacgaggagcacatgaagcagctggccgagtcctccccgtccattgtcactccgctgaactccgcaatcggctacgaagccgccgcgaaggtcgccaaggctgcgctggcagagggcaagaccatccgccagaccgtcatcgacatgggctttgtcgacggtgagaagctgaccgaggaggagctggacaagcgtctggacgttctcgcgatggccaacaccgaccgcaagcagaagttctaa

SEQ ID NO: 16975 - protein, 473 aa, Corynebacterium efficiens
MSDFMTEQEFRIEHDTMGEVKVPAQALWRAQTQRAVENFPISGRGLESAQIRAMGLLKAACAQVNKDSGALDAAKADAIIAAGKEIATGKHDAEFPIDVFQTGSGTSSNMNTNEVIASIAKANGTEVHPNDDVNMGQSSNDTFPTATHVAATEAAVNDLIPGLKVLHESLAKKANEWDSVVKSGRTHLMDAVPVTLGQEFGGYARQIQLGIERIEATLPRLGELAIGGTAVGTGINTSADFGGKVVAELVELTGVTQLQEAANHFEAQANRDALVEFSGAMRVVAVSLYKIANDIRLMGSGPLTGLGEIQLPDLQPGSSIMPGKVNPVLCETATQVSAQVIGNDAAVAFAGSQGQFELNVFIPVMARNVLESARLLANTARVFATRLVDGIVPNEEHMKQLAESSPSIVTPLNSAIGYEAAAKVAKAALAEGKTIRQTVIDMGFVDGEKLTEEELDKRLDVLAMANTDRKQKF

SEQ ID NO: 16976 - DNA, 1529 bp, Corynebacterium glutamicum
  CDS (37)..(1458)
aagcttgtgacagccgtatttaattctcagtaagaaatgagtgatttcatgaccgagcaggaattccgtattgagcacgacaccatgggtgaagtgaaggttccagcaaaggctctgtggcaggcacagacccagcgcgctgttgagaacttccctatctctggtcgtggtctggaatccgcacagatccgcgcaatgggtctgctgaaggcagcttgtgcgcaggtaaacaaggactccggtgcgctggatgcagagaaggcagatgccatcattgcagctggtaaggagatcgcgtccggtaagcatgacgctgagttcccaattgatgtgttccagactggttccggtacttcctccaacatgaacaccaatgaggttatcgcttccatcgcgaaggctaacggcgttgaggttcacccaaatgaccacgtcaacatgggtcagtcctccaatgacaccttccctactgcaactcacgttgctgcaaccgaagctgctgtcaatgacctcatcccaggcctgaaggttctgcacgagtctttggcgaagaaggctaacgagtggtctgaggttgttaagtccggccgcacccacctgatggacgctgttccagtaaccctgggccaggagttcggtggctacgctcgccagatccagctcggcatcgagcgcgttgaggctactcttcctcgccttggtgagctggctattggtggcaccgctgctggtaccggtatcaacacctccgctgatttcggtggcaaggttgttgctgaactgatcaacctgaccgacgtcaaggagctcaaggaagctgagaaccacttcgaggctcaggctgcacgcgacgctcttgttgagttctccggcgcaatgcgcgttatcgctgtctccttgtacaagatcgctaacgatatccgcctcatgggctccggcccactgaccggtcttggcgagatccgtctcccagacctgcagccaggttcctccatcatgccaggcaaggtcaacccagttctctgtgagaccgctacccaggtttccgctcaggttatcggcaatgacgcagctgttgcgttctccggcacccagggccagttcgagctcaatgtgttcatcccagtgatggctcgcaacgtgcttgagtccgctcgcctgctggctaacacttcccgcgtgttcgcgacccgtctcgttgatggcattgagccaaacgaggcacacatgaaggagctcgctgagtcttcaccttccatcgttaccccactgaactctgcaatcggctacgaagctgctgcaaaggtggctaagactgctttggctgagggcaagaccatccgccagactgtcatcgatttgggcttggttgatggcgagaagctcaccgaggaagagctggacaagcgcctcgacgttcttgctatggctcacaccgagcgcgagaacaagttctaaaactagaacccgataaataaggaccttcacttcttaagaagtgaaggtccctttttcgctacatatctaga

SEQ ID NO: 16977 - protein, 473 aa, Corynebacterium glutamicum
MSDFMTEQEFRIEHDTMGEVKVPAKALWQAQTQRAVENFPISGRGLESAQIRAMGLLKAACAQVNKDSGALDAEKADAIIAAGKEIASGKHDAEFPIDVFQTGSGTSSNMNTNEVIASIAKANGVEVHPNDHVNMGQSSNDTFPTATHVAATEAAVNDLIPGLKVLHESLAKKANEWSEVVKSGRTHLMDAVPVTLGQEFGGYARQIQLGIERVEATLPRLGELAIGGTAAGTGINTSADFGGKVVAELINLTDVKELKEAENHFEAQAARDALVEFSGAMRVIAVSLYKIANDIRLMGSGPLTGLGEIRLPDLQPGSSIMPGKVNPVLCETATQVSAQVIGNDAAVAFSGTQGQFELNVFIPVMARNVLESARLLANTSRVFATRLVDGIEPNEAHMKELAESSPSIVTPLNSAIGYEAAAKVAKTALAEGKTIRQTVIDLGLVDGEKLTEEELDKRLDVLAMAHTERENKF

SEQ ID NO: 16978 - DNA, 1380 bp, Coxiella burnetii
  CDS (1)..(1380)
atgcgaaaagagtccgacagcatgggtacgattgaagtgcccagtgaaaagtattatggcgcgcaatcacagcgctcattaattaattttgccattgggcgtgaaacgatgccgcctgagctcattcgcgcttttggcgttttgaaaaaagcggctgtgctcaccaatgttgaattgggcaaggtgtctcaagaaaaagctaactttattcttaaagcctgcgaagagctgatcgctggaaaactaaacgatcattttcccttgaaaatttggcaaaccggcagcggcacgcagaccaacatgaatgtgaacgaggttatcagtaatcgcgcgattgagttagctggtggaaagttaggaagcaaagaaccggttcatccgaacgatcacgttaatatgtcgcaatcttcaaatgatacttttccaacggccatgcacattactgctgccgaaatgataacgcatcagcttattcctaatctcactgtcttacgcgataccttggaaaaaaaatccaaggaattttccgaaatcattaaaatcggtcgaacgcatttgcaagacgctgtgccattaacgttgggtcaagaattttcaggttatgtcgctcaactcaaccataacttggaagccattaatgatgtacttccaacgctctatcgtcttgcgctcggcgggacggcggtaggcacggggctaaatacccacccgcaatttgccaaaaaagcggctgaccacattgccgaactgacgggaatacccttttactcggcgtctaataaatttgccgctctggctgccaacgacgaaattgttttagtcagcggcgttctcaaaacccttgcctgttcgttgatgaaaattgcaaacgatattcgttggttggcttccggcccgcgttgcggcatcggggaaattgttatcccagaaaacgagccaggttcttcgattatgccgggtaaagtaaatccaacgcaatccgaagcgatgacgatggtgtgtgttcaggtgataggaaacgatacgaccattaccatcgcgggatcgcaagggaattttgaattgaatgtttacaagcccgtgatggcttataatttaattcaatctatttatttattgtccgatgcttgtcgctcctttaatgatcattgcgccgttggcatcaaacccaatcaagaaaaaattaatgactatctgaataattctctaatgctggtcactgcattaaaccaaatcatcggttacgacaaagcctcagaaattgctaaaaaagcttacaaagaaggcacgacgcttaaagaagcggctcttcaattaggttatttaaccgcaagcgaattcgataaagccgtagaccccaaaaaaatggtcgctatttga

SEQ ID NO: 16979 - protein, 459 aa, Coxiella burnetii
MRKESDSMGTIEVPSEKYYGAQSQRSLINFAIGRETMPPELIRAFGVLKKAAVLTNVELGKVSQEKANFILKACEELIAGKLNDHFPLKIWQTGSGTQTNMNVNEVISNRAIELAGGKLGSKEPVHPNDHVNMSQSSNDTFPTAMHITAAEMITHQLIPNLTVLRDTLEKKSKEFSEIIKIGRTHLQDAVPLTLGQEFSGYVAQLNHNLEAINDVLPTLYRLALGGTAVGTGLNTHPQFAKKAADHIAELTGIPFYSASNKFAALAANDEIVLVSGVLKTLACSLMKIANDIRWLASGPRCGIGEIVIPENEPGSSIMPGKVNPTQSEAMTMVCVQVIGNDTTITIAGSQGNFELNVYKPVMAYNLIQSIYLLSDACRSFNDHCAVGIKPNQEKINDYLNNSLMLVTALNQIIGYDKASEIAKKAYKEGTTLKEAALQLGYLTASEFDKAVDPKKMVAI

SEQ ID NO: 16980 - DNA, 1395 bp, Haemophilus ducreyi
  CDS (1)..(1395)
atggaataccgtatcgaaaaagatactatgggcgaagtgaaagtaccggctgatcgttattgggcagcacaaacagaacgttcgcgtaataatttcaggattgggcctgaagcttctatgccggtcgaaattattgaagcatttgcttatttaaaaaaagccgctgcatttgctaatgctgaactaggtgcactcaccactgaaaaacgtgacttaatcgcgatggtttgtgatgaaatcttagcaaataaattagcggacgaatttccgttagtgatttggcaaacaggttctggtacacaatcaaatatgaatcttaatgaagtgattgccaaccgtgcccacgtattacaagggggggcattaggtgaaaaatcgattattcatccaaatgatgatgtcaataaatcgcaatcttcaaacgatacctatccaacggctatgcatattgctgcctataaaaaagtcgttgaagtaaccattccagcaatagaacgcttacaaaaaacatttgccataaaatctgaagcatttaaagatgtggttaaaattggtcgaactcatttaatggatgccaccccgcttacattaggccaagaattctctgcctatgcggcacaattacaatttggtttgttagcccttaaaaataccttgccccatttggcgcagttagcattaggtggcacagctgttggcacaggcttaaatacgcctaaaggttatgatgttaaagtagcagaatatatcgcacaatttactcaacttccttttattactgcggaaaataaatttgaagcattagccactcacgatgcaattattgaaacacacggtgcgctcaaacaaattgctatgtcattattcaaaattgccaatgatattcgtttattagcatcaggtcctcgctctggtattggcgaaattctaattcctgaaaatgaacccggctcctcaattatgcccggtaaagtcaatcctactcaatgtgaggcaatgactatggttgcagcgcaagtgttgggaaatgatactacgatttcatttgcgggtagccaaggccattttcagttaaatgttttcaaacctgttatggcagcaaatttcttacaatcggcacaattacttgctgatgtatgtatttcatttgatgagcattgtgcaagcggtattgaacctaattatccaagaattcaacaacaattagaaaactctttaatgttagtgaccgctttaaatacccatattggttatgaaaatgcggctaaaattgctaaaactgcgcacaaaaatggaacaacactcaaagaagaagcaattaacttaggtctagtcactgctgaacagtttgatcaatgggtacgccctcaaaatatggtcggtagtttaaaataa

SEQ ID NO: 16981 - protein, 464 aa, Haemophilus ducreyi
MEYRIEKDTMGEVKVPADRYWAAQTERSRNNFRIGPEASMPVEIIEAFAYLKKAAAFANAELGALTTEKRDLIAMVCDEILANKLADEFPLVIWQTGSGTQSNMNLNEVIANRAHVLQGGALGEKSIIHPNDDVNKSQSSNDTYPTAMHIAAYKKVVEVTIPAIERLQKTFAIKSEAFKDVVKIGRTHLMDATPLTLGQEFSAYAAQLQFGLLALKNTLPHLAQLALGGTAVGTGLNTPKGYDVKVAEYIAQFTQLPFITAENKFEALATHDAIIETHGALKQIAMSLFKIANDIRLLASGPRSGIGEILIPENEPGSSIMPGKVNPTQCEAMTMVAAQVLGNDTTISFAGSQGHFQLNVFKPVMAANFLQSAQLLADVCISFDEHCASGIEPNYPRIQQQLENSLMLVTALNTHIGYENAAKIAKTAHKNGTTLKEEAINLGLVTAEQFDQWVRPQNMVGSLK

SEQ ID NO: 16982 - DNA, 1395 bp, Haemophilus influenzae
  CDS (1)..(1395): s means g or c
atggcatttcgtattgaaaaagacacaatgggtgaagttcaagttctagcagataaatactgggctgcacaaactgaacgttcacgcaataactttaaaattggcccagccgcatcaatgccacatgaaattatcgaagcttttggctatttgaaaaaagcagccgcatttgctaatcatgatttgggtgtattacctcttgaaaaacgtgatttaattgctctggcttgtgacgaaattttagcaaataaattagatgatcaattcccacttgttatttggcaaactggttctggtacacaatctaatatgaatgtgaacgaagtagttgccaatcgtgctcatgtgttaaacggtggaaaattaggtgaaaaatctattattcacccaaatgatgatgtgaacaaatcacaatcttcaaatgatactttcccaacggcaatgcacattgcggcatataaaaaagtagttgagcacaccattccttgtgttgaacgtttacaaaaaacttttgcggcaaaatctgaagccttcaaaaacgtggtaaaaattggccgcactcacttaatggatgcaacgccactcacattaggtcaagaattttcggcttatgcagctcaattagatttcggcttaaaagcattaaaaaataccctcccacatttaagccaattagcattgggtggaactgcggttggcacaggtttgaacacgccgaaaggctatgatttgaaagtggtagattacattgcaaaattcaccgcacttccgtttgtcacagcagataataaatttgaagcattagccgctcatgatgcgattgttgaaactcacggtgcattacgtcaattagcaatgagtttatttaaaattgcgaacgatattcgtctattagcatctggccctcgttcgggaattggcgaaattttaattcctgaaaatgaaccaggttcttcaattatgccaggtaaagtaaacccaactcaatgcgaassgatgacaatggtctgtgcacaagtatttggtaacgacaccaccatcgcatttgtgggttcacaaggtcacttccaattaaatgtgttcaaccctgtgatgattgcaaacttcttacaatctgctcaattattgggcgatgcttgcgtatctttcgatgaacactgtgcagtgggtattgagccaaactatccacgcattaaacaacaacttgaaaattcattgatgttggtgaccgcacttaatacgcatatcggttatgaaaatgcagctaaaattgcaaaaaccgcacataaaaatggcaccacattacgtgaagaagcgattaatttaggtttagtgtctgccgaagattttgataaatgggttcgcccagaagatatggtgggtagcttaaaataa

SEQ ID NO: 16983 - protein, 464 aa, Haemophilus influenzae
  misc_feature (332)..(332): Xaa can be Ala or Arg or Gly or Pro
MAFRIEKDTMGEVQVLADKYWAAQTERSRNNFKIGPAASMPHEIIEAFGYLKKAAAFANHDLGVLPLEKRDLIALACDEILANKLDDQFPLVIWQTGSGTQSNMNVNEVVANRAHVLNGGKLGEKSIIHPNDDVNKSQSSNDTFPTAMHIAAYKKVVEHTIPCVERLQKTFAAKSEAFKNVVKIGRTHLMDATPLTLGQEFSAYAAQLDFGLKALKNTLPHLSQLALGGTAVGTGLNTPKGYDLKVVDYIAKFTALPFVTADNKFEALAAHDAIVETHGALRQLAMSLFKIANDIRLLASGPRSGIGEILIPENEPGSSIMPGKVNPTQCEXMTMVCAQVFGNDTTIAFVGSQGHFQLNVFNPVMIANFLQSAQLLGDACVSFDEHCAVGIEPNYPRIKQQLENSLMLVTALNTHIGYENAAKIAKTAHKNGTTLREEAINLGLVSAEDFDKWVRPEDMVGSLK

SEQ ID NO: 16984 - DNA, 1395 bp, Leptospira interrogans
  CDS (1)..(1395)
atgaaaaccagaatcgaaacggattcgatgggcgaaattgcagtagacgattccaaatattggggcgcacaaacagaacgttccttacatcattttcatatcggaaacgatcgatttccaagagaaatgattcgtgctttaggaattttaaagaaatctgcagcggttgttaatgcggaacttggtcttttaagcgaagataaaaagaaactgattgttcaagccgccgacgaagtgatttccggaaaattggatgagcattttccgctttcggtttggcagaccggctccggaactcagactaacatgaattctaatgaagtgatttcgaaccgtgcgatcgaaattgcaggtggggtgaagggctctaaaaaaccgattcatccaaatgacgatgttaacaaggctcaatcctcaaacgatacgtttcctacagccatgcatatcgctgcggcggaacagttaaaccaaaagttgattcctgctctgatacaactcaaagaaacgttcaagaaaaaaacagatgaatttcagaatattataaaaatcggtagaactcatcttcaagacgcgactcctctgactttaggccaagaattttctggctatgttcaacaattggaatacaatattgcaagggtaaaggcagttttaccttccgtttatagacttgcgttaggcggaacagctgtcggaaccggattaaatactcaccctcagtttgcggtaaaagcagcggctcaaatcgctaaagaaactggacttccttttgtaagcgcggaaaataagttcgaggcactcgcggctcacgattctcttgtagaaacgagcggtgtgttgaaaacgatcgctgcttctttaatgaaaattgcaaacgatatacgttggctttcttctggtcctcgttgtggaattggtgaaattagtattccggaaaatgaaccaggttcttctatcatgccgggtaaagtgaatccaacacaatcagagcagatgacgatggtcgcggctcaagtaattgcaaatgacgttgcagtaaatataggcggtgcttctggaaatttcgagttgaacgtttttaaacctttgattatccacaacgttttgaattcgattcgattactttctgattcttgtgtttcttttgaagaacattgtgctcgtggaattattccgaataaggaaaagttaaacgaacacttaaataattctttgatgcttgtgaccgctttgaatcctcatataggttatgataacgctgctaaaattgccaagaacgcgcataaaaaaggaacaactctgaaagagtccggaattgaattgggacttttaacaagtgaacaatttgatcagtgggttcttcccgaaaagatgatccatccttcggtggattaa

SEQ ID NO: 16985 - protein, 464 aa, Leptospira interrogans
MKTRIETDSMGEIAVDDSKYWGAQTERSLHHFHIGNDRFPREMIRALGILKKSAAVVNAELGLLSEDKKKLIVQAADEVISGKLDEHFPLSVWQTGSGTQTNMNSNEVISNRAIEIAGGVKGSKKPIHPNDDVNKAQSSNDTFPTAMHIAAAEQLNQKLIPALIQLKETFKKKTDEFQNIIKIGRTHLQDATPLTLGQEFSGYVQQLEYNIARVKAVLPSVYRLALGGTAVGTGLNTHPQFAVKAAAQIAKETGLPFVSAENKFEALAAHDSLVETSGVLKTIAASLMKIANDIRWLSSGPRCGIGEISIPENEPGSSIMPGKVNPTQSEQMTMVAAQVIANDVAVNIGGASGNFELNVFKPLIIHNVLNSIRLLSDSCVSFEEHCARGIIPNKEKLNEHLNNSLMLVTALNPHIGYDNAAKIAKNAHKKGTTLKESGIELGLLTSEQFDQWVLPEKMIHPSVD

SEQ ID NO: 16986 - DNA, 1455 bp, Methanosarcina acetivorans
  CDS (1)..(1455)
atgccttcaatcctcgacctgcctatcggtactggagcgactggcaaacgaaaagaaagcgattctttgggggaggttgaggttccagccgaccattactggggggctcagacccagaggtctctgattcacttttccatcggcgacgactacatgccaaaggaggtctatcatgcttatgggtacgtgaaaaaggcagctgctctggtcaacgaagccgccggaataataccgccgtggaaagctgaattgatagcaagggttgcagatgaagttatcgccggtaaactcgacagcgaattcccgctctatgtctggcagactggctcaggcactcagtcgaacatgaacgtgaatgaagtcatcagcaatcgcgccatccagctcgtgggcggaagcctcggcagtaagcaccctgtccatcctaatgacgatgttaatatgagtcagtcgtccaacgacacctttccaacggccatgcacattgcaactgtgctcgaattcagcaaccgcctcattcccgcagttaccgttcttgaagagtccatatgggccaaagcacgggaatgggtggatatcgtcaagataggccgaacacatcttcaggacgcaaccccacttacagtgggccaggagtggtctggctacgccacacagctcgatgacgcgttggcgtttgtcaagcattctctccggggattatatcggttggccatcggaggcactgcggtcgggaccggcatcaataccccaccagacttcggtgaaaaggttgcagatgagattgccaggctcacaggtcatccatttgtcacagctccaaataaattcgcagctcagggctcccttgatgcaatggtaacctcaagcgcggcactgcgtacattagcagtcgcactgatgaagattgcaaatgacctgcaatggcttggttcgggaccgaggtcgggtctccacgagcttatcctcccaagtgacgagccgggaagctcaatcatgcctgggaaagtcaatccgactcaggaggaagccatgttaatggtttgcatccaggtgattggggaagataatgccgtcgcatttgccgggtcacagggaaacttcgagcttaacgcaatgtgcccgataatcataaataatgtcttacattctgcgcgcactctcggcgatgcttgcgtaaagttccgtgagtacggaatcaatggaatcatgctcgacaggagtcgtatcgacaaatttgtgggcacctccctcatgttagtgacagcgcttagccctgtcataggctacgacaaggcttccgcaattgtccagcgagcactggacgagaatacgacactgagggaagctgcagtgaaaggaggtttcatcagcgcggaggattttgacaggattgtggatccgaagaagatggttggggatccgcgacacgacctgaagctggcttcagagtag

SEQ ID NO: 16987 - protein, 484 aa, Methanosarcina acetivorans
MPSILDLPIGTGATGKRKESDSLGEVEVPADHYWGAQTQRSLIHFSIGDDYMPKEVYHAYGYVKKAAALVNEAAGIIPPWKAELIARVADEVIAGKLDSEFPLYVWQTGSGTQSNMNVNEVISNRAIQLVGGSLGSKHPVHPNDDVNMSQSSNDTFPTAMHIATVLEFSNRLIPAVTVLEESIWAKAREWVDIVKIGRTHLQDATPLTVGQEWSGYATQLDDALAFVKHSLRGLYRLAIGGTAVGTGINTPPDFGEKVADEIARLTGHPFVTAPNKFAAQGSLDAMVTSSAALRTLAVALMKIANDLQWLGSGPRSGLHELILPSDEPGSSIMPGKVNPTQEEAMLMVCIQVIGEDNAVAFAGSQGNFELNAMCPIIINNVLHSARTLGDACVKFREYGINGIMLDRSRIDKFVGTSLMLVTALSPVIGYDKASAIVQRALDENTTLREAAVKGGFISAEDFDRIVDPKKMVGDPRHDLKLASE

SEQ ID NO: 16988 - DNA, 1419 bp, Methylobacterium extorquens
  CDS (1)..(1419)
atgtcgccgcacgagaacccttccgtcgagacgcgtaccgagtccgacaccttcggcccgatcgaagtgcccgcccaccgctactggggcgcccagacgcagcgctcgatccagaacttcaagatcggcaccgagcgccagccggcgccgctcgtccatgcgctcggcatcgtcaagcaggccgccgcgctggtgaacaaggatctcggcggcctcgatccgaagatcgccgacgcgatcgccgaatccgctgccgaagtggtcgccggaaagcacgacgacgagttcccgctggtggtgtggcagacgggctcgggcacgcagtccaacatgaacgccaacgaggtgatcgcgagcctcgcaaacgagcggctcgggggcaagcgcggcggcaagtcgccggtccaccccaacgatcattgcaaccgcggccagtcctcgaacgacaccttccccaccgccatgcacatcgcggtcgcccgcgaggttcaggagcggctgctgccggcgctctcccacctgcacaccgcgctcgatgccaaggcgaaggagttcgagagcatcgtcaagatcggccgcacgcacttgcaggatgcgacgccggtctcgctcggccaggaattctccggttacgccgcgcaggtcgcgctcggtggcgcgcgcatcgccgccacgctccccggcgtgctggcgctggcgcagggcggcaccgccgtcggcaccggcctcaatgcgcatccggaattcgcggagcggtttgcggccaaggtcgcggagctgaccgggctgccctttacctcggccgagaacaagttcgaggcgctggccacccacgacgccctcgtcttccttcagggcgcgctgacggctttggcatcgggcctcttcaagatcgccaacgacatccgcctgctcggctccggcccgcgctcgggcctcggcgaattgtcgctgccggagaacgagcccggctcgtcgatcatgccgggcaaggtcaacccgacccagtgcgaggcgctgacgatggtctgcgcgcaggtggtcggcaacggcaccacggtgagctttgccggctcacagggtcatttcgagctcaacgtgttcaagccggtgatcgccaacgcggtgctgcaatcggtgcggattctggccgacgcctcagtcagcttcaccgacaattgcgtcgtcggcatcaaggccaacaccgaccggatcagcgacctgatgagccgctcgctcatgctggtgaccgcgctcgcgccctcgatcggctacgacaaggccgccgagatcgccaagaccgcgcacaagaacggcaccaccctgaaggaagaggcgctgcggctcggctacgtcacggacgaggagttcgagcgggtcgtacgccccgaaaccatgctggcgccgagcgcggaataa

SEQ ID NO: 16989 - protein, 472 aa, Methylobacterium extorquens
MSPHENPSVETRTESDTFGPIEVPAHRYWGAQTQRSIQNFKIGTERQPAPLVHALGIVKQAAALVNKDLGGLDPKIADAIAESAAEVVAGKHDDEFPLVVWQTGSGTQSNMNANEVIASLANERLGGKRGGKSPVHPNDHCNRGQSSNDTFPTAMHIAVAREVQERLLPALSHLHTALDAKAKEFESIVKIGRTHLQDATPVSLGQEFSGYAAQVALGGARIAATLPGVLALAQGGTAVGTGLNAHPEFAERFAAKVAELTGLPFTSAENKFEALATHDALVFLQGALTALASGLFKIANDIRLLGSGPRSGLGELSLPENEPGSSIMPGKVNPTQCEALTMVCAQVVGNGTTVSFAGSQGHFELNVFKPVIANAVLQSVRILADASVSFTDNCVVGIKANTDRISDLMSRSLMLVTALAPSIGYDKAAEIAKTAHKNGTTLKEEALRLGYVTDEEFERVVRPETMLAPSAE

SEQ ID NO: 16990 - DNA, 1401 bp, Myxococcus xanthus
  CDS (1)..(1401)
atgagcacgaagaacgtccgtaccgagaaagacaccttcggtcccatcgacgtccccgccgaccggctgtggggcgcgcagacgcagcgcagcctccagaacttcgccatctccaccgagcgcatgccgctggccctcatccgcgccctggtgctggtgaagaaggccgccgcgcgggtgaacgtggagaacggctcgctggcgaaggagaagggcgaggccatcatccgggccgcggacgaggtgctggccggccagcacgacgcggagttccccttgagcgtctggcagacgggcagcgggacgcagacgaacatgaacacgaacgaggtgctcgccaaccgcgcctcggagctgctgggcggcgagcgcggcgagcgccgcaaggtccaccccaacgacgacgtcaacaaggggcagagctccaacgacgtcttccccaccgcgatgagcgtggccgccgtggccgccatcaccgagcacgtgctgccggagctgaaggcgctgcgcgacgtgctcgcgcagaaggcccgcgccttccatgacgtggtgaaggtgggccgcacccacctgcaggacgccacgcccctgacgctggggcaggaggtcggcggcttcgtggcgcagttggaccacgcgaagggccacctggagcgcaccctgccgcatcttctggagctggccctgggcggcacggcggtgggcaccggcctcaacgcccccaagggctatgccgagcgggtggcgcaggagctggcccagctcaccggccaccccttcgtcaccgcgcccaacaagttcgaggcgctggccgccaacgacgcgctggtgcaggcgcacggggcgctgaaggggctggcggcggtgctcttcaaggtggccaacgacgtgcgctggctgtcctcggggccgcgctcggggctggcggaaatcaccatcccggagaacgagccgggcagctccatcatgccgggcaaggtgaaccccacccagagcgaggcgctcaccatgctgtgcgcccaggtgatggggaacgacgtcgccgtcaccgtgggtggggcgtccggcaacttccagctcaacgtcttcaagccgctcatcgcccacaacctgctccagagctgccggttgctggcggatggcatgcgcagcttccgcctgcactgcgcggtgggcatcgagcccaaccggccccgcatccaggagaacctggagcgcagcctgatgctcgtcacggcgctcaacccccacatcggctacgacaacgcggcgaaaatcgccaagacggcccacagggacggcacgacgctcaaggagacggccgtggcgctggggctcgtcacccccgagcagttcgaccagtgggtccgcccggaggacatgacgggccacaaggggtag

SEQ ID NO: 16991 - protein, 466 aa, Myxococcus xanthus
MSTKNVRTEKDTFGPIDVPADRLWGAQTQRSLQNFAISTERMPLALIRALVLVKKAAARVNVENGSLAKEKGEAIIRAADEVLAGQHDAEFPLSVWQTGSGTQTNMNTNEVLANRASELLGGERGERRKVHPNDDVNKGQSSNDVFPTAMSVAAVAAITEHVLPELKALRDVLAQKARAFHDVVKVGRTHLQDATPLTLGQEVGGFVAQLDHAKGHLERTLPHLLELALGGTAVGTGLNAPKGYAERVAQELAQLTGHPFVTAPNKFEALAANDALVQAHGALKGLAAVLFKVANDVRWLSSGPRSGLAEITIPENEPGSSIMPGKVNPTQSEALTMLCAQVMGNDVAVTVGGASGNFQLNVFKPLIAHNLLQSCRLLADGMRSFRLHCAVGIEPNRPRIQENLERSLMLVTALNPHIGYDNAAKIAKTAHRDGTTLKETAVALGLVTPEQFDQWVRPEDMTGHKG

SEQ ID NO: 16992 - DNA, 1389 bp, Nitrosomonas europaea
  CDS (1)..(1389)
atggaccagtatcgcgaagaacatgatgcaataggcacagtacaggtgcctgccagcgccctctggggtgcgcagacacaacgatcgctcaacaacttcaatatctcgggcgaacgcatgccgtcagccctgatccacgcactggcgctggtcaaacgcgccgctgccagtgtcaatcatgatctgggattactggacgagaacatcgcccgggcaatcatcaccgctgccgatgaagtgctggcaggagaacacgccggcgaatttccgttggtagtttggcaaaccggttccggcacacaaaccaatatgaacatgaacgaggtgctggccaaccgcgcttcggaaattctgggcggtacacggggcaaaggtcgcaaggtgcaccctaacgaccatgtcaacaaaggacaatcttccaatgacgtttttcccactgccatgcacattgctgccgtggaagccatccgcaaccggttgattccggcactggaagcactacgtaaaacattatcttccaaatcggcagcattttcggatatcgtcaagatcggccgcacacatttgcaggatgccaccccgcttacactggggcaggaattttcaggctatgtttcacagctcgatcatggcctggctcatctcgaatctgcgctgccgcatctgctcgaactggcgctgggggggacagccgtaggtaccggtctcaacacccatccggaatttgcacgccgtgtcgcggcagaaattgcacgcctcagcggctatccttttataacagctgccaataaatttgaggcactggccgcgcatgatgcactggtccatgcgcatggggtgctgaaaacactagcagctatactgatcaaaattgccaatgacgtccgctggctggcatccggcccgcgttgcggtattggtgaaatccttatcccggagaacgaacccggcagttcgatcatgcccggaaaagtcaatcctacccaatcggaagcagttgtcatgcttgcctgtcaggtcatgggcaatgatgttgcaatcaatctgggaggcgccatgggaaatttcgaactcaataccatgaaaccactgatcattcacaattttttacaaagtacacgtttgctcgcagatggtgcagaaagcttcaacacccattgcgcagccggtattacggccaatacagtacgaatcaagcagcatttacaggagtctctgatgctggtaaccgcgctcaatcctcacattggttacgacaaagcagcagaaatagccaaaaaagcccatcatgaaatgctgacattaaaagaagccgcaatcaggctgggttatgtcaccgcagaacaattcgatgtatgggttgacccacaaaaaatgacagaggtgtga

SEQ ID NO: 16993 - protein, 462 aa, Nitrosomonas europaea
MDQYREEHDAIGTVQVPASALWGAQTQRSLNNFNISGERMPSALIHALALVKRAAASVNHDLGLLDENIARAIITAADEVLAGEHAGEFPLVVWQTGSGTQTNMNMNEVLANRASEILGGTRGKGRKVHPNDHVNKGQSSNDVFPTAMHIAAVEAIRNRLIPALEALRKTLSSKSAAFSDIVKIGRTHLQDATPLTLGQEFSGYVSQLDHGLAHLESALPHLLELALGGTAVGTGLNTHPEFARRVAAEIARLSGYPFITAANKFEALAAHDALVHAHGVLKTLAAILIKIANDVRWLASGPRCGIGEILIPENEPGSSIMPGKVNPTQSEAVVMLACQVMGNDVAINLGGAMGNFELNTMKPLIIHNFLQSTRLLADGAESFNTHCAAGITANTVRIKQHLQESLMLVTALNPHIGYDKAAEIAKKAHHEMLTLKEAAIRLGYVTAEQFDVWVDPQKMTEV

SEQ ID NO: 16994 - DNA, 1386 bp, Oceanobacillus iheyensis
  CDS (1)..(1386)
atggattatcgtgttgaaaaagatacaattggggaaattcaagttcctgctgataaatactggggggcgcaaacacagcgtagtaagcaaaattttccaattggaaatgaaaaaatgccagtcgaaattattaaagcgtttgcaattctaaaacgaagtactgctgaagctaattttgaattaggcttaatggaacgagataaaatggaagcaattcaatatgctgctgatcaggtattaaacgattctctaacagatcatttcccactagtcgtttggcaaactggtagtggtacgcaaagtaatatgaatgtaaacgaagtattagcttttgtaggtaataaatggttacaagaacagggaagcgatttaaaattacatcccaatgatgatgtaaataaatctcaaagttcgaacgatacatatccaacggcaatgcatattgcagccgtattgaaattagaagatacggtattaccagctttgagtcagttgaaaaatacttttgcagaaaagcaaagtgcttttgaaaatatcgtgaaaattggtcgtacacatttacaggatgcgactcctctaacactaggccaggaaatcagtgggtggcatcgtatgttagagaaatctgaaacgatgatttcagagagtttagagcatcttcgtgaattagcaataggtggaacagctgtaggcacaggcttaaatgcacatccagatttttcagagaaagtttgtaaggcaattagtacattcacaaacaaaaaattcatatctgcaaaaaataaatttcattcattaacaagtcatgacgaaactgtatatgcacatggtgcactaaagggactagcagcagatttaatgaaaattgcaaatgatgttcgttggttagcaagcggtccacgctgtggcattggagaaattacgattccggcgaatgaaccaggaagttcaattatgccagggaaggtaaatccgactcaaagtgaagctgtaacaatggtagtaactcaagtaatggggaatgatgctgctattggttttgccgctagtcaggggaatttcgaattgaatgtatttaagccagtaattgcatataatttcttacaatcaagtcaattattagcagatagtataatttccttcgatgagcgctgtgcggttggaatcgaaccaaaccacgagcaaatcgaaaagaatcttaatgattctttaatgttggttaccgcattaaatccgcatataggatacgaaaatgcagcaaaaattgctaaaaaagcatttgcagataattcaactttaaaagaaacagctgtagaattaggactattaacagaagaacagtttgatgagtatgttaatccagaggaaatgacatatcctaaataa

SEQ ID NO: 16995 - protein, 461 aa, Oceanobacillus iheyensis
MDYRVEKDTIGEIQVPADKYWGAQTQRSKQNFPIGNEKMPVEIIKAFAILKRSTAEANFELGLMERDKMEAIQYAADQVLNDSLTDHFPLVVWQTGSGTQSNMNVNEVLAFVGNKWLQEQGSDLKLHPNDDVNKSQSSNDTYPTAMHIAAVLKLEDTVLPALSQLKNTFAEKQSAFENIVKIGRTHLQDATPLTLGQEISGWHRMLEKSETMISESLEHLRELAIGGTAVGTGLNAHPDFSEKVCKAISTFTNKKFISAKNKFHSLTSHDETVYAHGALKGLAADLMKIANDVRWLASGPRCGIGEITIPANEPGSSIMPGKVNPTQSEAVTMVVTQVMGNDAAIGFAASQGNFELNVFKPVIAYNFLQSSQLLADSIISFDERCAVGIEPNHEQIEKNLNDSLMLVTALNPHIGYENAAKIAKKAFADNSTLKETAVELGLLTEEQFDEYVNPEEMTYPK

SEQ ID NO: 16996 - DNA, 1395 bp, Pasteurella multocida
  CDS (1)..(1395)
atgacatttcgtatcgaaaaagacactatgggtgaagtacaagttcctgccgataaatattgggcagcacagactgaacgctcacgcaataatttcaaaattggacctgaagcctctatgccaaaagagattattgaagcctttggttatttaaaaaaagcagccgcttatgctaaccatgatttaggtgtattaccagtggaaaaacgggatttaattgcacaggcttgtgatgagatcctcgctaataaattagatgatcaatttcctctcgtcatttggcaaaccggttccggtacacaatccaatatgaaccttaacgaagtcatttcaaaccgtgcccatgttttaaatggtggtaaattaggtgaaaaatccattatccatccaaatgacgatgtgaacaaatctcaatcttcaaacgatacttacccaacagcaatgcacatcgcggcgtataaaaaagtcgttgaagtcactattccttgtgtagaacgtttacaaaaaaccttagcgcaaaaagcagacgcctttaaagatgtggtgaaaattgggcgtactcacttaatggatgcgacaccattaaccttaggtcaagaattctctgcttatgctgcccaattagattttggcttacgcgcattgaaaaacacgctgccacatttagcacaattagcgctaggcggtactgcagtgggtacaggtttaaatacaccgaaaggttatgatgtgaaagtggcagactacattgcaaaatttacaggcttgccatttatcaccgctgaaaataaatttgaagcgttagccacccatgatgccgttgtggaaacgcacggcgcattaaaacaattagcggtatccttatacaaaatcgcaaatgatatccgtttattagcctctggaccacgttctggtattggtgaaattttaattcctgaaaatgagccgggctcttctatcatgccaggtaaagttaacccaacccaatgtgaagccatgacgatggtatgcgcgcaagtactcggtaatgacaccaccatttcctttgcaggtacacaaggtcatttccaattgaacgtatttaaaccagtgatggcggctaacttcttacaatctgctcaattattggcggatgcttgtgtgtccttcgatgaacattgtgcagtcggtattgaaccaaacttccctcgcatcaaaaaacaacttgatgactcattaatgttagtgaccgccttaaatacacatatcggttacgaaaatgcggcgaaaatcgcgaaaaccgcacacaaaaatgggacaacattaaaagaagaagcaatcaacttaggcttagttacagctgaacaatttgatgaatgggtacgtccagaagatatggtcggtagcttaaagtaa

SEQ ID NO: 16997 - protein, 464 aa, Pasteurella multocida
MTFRIEKDTMGEVQVPADKYWAAQTERSRNNFKIGPEASMPKEIIEAFGYLKKAAAYANHDLGVLPVEKRDLIAQACDEILANKLDDQFPLVIWQTGSGTQSNMNLNEVISNRAHVLNGGKLGEKSIIHPNDDVNKSQSSNDTYPTAMHIAAYKKVVEVTIPCVERLQKTLAQKADAFKDVVKIGRTHLMDATPLTLGQEFSAYAAQLDFGLRALKNTLPHLAQLALGGTAVGTGLNTPKGYDVKVADYIAKFTGLPFITAENKFEALATHDAVVETHGALKQLAVSLYKIANDIRLLASGPRSGIGEILIPENEPGSSIMPGKVNPTQCEAMTMVCAQVLGNDTTISFAGTQGHFQLNVFKPVMAANFLQSAQLLADACVSFDEHCAVGIEPNFPRIKKQLDDSLMLVTALNTHIGYENAAKIAKTAHKNGTTLKEEAINLGLVTAEQFDEWVRPEDMVGSLK

SEQ ID NO: 16998 - DNA, 1395 bp, Photorhabdus luminescens
  CDS (1)..(1395)
atggcagccactcgcattgaaaaagactcaatggggcccatcgaagtacctgctgaccaattgtggggagcgcaaactcaacgttcacttgagcattttcgcatttcgcaggagaaaatgccggttgcattaattcatgctctggcattgactaaacaggctgcggccagtgtcaatatggatttgggtcttctgccgcaagaacgtggtgaagcaattattgctgctgcgaaagaggtgctggaaggtaaacatccgacagaatttcctcttgctatctggcagaccggttcaggaacacaaagtaacatgaacatgaacgaagtgttggcgaaccgtggtagcgagatccttggcggggtgagggggagtgaacgccttatccatcctaacgatgatgtcaataaaagtcagagttctaacgatgttttcccaacagcaatgcatgttgctgcggttattgcgctgagtgagcatcttattcctgagctgaaaatattacaaaaaacattggctgataaagctgaagcttataaggatatcgttaaaattggccgtacacacttgcaagatgcgacgccattgacccttggtcaggaaatttctggctgggcggcaatgttaacgcataacctgaaacacattgaagacagtattccccatgtttgtgaattggcactagggggaactgcggttggcaccggtttaaatactcatcctgaatatgctgttcgtgttgctaagaaattggctgaactgaccaaccattcgtttgttactgccccaaataaatttgaagccctggcgacttgtgatgctctggttcattctcatggggcattaaaaggtctggctgcatccataatgaaaattgcaaacgatgttcgttggttggcttccggccctcgctgtggtatcggtgaaatttcaattcctgaaaatgaaccgggtagctcaatcatgccaggtaaagttaacccaactcagtgtgaagcagtgacgatgctttgtgcacaggtgatgggcaatgatgttgctattaatattggtggggcatcaggcaactttgagctaaatgtgtttcgcccaatggtgattaataacttcctgcaatctgttcgcttgttggctgatggtatgcgtagcttcaatgaacattgtgcagtcggtatcgaacccaaccgtgatcgcattactcagttgctgaatgaatctctgatgttagtaacggcgctgaatacacatattggttatgacaaagctgcagaaattgctaagaaagcccataaagaagggctgacattaaaacaatcggcgatgaaactgggttatctgacagaagctgagtttgatgagtgggttcgtccagaagatatggttggcagcttgaagtag

SEQ ID NO: 16999 - protein, 464 aa, Photorhabdus luminescens
MAATRIEKDSMGPIEVPADQLWGAQTQRSLEHFRISQEKMPVALIHALALTKQAAASVNMDLGLLPQERGEAIIAAAKEVLEGKHPTEFPLAIWQTGSGTQSNMNMNEVLANRGSEILGGVRGSERLIHPNDDVNKSQSSNDVFPTAMHVAAVIALSEHLIPELKILQKTLADKAEAYKDIVKIGRTHLQDATPLTLGQEISGWAAMLTHNLKHIEDSIPHVCELALGGTAVGTGLNTHPEYAVRVAKKLAELTNHSFVTAPNKFEALATCDALVHSHGALKGLAASIMKIANDVRWLASGPRCGIGEISIPENEPGSSIMPGKVNPTQCEAVTMLCAQVMGNDVAINIGGASGNFELNVFRPMVINNFLQSVRLLADGMRSFNEHCAVGIEPNRDRITQLLNESLMLVTALNTHIGYDKAAEIAKKAHKEGLTLKQSAMKLGYLTEAEFDEWVRPEDMVGSLK

SEQ ID NO: 17000 - DNA, 1401 bp, Prochlorococcus marinus
  CDS (1)..(1401)
atgatggctgacctgatgcgtatcgaacacgacagcatgggcactattgaggtgcccgctggggttctctggggtgcacaaacccagcgatcgctccttaacttcgccatcagcacagaccgcatgccagtcgaactgatccatgccttggcattgatcaaacaggctgccgccagcgtgaactgtcgcctgggtgtgctcgatgaagtccagcgggatcaaattatcaaggctgcctctgctgttgcatccggtcttcacgacgatcagtttccactgagggtgtggcaaaccggtagcggtacccacacaaacatgaatgtcaacgaggtgattagcaacctggcgtctcaggcaaacgacgaacccctaggtagccataggccggtgcatccaaacgatcatgtcaatcgatcccagtccaccaatgacgccttccctacagctatacatatcgccgcagtccaggggatcaccaacaacttgctgcctgaactggagcaattgatcgcagcctttgcccgaaaaagcgatgcctggagtgacatcatcaaaatcggtcgcactcatctacaggatgccgtacctctcacccttggtcaggaggcctctgcgtggcgggatcaaattgcctcagcccatagtcgtattcagtcaagcctgatagagctctaccccctgccgcttggaggcaccgccgtgggaacaggcctcaacgccccagctcgcttcggtcaagaaacagctgcgcaacttgccagcatcacaggcctgccattcagctcagcgaaaaacaagttcgccgtgatggcgagccatgacgggttagtgaatgcaatggctcagttgcgcatgttggcggttgcccttttcaagatctccaatgatctgcgcctactggcctgtggcccaagggccggcctggcagagctgcatctacctgagaatgagccgggaagctcgatcatgcctgggaaagtcaacccctctcaatgcgaggccatggccatggtctgtttacaggtcatcgggcttgattcagccgtgaccatggcaggtgggagtggtcatctccaaatgaacgtctacaaacccctgattggcttcaacctgcttcacagcattgaattgctacatgacgcctgccgcaagtaccggctggcaatggtgcaagggattgaaccaaaccgaatcaagatccagcatgatctagagcaatcgctgatgctagtgactgctttagccccagaaatcggttacgacaaagccagtgagattgcccacctcgcccatgagaagggattcagcctgcgtgaagcagcactaaaactcggctatgtgagcaaagaagacttcgatcgcattgttaatccggcattgatgacatctgctcggctgtga

SEQ ID NO: 17001 - protein, 466 aa, Prochlorococcus marinus
MMADLMRIEHDSMGTIEVPAGVLWGAQTQRSLLNFAISTDRMPVELIHALALIKQAAASVNCRLGVLDEVQRDQIIKAASAVASGLHDDQFPLRVWQTGSGTHTNMNVNEVISNLASQANDEPLGSHRPVHPNDHVNRSQSTNDAFPTAIHIAAVQGITNNLLPELEQLIAAFARKSDAWSDIIKIGRTHLQDAVPLTLGQEASAWRDQIASAHSRIQSSLIELYPLPLGGTAVGTGLNAPARFGQETAAQLASITGLPFSSAKNKFAVMASHDGLVNAMAQLRMLAVALFKISNDLRLLACGPRAGLAELHLPENEPGSSIMPGKVNPSQCEAMAMVCLQVIGLDSAVTMAGGSGHLQMNVYKPLIGFNLLHSIELLHDACRKYRLAMVQGIEPNRIKIQHDLEQSLMLVTALAPEIGYDKASEIAHLAHEKGFSLREAALKLGYVSKEDFDRIVNPALMTSARL

SEQ ID NO: 17002 - DNA, 1386 bp, Prochlorococcus marinus subsp
  CDS (1)..(1386)
atgaccaagaactttagatttgaaaaagatagtatgggacagataaaagttccttcagaggctttgtggggagcccaaacgcagagatcaattataaatttttctattggtgaggagttaattccaattgaattaatttattcacttacggttataaaaagagcagccgcaatttctaatttcaaattgggtttaataaataatgtaaaaaaagatctcattattgaagcctgtacagaaatccttgatgggaaacatgattctcaattccccttaaaaatatggcaaacaggtagtggtacacaaacaaatatgaatatcaatgaagtcatatctaatattgctgcgttaaaaacaaattcaggacttggaagtcatcatcctattcatccaaatgatgatgttaataaatcgcagtctacaaatgatacttttcctgcggctattcagatatctgttgttactcaaataattaaaaaattagttccatcaataaaggaacttactaaggttcttgatagtaagagtaataaatggaaagatcttataaaaataggtagaactcattttcaagatgcagtgccaatttcccttggtcaagaagtttctgcatggtcaaaacaactaaaggacgctgaagatgctctgataattagtcttaatgaattatgtttcttaccactaggtggtacggcagttggtacaggtattaattgtccaaaagatttttcaaaagaatctataaaatcaatttcagaatatactggtttatttttttataagtcaaagaatcatttctctttaatggcatctcatgatcgattagcccaagtaatgggtcaaataaaaatcctagcaagtgcattatttaagatttctaatgatattaaaatattgtcctcaggacctagatctggcatttatgaattaataattcccaaaaatgaaccagggagctcaatcatgcctgggaaagttaatccaacccaatgtgaagcattatcaatggtatgcactcaagtaatgggttttgaatacgcagtatcaatagctaatgccagcggcactttacaaatgaatgaatataagccactaattggatttaatattctcacgagtataaaattactgaatcatgcgataagtaacttcagactaaaattagttgaagggatacaaccaaacccaaaaactataaaagctaatcttgaaaattcactaatgcttgtaactgcattggttcccaaaataggttatgaaaaagcagcagaaattgcgaatcttgcttttaatgaatcaatcaacttaaaagaagcaacaataaaattaggttacttaactgctaatgaatttgaggatgctataaatactaataaaatgatttaa

SEQ ID NO: 17003 - protein, 461 aa, Prochlorococcus marinus subsp
MTKNFRFEKDSMGQIKVPSEALWGAQTQRSIINFSIGEELIPIELIYSLTVIKRAAAISNFKLGLINNVKKDLIIEACTEILDGKHDSQFPLKIWQTGSGTQTNMNINEVISNIAALKTNSGLGSHHPIHPNDDVNKSQSTNDTFPAAIQISVVTQIIKKLVPSIKELTKVLDSKSNKWKDLIKIGRTHFQDAVPISLGQEVSAWSKQLKDAEDALIISLNELCFLPLGGTAVGTGINCPKDFSKESIKSISEYTGLFFYKSKNHFSLMASHDRLAQVMGQIKILASALFKISNDIKILSSGPRSGIYELIIPKNEPGSSIMPGKVNPTQCEALSMVCTQVMGFEYAVSIANASGTLQMNEYKPLIGFNILTSIKLLNHAISNFRLKLVEGIQPNPKTIKANLENSLMLVTALVPKIGYEKAAEIANLAFNESINLKEATIKLGYLTANEFEDAINTNKMI

SEQ ID NO: 17004 - DNA, 1395 bp, Pseudomonas putida
  CDS (1)..(1395)
atgagccgtatcgagacagacagcctgggcccggtcgaagttccggaggacgcctactggggtgcgcagacccagcgttcgctgatcaacttcgccattggcaaggaacgcatgcccctcgcggtattgcacgccctggcactgatcaagaaggccgcggcgcgcgtcaacgaccgcaatggcgacctgccggccgacatcgcccggttgatcgaacaggccgccgatgaagtgctggatggccagcacgacgatcagttcccgctcgtcgtctggcagacgggcagtggcacccaaagcaacatgaacgtcaacgaggtgatcgccggacgcgccaacgaactggccggcaaaggccgtggcggcaaggcgccagtacaccccaatgaccacgtcaaccgctcgcagagctccaacgactgcttccccaccgccatgcacattgccgcagcccaggcggtgcatgaaaagctgctgccggccgtcactgaactgtcttcggggctggccgagctgtcgatgcgccaccacaagctggtaaaaaccggccgcacgcacatgatggacgccacgccgattaccttcggccaggaagtgtcggctttcgtcgcccagctcgattacgcccagcgcgctatccgcgccaccctgccggcggtgtgcgaactggcccagggcggcactgccgtgggtaccgggctgaacgctccgcagggttttgccgaggccatcgcggccgagctggcggcgctgtccggcctgccgttcatcactgcacccaacaagttcgccgccctcgccggccacgaaccgctgaccagcctggcgggagccctgaagaccctggccgtggccctgatgaaaatcgccaacgacctgcgcctgctggggtccggccctcgcgccgggcttgccgaggtgcgcctgccagccaacgagccgggcagctcgatcatgccgggcaaggtcaaccccacccagtgcgaggcgctgtcgatgctggcctgccaggtactgggcaacgacgcggccatcggctttgccgccagccaggggcatttgcagttgaatgtgttcaagccggtgatcattcataacctgctgcaatccatcgagttgctggccgatggttgccgcaacttccagcagcattgcgtggcgggtatcgagccggatgccgagcagatggccgcgcacctggagcgtgggttgatgctggtgacggcgctgaacccgcatattggctatgacaaggcggcagaaattgccaagaaggcttacagcgagggcacgaccttgcgcgaggcggcattggcgttgaagtacctgaccaatgaacagttcgaccagtgggtgcggccggagaacatgctggcgcctgggggcaaaggctag

SEQ ID NO: 17005 - protein, 464 aa, Pseudomonas putida
MSRIETDSLGPVEVPEDAYWGAQTQRSLINFAIGKERMPLAVLHALALIKKAAARVNDRNGDLPADIARLIEQAADEVLDGQHDDQFPLVVWQTGSGTQSNMNVNEVIAGRANELAGKGRGGKAPVHPNDHVNRSQSSNDCFPTAMHIAAAQAVHEKLLPAVTELSSGLAELSMRHHKLVKTGRTHMMDATPITFGQEVSAFVAQLDYAQRAIRATLPAVCELAQGGTAVGTGLNAPQGFAEAIAAELAALSGLPFITAPNKFAALAGHEPLTSLAGALKTLAVALMKIANDLRLLGSGPRAGLAEVRLPANEPGSSIMPGKVNPTQCEALSMLACQVLGNDAAIGFAASQGHLQLNVFKPVIIHNLLQSIELLADGCRNFQQHCVAGIEPDAEQMAAHLERGLMLVTALNPHIGYDKAAEIAKKAYSEGTTLREAALALKYLTNEQFDQWVRPENMLAPGGKG

SEQ ID NO: 17006 - DNA, 1395 bp, Pseudomonas syringae
  CDS (1)..(1395)
atgagccgcaccgaaaccgacagcatcggcccgatcgaagtccctgaagatgcctattggggcgcgcagacccaacgctcactgatcaactttgcgattggcgaccagcgtatgccgttggccgttctgcatgcgttgaccttgatcaagaaagccgccgcacgcgtcaacgaccgcaacggcgacctgccggccgatatcgcccggctgatcgaacaggctgccgacgaggtgctcgacggtcagcacgacgcgcagtttccgctggtggtctggcagaccggcagtggcacgcagagcaacatgaacgtcaacgaagtgatcgccggccgcgccaacgaactggccggccagggccgtggcggcaaatcgccggtccaccccaacgatcacgtcaatcgctcgcaaagctccaacgactgctttccgacagccatgcacattgccactgcgcaagcggtcaaggaacagctgctgccggcgattgccgagctgtccagcgggctggccgaacaggccgcgcgtcacatgaagctggtcaagaccgggcgcacgcacatgatggacgccacgccgatcacctttggccaggagctttcggggttcgtcgcgcaactggattacgcagaaaaagccattcgcgccgccctgcccgccgtctatgaactggcgcaaggtggcaccgcagtcggcaccgggctcaacgcgccgaaaggcttcgctgaagccatcgcggcagaactggctgcactgtcgggcttgccgttcgtcaccgcgccgaacaaattcgccgcactggcgggccacgagccgctggctgcgctttccggcgcattgaaaacgctggccggcaccctgatgaagatcgccaacgacctgcgcttgctgggttccggcccgcgtgccgggttggcggaagtcaggttgccagccaacgagcccggcagctcgatcatgcccggcaaggttaacccgactcagtgcgaggccctgtcgatgctggcctgccaggttatgggcaacgatgtgaccatcggttttgccgccagccagggccatttgcaactgaacgtctataagccggtgatcattcacaacgtattgcagtcgatccgactgctggccgacggttgcagcaatttcaatgaacactgcgtcgccggcatggagccagacgccgaaaaaatggctgagcaccttgaacgcggcctgatgctggtcaccgcgctcaacccgcacatcggctatgacaagtcggcgcacattgccaaaaaagcctacaccgaaggcctgaccctgcgtgaagcagcgctggcgctgggttacctgaccgacgaggagttcgacgcctgggtgcgcccggacaagatgctggaggcgggcagcaatggttga

SEQ ID NO: 17007 - protein, 464 aa, Pseudomonas syringae
MSRTETDSIGPIEVPEDAYWGAQTQRSLINFAIGDQRMPLAVLHALTLIKKAAARVNDRNGDLPADIARLIEQAADEVLDGQHDAQFPLVVWQTGSGTQSNMNVNEVIAGRANELAGQGRGGKSPVHPNDHVNRSQSSNDCFPTAMHIATAQAVKEQLLPAIAELSSGLAEQAARHMKLVKTGRTHMMDATPITFGQELSGFVAQLDYAEKAIRAALPAVYELAQGGTAVGTGLNAPKGFAEAIAAELAALSGLPFVTAPNKFAALAGHEPLAALSGALKTLAGTLMKIANDLRLLGSGPRAGLAEVRLPANEPGSSIMPGKVNPTQCEALSMLACQVMGNDVTIGFAASQGHLQLNVYKPVIIHNVLQSIRLLADGCSNFNEHCVAGMEPDAEKMAEHLERGLMLVTALNPHIGYDKSAHIAKKAYTEGLTLREAALALGYLTDEEFDAWVRPDKMLEAGSNG

SEQ ID NO: 17008 - DNA, 1386 bp, Ralstonia solanacearum
  CDS (1)..(1386)
atgacgacccgtaccgaacgcgatacctttggcccgatcgaagtccccgccgaccgcctgtggggcgcgcagacgcagcgctcgctgcagaacttcgacatcgccggcgaccgcatgccgcgcgagctgatcgacgcgctggcccgcatcaagcgcgccagcgccgccgtcaaccagcgcctgggcctgctgccggccgacaaggcgaacgcggtcatcgccgcggccgacgaggtcatcgccggcaagcatccgggcgagttcccgctggtggtctggcagaccggctccggcacgcagagcaacatgaacatgaacgaggtgctcgccaaccgcgccagcgaactgctgggcggcgagcgcggcgaagcccgcctggtgcaccccaacgacgacgtgaaccgcagccagtcgtccaacgacgtgttcccgacggcgatgcacgtggcggccgtcaccgccatcacgcggcacctgctgccgtcgctgcgcgcgctgcgcgagacgctggcgcgcaaggccatcgacttcgacgacatcatcaagatcggccgcacccacctgcaggacgccacgccgctcacgctcggccaggagttctccggctacgcggcccagctgcagcacagcgagacgcacctgaacgccgcgctgccgcacctgtgcgagctggcgctgggcggcacggcggtcggcaccggcctgaatgcgccggccggctatgccgaacaggtggccgccgaactcgccgcgctgaccggcctgcccttcgtcacctcgcccaacaagttcgagaccatggcctcggccgacggcctggtgcacgcgcacggcgccctgaagacgctggccgccagcctgaccaagatcgccaacgacatccgctggctggccagcggcccgcgcagcggcctgggcgagctgtccattcccgagaacgagccgggctcgtccatcatgccgggcaaggtcaacccgacccagagcgaggcgatgacgatgctgtgcgcgcaggtgttcggcaacgatgtcgccgtcaacatcggcggggcctcgggcaacttcgagctgaacgtgttccggccgatgatcgcctacaacttcctgcacagcgcgcgcctgctggccgacggcatgcgcagcttcaacgaccactgcgcggtcggcatcgagcccaaccgcgagcgcatcgccgagctggtgcagcgctcgctgatgctggtgaccgcgctcaacccgcacatcggctacgacaaatcggcgcagatcgccaagaaggcgcacaaggaaggcaccagcctgcgcgaggcggcgctggcgctggggtatgtgacggccgagcagttcgatgcgtgggtgcggccggagcagatggtgggacgctga

SEQ ID NO: 17009 - protein, 461 aa, Ralstonia solanacearum
MTTRTERDTFGPIEVPADRLWGAQTQRSLQNFDIAGDRMPRELIDALARIKRASAAVNQRLGLLPADKANAVIAAADEVIAGKHPGEFPLVVWQTGSGTQSNMNMNEVLANRASELLGGERGEARLVHPNDDVNRSQSSNDVFPTAMHVAAVTAITRHLLPSLRALRETLARKAIDFDDIIKIGRTHLQDATPLTLGQEFSGYAAQLQHSETHLNAALPHLCELALGGTAVGTGLNAPAGYAEQVAAELAALTGLPFVTSPNKFETMASADGLVHAHGALKTLAASLTKIANDIRWLASGPRSGLGELSIPENEPGSSIMPGKVNPTQSEAMTMLCAQVFGNDVAVNIGGASGNFELNVFRPMIAYNFLHSARLLADGMRSFNDHCAVGIEPNRERIAELVQRSLMLVTALNPHIGYDKSAQIAKKAHKEGTSLREAALALGYVTAEQFDAWVRPEQMVGR

SEQ ID NO: 17010 - DNA, 1392 bp, Rhizobium meliloti
  CDS (1)..(1392)
atgacatcgacccgcacggaaacagatacgttcggccccatcgaagtggcgagcgaccgctattggggcgcccaggcgcagcgatcgctgggcaatttcaaaatcggctgggaaaagcagcctctggcaatcgtgcgcgcactcggcatcgtcaaacaggcggctgcccgcgccaacatggcgctcggccgcctcgacccggcgatcggcgacgccatcgtcaaggccgcacaggaggtgatcgacggcaagcttgacgagcacttccctctcgtcgtgtggcagacgggctccggaacccagtcgaacatgaatgcgaacgaggtcgtttccaaccgtgcgatcgagctgctcggcggcgtcatgggttcgaagaagccggttcacccgaacgatcacgtcaatatgagccagtcgtcgaacgacacctatcccacggccatgcacatcgcctgtgcggagcgcgtgatccacgatctgctgccggcgctcaagcacctgcacaaggcgctcgaagagaaggtgaaggctttcgatcacatcatcaagatcggccgcacccacacgcaggacgcaacgcccctgacgctggggcaggagttttccggctatgcggcgcaggtcgcctcctcgatcaaacggatcgagatgacgctccccggcctttgcgagctcgcccagggggggaccgcggtcggcaccgggctcaatgcgccggtcggatttgccgagaaggtcgccgaggaaatcgctgccatcaccggcatcggcttcacttccgcgccgaacaagttcgaagcgctggccgcccacgactcgatggtcttcagccacggggcaatcaacgccaccgccgccgcgctcttcaagatcgccaacgacatccgcttcctcggctccggcccccgctccggcctcggcgagctttcactgccggaaaacgagccgggctcgtccatcatgccgggcaaggtcaacccgactcagtgcgaggcgctcacccaggtctgcgtccaggtcttcggcaatcatgcggcgctgacctttgccggcagccagggccacttcgagctcaacgtctacaatccgctgatggcgtacaacttcctgcagtcggtgcaactgctcgccgatgcggctatctccttcaccgacaattgcgtcgtcgggatcgaggcgcgggaggacaacatcaaggcggcgctcgaccgttcgctcatgctggtgactgcgcttgcgccgaagatcggctacgacaacgcggccaagatcgccaagaccgcccacaagaacggtaccacgcttcgcgaggaggccgtcggcggcggttacgtcacggacgaggagttcgacgccgtcgtccgccccgaaaccatgatcggcccggcctga

SEQ ID NO: 17011 - protein, 463 aa, Rhizobium meliloti
MTSTRTETDTFGPIEVASDRYWGAQAQRSLGNFKIGWEKQPLAIVRALGIVKQAAARANMALGRLDPAIGDAIVKAAQEVIDGKLDEHFPLVVWQTGSGTQSNMNANEVVSNRAIELLGGVMGSKKPVHPNDHVNMSQSSNDTYPTAMHIACAERVIHDLLPALKHLHKALEEKVKAFDHIIKIGRTHTQDATPLTLGQEFSGYAAQVASSIKRIEMTLPGLCELAQGGTAVGTGLNAPVGFAEKVAEEIAAITGIGFTSAPNKFEALAAHDSMVFSHGAINATAAALFKIANDIRFLGSGPRSGLGELSLPENEPGSSIMPGKVNPTQCEALTQVCVQVFGNHAALTFAGSQGHFELNVYNPLMAYNFLQSVQLLADAAISFTDNCVVGIEAREDNIKAALDRSLMLVTALAPKIGYDNAAKIAKTAHKNGTTLREEAVGGGYVTDEEFDAVVRPETMIGPA

SEQ ID NO: 17012 - DNA, 1404 bp, Salmonella typhimurium
  CDS (1)..(1404)
atggtaacggtacgccgcgagaaagattcaatgggcgcgattgaagtcccggcagataaactgtggggggcgcagactcaacgttcgctggagcattttcggatttccacggagaaaatgcccgtctcgctcattcacgctctggcgttgaccaagcgcgccgctgcgaaggtcaaccaggacttagggttgttggcggcggaaaaagccagcgcgattatccaggcggctgatgaagtgctggcgggaaaacatgctgatgagtttccgctggcgatttggcagaccgggtccggtacgcaaagcaacatgaatatgaatgaagtgttagcgaaccgcgccagtgaaattttgggcggcgttcgcggtatggaacgcaaggtgcatcccaatgatgacgtcaataagagtcaaagctcaaacgatgttttcccaaccgccatgcacgtggcggcgttactggcgttacgcgaacaccttatcccgcaattatccgcattaacggatacgcttcgcgataaatcccacgctttcgccgatattgtcaaaattggccgtactcacctgcaggacgcgacgccgctcaccttaggccaggagatttccggttgggtagccatgctggaacataacctcagacacattgagcacagtttaccgcacgtcgcggaactggcgctcggcggaaccgcagtagggacagggcttaatacccatccggaatatgcccggcgcgtggccgaggaactggcgacgattaccgcggcgccgtttgttaccgcccccaataaattcgaagcgctggcgacctgtgacgcgttggtacaggcgcatggcgcattaaaaggactggcggcctcgctgatgaaaatcgccaacgatgttcgctggctggcgtccggcccgcgttgcggcattggcgagattgctatcccggagaatgagccaggcagttccattatgcctggtaaagtgaacccgacccagtgtgaagcggtaacgatgctatgttgccaggtgatgggtaacgatgtggccatcaatatggggggcgcatcgggcaactttgagctcaacgtctatcgtccgatggttattcataattttctgcaaacggtgcgcctgctggccgatggcatggagagttttaataaacactgtgcgtcaggaatcgagccaaaccgcgagcgtattacgcagttgctgaatgagtcgctgatgctggtcactgcgctgaatacgcacatcggttacgataaagcggcggagattgcgaagaaggcgcataaagaagggctgacgctcaaagcctcagccgtggcattaggataccttagcgacgaggagttcgacgcctgggtacgtccggagttgatggttggcagtatgacgccgggacgttaa

SEQ ID NO: 17013 - protein, 467 aa, Salmonella typhimurium
MVTVRREKDSMGAIEVPADKLWGAQTQRSLEHFRISTEKMPVSLIHALALTKRAAAKVNQDLGLLAAEKASAIIQAADEVLAGKHADEFPLAIWQTGSGTQSNMNMNEVLANRASEILGGVRGMERKVHPNDDVNKSQSSNDVFPTAMHVAALLALREHLIPQLSALTDTLRDKSHAFADIVKIGRTHLQDATPLTLGQEISGWVAMLEHNLRHIEHSLPHVAELALGGTAVGTGLNTHPEYARRVAEELATITAAPFVTAPNKFEALATCDALVQAHGALKGLAASLMKIANDVRWLASGPRCGIGEIAIPENEPGSSIMPGKVNPTQCEAVTMLCCQVMGNDVAINMGGASGNFELNVYRPMVIHNFLQTVRLLADGMESFNKHCASGIEPNRERITQLLNESLMLVTALNTHIGYDKAAEIAKKAHKEGLTLKASAVALGYLSDEEFDAWVRPELMVGSMTPGR

SEQ ID NO: 17014 - DNA, 1386 bp, Staphylococcus aureus
  CDS (1)..(1386)
atgtcagtaagaattgaacatgatacttttggagaaatagaagtacctgcagataaatattggggtgctcaaacagaaagaagtaaacgcaatttcccagttggtaaagagcgtatgccaatcgaagtagtttatggttttgcacaactaaagcgtgcagcagcattagctaattttgatttaggaaaattaagcgaggcaaagaaagatgccattgtatacgcatgtgatcaaattttatcaggtgaattagatgaacacttcccactagttgtatggcaaacaggaagcggtacacaaagtaatatgaatgtgaacgaagtagtaagttatgttgctaatatgtatttaaaagatcatcaaattgatgaaagtatccacccaaatgatgatgtaaataaatcacaaagttcgaatgatacattcccaactgctatgcacgttgcattatatcaagaggttgaaacaaaattagaacctgcattaaaacttttaagaaatactttgaaagaaaaagaagacaaatttgattcaattattaaaattggtcgtacacatttacaagatgcaacgccgatcaaactaggacaagagattagtggctggcgttatatgcttgaccgttgcgaaataatgttatctgaatctaagaagcacattttaaatcttgccatcggtggtacggctgttggtactggtattaatgcgcatcctgaatttggtgataaagtggcacattatatttcagaaaatacgggttatccatttgtatcttctgaaaataaattccatgcattaacagcacatgatgaagtagtacaactacatggaacattgaaggcgctagcaggagacttaatgaaaattgctaatgatgtgagatggttggcttcagggccacgagctggtttggcagaaatttctatccctgaaaatgaaccaggttcatcaattatgcctggtaaagttaatcctacacaatgtgaaatgttaacaatggttgcagtccaagtaatgggtaatgatacagttgttggcttcgcaagttcacaaggtaactttgaattgaatgtttataaaccagttattatgcataatacactacaatcaatttaccttttagctgatggtatggaaacatttaataacaattgcgcagtgggcattgaaccaatcgaagagaatattgataattatttaaatcaatcattaatgttagttactgcattaaatccacatattggttatgaaaaagcagctcaaattgctaagaaagcccataaagaaggtttaactttaaaagaatctgcaattcaaactggatatgttacagaagaacaatttgaagcatggattaaaccagaagatatggtagatcctcattaa

SEQ ID NO: 17015 - protein, 461 aa, Staphylococcus aureus
MSVRIEHDTFGEIEVPADKYWGAQTERSKRNFPVGKERMPIEVVYGFAQLKRAAALANFDLGKLSEAKKDAIVYACDQILSGELDEHFPLVVWQTGSGTQSNMNVNEVVSYVANMYLKDHQIDESIHPNDDVNKSQSSNDTFPTAMHVALYQEVETKLEPALKLLRNTLKEKEDKFDSIIKIGRTHLQDATPIKLGQEISGWRYMLDRCEIMLSESKKHILNLAIGGTAVGTGINAHPEFGDKVAHYISENTGYPFVSSENKFHALTAHDEVVQLHGTLKALAGDLMKIANDVRWLASGPRAGLAEISIPENEPGSSIMPGKVNPTQCEMLTMVAVQVMGNDTVVGFASSQGNFELNVYKPVIMHNTLQSIYLLADGMETFNNNCAVGIEPIEENIDNYLNQSLMLVTALNPHIGYEKAAQIAKKAHKEGLTLKESAIQTGYVTEEQFEAWIKPEDMVDPH

SEQ ID NO: 17016 - DNA, 1386 bp, Staphylococcus epidermidis
  CDS (1)..(1386)
atgtcagtcagaattgaacatgatacatttggagaaattgaagtaccagaagacaaatattggggtgcacagactgaaagaagtaaacgaaattttccagtcggcaaagagcatatgcctatacaagtcatttacggatttgctcaactaaaaagaggtgcagccttagcaaatcatgaattaggaaaattgagtgatgaaaaaaagaacgccatcgtttatgcttgtgatcgtattttaaatggagaactagataatcattttccacttgtgatttggcaaacaggtagtggtactcaaagcaatatgaatgtaaatgaagtcgtaagctatgtagctaatgaataccttaagaaacatggaagtaaggaaactatccatccaaatgatgatgtaaataaatctcaaagttcaaatgatacatttcctacagctatgcatgtcgcattgttccatgaagttgaaactaagttagagccagcacttaaccatttacgtcaaacttttaaagaaaaagaagaccaatatcaatcaatcattaaaattggacgcacacatttgcaagatgcaacgcctattaaactaggtcaagagataagtggttggcgctatatgttagaaaaatgtgagcaattactatcagaatcaaaaaagcatattttaaatttagcaattggtggaactgcagtaggaacgggaattaatgctcatccagaatttggtcataaagtagccaaatatatttcccaaaacacagggtatgctttcgtatcatctgaaaacaaatttcatgctttaacttctcatgatgaaattgtacaattacatggaacattaaaagcgctagcgacagatttaatgaaaattgcaaatgatattagatggctagcctctggaccgcgtgcaggtcttgctgagatttcaattccagaaaatgaacctggatcttctattatgccaggaaaagtaaatccaacacaatgtgaaatgttaactatggtagcagtacaagtcatggggaatgatacgacggtaggtatcgcaagttctcaaggtaattttgaactaaatgtatttaaaccggtaattatgcataacactttacaatctatttacttattagcagatggaatgaatacctttaataaaaactgtgcaattggtattcaaccgatagaagaaaatattaataattatttaaatcaatcattaatgctagttacggcactgaaccctcatattggatatgagaaagcagctcaaatagctaaaaaggcacacaaagaaggacttactttaaaagaatctgcaatagaaagtggatatgtaactgaatcacaatttgaagagtggataaaaccagaagatatggtagacccacattga

SEQ ID NO: 17017 - protein, 461 aa, Staphylococcus epidermidis
MSVRIEHDTFGEIEVPEDKYWGAQTERSKRNFPVGKEHMPIQVIYGFAQLKRGAALANHELGKLSDEKKNAIVYACDRILNGELDNHFPLVIWQTGSGTQSNMNVNEVVSYVANEYLKKHGSKETIHPNDDVNKSQSSNDTFPTAMHVALFHEVETKLEPALNHLRQTFKEKEDQYQSIIKIGRTHLQDATPIKLGQEISGWRYMLEKCEQLLSESKKHILNLAIGGTAVGTGINAHPEFGHKVAKYISQNTGYAFVSSENKFHALTSHDEIVQLHGTLKALATDLMKIANDIRWLASGPRAGLAEISIPENEPGSSIMPGKVNPTQCEMLTMVAVQVMGNDTTVGIASSQGNFELNVFKPVIMHNTLQSIYLLADGMNTFNKNCAIGIQPIEENINNYLNQSLMLVTALNPHIGYEKAAQIAKKAHKEGLTLKESAIESGYVTESQFEEWIKPEDMVDPH

SEQ ID NO: 17018 - DNA, 1404 bp, Streptomyces avermitilis
  CDS (1)..(1404)
atgaccgacgaggacgacaagcagaactaccgtgtcgagcacgactccatgggtgaggtccgtgtccccgcggacgccaagtggcgggcccagacccagcgtgccgtggagaacttccccatctccgggcagcggctcgagcgggcgcacatcgaggccctcgcccggatcaagggagccgccgccaaggtgaacgccgagttgggcgtgctcgacaaggacgtcgccgaggccattcaggaggcggccgccgaggtcgcggaggggcgttgggacgagcacttccccgtggacgtgttccagaccggctccgggacctcgtccaacatgaacgccaacgaggtcatcgccacgctcgcgaccgaacggctcggcagggacgtacaccccaatgaccacgtgaacgcgtcgcagtcgtcgaacgacgtgttcccgtccagcattcacatcgcggccaccgccgccgtcacccgcgatctggtacccgccctggagcacctggccgccgcgctgggccgcaagtccgaggagttcgcggacgtcgtgaaggccgggcgtacgcatctcatggacgcgacgcccgtgaccctggggcaggagttcggcggatacgcggcccaggtgcggtacggcgtcgagcggctggccgcctccctgccgcggctcgccgaactgcccctcgggggcaccgcggtcgggaccgggatcaacaccccgccgggcttctccgccgccgtcatcgccgaggtcgcccgcgtcaccgggctgccgctcaccgaggcgcgcgaccacttcgaggcgcagggtgcgcgggacgggatcgtcgagaccagcgggcagttgcggaccatcgccgtaggactgacgaagatcgcgaacgatctgcggtggatggcttcggggccgcgtaccgggctctccgagatcagcctgcccgaccttcagccggggtcctcgatcatgcccggcaaggtgaatcccgtgattcccgaggccgtgctgatggtcgccgcacaggtgacgggcaacgacgcgaccgtcgccgccgccggagccgccggcaacttcgaactcaatgtgatgctgcccgtcatcgcgaagaacgtgctggagtccgtccggctgctcgcccatgtctcccggctgctggccgaccgcaccgtcgacgggatcgtcgcccatcgcgaccgggcccgtgagtacgccgagtcgtcaccgtccgtcgtcaccccgctgaacaagtacatcgggtacgaggaggccgcgaaggtcgccaagaaggccctcgccgagcggcagacgatccgtcaggtcgtcctggagagcggatacgtggaccgtggcgacctcaccctggagcagctcgacgaggcgctcgacgtcctgcggatgacgcacccctga

SEQ ID NO: 17019 - protein, 467 aa, Streptomyces avermitilis
MTDEDDKQNYRVEHDSMGEVRVPADAKWRAQTQRAVENFPISGQRLERAHIEALARIKGAAAKVNAELGVLDKDVAEAIQEAAAEVAEGRWDEHFPVDVFQTGSGTSSNMNANEVIATLATERLGRDVHPNDHVNASQSSNDVFPSSIHIAATAAVTRDLVPALEHLAAALGRKSEEFADVVKAGRTHLMDATPVTLGQEFGGYAAQVRYGVERLAASLPRLAELPLGGTAVGTGINTPPGFSAAVIAEVARVTGLPLTEARDHFEAQGARDGIVETSGQLRTIAVGLTKIANDLRWMASGPRTGLSEISLPDLQPGSSIMPGKVNPVIPEAVLMVAAQVTGNDATVAAAGAAGNFELNVMLPVIAKNVLESVRLLAHVSRLLADRTVDGIVAHRDRAREYAESSPSVVTPLNKYIGYEEAAKVAKKALAERQTIRQVVLESGYVDRGDLTLEQLDEALDVLRMTHP

SEQ ID NO: 17020 - DNA, 1386 bp, Streptomyces coelicolor
  CDS (1)..(1386)
atgagcgaataccgcatcgagcacgactccatgggcgaggtccgcgtccccgcggacgccaagtggcgcgcccagacccagcgcgccgtcgagaacttccccgtctccgggcagcgcatcgagcgcgcgcacatcgaggcgctggcgcggatcaagagcgcggcggcgaaggtcaacgccgagctgggagtgctcgacgaggacgtcgccggcgcgatccaggaggcggccggtgaggtggccgaggggaagtgggacgagcacttccccgtcgacgtgttccagaccgggtccgggacctcgtccaacatgaacaccaacgaggtcgtcgccaccctggcgactgaacggctcggccgcgacgtgcatcccaacgaccacgtcaacgcctcccagtcgtccaacgacgtcttcccgtcctcgatccacatcgccgccaccgccgccgtcacccgcgacctgatcccggccctggaccatctcgccggcgccctggagcgcaaggccggggagttcgccgacgtggtgaagtccgggcgtacgcacctcatggacgccacgcccgtcaccctgggccaggagttcggcggttacgcggcccaggtgcggtacggcatcgagcggcttcaggcctcactgccccggctcgccgagctgccgctgggcggcaccgcggtcggcaccggcatcaacaccccgcccggcttctccgccgccgtcatcgaggaggtggcccgcgcgacggggctgccgctgaccgaggcgcgcgaccacttcgaggcgcagggcgcccgggacggcatcgtcgagaccagcgggcagctgcggaccatcggcgtcgggctcacgaagatcgccaacgacctgcgctggatggcgtccggtccgcgcaccgggctcgcggagatctcgctgcccgacctccagcccgggtcgtccatcatgcccggcaaggtcaacccggtgatccccgaggcggtcctcatggtcgccgcccaggtcaccggcaacgacgcgacggtcgccgcggcgggcgcggccggcaacttcgagctgaacgtgatgctgccggtcatcgccaagaacgtgctggagtcggtgcggctgctcgccaacgtctcccggctgctcgccgaccgcaccgtggacgggatcgtggcgcaccccgagcgggcccgcgagtacgccgagtcctcgccctccgtggtcacgccgctcaacaagtacctcgggtacgaggaggccgccaaggtcgccaagagggcgctggccgagcggaagacgatccggcagaccgtgctggagggcggctacgtggaacgcggcgacctcacgcgggagcaactggaccaggccctggacgtgctgcggatgacccgcccgtga

SEQ ID NO: 17021 - protein, 461 aa, Streptomyces coelicolor
MSEYRIEHDSMGEVRVPADAKWRAQTQRAVENFPVSGQRIERAHIEALARIKSAAAKVNAELGVLDEDVAGAIQEAAGEVAEGKWDEHFPVDVFQTGSGTSSNMNTNEVVATLATERLGRDVHPNDHVNASQSSNDVFPSSIHIAATAAVTRDLIPALDHLAGALERKAGEFADVVKSGRTHLMDATPVTLGQEFGGYAAQVRYGIERLQASLPRLAELPLGGTAVGTGINTPPGFSAAVIEEVARATGLPLTEARDHFEAQGARDGIVETSGQLRTIGVGLTKIANDLRWMASGPRTGLAEISLPDLQPGSSIMPGKVNPVIPEAVLMVAAQVTGNDATVAAAGAAGNFELNVMLPVIAKNVLESVRLLANVSRLLADRTVDGIVAHPERAREYAESSPSVVTPLNKYLGYEEAAKVAKRALAERKTIRQTVLEGGYVERGDLTREQLDQALDVLRMTRP

SEQ ID NO: 17022 - DNA, 1404 bp, Synechococcus elongatus
  CDS (1)..(1404)
atgacaactgacactcgcctagaatacgattccctcggtgccgttgaggtgcctgcggactgctattggggtgctcagacggcgcgttccctcaagcactttgccattggcagtcagcgaatgcccctagcggtgatccatgccatggcacggctcaaaaaggcggcggcgatcgccaaccgtgatttaggagttttagaccctgagaaagccaaatggatcattcaagccgccgatgaagttattgccggacagtgggatgatcagtttcccctcgccatctggcagacgggtagcggcacccaaacgaatatgaatgtcaatgaggtcattgctaaccgtgccattgagctggcgggaggcgttaaggggagcaaaagccccatccatcccaacgatcatgtgaattgtagccagtcctccaatgacacctttcccacggccatgcatgttgccacagtccttgccctacaggagcgcctgctgccaacgctacgccatctcttgacggtcttgcaggaaaaagcggctgcctttgcagagattatcaaaattggccgtacccatttaatggatgccgttcccttgaccctaggccaggaattcagcggttacgccagtcaaattgcggccgctcaagcccatattgaatatgccctgcagcatctgtatccccttgccattggcgctacagcggtggggacggggttgaatgcacccgctggttttggcgatcgcgtggcagcagaattagcgcaaatgacggggtatccctttcgtaaagctgaaaacccctttgccgccttggcagcccacgatcccctagtgatgctcagtggtgctctaaaaaccctggctgccgccctgatgaaaatcgccaacgatattcgttggttgggatcgggaccgcgttgtggtctgggggaattgaggttacccgccaatgaaccggggtcatcaattatgcccggcaaggtgaaccccacccaatgcgaagccttaacgatggtgtgtgtgcaggtgatgggcaacgatgcagccgtgggaatagcgggcagtcaaggaaattttgagttaaatgtctataagcccttgatcatttacaatgtgctgcaatctattgcccttctgagtgatgcagctcaatcgtttaccgaccattgcttagtgggagttgagcccaatcggcagcaaattcaagcctatgtggagcgatcgctcatgttggtgacggctctcaatccccacataggctacgacaaggcggcggcagtcgcgaaaaaggcctacagtgagggtaaaaccctcaaggaagcagctgtggaattgggctatctcactgctgaggagtttgaccgctgggtacgactagagctgatgcttggcgaaaagggcaccagttga

SEQ ID NO: 17023 - protein, 467 aa, Synechococcus elongatus
MTTDTRLEYDSLGAVEVPADCYWGAQTARSLKHFAIGSQRMPLAVIHAMARLKKAAAIANRDLGVLDPEKAKWIIQAADEVIAGQWDDQFPLAIWQTGSGTQTNMNVNEVIANRAIELAGGVKGSKSPIHPNDHVNCSQSSNDTFPTAMHVATVLALQERLLPTLRHLLTVLQEKAAAFAEIIKIGRTHLMDAVPLTLGQEFSGYASQIAAAQAHIEYALQHLYPLAIGATAVGTGLNAPAGFGDRVAAELAQMTGYPFRKAENPFAALAAHDPLVMLSGALKTLAAALMKIANDIRWLGSGPRCGLGELRLPANEPGSSIMPGKVNPTQCEALTMVCVQVMGNDAAVGIAGSQGNFELNVYKPLIIYNVLQSIALLSDAAQSFTDHCLVGVEPNRQQIQAYVERSLMLVTALNPHIGYDKAAAVAKKAYSEGKTLKEAAVELGYLTAEEFDRWVRLELMLGEKGTS

SEQ ID NO: 17024 - DNA, 1398 bp, Synechococcus sp
  CDS (1)..(1398)
atgggccaaccgatgaggcaggagcacgacagcattggaggtgtcgacgtccccgctgcagcgctctggggagcccaaacccagcgatctctcaacaacttcgccattggtcatcaaaagattccagcggagctgattcatgccctggcacggatcaaacagtgctgcgccgcggtgaacggtcgccatggtctgttgaacgaccaacaggtggccttgatcgaacgggcgggccaggcaatccaaacaggccagcaagatgatcactttcctctgagtgtctggcaaaccggcagcggcacgcagacgaacatgaacgtgaatgaggtgatcagcaacctcgctgctcaggaatccggagagaacctcggctcgcaccgtcccctccaccccaacgaccacatcaaccggtctcagtccacaaatgacgttttcccggcagcgatccatgtagctgcggctctgcagctgcagcaggagctgctgccagagctgaagcggctgatcgcgagtctcgatgccaaggccgttgcctggcaggacatcatcaagatcgggcggacccatctgcaggacgcagtgccgcttcgccttggagatgaagtcagcgcctggcgcgaccgactcagcgacggcgcccattggctgaccacagcccatcaagacctactggctctgccgctcggaggcacagccgtcggcagtggattgaacacgccggaccgatttgcccacgaggtttgtgctgaactcgccagccgaacgggatccgactttcagccggcggacaacctgtttgctgtcatggcgggccatgactccctggtgcagaccatggctcagctgcggcgcctggccgtgacgctgctcaccatcgctaatgacatccgcctgctggcttgcggacccagggctgggctgggggaactgctgttgccggccaatgaaccgggcagctcgatcatgccaggaaaggtgaatcccacccagtgcgaggccatggcgatggtctgcacccaggtgatcggcatggatgcagccgtcgcggcagctggtgctggggggcatctccagatgaacgtgtataaacccctgatcggctacaacctgatcgagggcatccgtctgctgcaagacgcctgccgctgtttccggctgaatctgttgaccgggatggaagcagaccgtgaccggatcgcattttacgtggagcgatccctgatgctggtgacggctttgacgccggagatcggctacgaaaaagcctgtgcgatcgcccagcacgcccaccgagacggactgacgcttcgagaggccgccatgcaatccggagcgatcacagacgaacgctttgaccagttgatcgatccagccgcgatggcctcaccccaccgctga

SEQ ID NO: 17025 - protein, 465 aa, Synechococcus sp
MGQPMRQEHDSIGGVDVPAAALWGAQTQRSLNNFAIGHQKIPAELIHALARIKQCCAAVNGRHGLLNDQQVALIERAGQAIQTGQQDDHFPLSVWQTGSGTQTNMNVNEVISNLAAQESGENLGSHRPLHPNDHINRSQSTNDVFPAAIHVAAALQLQQELLPELKRLIASLDAKAVAWQDIIKIGRTHLQDAVPLRLGDEVSAWRDRLSDGAHWLTTAHQDLLALPLGGTAVGSGLNTPDRFAHEVCAELASRTGSDFQPADNLFAVMAGHDSLVQTMAQLRRLAVTLLTIANDIRLLACGPRAGLGELLLPANEPGSSIMPGKVNPTQCEAMAMVCTQVIGMDAAVAAAGAGGHLQMNVYKPLIGYNLIEGIRLLQDACRCFRLNLLTGMEADRDRIAFYVERSLMLVTALTPEIGYEKACAIAQHAHRDGLTLREAAMQSGAITDERFDQLIDPAAMASPHR

SEQ ID NO: 17026 - DNA, 1401 bp, Thermus thermophilus
  CDS (1)..(1401)
atggaataccggattgagcgggacaccatgggcgaggtgcgggtgccggcggacaagtactggggcgcgcagacccagcgctccctggagaacttcaggatcgggaccgaccgcttccgcatgcccctggagatcatccgggcctacgggatgctgaagaaggcggccgcgagagccaacctggagctcggggagctccccgaggagatcgccaaggccatcatccaggcggcggaggaggtggtccaggggaagtgggacgaccacttcccccttgtggtcttccagacgggcagcggcacccagaccaacatgaacgtcaacgaggtcatcgccaaccgggcctcggagatcctggggaagcctctggggagcaagtacgtccaccccaacgaccacgtgaaccgggggcagagctccaacgacaccttccccaccgccatgtacgtggccgtggccctggcgctccaccagaggctctatcccgcggtggaaggcctgatccggacctttacggccaaggcccaggcctttgaccagatcgtcaaggtggggcggacccacctgatggacgccgtgcccatcaccctgggacaggagatcggcagctgggccgcccagctcaagaccaccctcgccgccgtcaaggaaatggaaaagggcctctacaacctcgccatcggcgggacggcggtgggcacgggcctcaacgcccacccccgctttggggagctcgtggccaagtacctcgcggaggagacggggctccccttccgggtggcggagaaccgcttcgccgccctggccgcccacgacgagctggtcaacgtcatgggggccatccgcaccctggccggggccctgatgaagatcggcaacgacgtccgctggctcgcctccggcccctacgcgggcattggggagatcaccatccccgccaacgagcccgggtcctccatcatgccggggaaggtcaaccccacccaggtggaggccctcaccatggtggtggtccgggtctacggcaacgaccacaccgtggccttcgcgggaagccaggggaacttccagctcaacgtctacaagccggtgatggcctacagcaccctggagagcatcaacctcctcgcggacgccgtggcctcctttgacgcccacctggcccaggggattgagcccaatctggagcgcattgaggagcacctgcagaagaaccccatgctggccaccgccctcaacaaggccatcggctacgacaaggcggcggagatcgtcaagaaggccctcaaggagaagaagaccctgaagcaggcggccctcgagctcggctacctcacggaggaggagtttgaccgcatcgtggtccccatgaggctcgccaagccccacgagggggcgtag

SEQ ID NO: 17027 - protein, 466 aa, Thermus thermophilus
MEYRIERDTMGEVRVPADKYWGAQTQRSLENFRIGTDRFRMPLEIIRAYGMLKKAAARANLELGELPEEIAKAIIQAAEEVVQGKWDDHFPLVVFQTGSGTQTNMNVNEVIANRASEILGKPLGSKYVHPNDHVNRGQSSNDTFPTAMYVAVALALHQRLYPAVEGLIRTFTAKAQAFDQIVKVGRTHLMDAVPITLGQEIGSWAAQLKTTLAAVKEMEKGLYNLAIGGTAVGTGLNAHPRFGELVAKYLAEETGLPFRVAENRFAALAAHDELVNVMGAIRTLAGALMKIGNDVRWLASGPYAGIGEITIPANEPGSSIMPGKVNPTQVEALTMVVVRVYGNDHTVAFAGSQGNFQLNVYKPVMAYSTLESINLLADAVASFDAHLAQGIEPNLERIEEHLQKNPMLATALNKAIGYDKAAEIVKKALKEKKTLKQAALELGYLTEEEFDRIVVPMRLAKPHEGA

SEQ ID NO: 17028 - DNA, 1395 bp, Wigglesworthia glossinidia brevipalpis
  CDS (1)..(1395)
atgttaattaatagaatagaaaaagatactattggcgaagttgaattgccaaaaaaatgtttgtggggatcccaaactcaaagatctatttataattttaatatctctacagagaaaatgccttatgagcttattcacgctttagttcaaataaaacttgtagcagcaaaagttaataaagatctaaaattattagaagaaaaaaaagctgatgctataattaaagcttctgaagagatattatctggaaaatacaaagatagttttcctttggtaatttggcaaactggatctggaactcaaacaaacatgaacgtaaatgaagtaatagctaatattgcaataaaattattaggaggaaagtatggagactattcaataatacatcctaacgatcatgtaaataaaagtcaaagttctaatgatgtatttcctacagcaatgcatatatctgcagttttgtctttaaagaaaaatttattaccgaatttaattaaattaaaaaaatcattttatgataaatctatattatttaaagatattattaaaattggaagaactcacctgcaagatgcaactccattgactttaggccaagaagtttcttcttggtattgtatgttgaaaaaaaacattaaatatataaaaaatagcatactttgtatttctgaaatagctttaggtggtacagccgtaggaactgggttaaatgctcacgaaaaatattcattaaaagcatctaaattattgtcagaaataaataaacataattttattagttctacaaataaatttgaatctttaagtacatgtgatgcaatagtaaaagttcatagcactttaaaaaatttatctatttcaattatgaaaatatcaaatgatatacgttggttatcttctggcccaagatgtggaataggagaattaattattccagaaaatgaaccaggaagttctataatgcccggtaaagttaatccaactcaatgcgaatctatatctatgatatgctgtcaagtaataggaaacgactccgccataggaataggaggattgtctggaaattttcaattgaatgtatttcgacctatgattatttataattttttacaatccgtaagaatattatctgatggaataaaaagctttaacaaaaaatgtgttattggtattaaaccaaatattaaaagaataaaaaaatttcttaaagaatctttgatgctagttacatcattaactcctcatataggatatgataaatctgcaaaaatagcaaaattagctcacaatgaaaatattactttaaaagaagcttgtttgaaattgaattatatttcagagagtcaatttgatattttagttcgtccagaaaacatgattggaaataaaaattaa

SEQ ID NO: 17029 - protein, 464 aa, Wigglesworthia glossinidia brevipalpis
MLINRIEKDTIGEVELPKKCLWGSQTQRSIYNFNISTEKMPYELIHALVQIKLVAAKVNKDLKLLEEKKADAIIKASEEILSGKYKDSFPLVIWQTGSGTQTNMNVNEVIANIAIKLLGGKYGDYSIIHPNDHVNKSQSSNDVFPTAMHISAVLSLKKNLLPNLIKLKKSFYDKSILFKDIIKIGRTHLQDATPLTLGQEVSSWYCMLKKNIKYIKNSILCISEIALGGTAVGTGLNAHEKYSLKASKLLSEINKHNFISSTNKFESLSTCDAIVKVHSTLKNLSISIMKISNDIRWLSSGPRCGIGELIIPENEPGSSIMPGKVNPTQCESISMICCQVIGNDSAIGIGGLSGNFQLNVFRPMIIYNFLQSVRILSDGIKSFNKKCVIGIKPNIKRIKKFLKESLMLVTSLTPHIGYDKSAKIAKLAHNENITLKEACLKLNYISESQFDILVRPENMIGNKN

SEQ ID NO: 17030 - DNA, 1760 bp, Brachydanio rerio
  CDS (19)..(1548)
gttccgcccccggtcgccatgtaccgctccgctcgctccctgcatcgcttcagcgcgagtttgtcagatctgcgggccgctcagagatccatcaaagctcgcaacgtctgtccagcacccgggctccggcaccagaccgtcagaatggccagttcagaggcatttcggattgagagggacacatttggagagcttaaagtcccctctgataaatactatggagctcagactgtcagatccaccatgaacttcaggatcggaggagtcacggagaggatgccgattcaggtgatcagagctttcggtatcctgaagaaagctgctgcagaagtcaataaagattacggtttggacccaaagatcgcagacgccatcatgaaagctgctgatgaggtggagtctgggaagctggatgatcatttcccgctggttgtttggcaaacaggatccggaactcagactaacatgaacgtcaatgaggtgatcagtaacagagccatcgagatgctgggaggaaaactgggcagcaaagaccccgttcatcccaatgaccacgtcaacaagagccagagctccaatgacacgttccccacagccatgcacatcgctgctgctaaagaggttcacgaggttctcctgccgggccttcagacgcttcatgatgctctcgctgccaaagctgaacagttcaaagacatcataaagatcggccgcacacacacacaggacgccgtgccgctctcgctcggacaggagtttggcgggtacgtgcagcaggtgaagtacagtattgcgcgcgtgaaagcgtctctgccgcgtgtgtatgagctggcagcaggaggaaccgcagtcggcactggactcaacacacgcatcggctttgcagagaaggtggcagataaagtgtctgcacttacaggtcttccgttcgtgaccgcagccaataagttcgaggctctggcggctcatgatgctctggtggagctgagtggcgctctgaacactgtggccgtgagcatgatgaagatcgccaatgatatccgcttcctcggctctgggcctcgttcgggtctcggagaactcatcctgccagagaacgaacccggatccagcatcatgcccggtaaggtgaacccgacgcagtgtgaggccatgactatggtggccgctcaggtgatggggaatcatgtggccgttactgtcggaggaagcaatggacacttcgagctcaatgtgttcaagcccatgatcattaagaacgtgctgaactcggccaggctgctgggcgatgcttcggtctccttcactaataactgcgtggtcggcatcgaggcgaacaccgagaggatcaacaagctgatgagcgagtctctgatgctggtcaccgccctcaatccacatataggttatgataaagccgcaaaaattgcgaaaaccgctcataaagacggttcgactctgaaagaggcggcgctgaagctgggattcctgaacgagcagcagtttgaggagtgggttcgacctcatgacatgctgggcccaaagtaaaggagaacagagctgaaacacacgcacaccagtaaaacacttgtggatcaccgttcacagacggggtttgtgctggaggtattattcttcagagtctgtgtgttccctgtgaatgcatgactgtgtttctttttcatcccaaaatctgaggaataaaataaccgggggagaaaaaaaaaaaaaaaaaaaaaaaaaaaaaaaaaaaaaaaaaa

SEQ ID NO: 17031 - protein, 509 aa, Brachydanio rerio
MYRSARSLHRFSASLSDLRAAQRSIKARNVCPAPGLRHQTVRMASSEAFRIERDTFGELKVPSDKYYGAQTVRSTMNFRIGGVTERMPIQVIRAFGILKKAAAEVNKDYGLDPKIADAIMKAADEVESGKLDDHFPLVVWQTGSGTQTNMNVNEVISNRAIEMLGGKLGSKDPVHPNDHVNKSQSSNDTFPTAMHIAAAKEVHEVLLPGLQTLHDALAAKAEQFKDIIKIGRTHTQDAVPLSLGQEFGGYVQQVKYSIARVKASLPRVYELAAGGTAVGTGLNTRIGFAEKVADKVSALTGLPFVTAANKFEALAAHDALVELSGALNTVAVSMMKIANDIRFLGSGPRSGLGELILPENEPGSSIMPGKVNPTQCEAMTMVAAQVMGNHVAVTVGGSNGHFELNVFKPMIIKNVLNSARLLGDASVSFTNNCVVGIEANTERINKLMSESLMLVTALNPHIGYDKAAKIAKTAHKDGSTLKEAALKLGFLNEQQFEEWVRPHDMLGPK

SEQ ID NO: 17032 - DNA, 1588 bp, Mus musculus
  CDS (6)..(1529)
gcaccatgtaccgcgcactccgtctcctcgcgcgctcgcgtcgcctcctgcgggttccgtccgccggtgctgcagtgtctggggaagcgaccaccctcccgcggtgtgctccgaacgtcgcgcgaatggcaagccaaaattccttccgtgtagagttcgacacctttggtgaattgaaggttccaaccgataagtattatggtgctcagaccgtaagatctacgatgaactttaagattggaggtgctacagaacgtatgccaatcccagtcattcaagctttcggcatcttgaagcgagctgctgctgaagtaaaccaggagtatggtctcgatccaaagattgctagtgcaataatgaaggccgcagatgaggtagctgaaggtaaattaaatgatcactttcctctggtggtttggcagactggatcaggaacccagacaaacatgaatgtaaatgaagtcattagcaacagagcaattgaaatgttaggaggtgaacttggcagcaagaagcctgtgcaccccaatgatcatgttaacaaaagccagagctcgaatgacacctttcccacagcaatgcatattgctgctgcagtggaagttcacaaggtcctgttgccagggttacagaagctccatgatgctctcagtgcaaaatccaaagagtttgcgcaggtcatcaaaattgggcgaactcacacgcaggacgctgtccctcttactcttggacaggaattcagtggttacgttcagcaagtccagtatgcgatggtgagaataaaagccgccatgccaagaatctacgagctcgctgctggaggcactgctgtggggacggggttaaacaccaggatcggcttcgcagaaaaggtggccgcaaaagtagcagcactcacaggtttgccttttgtcactgccccgaataaatttgaagctctagctgctcatgatgctctggttgagcttagtggagccatgaacactgccgcctgcagtctaatgaagatagcgaatgatattcgcttcctgggttctggtcctcggtcaggtttgggagagctgatcttgcctgaaaacgagccagggagcagcatcatgccaggaaaggtgaaccctactcagtgtgaagcgatgaccatggttgcagcccaagtcatggggaatcacgttgctgttactgttggaggcagcaatggacattttgaactgaatgtgtttaaaccaatgatgattaagaatgtgttgcactcagcgaggctactgggagatgcttcagtgtccttcacagaaaactgtgtggtcgggatccaggccaacacagagcggatcaacaagctaatgaatgagtctttaatgttggtcacagctcttaatccacatatagggtatgacaaagcagcaaagattgccaagactgcgcacaagaacggatcaaccttaaaggaaacggctattgaacttggctatctcacagcagagcagtttgatgagtgggtgaaacccaaggacatgctgggtccaaagtgacttcaataaatttatattaaaataaacttaagaaatttacaaacaaaaaaaaaaaaaaa

SEQ ID NO: 17033 - protein, 507 aa, Mus musculus
MYRALRLLARSRRLLRVPSAGAAVSGEATTLPRCAPNVARMASQNSFRVEFDTFGELKVPTDKYYGAQTVRSTMNFKIGGATERMPIPVIQAFGILKRAAAEVNQEYGLDPKIASAIMKAADEVAEGKLNDHFPLVVWQTGSGTQTNMNVNEVISNRAIEMLGGELGSKKPVHPNDHVNKSQSSNDTFPTAMHIAAAVEVHKVLLPGLQKLHDALSAKSKEFAQVIKIGRTHTQDAVPLTLGQEFSGYVQQVQYAMVRIKAAMPRIYELAAGGTAVGTGLNTRIGFAEKVAAKVAALTGLPFVTAPNKFEALAAHDALVELSGAMNTAACSLMKIANDIRFLGSGPRSGLGELILPENEPGSSIMPGKVNPTQCEAMTMVAAQVMGNHVAVTVGGSNGHFELNVFKPMMIKNVLHSARLLGDASVSFTENCVVGIQANTERINKLMNESLMLVTALNPHIGYDKAAKIAKTAHKNGSTLKETAIELGYLTAEQFDEWVKPKDMLGPK

SEQ ID NO: 17034 - DNA, 1485 bp, Rhizopus oryzae
  CDS (1)..(1485)
atgttgcgagcttctgctaccagattcttaagtcaagctaaaaacatgaacaactctcctcgtcttttcagtagtgcctctgctgctttgcaaaaattccgtgctgagcgcgatacttttggtgatctccaagttcctgctgatagatattggggtgctcaaacccaaaggtctcttcaaaattttgacattggtggccctactgaacgtatgcccgaacctttgatccgtgcctttggtgtcctcaaaaaggctgctgctactgtcaacatgacttatggcttggatcctaaagttggtgaagctattcaaaaggctgctgacgaggtcattgatggaagcttgattgatcatttccctcttgttgtctggcaaactggttccggtactcaaaccaagatgaacgttaacgaagttatctccaaccgtgctattgaacttttgggtggtgagcttggtagtaaggctcctgttcatcccaacgatcatgtcaacatgagtcaatcatccaatgacacgttccctactgccatgcacgttgctgctgttgttgaaattcacggtcgacttattcctgctttgaccactttgcgtgatgcccttcaagccaaatccgctgagtttgaacacatcatcaagatcggtcgtactcacttgcaagatgcaactcctttgactctcggtcaagaattctctggttatactcaacaattgacttacggtattgctcgtgtacaaggtaccttggagcgcctctataaccttgctcaaggtggtactgctgttggtactggtcttaacaccagaaaaggtttcgatgccaaggtagctgaagctattgcttctattaccggtcttcctttcaagaccgcccctaataagtttgaagcccttgctgctcacgatgctctcgttgaagctcacggagctctcaataccgttgcttgttctcttatgaagatcgccaacgatatccgttatcttggttctggacctcgctgtggtcttggtgaactttccttgcctgaaaacgaacccggatcttctatcatgcccggtaaggttaatcctactcaatgtgaagctatgaccatggtctgtgctcaagtcatgggtaacaacactgctatttctgttgctggttccaatggtcaattcgagcttaatgtcttcaaacccgtcatgatcaagaacttgatccaatccattcgtcttatttctgatgcctctatttcattcaccaaaaactgtgttgttggtattgaagccaatgaaaagaagattagcagcattatgaatgagtcattgatgttggtcactgctcttaaccctcatattggttacgataaagctgctaaatgtgccaagaaggcccacaaggaaggcaccaccttgaaggaagctgccctttctcttggttacttgacttctgaagaattcgaccagtgggttagacccgaagatatgatctctgccaaggattaa

SEQ ID NO: 17035 - protein, 494 aa, Rhizopus oryzae [sequence omitted]

SEQ ID NO: 17036 - DNA, 23 bp, Primer
atgaatacagtacgcagcgaaaa

SEQ ID NO: 17037 - DNA, 23 bp, Primer
ttaacgcccggctttcatactgc

SEQ ID NO: 17038 - DNA, 2685 bp, Escherichia coli K12; identical to SEQ ID NO: 1982
  CDS (1)..(2685)

SEQ ID NO: 17039 - protein, 894 aa, Escherichia coli K12; identical to SEQ ID NO: 1983

SEQ ID NO: 17040 - DNA, 2679 bp, Caulobacter crescentus; identical to SEQ ID NO: 1984
  CDS (1)..(2679)

SEQ ID NO: 17041 - protein, 892 aa, Caulobacter crescentus; identical to SEQ ID NO: 1985

SEQ ID NO: 17042 - DNA, 2709 bp, Salmonella enterica subsp. enterica serovar Typhi; identical to SEQ ID NO: 1986
  CDS (1)..(2709)

SEQ ID NO: 17043 - protein, 902 aa, Salmonella enterica subsp. enterica serovar Typhi; identical to SEQ ID NO: 1987

SEQ ID NO: 17044 - DNA, 2691 bp, Listeria innocua; identical to SEQ ID NO: 1988
  CDS (1)..(2691)

SEQ ID NO: 17045 - protein, 896 aa, Listeria innocua; identical to SEQ ID NO: 1989

SEQ ID NO: 17046 - DNA, 2727 bp, Yersinia pestis; identical to SEQ ID NO: 1990
  CDS (1)..(2727)

SEQ ID NO: 17047 - protein, 908 aa, Yersinia pestis; identical to SEQ ID NO: 1991

SEQ ID NO: 17048 - DNA, 2658 bp, Pseudomonas aeruginosa; identical to SEQ ID NO: 1992
  CDS (1)..(2658)

SEQ ID NO: 17049 - protein, 885 aa, Pseudomonas aeruginosa; identical to SEQ ID NO: 1993

SEQ ID NO: 17050 - DNA, 2634 bp, Staphylococcus aureus; identical to SEQ ID NO: 1994
  CDS (1)..(2634)

SEQ ID NO: 17051 - protein, 877 aa, Staphylococcus aureus; identical to SEQ ID NO: 1995

SEQ ID NO: 17052 - DNA, 2703 bp, Agrobacterium tumefaciens; identical to SEQ ID NO: 1996
  CDS (1)..(2703)

SEQ ID NO: 17053 - protein, 900 aa, Agrobacterium tumefaciens; identical to SEQ ID NO: 1997

SEQ ID NO: 17054 - DNA, 2658 bp, Staphylococcus aureus; identical to SEQ ID NO: 1998
  CDS (1)..(2658)

SEQ ID NO: 17055 - protein, 885 aa, Staphylococcus aureus; identical to SEQ ID NO: 1999

SEQ ID NO: 17056 - DNA, 2691 bp, Sinorhizobium meliloti; identical to SEQ ID NO: 2000
  CDS (1)..(2691)

SEQ ID NO: 17057 - protein, 896 aa, Sinorhizobium meliloti; identical to SEQ ID NO: 2001

SEQ ID NO: 17058 - DNA, 2703 bp, Clostridium acetobutylicum; identical to SEQ ID NO: 2002
  CDS (1)..(2703)

SEQ ID NO: 17059 - protein, 900 aa, Clostridium acetobutylicum; identical to SEQ ID NO: 2003

SEQ ID NO: 17060 - DNA, 2583 bp, Mycobacterium tuberculosis; identical to SEQ ID NO: 2004
  CDS (1)..(2583)

SEQ ID NO: 17061 - protein, 860 aa, Mycobacterium tuberculosis; identical to SEQ ID NO: 2005

SEQ ID NO: 17062 - DNA, 2547 bp, Streptomyces coelicolor; identical to SEQ ID NO: 2006
  CDS (1)..(2547)

SEQ ID NO: 17063 - protein, 848 aa, Streptomyces coelicolor; identical to SEQ ID NO: 2007

SEQ ID NO: 17064 - DNA, 2694 bp, Photorhabdus luminescens; identical to SEQ ID NO: 2008
  CDS (1)..(2694)

SEQ ID NO: 17065 - protein, 897 aa, Photorhabdus luminescens; identical to SEQ ID NO: 2009

SEQ ID NO: 17066 - DNA, 2688 bp, Chromobacterium violaceum; identical to SEQ ID NO: 2010
  CDS (1)..(2688)

SEQ ID NO: 17067 - protein, 895 aa, Chromobacterium violaceum; identical to SEQ ID NO: 2011

SEQ ID NO: 17068 - DNA, 2715 bp, Bordetella pertussis; identical to SEQ ID NO: 2012
  CDS (1)..(2715)

SEQ ID NO: 17069 - protein, 904 aa, Bordetella pertussis; identical to SEQ ID NO: 2013

SEQ ID NO: 17070 - DNA, 2796 bp, Bordetella bronchiseptica; identical to SEQ ID NO: 2014
  CDS (1)..(2796)

SEQ ID NO: 17071 - protein, 931 aa, Bordetella bronchiseptica; identical to SEQ ID NO: 2015

SEQ ID NO: 17072 - DNA, 2556 bp, Streptomyces avermitilis; identical to SEQ ID NO: 2016
  CDS (1)..(2556)

SEQ ID NO: 17073 - protein, 851 aa, Streptomyces avermitilis; identical to SEQ ID NO: 2017

SEQ ID NO: 17074 - DNA, 2553 bp, Enterococcus faecalis; identical to SEQ ID NO: 2018
  CDS (1)..(2553)

SEQ ID NO: 17075 - protein, 850 aa, Enterococcus faecalis; identical to SEQ ID NO: 2019

SEQ ID NO: 17076 - DNA, 2664 bp, Pseudomonas syringae; identical to SEQ ID NO: 2020
  CDS (1)..(2664)

SEQ ID NO: 17077 - protein, 887 aa, Pseudomonas syringae; identical to SEQ ID NO: 2021

SEQ ID NO: 17078 - DNA, 2655 bp, Pseudomonas putida; identical to SEQ ID NO: 2022
  CDS (1)..(2655)

SEQ ID NO: 17079 - protein, 884 aa, Pseudomonas putida; identical to SEQ ID NO: 2023

SEQ ID NO: 17080 - DNA, 2724 bp, Bradyrhizobium japonicum; identical to SEQ ID NO: 2024
  CDS (1)..(2724)

SEQ ID NO: 17081 - protein, 907 aa, Bradyrhizobium japonicum; identical to SEQ ID NO: 2025

SEQ ID NO: 17082 - DNA, 2613 bp, Leptospira interrogans; identical to SEQ ID NO: 2026
  CDS (1)..(2613)

SEQ ID NO: 17083 - protein, 870 aa, Leptospira interrogans; identical to SEQ ID NO: 2027

SEQ ID NO: 17084 - DNA, 2661 bp, Xanthomonas campestris; identical to SEQ ID NO: 2028
  CDS (1)..(2661)

SEQ ID NO: 17085 - protein, 886 aa, Xanthomonas campestris; identical to SEQ ID NO: 2029

SEQ ID NO: 17086 - DNA, 2661 bp, Xanthomonas axonopodis; identical to SEQ ID NO: 2030
  CDS (1)..(2661)

SEQ ID NO: 17087 - protein, 886 aa, Xanthomonas axonopodis; identical to SEQ ID NO: 2031

SEQ ID NO: 17088 - DNA, 2814 bp, Ralstonia solanacearum; identical to SEQ ID NO: 2032
  CDS (1)..(2814)

SEQ ID NO: 17089 - protein, 937 aa, Ralstonia solanacearum; identical to SEQ ID NO: 2033

SEQ ID NO: 17090 - DNA, 2667 bp, Listeria innocua; identical to SEQ ID NO: 2034
  CDS (1)..(2667)

SEQ ID NO: 17091 - protein, 888 aa, Listeria innocua; identical to SEQ ID NO: 2035

SEQ ID NO: 17092 - DNA, 2724 bp, Rhizobium loti; identical to SEQ ID NO: 2036
  CDS (1)..(2724)

SEQ ID NO: 17093 - protein, 907 aa, Rhizobium loti; identical to SEQ ID NO: 2037

SEQ ID NO: 17094 - DNA, 2565 bp, Rathayibacter rathayi; identical to SEQ ID NO: 2038
  CDS (1)..(2565)

SEQ ID NO: 17095 - protein, 854 aa, Rathayibacter rathayi; identical to SEQ ID NO: 2039

SEQ ID NO: 17096 - DNA, 2658 bp, Geobacter sulfurreducens; identical to SEQ ID NO: 2040
  CDS (1)..(2658)

SEQ ID NO: 17097 - protein, 885 aa, Geobacter sulfurreducens; identical to SEQ ID NO: 2041

SEQ ID NO: 17098 - DNA, 2577 bp, Mycobacterium paratuberculosis; identical to SEQ ID NO: 2042
  CDS (1)..(2577)

SEQ ID NO: 17099 - protein, 858 aa, Mycobacterium paratuberculosis; identical to SEQ ID NO: 2043

SEQ ID NO: 17100 - DNA, 2724 bp, Rhodopseudomonas palustris; identical to SEQ ID NO: 2044
  CDS (1)..(2724)

SEQ ID NO: 17101 - protein, 907 aa, Rhodopseudomonas palustris; identical to SEQ ID NO: 2045

SEQ ID NO: 17102 - DNA, 24 bp, Primer
atgaataacgaacccttacgtccc

SEQ ID NO: 17103 - DNA, 28 bp, Primer
ttacatatcctcatgaaattcttcaagt

SEQ ID NO: 17104 - DNA, 723 bp, Escherichia coli; identical to SEQ ID NO: 417
  CDS (1)..(723)

SEQ ID NO: 17105 - protein, 240 aa, Escherichia coli; identical to SEQ ID NO: 418

SEQ ID NO: 17106 - DNA, 723 bp, Listeria innocua; identical to SEQ ID NO: 453
  CDS (1)..(723)

SEQ ID NO: 17107 - protein, 240 aa, Listeria innocua; identical to SEQ ID NO: 454

SEQ ID NO: 17108 - DNA, 798 bp, Yersinia pestis; identical to SEQ ID NO: 2052
  CDS (1)..(798)

SEQ ID NO: 17109 - protein, 265 aa, Yersinia pestis; identical to SEQ ID NO: 452

SEQ ID NO: 17110 - DNA, 744 bp, Salmonella enterica subsp. enterica serovar Typhi; identical to SEQ ID NO: 2054
  CDS (1)..(744)

SEQ ID NO: 17111 - protein, 247 aa, Salmonella enterica subsp. enterica serovar Typhi; identical to SEQ ID NO: 460

SEQ ID NO: 17112 - DNA, 714 bp, Listeria innocua; identical to SEQ ID NO: 455
  CDS (1)..(714)

SEQ ID NO: 17113 - protein, 237 aa, Listeria innocua; identical to SEQ ID NO: 456

SEQ ID NO: 17114 - DNA, 723 bp, Listeria monocytogenes; identical to SEQ ID NO: 457
  CDS (1)..(723)

SEQ ID NO: 17115 - protein, 240 aa, Listeria monocytogenes; identical to SEQ ID NO: 458

SEQ ID NO: 17116 - DNA, 729 bp, Listeria monocytogenes; identical to SEQ ID NO: 429
  CDS (1)..(729)

SEQ ID NO: 17117 - protein, 242 aa, Listeria monocytogenes; identical to SEQ ID NO: 430

SEQ ID NO: 17118 - DNA, 729 bp, Listeria innocua; identical to SEQ ID NO: 2062
  CDS (1)..(729)

SEQ ID NO: 17119 - protein, 242 aa, Listeria innocua; identical to SEQ ID NO: 432

SEQ ID NO: 17120 - DNA, 729 bp, Bacillus subtilis; identical to SEQ ID NO: 421
  CDS (1)..(729)

SEQ ID NO: 17121 - protein, 242 aa, Bacillus subtilis; identical to SEQ ID NO: 422

SEQ ID NO: 17122 - DNA, 747 bp, Bacillus halodurans; identical to SEQ ID NO: 445
  CDS (1)..(747)

SEQ ID NO: 17123 - protein, 248 aa, Bacillus halodurans; identical to SEQ ID NO: 446

SEQ ID NO: 17124 - DNA, 723 bp, Bacillus halodurans; identical to SEQ ID NO: 433
  CDS (1)..(723)

SEQ ID NO: 17125 - protein, 240 aa, Bacillus halodurans; identical to SEQ ID NO: 434

SEQ ID NO: 17126 - DNA, 714 bp, Bacillus halodurans; identical to SEQ ID NO: 427
  CDS (1)..(714)

SEQ ID NO: 17127 - protein, 237 aa, Bacillus halodurans; identical to SEQ ID NO: 428

SEQ ID NO: 17128 - DNA, 811 bp, Corynebacterium glutamicum; identical to SEQ ID NO: 2072

SEQ ID NO: 17129 - protein, 269 aa, Corynebacterium glutamicum; identical to SEQ ID NO: 462

SEQ ID NO: 17130 - DNA, 732 bp, Bacillus subtilis; identical to SEQ ID NO: 425
  CDS (1)..(732)

SEQ ID NO: 17131 - protein, 243 aa, Bacillus subtilis; identical to SEQ ID NO: 426

SEQ ID NO: 17132 - DNA, 744 bp, Caulobacter crescentus; identical to SEQ ID NO: 2076
  CDS (1)..(744)

SEQ ID NO: 17133 - protein, 247 aa, Caulobacter crescentus; identical to SEQ ID NO: 442

SEQ ID NO: 17134 - DNA, 711 bp, Streptococcus pneumoniae; identical to SEQ ID NO: 2078
  CDS (1)..(711)

SEQ ID NO: 17135 - protein, 236 aa, Streptococcus pneumoniae; identical to SEQ ID NO: 436

SEQ ID NO: 17136 - DNA, 729 bp, Streptococcus pneumoniae; identical to SEQ ID NO: 2080
  CDS (1)..(729)

SEQ ID NO: 17137 - protein, 242 aa, Streptococcus pneumoniae; identical to SEQ ID NO: 438

SEQ ID NO: 17138 - DNA, 708 bp, Streptococcus pneumoniae; identical to SEQ ID NO: 2082
  CDS (1)..(708)

SEQ ID NO: 17139 - protein, 235 aa, Streptococcus pneumoniae; identical to SEQ ID NO: 450

SEQ ID NO: 17140 - DNA, 717 bp, Escherichia coli; identical to SEQ ID NO: 423
  CDS (1)..(717)

SEQ ID NO: 17141 - protein, 238 aa, Escherichia coli [sequence omitted]

SEQ ID NO: 17142 - DNA, 708 bp, Lactococcus lactis subsp. lactis; identical to SEQ ID NO: 443
  CDS (1)..(708)

SEQ ID NO: 17143 - protein, 235 aa, Lactococcus lactis subsp. lactis; identical to SEQ ID NO: 444

SEQ ID NO: 17144 - DNA, 756 bp, Escherichia coli; identical to SEQ ID NO: 439
  CDS (1)..(756)

SEQ ID NO: 17145 - protein, 251 aa, Escherichia coli; identical to SEQ ID NO: 440

SEQ ID NO: 17146 - DNA, 732 bp, Clostridium acetobutylicum; identical to SEQ ID NO: 2090
  CDS (1)..(732)

SEQ ID NO: 17147 - protein, 243 aa, Clostridium acetobutylicum; identical to SEQ ID NO: 448

SEQ ID NO: 17148 - DNA, 747 bp, Bordetella parapertussis; identical to SEQ ID NO: 2092
  CDS (1)..(747)

SEQ ID NO: 17149 - protein, 248 aa, Bordetella parapertussis; identical to SEQ ID NO: 510

SEQ ID NO: 17150 - DNA, 747 bp, Bordetella bronchiseptica; identical to SEQ ID NO: 2094
  CDS (1)..(747)

SEQ ID NO: 17151 - protein, 248 aa, Bordetella bronchiseptica; identical to SEQ ID NO: 508

SEQ ID NO: 17152 - DNA, 738 bp, Bacillus cereus; identical to SEQ ID NO: 503
  CDS (1)..(738)

SEQ ID NO: 17153 - protein, 245 aa, Bacillus cereus; identical to SEQ ID NO: 504

SEQ ID NO: 17154 - DNA, 732 bp, Bacillus anthracis; identical to SEQ ID NO: 2098
  CDS (1)..(732)

SEQ ID NO: 17155 - protein, 243 aa, Bacillus anthracis; identical to SEQ ID NO: 502

SEQ ID NO: 17156 - DNA, 738 bp, Bacillus anthracis; identical to SEQ ID NO: 499
  CDS (1)..(738)

SEQ ID NO: 17157 - protein, 245 aa, Bacillus anthracis; identical to SEQ ID NO: 500

SEQ ID NO: 17158 - DNA, 765 bp, Streptomyces avermitilis; identical to SEQ ID NO: 2102
  CDS (1)..(765)

SEQ ID NO: 17159 - protein, 254 aa, Streptomyces avermitilis; identical to SEQ ID NO: 498

SEQ ID NO: 17160 - DNA, 756 bp, Enterococcus faecalis; identical to SEQ ID NO: 2104
  CDS (25)..(756)

SEQ ID NO: 17161 - protein, 243 aa, Enterococcus faecalis; identical to SEQ ID NO: 496

SEQ ID NO: 17162 - DNA, 708 bp, Enterococcus faecalis; identical to SEQ ID NO: 2106
  CDS (1)..(708)

SEQ ID NO: 17163 - protein, 235 aa, Enterococcus faecalis; identical to SEQ ID NO: 494

SEQ ID NO: 17164 - DNA, 675 bp, Shigella flexneri; identical to SEQ ID NO: 2108
  CDS (1)..(675)

SEQ ID NO: 17165 - protein, 224 aa, Shigella flexneri; identical to SEQ ID NO: 506

SEQ ID NO: 17166 - DNA, 723 bp, Shigella flexneri; identical to SEQ ID NO: 491
  CDS (1)..(723)

SEQ ID NO: 17167 - protein, 240 aa, Shigella flexneri; identical to SEQ ID NO: 492

SEQ ID NO: 17168 - DNA, 927 bp, Pseudomonas putida; identical to SEQ ID NO: 2112
  CDS (1)..(927)

SEQ ID NO: 17169 - protein, 308 aa, Pseudomonas putida; identical to SEQ ID NO: 490

SEQ ID NO: 17170 - DNA, 711 bp, Lactobacillus plantarum; identical to SEQ ID NO: 487
  CDS (1)..(711)

SEQ ID NO: 17171 - protein, 236 aa, Lactobacillus plantarum; identical to SEQ ID NO: 488

SEQ ID NO: 17172 - DNA, 699 bp, Streptococcus mutans; identical to SEQ ID NO: 485
  CDS (1)..(699)

SEQ ID NO: 17173 - protein, 232 aa, Streptococcus mutans; identical to SEQ ID NO: 486

SEQ ID NO: 17174 - DNA, 699 bp, Streptococcus agalactiae; identical to SEQ ID NO: 2118
  CDS (1)..(699)

SEQ ID NO: 17175 - protein, 232 aa, Streptococcus agalactiae; identical to SEQ ID NO: 484

SEQ ID NO: 17176 - DNA, 747 bp, Oceanobacillus iheyensis; identical to SEQ ID NO: 481
  CDS (1)..(747)

SEQ ID NO: 17177 - protein, 248 aa, Oceanobacillus iheyensis; identical to SEQ ID NO: 482

SEQ ID NO: 17178 - DNA, 756 bp, Escherichia coli O6; identical to SEQ ID NO: 479
  CDS (1)..(756)

SEQ ID NO: 17179 - protein, 251 aa, Escherichia coli O6; identical to SEQ ID NO: 480

SEQ ID NO: 17180 - DNA, 699 bp, Escherichia coli O6; identical to SEQ ID NO: 477
  CDS (1)..(699)

SEQ ID NO: 17181 - protein, 232 aa, Escherichia coli O6; identical to SEQ ID NO: 478

SEQ ID NO: 17182 - DNA, 765 bp, Streptomyces sp; identical to SEQ ID NO: 2126
  CDS (1)..(765)

SEQ ID NO: 17183 - protein, 254 aa, Streptomyces sp; identical to SEQ ID NO: 468

SEQ ID NO: 17184 - DNA, 714 bp, Streptococcus mutans; identical to SEQ ID NO: 2128
  CDS (1)..(714)

SEQ ID NO: 17185 - protein, 237 aa, Streptococcus mutans; identical to SEQ ID NO: 476

SEQ ID NO: 17186 - DNA, 762 bp, Streptomyces griseus; identical to SEQ ID NO: 2130
  CDS (1)..(762)

SEQ ID NO: 17187 - protein, 253 aa, Streptomyces griseus; identical to SEQ ID NO: 466

SEQ ID NO: 17188 - DNA, 726 bp, Clostridium perfringens; identical to SEQ ID NO: 471
  CDS (1)..(726)

SEQ ID NO: 17189 - protein, 241 aa, Clostridium perfringens; identical to SEQ ID NO: 472

SEQ ID NO: 17190 - DNA, 726 bp, Streptococcus pyogenes; identical to SEQ ID NO: 469
  CDS (1)..(726)

SEQ ID NO: 17191 - protein, 241 aa, Streptococcus pyogenes; identical to SEQ ID NO: 470

SEQ ID NO: 17192 - DNA, 705 bp, Pseudomonas fluorescens; identical to SEQ ID NO: 463
  CDS (1)..(705)

SEQ ID NO: 17193 - protein, 234 aa, Pseudomonas fluorescens; identical to SEQ ID NO: 464

SEQ ID NO: 17194 - DNA, 765 bp, Streptomyces coelicolor; identical to SEQ ID NO: 2138
  CDS (1)..(765)

SEQ ID NO: 17195 - protein, 254 aa, Streptomyces coelicolor; identical to SEQ ID NO: 474

SEQ ID NO: 17196 - DNA, 23 bp, Primer
atgggacacaagcccttataccg

SEQ ID NO: 17197 - DNA, 23 bp, Primer
ttatcgcgatgattttcgctgcg

SEQ ID NO: 17198 - DNA, 2200 bp, Escherichia coli K12
  CDS (776)..(2200)
atgacagaaccgttaaccgaaacccctgaactatccgcgaaatatgcctggttttttgatcttgatggaacgctggcggaaatcaaaccgcatcccgatcaggtcgtcgtgcctgacaatattctgcaaggactacagctactggcaaccgcaagtgatggtgcattggcattgatatcagggcgctcaatggtggagcttgacgcactggcaaaaccttatcgcttcccgttagcgggcgtgcatggggcggagcgccgtgacatcaatggtaaaacacatatcgttcatctgccggatgcgattgcgcgtgatattagcgtgcaactgcatacagtcatcgctcagtatcccggcgcggagctggaggcgaaagggatggcttttgcgctgcattatcgtcgggctccgcagcatgaagacgcattaatgacattagcgcaacgtattactcagatctggccacaaatggcgttacagcagggaaagtgtgttgtcgagatcaaaccgagaggtaccagtaaaggtgaggcaattgcagcttttatgcaggaagctccctttatcgggcgaacgcccgtatttctgggcgatgatttaaccgatgaatctggcttcgcagtcgttaaccgactgggcggaatgtcagtaaaaattggcacaggtgcaactcaggcatcatggcgactggcgggtgtgccggatgtctggagctggcttgaaatgataaccaccgcattacaacaaaaaagagaaaataacaggagtgatgactatgagtcgtttagtcgtagtatctaaccggattgcaccaccagacgagcacgccgccagtgccggtggccttgccgttggcatactgggggcactgaaagccgcaggcggactgtggtttggctggagtggtgaaacagggaatgaggatcagccgctaaaaaaggtgaaaaaaggtaacattacgtgggcctcttttaacctcagcgaacaggaccttgacgaatactacaaccaattctccaatgccgttctctggcccgcttttcattatcggctcgatctggtgcaatttcagcgtcctgcctgggacggctatctacgcgtaaatgcgttgctggcagataaattactgccgctgttgcaagacgatgacattatctggatccacgattatcacctgttgccatttgcgcatgaattacgcaaacggggagtgaataatcgcattggtttctttctgcatattcctttcccgacaccggaaatcttcaacgcgctgccgacatatgacaccttgcttgaacagctttgtgattatgatttgctgggtttccagacagaaaacgatcgtctggcgttcctggattgtctttctaacctgacccgcgtcacgacacgtagcgcaaaaagccatacagcctggggcaaagcatttcgaacagaagtctacccgatcggcattgaaccgaaagaaatagccaaacaggctgccgggccactgccgccaaaactggcgcaacttaaagcggaactgaaaaacgtacaaaatatcttttctgtcgaacggctggattattccaaaggtttgccagagcgttttctcgcctatgaagcgttgctggaaaaatatccgcagcatcatggtaaaattcgttatacccagattgcaccaacgtcgcgtggtgatgtgcaagcctatcaggatattcgtcatcagctcgaaaatgaagctggacgaattaatggtaaatacgggcaattaggctggacgccgctttattatttgaatcagcattttgaccgtaaattactgatgaaaatattccgctactctgacgtgggcttagtgacgccactgcgtgacgggatgaacctggtagcaaaagagtatgttgctgctcaggacccagccaatccgggcgttcttgttctttcgcaatttgcgggagcggcaaacgagttaacgtcggcgttaattgttaacccctacgatcgtgacgaagttgcagctgcgctggatcgtgcattgactatgtcgctggcggaacgtatttcccgtcatgcagaaatgctggacgttatcgtgaaaaacgatattaaccactggcaggagtgcttcattagcgacctaaagcagatagttccgcgaagcgcggaaagccagcagcgcgataaagttgctacctttccaaagcttgcgtag

SEQ ID NO: 17199 - protein, 474 aa, Escherichia coli K12
MSRLVVVSNRIAPPDEHAASAGGLAVGILGALKAAGGLWFGWSGETGNEDQPLKKVKKGNITWASFNLSEQDLDEYYNQFSNAVLWPAFHYRLDLVQFQRPAWDGYLRVNALLADKLLPLLQDDDIIWIHDYHLLPFAHELRKRGVNNRIGFFLHIPFPTPEIFNALPTYDTLLEQLCDYDLLGFQTENDRLAFLDCLSNLTRVTTRSAKSHTAWGKAFRTEVYPIGIEPKEIAKQAAGPLPPKLAQLKAELKNVQNIFSVERLDYSKGLPERFLAYEALLEKYPQHHGKIRYTQIAPTSRGDVQAYQDIRHQLENEAGRINGKYGQLGWTPLYYLNQHFDRKLLMKIFRYSDVGLVTPLRDGMNLVAKEYVAAQDPANPGVLVLSQFAGAANELTSALIVNPYDRDEVAAALDRALTMSLAERISRHAEMLDVIVKNDINHWQECFISDLKQIVPRSAESQQRDKVATFPKLA

SEQ ID NO: 17200 - DNA, 3053 bp, Arabidopsis thaliana (mouse-ear cress)
  CDS (1)..(2556)
atgatttctaggtcgtacacgaatctgttagacttggcatcagggaatttccctgtcatgggaagagagcgtaggcggcttcctagggtaatgactgttcctggtaatgtctctgagtttgatgaagatcaagcgtatagtgtgtcttccgataatccttcttcggtttcctctgatcgaatgatcattgtggctaaccggctcccattgaaggcggagaaacgaaatggaagctggagttttagttgggatcaagattctctgtatttgcagctcaaggacgggttgcctgaggatatggagattttatatgttggatctttgagcgttgatgttgattcaaatgaacaagacgatgtggcgcagatactgttggacaaatttaaatgtgttcctacgtttttcccacctgatttgcaatcaaagttttacgacggtttttgcaagaggcagatatggccgctttttcactacatgcttccgttttccgctgatcatggtggaagatttgataggtctctttgggaggcttatgtagcgactaacaagctcttcttccagaaagtaattgaggttattaacccagatgatgattttgtctggattcatgactaccatttgatggtcttaccaacttttctgagaaggcggtttaaccggataaggatgggatttttccttcacagtcccttcccctcatctgagatataccggtctcttcctgttcgggaggagatacttaaggcgttactaaacagcgaccttattggctttcacacgttcgattatgctcgtcacttccttacttgctgcagtcggatgttgggtctagaatatcagtctaagagaggttacattgggctggagtattacgggaggactgtgggaatcaagatcatgccagtggggatcaacatgggtcggattcaatcggtgatgagatattcagaagaggagggtaaggtgatggagctcagaaatcgtttcgaaggtaagacagtgttgcttggtatcgatgacatggatattttcaagggtataaacctgaagcttctagcaatggaacaaatgctgaggcagcacccgaattggaggggaagggctgttctggttcagattgtaaatcccgctaggggtaaaggtattgatgtagaggaaatacgtggtgaaatcgaagaaagctgcaggaggatcaatggagagtttgggaaacctggatatcaacctatcatatatattgatactccggtttcgattaatgaaataaatgcttattaccatattgctgagtgcgtggtcgttacagctgttagagatggtatgaaccttactccctacgaatatatcgtttgtagacaaggtttacttgggtctgaatcagactttagtggcccaaagaagagcatgttggttgcatcagagtttattggatgttccccttcgcttagtggggctatacgcgtaaacccatggaacgttgaagctactggagaagcactaaatgaggccctctcaatgagtgatgctgagaaacagctacggcatgagaaacatttccggtatgttagtactcacgatgtagcttattggtcaagaagtttcttgcaagacctagagaggatatgtgtggaccatttcaagaaaaggtgttgggggatggggattagttttggtttcagagttgttgcactcgatcctaattttagaaagctttcaataccgtgcattgtgtcagactacaaaagggcgaaaagcagagcgatactgttggattatgatggcactctgatgcctcaaaactccatcaataaagctccaagccaggaagttcttaactttttggatgcactttgcgaggacaagaagaattcaattttcattgtcagtggaagagggagggaaagtttaagcaagtggttcactccgtgcaaaaaaattggaattgcggcagagcatggatacttcttaaagtggtcaggcagtgaagaatgggagacatgtgggcagagctctgattttgggtggatgcagatcgtggaacctgtaatgaagcagtacactgaatcgactgatggctcttccattgaaatcaaagagagcgctttggtttggcaatatcgggatgcagatccaggctttggttctttacaagcgaaggaaatgctagagcatttagagagtgttctagctaatgagccagtggcagtcaaaagcggtcactacatagtagaagtcaagcctcagggagtgagcaaaggatccgtgtcagaaaagatattttcatcaatggccggaaagggaaaaccggttgatttcgtgttatgtattggagatgacagatctgatgaagacatgtttgaagcgattggtaatgcgatgtcgaaaaggttactctgtgataatgctctagtctttgcatgcacagttgggcaaaagccaagcaaggctaaatactacttggacgatactactgaagtgacatgcatgcttgaatctctagctgaagcatcagaggcttcaaacttttctatgcgtgaacttgatgaagccctttgatttggaaccagatcttttgccagatggctaaagaagaggttagacagacaaagacaaggaatagaagagactgggagtttgttggtctgtatgtgtttgtcagattgaaagaaagaaaagaagaaaagggtagtgaaagagtaataatggggaaaaaaacaaatggtgatgtgaagaagctttgttatttgcagagcaatcaatcaaacaatcaaaggaggaggaaaatagatgtgtttgggttcatcagggaaatgtgtttgcaggatgttgaagttaacaacaagcaaaagcttttcctgatcttttttttttaatattcttattactattattattgttatttgtaattggatgatctcttgaggatatcaaatttggattcggctgtttattggatctgaacgaaaacgaaactgtgaagaaaatgtttgtaaagataacgttgcttgtccattgttgatttttttctttctatttattattatgcttttctt

SEQ ID NO: 17201 - protein, 851 aa, Arabidopsis thaliana (mouse-ear cress)
MISRSYTNLLDLASGNFPVMGRERRRLPRVMTVPGNVSEFDEDQAYSVSSDNPSSVSSDRMIIVANRLPLKAEKRNGSWSFSWDQDSLYLQLKDGLPEDMEILYVGSLSVDVDSNEQDDVAQILLDKFKCVPTFFPPDLQSKFYDGFCKRQIWPLFHYMLPFSADHGGRFDRSLWEAYVATNKLFFQKVIEVINPDDDFVWIHDYHLMVLPTFLRRRFNRIRMGFFLHSPFPSSEIYRSLPVREEILKALLNSDLIGFHTFDYARHFLTCCSRMLGLEYQSKRGYIGLEYYGRTVGIKIMPVGINMGRIQSVMRYSEEEGKVMELRNRFEGKTVLLGIDDMDIFKGINLKLLAMEQMLRQHPNWRGRAVLVQIVNPARGKGIDVEEIRGEIEESCRRINGEFGKPGYQPIIYIDTPVSINEINAYYHIAECVVVTAVRDGMNLTPYEYIVCRQGLLGSESDFSGPKKSMLVASEFIGCSPSLSGAIRVNPWNVEATGEALNEALSMSDAEKQLRHEKHFRYVSTHDVAYWSRSFLQDLERICVDHFKKRCWGMGISFGFRVVALDPNFRKLSIPCIVSDYKRAKSRAILLDYDGTLMPQNSINKAPSQEVLNFLDALCEDKKNSIFIVSGRGRESLSKWFTPCKKIGIAAEHGYFLKWSGSEEWETCGQSSDFGWMQIVEPVMKQYTESTDGSSIEIKESALVWQYRDADPGFGSLQAKEMLEHLESVLANEPVAVKSGHYIVEVKPQGVSKGSVSEKIFSSMAGKGKPVDFVLCIGDDRSDEDMFEAIGNAMSKRLLCDNALVFACTVGQKPSKAKYYLDDTTEVTCMLESLAEASEASNFSMRELDEAL

SEQ ID NO: 17202 - DNA, 1422 bp, Salmonella enterica subsp. enterica serovar Typhi
  CDS (1)..(1422)
atgagtcgtttagtcgtagtatctaatcgaattgcccccccggataataaaggcggcgccggcggcctcgccgttggcgtgcttggcgcgctaaaagcggctggcgggttgtggttcggctggagtggcgagacaggtaacgaggatgagccattaaaaaaggtgacaaaaggtaatattacctgggcatcgtttaacctgagcgaacaagattacgaagattattactgtcaattttccaatgcggttctctggcctgcgttccactatcgtctggacctggtacagtttcagcgtcctgcatgggaaggctatatgcgggtgaatgcgttattagcggataagttattgcccctcattaaagagaacgacatcatttgggtgcatgactaccacctgttaccgttcgccagcgagctgcgtaaacgcggcgtgaacaaccgaattggttttttcctgcatattccattcccgaccccggagatttttaacgccttaccgccgcatgatgaactgctggagcagttgtgtgactttgatctgctagggttccagaccgaaaatgatcgcctggcttttctggatagcctttcgagtcaaacgcgagtcacgactcgcagcggcaagcagcatatcgcgtggggtaaagacttccagacagaagtgtatcctatcggtattgagcccgatgagattgctctgcaggctgccgggccgttgccgcctaaactggcgcagctcaaggcggaactgaaaaatgtgaagaatattttttccgttgagcggctggattattcgaaagggctgccggaacgttttctggcgtatgaagcgctactggaaaactatccgcagcatcggggaaaaattcgttatacccaaattgcgcctacgtcacgcggcgaagtacaggcatatcaggatattcgccaccagcttgagacggaagcaggccggattaatgggaaatatggacaattgggctggacgccgctctattatctgaatcaacatttcgaccgtaaactgttaatgaagatattccgttattcagacgtcgggctcgtcaccccgttgcgtgacgggatgaacctggtggcgaaagagtttgtcgccgcgcaggaccccgctaaccctggcgtactggtactgtcacagtttgccggcgcggcgaatgaactgacgtcggcgttaatcgtcaatccttacgatcgggatgacgtggcggcggcgctcaatcgtgcgctaacgatgccccttgccgagcgtatttcgcgtcatgcggagatgctggacgtgatcgttaaaaatgacattaaccgctggcaggagcgttttattcatgacctaaaggaggtcacgccgcgtagccctgagcgtcagcagcagaacaacgtggcgacgttccctaagctggcctga

SEQ ID NO: 17203 - protein, 473 aa, Salmonella enterica subsp. enterica serovar Typhi
MSRLVVVSNRIAPPDNKGGAGGLAVGVLGALKAAGGLWFGWSGETGNEDEPLKKVTKGNITWASFNLSEQDYEDYYCQFSNAVLWPAFHYRLDLVQFQRPAWEGYMRVNALLADKLLPLIKENDIIWVHDYHLLPFASELRKRGVNNRIGFFLHIPFPTPEIFNALPPHDELLEQLCDFDLLGFQTENDRLAFLDSLSSQTRVTTRSGKQHIAWGKDFQTEVYPIGIEPDEIALQAAGPLPPKLAQLKAELKNVKNIFSVERLDYSKGLPERFLAYEALLENYPQHRGKIRYTQIAPTSRGEVQAYQDIRHQLETEAGRINGKYGQLGWTPLYYLNQHFDRKLLMKIFRYSDVGLVTPLRDGMNLVAKEFVAAQDPANPGVLVLSQFAGAANELTSALIVNPYDRDDVAAALNRALTMPLAERISRHAEMLDVIVKNDINRWQERFIHDLKEVTPRSPERQQQNNVATFPKLA

SEQ ID NO: 17204 - DNA, 1497 bp, Mycobacterium leprae
  CDS (1)..(1497)
atgacttcgcggggtaaccatggctcgaagacctcaagtgacaagcacctcggggattccgactttgtagtggtcgccaatcgcctgccagttgatcaggtgcgacttcccgatggcactgcgatctggaagcgcagtccaggcgggttggtcacagcgctagagccgctgctgcgtcagcggcgcggggcctgggtcggctggccgggcgtaataaacgacaacgtggacctcgacttgaccatcaagtcgatcgtgcaggatggccttactctttatccggtacggctgaacacacatgatgtcgccgagtactacgaggggttctcgaacgccacgctgtggccgctataccacgacgtcatcgtaaagcccatttaccactgcgaatggtgggaacgctacgtcgatgtcaaccggcgcttcgccgaaacaacgtcacgcacagccgcctacggtgggaccgtatgggtgcaggactaccaactgcaattggtaccgaagatgctgcgcataatgcggcccgacttgaccatcggtttcttcttgcacatcccgttcccgccggtggagctgttcatgcagataccatggcgcaccgagatcatcgagggtctgctcggggccgacctagtgggattccatctgaccagcggtgcgcagaatttcctgttcctgtcccgacatctgctcggcgctaacacgtcgcgcggattggttggtgtgcgatcacggttcggtgaagtgcaattgaagtcccacacagtccaagtgggcgcgtttcccatctcgatcgactccaaagaaatcgaccaagccacccgcgaccgcaacgtccggcgccgcgcccgcgaaatccgggctgagctaggtaacccccgcaaaatcctgctcggcgttgaccgactcgactacaccaagggcatcgatgttcgattgagggccttcgctgaactgctcgccgagggtcgggcgaagcgcgacgacaccgttctagtccagctagcgacaccgagccgcgaacgagtagaaagctataagattttacgcaacgacatcgaacgccaagttggccatatcaacggcgaatacggcgaggtcggtcatcccgtggtgcactacttgcaccgcccaattccccgcgacgagctcatcgcgttctacgtggcaagtgatgtcatgttggtcaccccgctgcgggacgggatgaacctagtggccaaggaatacgtcgcgtgccgcaacgatctcggcggtgcgctcgtcctcagcgaattcaccggagcagccgcggaactccggcaggcctatctagtcaacccacacgacctagaaggggttaaggacacgatcgaagcggcgctcaaccagctggccgaagaagcacggcgccggatgcggtcgctgcgacgccaagtgctcgcccatgacgtcgatcgctgggcgcgatcatttctcgacgcgctcgccgaagcgccggcgcgcgacgcgacataa

SEQ ID NO: 17205 - protein, 498 aa, Mycobacterium leprae
MTSRGNHGSKTSSDKHLGDSDFVVVANRLPVDQVRLPDGTAIWKRSPGGLVTALEPLLRQRRGAWVGWPGVINDNVDLDLTIKSIVQDGLTLYPVRLNTHDVAEYYEGFSNATLWPLYHDVIVKPIYHCEWWERYVDVNRRFAETTSRTAAYGGTVWVQDYQLQLVPKMLRIMRPDLTIGFFLHIPFPPVELFMQIPWRTEIIEGLLGADLVGFHLTSGAQNFLFLSRHLLGANTSRGLVGVRSRFGEVQLKSHTVQVGAFPISIDSKEIDQATRDRNVRRRAREIRAELGNPRKILLGVDRLDYTKGIDVRLRAFAELLAEGRAKRDDTVLVQLATPSRERVESYKILRNDIERQVGHINGEYGEVGHPVVHYLHRPIPRDELIAFYVASDVMLVTPLRDGMNLVAKEYVACRNDLGGALVLSEFTGAAAELRQAYLVNPHDLEGVKDTIEAALNQLAEEARRRMRSLRRQVLAHDVDRWARSFLDALAEAPARDAT

SEQ ID NO: 17206 - DNA, 2829 bp, Arabidopsis thaliana (mouse-ear cress)
  CDS (1)..(2829)
atgcctggaaataagtacaactgcagttcttctcatatcccactctctcgaacagaacgcctcttgagagatagagagcttagagagaagaggaagagcaaccgagctcgtaatcctaatgacgttgctggcagttccgagaactctgagaatgacttgcgtttagaaggtgacagttcaaggcagtatgttgaacagtacttggaaggggctgctgctgcaatggcgcacgatgatgcgtgtgagaggcaagaagttaggccttataataggcaacgactacttgtagtggctaacaggctcccagtttctgccgtgagaagaggtgaagattcatggtctcttgagatcagtgctggtggtctagtcagtgctctcttaggtgtaaaggaatttgaggccagatggataggatgggctggagttaatgtgcctgatgaggttggacagaaggcacttagcaaagctttggctgagaagaggtgtattcccgtgttccttgatgaagagattgttcatcagtactataatggttactgcaacaatattctgtggcctctgtttcactaccttggacttccgcaagaagatcggcttgccacaaccagaagctttcagtcccaatttgctgcatacaagaaggcaaaccaaatgttcgctgatgttgtaaatgagcactatgaagagggagatgtcgtctggtgccatgactatcatcttatgttccttcctaaatgccttaaggagtacaacagtaagatgaaagttggatggtttctccatacaccattcccttcgtctgagatacacaggacacttccatcacgatcagagctccttcgctcagttcttgctgctgatttagttggcttccatacatatgactatgcaaggcactttgtgagtgcgtgcactcgtattcttggacttgaaggaacacctgagggagttgaggatcaaggcaggctcactcgtgtagctgcttttccaattggcatagattctgatcggtttatacgagcacttgaggtccccgaagtcatacaacacatgaaggaattgaaagaaagatttgctggcagaaaggtgatgttaggtgttgatcgtcttgacatgatcaaagggattccacaaaagattctggcattcgaaaaatttctcgaggaaaatgcaaactggcgtgataaagtggtcttattgcaaattgcggtgccaacaagaactgacgttcctgagtatcaaaaactcacaagccaagttcatgaaattgttggacgcattaatggtcgttttgggacactgactgcagttccaatacatcatctggatcggtctctggactttcatgctttatgtgcactttatgccgtcacagatgttgcgcttgtaacatctttgagagatgggatgaatcttgtcagttatgagtttgttgcttgccaagaggccaaaaagggcgtcctcattctcagtgaatttgcaggtgctgcacagtctctgggtgctggagctattcttgtgaatccttggaacatcacagaagttgctgcctccattggacaagccctaaacatgacagctgaagaaagagagaaaagacatcgccataattttcatcatgtcaaaactcacactgctcaagaatgggctgaaacttttgtcagtgaactaaatgacactgtaattgaggcgcaactacgaattagtaaagtcccaccagagcttccacagcatgatgcaattcaacggtattcaaagtccaacaacaggcttctaatcctgggtttcaatgcaacattgactgaaccagtggataatcaagggagaagaggtgatcaaataaaggagatggatcttaatctacaccctgagcttaaagggcccttaaaggcattatgcagtgatccaagtacaaccatagttgttctgagcggaagcagcagaagtgttttggacaaaaactttggagagtatgacatgtggctggcagcagaaaatgggatgttcctaaggcttacgaatggagagtggatgactacaatgccagaacacttgaacatggaatgggttgatagcgtaaagcatgttttcaagtacttcactgagagaactcccaggtcacactttgaaactcgcgatacttcgcttatttggaactacaaatatgcagatatcgaattcgggagacttcaagcaagagatttgttacaacacttatggacaggtccaatctctaatgcatcagttgatgttgtccaaggaagccgctctgtggaagtccgtgcagttggtgtcacaaagggagctgcaattgatcgtattctaggagagatagtgcatagcaagtcgatgactacaccaatcgattacgtcttgtgcattggtcatttcttggggaaggacgaagatgtttacactttcttcgaaccagaacttccatccgacatgccagccattgcacgatccagaccatcatctgacagtggagccaagtcatcatcaggagaccgaagaccaccttcaaagtcgacacataacaacaacaaaagtggatcaaaatcctcatcatcctctaactctaacaacaacaacaagtcctcacagagatctcttcagtcagagagaaaaagtggatccaaccatagcttaggaaactcaagacgtccttcaccagagaagatctcatggaatgtgcttgacctcaaaggagagaactacttctcttgcgctgtgggtcgtactcgcaccaatgctagatatctccttggctcacctgacgacgtcgtttgcttccttgagaagctcgctgacaccacttcctcaccttaa

SEQ ID NO: 17207 - protein, 942 aa, Arabidopsis thaliana (mouse-ear cress)
MPGNKYNCSSSHIPLSRTERLLRDRELREKRKSNRARNPNDVAGSSENSENDLRLEGDSSRQYVEQYLEGAAAAMAHDDACERQEVRPYNRQRLLVVANRLPVSAVRRGEDSWSLEISAGGLVSALLGVKEFEARWIGWAGVNVPDEVGQKALSKALAEKRCIPVFLDEEIVHQYYNGYCNNILWPLFHYLGLPQEDRLATTRSFQSQFAAYKKANQMFADVVNEHYEEGDVVWCHDYHLMFLPKCLKEYNSKMKVGWFLHTPFPSSEIHRTLPSRSELLRSVLAADLVGFHTYDYARHFVSACTRILGLEGTPEGVEDQGRLTRVAAFPIGIDSDRFIRALEVPEVIQHMKELKERFAGRKVMLGVDRLDMIKGIPQKILAFEKFLEENANWRDKVVLLQIAVPTRTDVPEYQKLTSQVHEIVGRINGRFGTLTAVPIHHLDRSLDFHALCALYAVTDVALVTSLRDGMNLVSYEFVACQEAKKGVLILSEFAGAAQSLGAGAILVNPWNITEVAASIGQALNMTAEEREKRHRHNFHHVKTHTAQEWAETFVSELNDTVIEAQLRISKVPPELPQHDAIQRYSKSNNRLLILGFNATLTEPVDNQGRRGDQIKEMDLNLHPELKGPLKALCSDPSTTIVVLSGSSRSVLDKNFGEYDMWLAAENGMFLRLTNGEWMTTMPEHLNMEWVDSVKHVFKYFTERTPRSHFETRDTSLIWNYKYADIEFGRLQARDLLQHLWTGPISNASVDVVQGSRSVEVRAVGVTKGAAIDRILGEIVHSKSMTTPIDYVLCIGHFLGKDEDVYTFFEPELPSDMPAIARSRPSSDSGAKSSSGDRRPPSKSTHNNNKSGSKSSSSSNSNNNNKSSQRSLQSERKSGSNHSLGNSRRPSPEKISWNVLDLKGENYFSCAVGRTRTNARYLLGSPDDVVCFLEKLADTTSSP

SEQ ID NO: 17208 - DNA, 1491 bp, Methanobacterium thermoautotrophicum
  CDS (1)..(1491)
atgagtgagcttcagaaacgtgccatgaggtttcttgaagacaagaaccccgttattgtatccaacagggggcctgtggaattcttcaaggaaaatgatgaaactgttatgaagaggggtgccggtggccttgtctcaacactgctgcccctcgttgaaaggttcagtggtgtctggatttcaagtgcaatgacagttgaggatgcaagggtcgcctcagggtaccctgagaacagggttccactccctgaagatgatcccagattcacggtttcattcgttatagtggatcgtgaacgatatgagtcatactacagcattataagcaatcctcttctctggttcgtccagcactacatgtggaatactccctacgatcctcagatagatgataaagtttaccgtgcctgggaagatggctatgtccatgtcaataaaaaatttggggataaggtgatatctgaaattgagagaaatgaaaaggattccctgattatgttacaggattaccatctttatttatgtcctttcttcataaaaaaggaaattggtgacgtctttttaagtcacttcatacatataccctggccacaaagggattacttcaatatacttcctgaaaggatgagggctgacataataggaggccttctatcaaataccatcctcggcttccatatagagagatactgcgccaatttctttgagtgctgtgaggaccttggttatgaggttgacggggacagaggtatcgtgaggaacggggatgaaaaaacccttgttaaaagttatcccatatctgttgaccctgaaagcatggaaaggaccgtcagctcccccaccttcatggaaaaggatgaatttgttcggaaattaaaggggaacatgtttctcatataccgcacagatagggctgatctcagcaaaaacataatacgtggtttccgggcctatgaattatttttgagggatcatccagaatttcatggaaaggtaaagtttcttgcaaccggtaaaccaacaagacagcagataagagaatacaggaattactctgaggaggtcaaagatactgtagaggagatcaacgagaaatatggtacagatgaatggaaacccattgaatacatttaccgtgccgactacgaacttgttgcagccgccttcaagaactatgactgcctgattgtaaatcccattgcagatggtatgaacatcgtgccaaaggaggctgcgattatcaatagagaagatggtgccctgatactctcagaacgggctggatgctatgatgaacttgctgagcatgtaataggtgtaaacccctttgatataaaggaaactgcagatgcgatttacagtgccatgaaaatgagtcccgggaaaaggaagaagctttcagaaggtcttaagtcaagggtccttaaaagaacaatctaccactggatcaacgagcagttcgatgattttgaggatctatgggaaagttaa

SEQ ID NO: 17209 - protein, 496 aa, Methanobacterium thermoautotrophicum
MSELQKRAMRFLEDKNPVIVSNRGPVEFFKENDETVMKRGAGGLVSTLLPLVERFSGVWISSAMTVEDARVASGYPENRVPLPEDDPRFTVSFVIVDRERYESYYSIISNPLLWFVQHYMWNTPYDPQIDDKVYRAWEDGYVHVNKKFGDKVISEIERNEKDSLIMLQDYHLYLCPFFIKKEIGDVFLSHFIHIPWPQRDYFNILPERMRADIIGGLLSNTILGFHIERYCANFFECCEDLGYEVDGDRGIVRNGDEKTLVKSYPISVDPESMERTVSSPTFMEKDEFVRKLKGNMFLIYRTDRADLSKNIIRGFRAYELFLRDHPEFHGKVKFLATGKPTRQQIREYRNYSEEVKDTVEEINEKYGTDEWKPIEYIYRADYELVAAAFKNYDCLIVNPIADGMNIVPKEAAIINREDGALILSERAGCYDELAEHVIGVNPFDIKETADAIYSAMKMSPGKRKKLSEGLKSRVLKRTIYHWINEQFDDFEDLWES

SEQ ID NO: 17210 - DNA, 1392 bp, Sinorhizobium meliloti
  CDS (1)..(1392)
atgagccgtctcgtcattgtttccaatcgtgtgcccgtccctgacaagggaggcattgcgcctgccggtgggctggcggtcgcgctgaaagtcgcccttgaagagcatggcggcatctggatgggctggtcgggacgatcgagcggagagaacgagccggagccgcttgctcagttgcaccagggcaatatcacctatgcgctcacggacctgactgataccgacgtcggagaatattaccacggcttcgccaaccgggttctttggccgatctgccactaccggcttgatcttgccgaatacggtcgcaaggagatggccgggtatttccgcgtcaaccgcttcttcgcccatcggctggcgccgctcgtcaggcccgatgacgtgatctgggtgcacgactaccatttgatccctctcgccgcagaactccgtcaaatgggcttgaagaaccggatcggcttctttctccacattccctggccgcctgccgacgtactcttcacgatgcccgttcacgaggagatcatgcgcggcctgtcgcactacgatgtcgtcggtttccagaccgatcatgatcttgagaacttcgccggctgtctcaggcgggaaggcattggcgatgaactcggtggaggccgcttcagtgcctatggtcgcgtattcaagggcggcatctatgcaatcggcatagagactgcggcctttgccgaatttgccaaaaaggcattgaccaacaagaccgtcaggaaagcgcgtgaaagtatcgagcaccggagcctgatcatcggtgtcgatcgcctcgattactcaaaagggatcacgcagcgcatcgacgcgttcgagcgcttcatcctggccaatccggcccagcaggggcgcgtcacctatctgcagatcacgccgaagtcgcggtccgaagtgccggaatacgaagccatgcagcgaactgtggccgaacaggccggcagggtgaacggcgcgctcggcgctgttgattgggtgcccatacgctatattaaccgttcggtaggccggcatattcttgcagggctttaccggcttggcaaagtcggcctggtgacgccgcttcgagacgggatgaatctggttgcgaaggaatatgtggccgcgcaggacccggacgatccgggcgtgctcgtgctttcgcgtttcgccggggccgcccgcgatctaaaaggcgccctgctcgtcaatccctacgatattgagggtaccgcaaacgctatggcgcgcgcgcttagcatgccgctcgaagagcggaaggatcgctggaagactatgatggatcacttgctggaacacgacgtctcgcgctggtgccgggactttctcaatgatctggcgacatcaccggatccgtcgggttag

SEQ ID NO: 17211 - protein, 463 aa, Sinorhizobium meliloti
MSRLVIVSNRVPVPDKGGIAPAGGLAVALKVALEEHGGIWMGWSGRSSGENEPEPLAQLHQGNITYALTDLTDTDVGEYYHGFANRVLWPICHYRLDLAEYGRKEMAGYFRVNRFFAHRLAPLVRPDDVIWVHDYHLIPLAAELRQMGLKNRIGFFLHIPWPPADVLFTMPVHEEIMRGLSHYDVVGFQTDHDLENFAGCLRREGIGDELGGGRFSAYGRVFKGGIYAIGIETAAFAEFAKKALTNKTVRKARESIEHRSLIIGVDRLDYSKGITQRIDAFERFILANPAQQGRVTYLQITPKSRSEVPEYEAMQRTVAEQAGRVNGALGAVDWVPIRYINRSVGRHILAGLYRLGKVGLVTPLRDGMNLVAKEYVAAQDPDDPGVLVLSRFAGAARDLKGALLVNPYDIEGTANAMARALSMPLEERKDRWKTMMDHLLEHDVSRWCRDFLNDLATSPDPSG

SEQ ID NO: 17212 - DNA, 1503 bp, Mycobacterium tuberculosis
  CDS (1)..(1503)
atggctccctcgggaggccaggaggcgcagatttgcgattcggagaccttcggggactctgacttcgtggtggtagccaatcgactgcccgtcgatctggagcgtcttcccgacggcagcacaacctggaaacgcagccccggaggcttggtcaccgccttggagccggtgctgcggcgtcggcgcggggcctgggtcggctggcccggcgttaacgacgacggggccgaacccgacctccacgtgctggacggccccatcatccaagacgagctggaacttcatccggtacggctgagcaccacggacatagctcagtactacgagggattctccaacgccacactgtggccgctgtaccacgacgtcatcgtcaagccgctctaccaccgcgaatggtgggatcgctacgtcgacgtcaaccagcgctttgccgaggccgcgtcgcgcgccgccgcccacggcgcaaccgtgtgggtacaggactaccagctgcagctggtaccgaagatgctgcgcatgctgcggcccgatctgaccatcggtttctttttgcacatcccgttcccgccggtagagctgtttatgcagatgccgtggcgcaccgagatcatccagggcctactgggcgccgacctggtgggcttccatcttccgggcggtgcccagaatttcctgatcctgtcccggcgtctggtcggcaccgacacttcccgcggaaccgtcggtgtgcggtcgcggttcggtgcggcggtgctcgggtcccgcaccatacgagttggcgcctttcctatctcggttgactccggcgcgctcgaccacgctgcccgcgaccgcaacatcaggcgccgggcccgcgagattcgcaccgaactgggaaatccgcgcaagatcctgctcggtgttgaccggctcgactacaccaagggcatcgacgtacggctgaaggccttttccgagctgctggccgagggccgcgtcaaacgcgacgacaccgtcgtggtccagctggctaccccgagccgcgagcgggtggagagctaccagacgctgcgcaacgacatcgaacgccaggtcggccacattaacggcgagtacggtgaggttggccatccggtagtgcattacctgcatcgaccggctccgcgcgacgagcttatcgctttcttcgtggccagcgacgtcatgctggtcaccccactacgcgacgggatgaacctggtggccaaggagtacgtcgcttgccgcagcgatcttggcggtgccctggtgctcagcgaattcaccggggccgcagccgaactccggcacgcatacctggtcaacccgcacgacctggaaggcgtcaaggacgggatagaggaagcgctcaaccagacggaggaggcgggccggcggcgaatgcggtcgctgcgacgccaagtgctcgcccacgacgtggaccgctgggcacagtcgtttctcgacgctctcgccggggcacacccgaggggccaaggctaa

SEQ ID NO: 17213 - protein, 500 aa, Mycobacterium tuberculosis
MAPSGGQEAQICDSETFGDSDFVVVANRLPVDLERLPDGSTTWKRSPGGLVTALEPVLRRRRGAWVGWPGVNDDGAEPDLHVLDGPIIQDELELHPVRLSTTDIAQYYEGFSNATLWPLYHDVIVKPLYHREWWDRYVDVNQRFAEAASRAAAHGATVWVQDYQLQLVPKMLRMLRPDLTIGFFLHIPFPPVELFMQMPWRTEIIQGLLGADLVGFHLPGGAQNFLILSRRLVGTDTSRGTVGVRSRFGAAVLGSRTIRVGAFPISVDSGALDHAARDRNIRRRAREIRTELGNPRKILLGVDRLDYTKGIDVRLKAFSELLAEGRVKRDDTVVVQLATPSRERVESYQTLRNDIERQVGHINGEYGEVGHPVVHYLHRPAPRDELIAFFVASDVMLVTPLRDGMNLVAKEYVACRSDLGGALVLSEFTGAAAELRHAYLVNPHDLEGVKDGIEEALNQTEEAGRRRMRSLRRQVLAHDVDRWAQSFLDALAGAHPRGQG

SEQ ID NO: 17214 - DNA, 2091 bp, Saccharomyces cerevisiae
  CDS (233)..(1720)
cgccatggacaaactgcactgaggttctaagacacatgtattattgtgagtatgtatatatagagagagattaaggcgtacagccgggtggtagagattgattaacttggtagtcttatcttgtcaattgagtttctgtcagtttcttcttgaacaagcacgcagctaagtaagcaacaaagcaggctaacaaactaggtactcacatacagacttattaagacatagaactatgactacggataacgctaaggcgcaactgacctcgtcttcagggggtaacattattgtggtgtccaacaggcttcccgtgacaatcactaaaaacagcagtacgggacagtacgagtacgcaatgtcgtccggagggctggtcacggcgttggaagggttgaagaagacgtacactttcaagtggttcggatggcctgggctagagattcctgacgatgagaaggatcaggtgaggaaggacttgctggaaaagtttaatgccgtacccatcttcctgagcgatgaaatcgcagacttacactacaacgggttcagtaattctattctatggccgttattccattaccatcctggtgagatcaatttcgacgagaatgcgtggttggcatacaacgaggcaaaccagacgttcaccaacgagattgctaagactatgaaccataacgatttaatctgggtgcatgattaccatttgatgttggttccggaaatgttgagagtcaagattcacgagaagcaactgcaaaacgttaaggtcgggtggttcctgcacacaccattcccttcgagtgaaatttacagaatcttacctgtcagacaagagattttgaagggtgttttgagttgtgatttagtcgggttccacacatacgattatgcaagacatttcttgtcttccgtgcaaagagtgcttaacgtgaacacattgcctaatggggtggaataccagggcagattcgttaacgtaggggccttccctatcggtatcgacgtggacaagttcaccgatgggttgaaaaaggaatccgtacaaaagagaatccaacaattgaaggaaactttcaagggctgcaagatcatagttggtgtcgacaggctggattacatcaaaggtgtgcctcagaagttgcacgccatggaagtgtttctgaacgagcatccagaatggaggggcaaggttgttctggtacaggttgcagtgccaagtcgtggagatgtggaagagtaccaatatttaagatctgtggtcaatgagttggtcggtagaatcaacggtcagttcggtactgtggaattcgtccccatccatttcatgcacaagtctataccatttgaagagctgatttcgttatatgctgtgagcgatgtttgtttggtctcgtccacccgtgatggtatgaacttggtttcctacgaatatattgcttgccaagaagaaaagaaaggttccttaatcctgagtgagttcacaggtgccgcacaatccttgaatggtgctattattgtaaatccttggaacaccgatgatctttctgatgccatcaacgaggccttgactttgcccgatgtaaagaaagaagttaactgggaaaaactttacaaatacatctctaaatacacttctgccttctggggtgaaaatttcgtccatgaattatacagtacatcatcaagctcaacaagctcctctgccaccaaaaactgatgaacccgatgcaaatgagacgatcgtctattcctggtccggttttctctgccctctcttctattcactttttttatactttatataaaattatataaatgacataactgaaacgccacacgtcctctcctattcgttaacgcctgtctgtagcgctgttactgaagctgcgcaagtagttttttcaccgtataggccctctttttctctctctttctttctctcccgcgctgatctcttcttcgaaacatcatgaataaaaagaaaaaggaaatcaagaaaaaaaagccataatttatcccacatttttttttattgtcgctgttcacaccgcataacgaagatattggctacataaacaattgacattg

SEQ ID NO: 17215 - protein, 495 aa, Saccharomyces cerevisiae
MTTDNAKAQLTSSSGGNIIVVSNRLPVTITKNSSTGQYEYAMSSGGLVTALEGLKKTYTFKWFGWPGLEIPDDEKDQVRKDLLEKFNAVPIFLSDEIADLHYNGFSNSILWPLFHYHPGEINFDENAWLAYNEANQTFTNEIAKTMNHNDLIWVHDYHLMLVPEMLRVKIHEKQLQNVKVGWFLHTPFPSSEIYRILPVRQEILKGVLSCDLVGFHTYDYARHFLSSVQRVLNVNTLPNGVEYQGRFVNVGAFPIGIDVDKFTDGLKKESVQKRIQQLKETFKGCKIIVGVDRLDYIKGVPQKLHAMEVFLNEHPEWRGKVVLVQVAVPSRGDVEEYQYLRSVVNELVGRINGQFGTVEFVPIHFMHKSIPFEELISLYAVSDVCLVSSTRDGMNLVSYEYIACQEEKKGSLILSEFTGAAQSLNGAIIVNPWNTDDLSDAINEALTLPDVKKEVNWEKLYKYISKYTSAFWGENFVHELYSTSSSSTSSSATKN

SEQ ID NO: 17216 - DNA, 5981 bp, Saccharomyces cerevisiae
  CDS (2282)..(5578)
ggctcacattccaaaaagaacagttcgaacgataaagcttttcaccgctggtggtgataacaaggttaggatatggaagttgaacagagatgaaaacggacaaaatgggggggtgcgtaagattgaaagccttgactttcttggctcgtgacgcatcacgaacaggccataaatgtaatccgattcaactcgaagggtgacgtactggcgtctgcgggcgatgacggccaagtgctgctatggaagcaagaagaaccaaatacacagcaagaatctgtggtcagaccattcggaatggatgcggagactagtgaagcagacgagaacaaggagaaatgggttgtgtggaaacggctgcgtggtggtagcggtgctactgcggcggcagagatttacgatctagcgtggtcacctgataacaggaacatagtggtggcatgtatggacaattcgatacgactgttcgatgttggagctgggatgctggtatgcggccagtcggatcatggtcactacgtccaaggtcttgcatgggacccattaaatcagtttattctctcacagtctgcggaccggtctctgcatgtatatggagtcattctttcatctgcaggagttagttacagggcttgaaactttagaagtaaggttgccaaggcagaactgccttgtccaggtgatgtcctgaggacaaattactttttcacaacgagacgctaccttcattctttaggcgatgcagcatatcgccttgtggtggtttggtcgtaattcccagtggtgtgtataaggtggctggtgatgaagtcgcgaactgcgtatacgtgtatactagatctggaatactgaacagcgctggtggcgttaaaaaccggcctgcgattagaatcccatctttgaagaaaccagcgctgatggcggctttctcgcccgtattttacgaaacgtgccagaagagtgtgcttaagctgccctataagctagtatttgccatagcaacgactaacgaagtactcgtgtacgacacggatgtattggagccgttatgcgttgtgggaaatatacattactcacccataactgatttagcatggtctgaggatggctcgaccctactaatctcatcaacagacggattctgttcgtatgtatcgatcgacacagaaacgcaattcggttcaaggatagagccgccagcgatgcatgcagagccactagacactgacgagagcgcggtagcggctaagaaccagcgcgaggcaggtgggatcgtgaacatgctgccggtgaagaagatcccctgcaatagtagcgatagtaaaaagaggcgcatacatcctacgccagtcgatttgtgatttttaatatatttaatgcggtacataagaatgcctaatctagtttgccagcgaagatattttccattgtgtgctcaatggaccctgtgttcctgagatcttgcacgactttttcctgaggcacatgtggcgccatcgtcatcacgatttcaaccatgtcactattaacggctctctttcgatcactaccatgtctgtttaaccgagcaacgcgttcctccggagccgatggtactggctccggagaagggtcgttggtggcgaccgagggcgccggtttggcatcctgtacggtccgcaagggtacttgcttggcgcccctgtgtttcacggtgtaaacaaacaagcacaccatcgtcagtataaagcactatagtcgaaccatccatttttacttttgtgcgcgtgggtagccgtgcctcgtctgtgtgtgtgggaatgtataaatgtgtcccgagttattattctaaagcgggcaccattgtagtaacttattgcgaaatttctgctcttctcgtctcgctcaaaaatcgcgttcagggtaaaaggggcgaaacagagggccagatagaaatttcgagaaaacgggtcaccccgcccctgcattttgatatggcgtatttgggattgcttgctcgaaagtgtctaagtccggctggcgggcctggcgccctcgccgaagggagataggaaggggcgggggtccgggcagcggctatggtgtcagttacctagggaaggagaagggggtagaaccaaggggctagcacactcaccctggggcccccgtctagccaagcttaaatataaatactaatgtaactataaatataaggatctaccgtgtcattgcacatccacccacccgtcgattaaaaaaccaaacaaagcaaagaatacaatagcaacgcaagatcaacacaatggctctcatcgtggcatctttgtttttgccctaccaaccacaattcgagcttgacacctctctccctgagaactcgcaggtggactcatctctcgtgaacatccaggctatggccaatgaccaacagcaacaacgtgcgctttctaacaacatctcacaggaatcattggtcgcgccagcaccagaacaaggtgtccccccagcaatctcaaggagtgccaccaggtcacccagtgctttcaaccgcgcctcgtctacgacaaatactgccactttagatgatcttgtctcttcggacatattcatggaaaacttgactgcgaatgcaactacctcacatacgccaacaagcaagactatgcttaaaccccggaaaaatggttccgtggaacgattcttctccccttcttccaatattcccacggatcgcatcgcatcgccaatccagcatgagcatgactccggttcgagaattgcttcgccaatccaacagcaacagcaggaccccacgaccaacttattaaagaacgtcaacaagtcattgttagtgcactcactgttgaacaacacctcacaaactagcctagaaggacccaacaaccacattgttaccccgaaatcgagggcgggcaacaggcctacttcggcggctacttctttagttaataggaccaaacaaggttcggcctcctctggatcttctgggtcttctgcgccaccttccattaaaaggattacgccccacttgactgcgtctgctgcaaaacagcgtcccttattggctaaacagccttctaatctgaaatattcggagttagcagatatttcgtcgagtgagacgtcttcgcagcataatgagtcggacccggatgatctaactactgcccctgacgaggaatatgtttctgatttggaaatggatgacgcgaagcaggactacaaggttccaaagttcggcggctattccaataaatctaaacttaagaaatatgcgctgttaaggtcatctcaggagctgtttagccgtcttccatggtcgatcgttccctctatcaaaggtaatggcgccatgaagaacgccataaacactgcagtcttggagaatatcattccgcaccgtcatgttaagtgggtcggtaccgtcggaatcccaacggatgagattccggaaaatatccttgcgaacatctctgactctttaaaagacaagtacgactcctatcctgtccttacggacgacgacaccttcaaagccgcatacaaaaactactgtaaacaaatcttgtggcctacgctgcattaccagattccagacaatccgaactcgaaggcttttgaagatcactcttggaagttctatagaaacttaaaccaaaggtttgcggacgcgatcgttaaaatctataagaaaggtgacaccatctggattcatgattaccatttaatgctggttccgcagatggtgagagacgtcttgccttttgccaaaataggatttaccttacatgtctcgttccccagtagtgaagtgtttaggtgtctggctcagcgtgagaagatcttagaaggcttgaccggtgcagactttgtcggcttccagacgagggagtatgcaagacatttcttacagacgtctaaccgtctgctaatggcggacgtggtacatgatgaagagctaaagtataacggcagagtcgtttctgtgaggttcaccccagttggtatcgacgcctttgatttgcaatcgcaattgaaggatggaagtgtcatgcaatggcgtcaattgattcgtgaaagatggcaagggaaaaaactaattgtgtgtcgtgatcaattcgatagaattagaggtattcacaagaaattgttggcttatgaaaaattcttggtcgaaaatccggaatacgtggaaaaatcgactttaattcaaatctgtattggaagcagtaaggatgtagaactggagcgccagatcatgattgtcgtggatagaatcaactcgctatccaccaatattagtatttctcaacctgtggtgtttttgcatcaagatctagatttttctcagtatttagctttgagttcagaggcagatttgttcgtagtcagctctctaagggaaggtatgaacttgacatgtcacgaatttatcgtttgttctgaggacaaaaatgctcccctactgttgtcagaatttactggtagtgcatctttattgaatgatggcgctataataattaacccatgggataccaagaacttctcacaagccattctcaaggggttggagatgccattcgataagagaaggccacagtggaagaaattgatgaaagacattatcaacaacgactctacaaactggatcaagacttctttacaagatattcatatttcgtggcaattcaatcaagaaggttccaagatcttcaaattgaatacaaaaacactgatggaagattaccagtcatctaaaaagcgtatgtttgttttcaacattgctgaaccaccttcatcgagaatgatttccatactgaatgacatgacttctaagggcaatatcgtttacatcatgaactcatttccaaagcccattctggaaaatctttacagtcgtgtgcaaaacattgggttgattgccgagaatggtgcatacgttagtctgaacggtgtatggtacaacattgttgatcaagtcgattggcgtaacgatgtagccaaaattctcgaggacaaagtggagagattacctggctcgtactacaagataaatgagtccatgatcaagttccacactgaaaatgcggaagatcaagatcgtgtagctagtgttatcggtgatgccatcacacatatcaatactgtttttgaccacagaggtattcatgcctacgtttacaaaaacgttgtttccgtacaacaagtgggactttccttatcggcagctcaatttcttttcagattctataattctgcttcggatccactggatacgagttccggccaaatcacaaatattcagacaccatctcaacaaaatccttcagatcaagaacaacaacctccagcctctcccactgtgtcgatgaaccatattgatttcgcatgtgtctctggttcatcgtctcctgtgcttgaaccattgttcaaattggtcaatgatgaagcaagtgaagggcaagtaaaagccggacacgccattgtttatggtgatgctacttctacttatgccaaagaacatgtaaatgggttaaacgaacttttcacgatcatttcaagaatcattgaagattaaattttaccattttaaaattttaatgttcttgggtatgaacttttattttcaactgcttattatatatcaattctataaatttttttcttctctctaacgaccaattataaaattcatcctcttatttattacagcatcttatacattatgtatatgggtagctattattcatttttgcttcgtaaggactttttttgtcaactttttcatcctaagcggctaaaagtgattggagaggaatgtccaggcgaccaatgataaaaacgctttctcttggaacaagaaataggagcaattgacagttgtcgatgaacagcgaaaatagtaagataaccttcaagcccaatattctaattaaaggcgtttatatatttgtactttatggtatgtgcatatgtattgt

SEQ ID NO: 17217 - protein, 1098 aa, Saccharomyces cerevisiae
MALIVASLFLPYQPQFELDTSLPENSQVDSSLVNIQAMANDQQQQRALSNNISQESLVAPAPEQGVPPAISRSATRSPSAFNRASSTTNTATLDDLVSSDIFMENLTANATTSHTPTSKTMLKPRKNGSVERFFSPSSNIPTDRIASPIQHEHDSGSRIASPIQQQQQDPTTNLLKNVNKSLLVHSLLNNTSQTSLEGPNNHIVTPKSRAGNRPTSAATSLVNRTKQGSASSGSSGSSAPPSIKRITPHLTASAAKQRPLLAKQPSNLKYSELADISSSETSSQHNESDPDDLTTAPDEEYVSDLEMDDAKQDYKVPKFGGYSNKSKLKKYALLRSSQELFSRLPWSIVPSIKGNGAMKNAINTAVLENIIPHRHVKWVGTVGIPTDEIPENILANISDSLKDKYDSYPVLTDDDTFKAAYKNYCKQILWPTLHYQIPDNPNSKAFEDHSWKFYRNLNQRFADAIVKIYKKGDTIWIHDYHLMLVPQMVRDVLPFAKIGFTLHVSFPSSEVFRCLAQREKILEGLTGADFVGFQTREYARHFLQTSNRLLMADVVHDEELKYNGRVVSVRFTPVGIDAFDLQSQLKDGSVMQWRQLIRERWQGKKLIVCRDQFDRIRGIHKKLLAYEKFLVENPEYVEKSTLIQICIGSSKDVELERQIMIVVDRINSLSTNISISQPVVFLHQDLDFSQYLALSSEADLFVVSSLREGMNLTCHEFIVCSEDKNAPLLLSEFTGSASLLNDGAIIINPWDTKNFSQAILKGLEMPFDKRRPQWKKLMKDIINNDSTNWIKTSLQDIHISWQFNQEGSKIFKLNTKTLMEDYQSSKKRMFVFNIAEPPSSRMISILNDMTSKGNIVYIMNSFPKPILENLYSRVQNIGLIAENGAYVSLNGVWYNIVDQVDWRNDVAKILEDKVERLPGSYYKINESMIKFHTENAEDQDRVASVIGDAITHINTVFDHRGIHAYVYKNVVSVQQVGLSLSAAQFLFRFYNSASDPLDTSSGQITNIQTPSQQNPSDQEQQPPASPTVSMNHIDFACVSGSSSPVLEPLFKLVNDEASEGQVKAGHAIVYGDATSTYAKEHVNGLNELFTIISRIIED

SEQ ID NO: 17218 - DNA, 2358 bp, Kluyveromyces marxianus var. lactis, Candida sphaerica
  CDS (722)..(2188)
gaattcatcctcacactgtccgtttctggtaactcgattcacttatctcaagagaatcccagcgccaaaagggaactgagcttagtggtatcccaaaagggaaaatccgcttaacgtaagggaaataagcgataaggaggaaaacctctttcgcttgagtgagggaaagctaaagacacaagaaactggtgggtcctggttggagaggacaatagcgggtaattccgctcctcatgggatccctgagtatgcattttaactcacgtgactagcacgtgagagtcatctcatccacgtgactccaaaatttccaactttttcccgagaaaaataaagggaaacgggcatcttggcacaatttgctttggttctctgttttttttttttttagcaaaggaacatcagtagatatatgagatattagtttgcaccaggtgattgaaataaaaattggatacggtatttaatggcatacccacattcttctgcatcgaagaaaatacatagaaaggggatttcttactggaaagcaatagtgcgctctttactttggattcaaatttcaattgcttgcatataagaaagaggcaagtgttctattttaaagctaggctgaaagaagagatatactatttatcgatatattcactttatccgttttgttcttaaaagcagtttttaaccagctaacagcattacatcgttataacatactgacaccatggttaatcaagacattagtaagctatccttgaacgaatgtcctggtagtgtaattgtcatttccaatagactgcccgtaactatcaaaaaggatgaaaagaccggtgaatacgaatattctatgtcttccggtgggttagtcactgcattacagggtttgaagaaatctactacgttccaatggtatggttggcctggtttagaagttcctgatgaggataaggctaaggtgaaaagagagttgttggaaaaattcaatgcgattcctattttcttgagtgacgaagttgctgatcttcattacaacggattttccaactctattctatggccattgttccattaccatcctggtgagatcactttcgatgacactgcatggttggcgtacaacgaggcaaatatggcttttgccgatgaaattgagggaaatatcaacgataacgatgtggtgtgggttcatgattaccatttgatgttgttaccggagatgattcgtcaaagagttattgccaagaagttgaaaaacatcaagattggttggttcttacatacgccgttcccatcttctgagatttacagaattttgcctgtgagacaagagatcttgaagggtgttttgagttgtgatttgatcggattccatacttacgattatgctagacatttcttaagtgccgtgcaaaggattttaaacgtgaatacgttacccaatggtgtcgagtttgacggacgtttcgtcaacgttggtgctttccctattggtatcgatgtggaaacgttcacagaaggtttgaagcaagatgctgtaatcaagagaatcaaagagttgaaagaatcctttaaaggttgcaagataataattggggtcgatcgtcttgattacatcaaaggtgttcctcagaagttacacgccttggaagtgttcctcggtgcgcatcctgaatggattggtaaggtggtgctagtacaagtcgctgtaccaagtcgtggggatgttgaagagtatcaatacttgagatcggtggttaatgaactagttggtagaatcaatggtcaatttggtacagcggaattcgtacctatccatttcatgcacaggtctattcctttccaagaattgatctccctttatgccgttagtgacgtttgcttggtctcttccactcgtgatggtatgaatttggtctcctacgaatacatttcctgccaggaagagaaaaagggaacattaattctttcagagtttactggggctgctcaatctttgaacggtgcgttgatcgtgaatccatggaacacagatgatttagcagaatcaattaacgaagccttgacggtacctgaagagaaaagagctgctaattgggaaaaattgtacaaatatatctcgaaatatacaagtgctttctggggtgaaaacttcgtccatgaattgtacagattaggatcgtcaaacaactgattacactttaatccaaatttcgtaccacttttctatatcatgcatttctttatgcgctagatgaactttctgattacatatgtatatgtctctgtgtatttccatatcaacgttacaattatacatttaatgagaaaatgagatttaaaaagattaaagacctattccga

SEQ ID NO: 17219 - protein, 488 aa, Kluyveromyces marxianus var. lactis, Candida sphaerica
MVNQDISKLSLNECPGSVIVISNRLPVTIKKDEKTGEYEYSMSSGGLVTALQGLKKSTTFQWYGWPGLEVPDEDKAKVKRELLEKFNAIPIFLSDEVADLHYNGFSNSILWPLFHYHPGEITFDDTAWLAYNEANMAFADEIEGNINDNDVVWVHDYHLMLLPEMIRQRVIAKKLKNIKIGWFLHTPFPSSEIYRILPVRQEILKGVLSCDLIGFHTYDYARHFLSAVQRILNVNTLPNGVEFDGRFVNVGAFPIGIDVETFTEGLKQDAVIKRIKELKESFKGCKIIIGVDRLDYIKGVPQKLHALEVFLGAHPEWIGKVVLVQVAVPSRGDVEEYQYLRSVVNELVGRINGQFGTAEFVPIHFMHRSIPFQELISLYAVSDVCLVSSTRDGMNLVSYEYISCQEEKKGTLILSEFTGAAQSLNGALIVNPWNTDDLAESINEALTVPEEKRAANWEKLYKYISKYTSAFWGENFVHELYRLGSSNN

SEQ ID NO: 17220 - DNA, 3170 bp, Saccharomyces cerevisiae
  CDS (147)..(2837)
cagtcagcttttccttcatctttttcagtctaatctaaggaagaagaaaagcacttcaatacgaatagctaccaacgtacccagttcacgttgaacaagcaatagaaaaccaaaataacactgcctgtcactatttctgtgccgaaatgaccaccactgcccaagacaattctccaaagaagagacagcgtatcatcaattgtgtcacgcagctgccctacaaaatccaattgggagaaagcaacgatgactggaaaatatctgctactacaggtaacagcgcattattttcctctctagaataccttcaatttgattctaccgagtacgagcaacacgttgttggttggaccggcgaaataacaagaaccgaacgcaacctgtttactagagaagcgaaagaaaaaccacaggatctggacgatgacccactatatttaacaaaagagcagatcaatgggttgactactactctacaagatcatatgaaatctgataaagaggcaaagaccgatactactcaaacagctcccgttaccaataacgttcatcccgtttggctacttagaaaaaaccagagtagatggagaaattacgcggaaaaagtaatttggccaaccttccactacatcttgaatccttcaaatgaaggtgaacaagaaaaaaactggtggtacgactacgtcaagtttaacgaagcttatgcacaaaaaatcggggaagtttacaggaagggtgacatcatctggatccatgactactacctactgttattgcctcaactactgagaatgaaatttaacgacgaatctatcattattggttatttccatcatgccccatggcctagtaatgaatattttcgttgtttgccacgtagaaaacaaatcttagatggtcttgttggggccaatagaatttgtttccaaaatgaatctttctcccgtcattttgtatcgagttgtaaaagattactcgacgcaaccgccaaaaaatctaaaaactcttccaatagtgatcaatatcaagtctctgtgtacggtggtgacgtactcgtagattctttgcctataggtgttaacacaactcaaatactaaaagatgctttcacgaaggatatagattccaaggttctttccatcaagcaagcttatcaaaacaaaaaaattattattggtagagatcgtctggattccgtcagaggcgtcgttcaaaaattaagagctttcgaaactttcttggccatgtatccagaatggcgagatcaagtggtattgatccaagtcagcagtcctactgccaacagaaattccccccaaactatcagattggaacaacaagtcaacgagttggttaactccataaattctgaatacggtaatttgaatttttctcccgtccagcattactatatgagaatccctaaagatgtatacttgtccttactaagagttgcagacttatgtttaatcacaagtgttagagacggtatgaataccactgctttggaatacgtcactgtcaaatcgcacatgtcgaactttttatgctacggaaatccattgatcttaagtgagttttctggctctagtaacgtattgaaagatgccattgtggttaacccatgggattcggtggccgtggctaaatctattaacatggctttgaaattggacaaggaagaaaagtccaatttagaatcaaaattatggaaagaagttcctacaattcaagattggactaataagtttttgagttcattaaaggaacaggcgtcatctaatgatgatatggaaaggaaaatgactccagcacttaatagacctgttcttttagaaaattacaagcaggctaagcgtagattgttcctttttgattacgatggtactttgaccccaattgtcaaagacccagctgcagctattccatcggcaagactttatacaattctacaaaaattatgtgctgatcctcataatcaaatctggattatttctggtcgtgaccagaagtttttgaacaagtggttaggcggtaaacttcctcaactgggtctaagtgcggagcatggatgtttcatgaaagatgtttcttgccaagattgggtcaatttgaccgaaaaagttgatatgtcttggcaagtacgcgtcaatgaagtgatggaagaatttaccacaaggaccccaggttcattcatcgaaagaaagaaagtcgctctaacttggcattatagacgtaccgttccagaattgggtgaattccacgccaaagaactgaaagaaaaattgttatcatttactgatgactttgatttagaggtcatggatggtaaagcaaacattgaagttcgtccaagattcgtcaacaaaggtgaaatagtcaagagactagtctggcatcaacatggcaaaccacaggacatgttgaagggaatcagtgaaaaactacctaaggatgaaatgcctgattttgtattatgtttgggtgatgacttcactgacgaagacatgtttagacagttgaataccattgaaacttgttggaaagaaaaatatcctgaccaaaaaaatcaatggggcaactacggattctatcctgtcactgtgggatctgcatccaagaaaactgtcgcaaaggctcatttaaccgatcctcagcaagtcctggagactttaggtttacttgttggtgatgtctctctcttccaaagtgctggtacggtcgacctggattccagaggtcatgtcaagaatagtgagagcagtttgaaatcaaagctagcatctaaagcttatgttatgaaaagatcggcttcttacaccggcgcaaaggtttgaaacaccctttttaacgaaatggttatgactagacagacatcttacgtcttactccttcatgctttatttttttctttgtattgtatttgaacagtcaatatgtggtgttgcgacgaaggcatatatataatagtctcaacccaccattttcgaagatttacatacacattatatttttataaacttccaatatgtaataactttatatgatatgtaacttctcactattatccttactattaaacggtttttaataaatatcattgttctttgttttattaatgagaaaaagaaatttaatacaatgtccggcgggaagaaaaaaaatcgatg

SEQ ID NO: 17221 - protein, 896 aa, Saccharomyces cerevisiae
MTTTAQDNSPKKRQRIINCVTQLPYKIQLGESNDDWKISATTGNSALFSSLEYLQFDSTEYEQHVVGWTGEITRTERNLFTREAKEKPQDLDDDPLYLTKEQINGLTTTLQDHMKSDKEAKTDTTQTAPVTNNVHPVWLLRKNQSRWRNYAEKVIWPTFHYILNPSNEGEQEKNWWYDYVKFNEAYAQKIGEVYRKGDIIWIHDYYLLLLPQLLRMKFNDESIIIGYFHHAPWPSNEYFRCLPRRKQILDGLVGANRICFQNESFSRHFVSSCKRLLDATAKKSKNSSNSDQYQVSVYGGDVLVDSLPIGVNTTQILKDAFTKDIDSKVLSIKQAYQNKKIIIGRDRLDSVRGVVQKLRAFETFLAMYPEWRDQVVLIQVSSPTANRNSPQTIRLEQQVNELVNSINSEYGNLNFSPVQHYYMRIPKDVYLSLLRVADLCLITSVRDGMNTTALEYVTVKSHMSNFLCYGNPLILSEFSGSSNVLKDAIVVNPWDSVAVAKSINMALKLDKEEKSNLESKLWKEVPTIQDWTNKFLSSLKEQASSNDDMERKMTPALNRPVLLENYKQAKRRLFLFDYDGTLTPIVKDPAAAIPSARLYTILQKLCADPHNQIWIISGRDQKFLNKWLGGKLPQLGLSAEHGCFMKDVSCQDWVNLTEKVDMSWQVRVNEVMEEFTTRTPGSFIERKKVALTWHYRRTVPELGEFHAKELKEKLLSFTDDFDLEVMDGKANIEVRPRFVNKGEIVKRLVWHQHGKPQDMLKGISEKLPKDEMPDFVLCLGDDFTDEDMFRQLNTIETCWKEKYPDQKNQWGNYGFYPVTVGSASKKTVAKAHLTDPQQVLETLGLLVGDVSLFQSAGTVDLDSRGHVKNSESSLKSKLASKAYVMKRSASYTGAKV

SEQ ID NO: 17222 - DNA, 1500 bp, Synechocystis sp
  CDS (1)..(1500)
atgaattcatcccttgtgatcctttaccaccgtgagccctacgacgaagttagggaaaatggcaaaacggtgtatcgagagaaaaagagtcccaacgggattttgcccaccctcaaaagtttttttgccgatgcggaacagagcacctgggtcgcatggaaacaggtttcgccgaagcaaaaggatgattttcaggcggatatgtccattgaaggccttggcgatcgttgtacggtgcgccgggtgcccctgacggcggagcaggtaaaaaacttctatcacatcacttccaaggaagccttttggcccattctccactctttcccctggcagttcacctacgattcttctgattgggataattttcagcacattaaccgcttatttgccgaggcggcctgtgccgatgccgatgacaatgcattgttttgggtccacgactataacctctggttagcgcccctttacattcgtcagctcaagcccaacgccaagattgcctttttccaccacacccccttccccagcgttgatattttcaatattttgccctggcgggaggcgatcgtagaaagcttgctggcctgtgatctctgtggttttcatattccccgctacgtagaaaattttgtcgccgtggcccgtagtctcaagccggtggaaatcaccagacgggttgtggtagaccaagcctttaccccctacggtacggccctggcggaaccggaactcaccacccagttgcgttatggcgatcgcctcattaacctcgatgcgtttcccgtgggcaccaatccggcaaatatccgggcgatcgtggccaaagaaagtgtgcaacaaaaagttgctgaaattaaacaagatttaggcggtaagaggctaattgtttccgctgggcgggtggattacgtgaagggcaccaaggaaatgttgatgtgctatgaacgtctactggagcgtcgccccgaattgcagggggaaattagcctggtagtccccgtagccaaggccgctgagggaatgcgtatttatcgcaacgcccaaaacgaaattgaacgactggcagggaaaattaacggtcgctttgccaaactgtcctggacaccagtgatgctgttcacctctcctttagcctatgaggagctcattgccctgttctgtgccgccgacattgcctggatcactcccctgcgggatgggctaaacctggtggctaaggagtatgtggtggctaaaaatggcgaagaaggagttctgatcctctcggaatttgccggttgtgcggtggaactacccgatgcggtgttgactaacccctacgcttccagccgtatggacgaatccattgaccaggccctggccatggacaaagacgaacagaaaaaacgcatggggagaatgtacgccgccattaagcgttacgacgttcaacaatgggccaatcacctactgcgggaagcctacgccgatgtggtactgggagagcccccccaaatgtag

SEQ ID NO: 17223 - protein, 499 aa, Synechocystis sp
MNSSLVILYHREPYDEVRENGKTVYREKKSPNGILPTLKSFFADAEQSTWVAWKQVSPKQKDDFQADMSIEGLGDRCTVRRVPLTAEQVKNFYHITSKEAFWPILHSFPWQFTYDSSDWDNFQHINRLFAEAACADADDNALFWVHDYNLWLAPLYIRQLKPNAKIAFFHHTPFPSVDIFNILPWREAIVESLLACDLCGFHIPRYVENFVAVARSLKPVEITRRVVVDQAFTPYGTALAEPELTTQLRYGDRLINLDAFPVGTNPANIRAIVAKESVQQKVAEIKQDLGGKRLIVSAGRVDYVKGTKEMLMCYERLLERRPELQGEISLVVPVAKAAEGMRIYRNAQNEIERLAGKINGRFAKLSWTPVMLFTSPLAYEELIALFCAADIAWITPLRDGLNLVAKEYVVAKNGEEGVLILSEFAGCAVELPDAVLTNPYASSRMDESIDQALAMDKDEQKKRMGRMYAAIKRYDVQQWANHLLREAYADVVLGEPPQM

SEQ ID NO: 17224 - DNA, 2586 bp, Arabidopsis thaliana (mouse-ear cress)
  CDS (1)..(2586)
atggggtcaaaatcatttggaaatctattagacttggcctctggggatcttttggacattcctcagactccgagatatcttccaagagtgatgactgttcctggcattatctctgacgttgatggatatggaattagtgatggcgattcagatgtcatttcattaccttgccgtgagcggaaaatcattgtggccaattttcttcctttgaatggtaaaaaggattcagaaactggaaagtggaaattcagtctcgacaatgattctcccctgttacatctcaaggatggtttttctccagagactgaagtcatttatgttggatcgctcaagacgcatgttgatgttagtgagcaagacgaggtttcccataatctttttgaggaattcaattgtgtagcgactttcctcccacaagatgtgcataaaaaattctaccttggcttttgtaaacagcaactatggccacttttccattacatgttacccatgtgtcctgatcatggtgaacggtttgatcgtggtctttggcaggcatatgtttctgccaacaagatatttgcagataaggtaatgggtgtgattaatcttgaagaagattatatctggattcatgactatcatttaatggttctcccaacatttttgagaaggcggtttcacagggttaagcttggtttcttcctccacagtccattcccttcttcagaaatttatcgaaccttacctgttcgagaggaactactaagagggctcttaaattgtgacttaattggttttcacacgtttgattatgcacggcatttcttgtcatgctgctgtagaatgcttggattggagtatgaatctaagagagggcatattgctcttgactacttgggacgtacagtttttctgaagattcttcctataggtattcacatgggaaggctggaatccgttctgaatcttcctgctacagctgaaaagctgaaagagattcaagaaaagtatcggggtaaaaagataattctcggtgttgatgacatggatatattcaaaggtttaagtcttaaaattttggcctttgaacacctccttcagcaatatcctagcatgctagggaaaatagttcttattcagattgtgaacccagccagaggctcaggtaaagacgttcaggaagcgaggaaagaaacgtatgatactgttaaaagaatcaacgagcgttatggttcacatgattatgagccagtggttctgattgatcgccctgttcctcggtttgagaagtctgcctattatgccctggcagaatgctgcatagtcaatgcagtgagggatgggatgaacttagttccgtacaagtacactgtttgtcggcagggaactcctagtatgaataagtctttgggagtaagtgatgatttgcctcgcacaagcacccttgttctgtccgagttcattggttgctcgccttctctaagtggtgcgattagggttaatccttgggacgttgacgcggtagccgattcactatattctgctattaccatgtctgattttgagaagcaactacgacataaaaaacactttcactacattagtacacatgatgtgggttattgggcgcgcagcttttcgcaggatttggagagggcatctcgagatcattacagtaaacggtgctggggtgtgggttggggtttgggtttcaggcttgtcgctctctctcctaatttcagaaggctatccattgagcaaactgttagtgcttacagaagatcgagcaagagagcaatatttcttgattatgatggtactttagttcctgagacctcgattgtaaaggacccaagtgctgaagttatatctgcgttgaaggcactgtgtagtgatcctaacaacactatatttattgttagcgggaggggaaaagtttctttgagcgagtggcttgcgccatgtgagaatcttggaatagcggctgaacatggttactttacaaggtggaataagtcttctgactgggaaacaagcggcttatctgatgaccttgagtggaagaaagttgtggaacctattatgagactttatacagagactactgatggatccaatatagaagcaaaagagagtgctttagtctggcatcaccaagatgctgacccagactttggttcttgtcaagccaaggaactactggaccatctagaaactgttcttgtgaatgaaccagttattgtgaacagaggccaccaaatcgttgaagttaagcctcagggagtaagcaaagggcttgtcaccgggaaaattcttagccgaatgcttgaagatgggatagcgccagattttgtggtatgcattggggatgatagatcagacgaggagatgtttgaaaacatatcaacaaccctctcagctcaatcatcgtcaatgtctacagagatattcgcgtgtactgtgggaagaaaaccgagcaaagccaaatacttcctcgatgaagtaagcgacgtggtgaagttgcttcaaggacttgccaacacttcgagcccaaagcctaggtacccttctcacctcagagtctccttcgaaagcgtggtatga

SEQ ID NO: 17225 - protein, 861 aa, Arabidopsis thaliana (mouse-ear cress)
MGSKSFGNLLDLASGDLLDIPQTPRYLPRVMTVPGIISDVDGYGISDGDSDVISLPCRERKIIVANFLPLNGKKDSETGKWKFSLDNDSPLLHLKDGFSPETEVIYVGSLKTHVDVSEQDEVSHNLFEEFNCVATFLPQDVHKKFYLGFCKQQLWPLFHYMLPMCPDHGERFDRGLWQAYVSANKIFADKVMGVINLEEDYIWIHDYHLMVLPTFLRRRFHRVKLGFFLHSPFPSSEIYRTLPVREELLRGLLNCDLIGFHTFDYARHFLSCCCRMLGLEYESKRGHIALDYLGRTVFLKILPIGIHMGRLESVLNLPATAEKLKEIQEKYRGKKIILGVDDMDIFKGLSLKILAFEHLLQQYPSMLGKIVLIQIVNPARGSGKDVQEARKETYDTVKRINERYGSHDYEPVVLIDRPVPRFEKSAYYALAECCIVNAVRDGMNLVPYKYTVCRQGTPSMNKSLGVSDDLPRTSTLVLSEFIGCSPSLSGAIRVNPWDVDAVADSLYSAITMSDFEKQLRHKKHFHYISTHDVGYWARSFSQDLERASRDHYSKRCWGVGWGLGFRLVALSPNFRRLSIEQTVSAYRRSSKRAIFLDYDGTLVPETSIVKDPSAEVISALKALCSDPNNTIFIVSGRGKVSLSEWLAPCENLGIAAEHGYFTRWNKSSDWETSGLSDDLEWKKVVEPIMRLYTETTDGSNIEAKESALVWHHQDADPDFGSCQAKELLDHLETVLVNEPVIVNRGHQIVEVKPQGVSKGLVTGKILSRMLEDGIAPDFVVCIGDDRSDEEMFENISTTLSAQSSSMSTEIFACTVGRKPSKAKYFLDEVSDVVKLLQGLANTSSPKPRYPSHLRVSFESVV

SEQ ID NO: 17226 - DNA, 2388 bp, Arabidopsis thaliana (mouse-ear cress)
  CDS (1)..(2388)
atggcaaggccacgactgcttgtagtgtcgatgtcgcttccggtcactgcaaagaggactggagaagagtcttggtctttcacgatgagtcctggtggtctagttagtgctcttctaggtttgaaagaatttgagaccaaatggattggatggcctggagtagatgttcatgatgcgattggcaaaaagacactctccattaccctagctgaaaagggatgtatcccagtgtttttggaagaagtgtgtgatcaatactataatggctactgcaacaatattctgtggccgatttttcactacttgggaacgccaccagaatatcgtaacgatgcaaccataacataccagtcacagtatgaagcatacaagaaagcaaatcaaattttctttgatgttgtcaaagagcactatgaagaaggagatgtggtttggtgccatgattatcatgttatgcttcttcctcaatatcttaaggaatacaacagtaagatgaaagttggatggtttctccatacaccatttccttcttccgagatgtacaaaacattgccctcgcgatccgatctgcttcgttctgttcttactgctgatttagttggtttccatacctatgacttcgcaagacattttttgaatgcatgcatgtgtattcttggagtcgaagcaacatctgaaggaattgtggatcagggcaaagtcactcgagtagctgtttttcccattgggatagaacctgagaggtttataaacacaagtgaactctctgaagttgttcaatacatgaagaagttcaaaaacgattttggtgggagaaagttgatattaggtgttgatcgtctcgatacgatcaaagggattccacaaaaatatcaggcatttgagaagttcttagaggaaaatgcagagtggcgtggtaaagtcatgttacttcagattgcagtgccaacaaggaacggtattggtgaatatcaaaagatcaaagaccaatgtcattaccatgttggacgaattaatggtcgttttggttccatctcttctgttccaataattcacctggattgttctattgactttaatcaattatgcgcactttatgccatcacagatgtattacttgtaacatctctgagagatggaatgaaccttgtgagttctgaattcattgcctgccaaaaagcagaaaaaggggttctcattctaagcgagtttgcaggtgctggacagtcacttggtgccggagctattttagtgaatccttggaacattaaagaagtttcttctgccattggagaagctctaaatatgtcacatgaagaaaaggagagaaaacataaaatcaattttcagtatgtgaaaactcactccactcagcagtgggcagatgatttcatgaaattgactcttacaaacattttatgcagtaaacttattgagattacaaccagcgcggagctaggagctggattagccgccacacttgaacttccagaacatgatgtgattcaacaatactcaaagtctaacaatagactgctgattcttggattctatggaacgctcactcagccgatgaaaaatcaagagagaagaggcgacggaatgaatcttgaactgcatccacagctaaaagagagactcaaagaattatgcagtgatccaaaaacaacagtagttgtcctgagtagaagtgaaaaatgcatattggataaaaactttggagaatataacatgtggttggctgctgaaaatgggatgtttctaaggcatacaagtggagaatgggtgacaagaattccagaacacatgaatttggaatggattgatggtgttaagcatgttttcaagtacttcactgaaagaactccaggatcatatctcgaaacaagcgaggcttcgcttgtatggaactacgaaaatgcagatgctgaattcgggagagctcaagcaagagacatgttacaacacttgtgggcaggaccaatctctaatgcctcagtggatgttgttagaggaggccaatctgttgaagtccatgccgttggtgtgacaaagggaagtgcaatggagcgtattctcggagaaatagtgcataacaagtcaatggctacaccaattgactatgtcttgtgcattggttgtttcttggggaaagacgaagacgtttacacattcttcgagccagagttgaccaagaaagccaagtcgctttcttcttcaggtagtgactcccccaagaaggtatcatcgaccattgttgacctcaagggagagaattacttctccgtagctattggacaaacgcacacaaaggctcgctatttccttgactcatctgatgacgttgtgaaacttattggcaagctttgcacacacaacaatgcttga

SEQ ID NO: 17227 - protein, 795 aa, Arabidopsis thaliana (mouse-ear cress)
MARPRLLVVSMSLPVTAKRTGEESWSFTMSPGGLVSALLGLKEFETKWIGWPGVDVHDAIGKKTLSITLAEKGCIPVFLEEVCDQYYNGYCNNILWPIFHYLGTPPEYRNDATITYQSQYEAYKKANQIFFDVVKEHYEEGDVVWCHDYHVMLLPQYLKEYNSKMKVGWFLHTPFPSSEMYKTLPSRSDLLRSVLTADLVGFHTYDFARHFLNACMCILGVEATSEGIVDQGKVTRVAVFPIGIEPERFINTSELSEVVQYMKKFKNDFGGRKLILGVDRLDTIKGIPQKYQAFEKFLEENAEWRGKVMLLQIAVPTRNGIGEYQKIKDQCHYHVGRINGRFGSISSVPIIHLDCSIDFNQLCALYAITDVLLVTSLRDGMNLVSSEFIACQKAEKGVLILSEFAGAGQSLGAGAILVNPWNIKEVSSAIGEALNMSHEEKERKHKINFQYVKTHSTQQWADDFMKLTLTNILCSKLIEITTSAELGAGLAATLELPEHDVIQQYSKSNNRLLILGFYGTLTQPMKNQERRGDGMNLELHPQLKERLKELCSDPKTTVVVLSRSEKCILDKNFGEYNMWLAAENGMFLRHTSGEWVTRIPEHMNLEWIDGVKHVFKYFTERTPGSYLETSEASLVWNYENADAEFGRAQARDMLQHLWAGPISNASVDVVRGGQSVEVHAVGVTKGSAMERILGEIVHNKSMATPIDYVLCIGCFLGKDEDVYTFFEPELTKKAKSLSSSGSDSPKKVSSTIVDLKGENYFSVAIGQTHTKARYFLDSSDDVVKLIGKLCTHNNA

SEQ ID NO: 17228 - DNA, 2676 bp, Schizosaccharomyces pombe
  CDS (1)..(2676)
atgggaagacaattcatttgctcaatttatcttccatataccatcaattttcaccttgatgagctggaaggtaaccatgaatcacatccagcaattactcatcaggagaaggtcacacaaacacaccgtgattctgtcaagatagatgatatccttactcgtttaagtatctcaaaatccgaaagtggtcaggctactcctgttttgacgcctcaacttgaggggatgaatgactattttagcttgggtccgtcaaagagaactggtggttcaatgaccccgggattaggtgctatgtcccctattccaggatctggccgatcctctcctctgtatacccaacctcgttctcgcgctacttctccttctcgtgttaggcaggccgatcgttttgcggcacctggtatcggcgctggtgcacttcctattcgtcgaaagagaagagattctttagcgaaatctgttgcactttttgaatctgctcgttggtctgttgagcgaggagttgtaggaaatagtggtttatttcatgctgtggacgcagctgttcgtgatcatggattgcagaaccctctatgggttggtctccttggtatgccaactgaatcgttatctgagaaaacaaaaaatgctatttcaggagctttgttagtaaaacaccaatctttggttgtttatacctctgattcgaactttgagggtcactataatcactactgccgtaagattttatggccctcattgcattatcagcataacgaaatattttcattcttccatgaagaaagtaattgggacgactatgtcgccgtaaacagggcgtttgccgatgctttaataaagaattacaaaactggtgataccatttgggttaatgactatcatttgcttttggttccaaatatggttagagagaggatacccagtgcaattattggcttatttattcatgtttcttttccctcttccgaagtttttcgttgctttgcccgaagaaaagaacttcttcaaggtatgcttgggtcgaatttaattggtttccaaactgaggaatacaagcgccatttccttcaatcttgttctcgtgtactttatgctgaatcaactttcgatcgaattcttctggatgataggtatatagatgtatatgcacatcctatcggtgcagacccggttttagtggacaagtggcttgaaaaccctgagactttagaggttaaagaagttctcgaaaagcgctacgcaaatctcaatatctttgtgggatgtgacaaaatggatcctataagaggaattcgtgagaaacttttggctttcgaacaatttctttacgataaccctgagtatcaaaaaaataccattctgattcaaacttcaacctttactgaagagcagaaggagtatggcgttgcaatatccgatatcgtcactagaatcaattctgctttcggagacttttcactagatcatcttcctgtcacaattttgtcaagtgatctatcatatcctcagtatcttgctttgctatctgttgcagatgctttcattgtgacatctttacgtgaaggaatgagtttgacttgccacgaatttatccttacacaacgtcaaaagaagtcgccgttgattgttagtgaattcattggctgtgcttcaatgttctctaacggtgcattcattgttaacccctggagcacgttggaactgagtttgtcaatgaaaaaagcgcttacgttaagtactaatgaacgtaatcagcgatattccaactgtctggatgttgtattaactcattctgctagcaattgggtcactggctttgagacgaaactcaaaaagtcttggacttctcaacaaaaacgtgacttttctcgtttgccaagattcacattgaatttcattggcaatcgctatgatcatgcaaagaagaggttattaattcttaattttgatggaaacgctgttacctgggaaggtcgccatgagtttgtcgatttccattatggatatatggtcagcatattgtcaaagttgatcgctgatgatcgaaatattgtatacatagctagttgtttagaggaagacgagcttgaatcgttattcatgcatgttccgggtgttggtttgattgcggaaaacggctgttatgtgctaccacactatgctgagaatgttcatcaatcgtggattcgtttgtacaaaaagcaacaaatggactggcgtgagccattgcatgacattattcaatattacagtgaaagaacacctggctcctcgctaattgatcacggctttgccatggaatttaattatgtaaaggcagaaaacagagagaacggtttacgatcggctggcgagttggccagtagtattaatgaaacacagcatggctgccgtgctgttcctctagatgggcgagtactttgcgagcctactactattagtaaagctactgctgccaattacattatgactcatctcattaaaaatcctgaagagcttgatttaattctagtggcaggaaacaatcgtaccgacgaatcagtttttgcttgggccaataagagcaaagtttcatcatttactgtttcaatgggtgttggtaatacagaagctaaggcttatactgatggtattccaagcttcttcaatgttttaaactcattatgtgcttaa

SEQ ID NO: 17229 - protein, 891 aa, Schizosaccharomyces pombe
MGRQFICSIYLPYTINFHLDELEGNHESHPAITHQEKVTQTHRDSVKIDDILTRLSISKSESGQATPVLTPQLEGMNDYFSLGPSKRTGGSMTPGLGAMSPIPGSGRSSPLYTQPRSRATSPSRVRQADRFAAPGIGAGALPIRRKRRDSLAKSVALFESARWSVERGVVGNSGLFHAVDAAVRDHGLQNPLWVGLLGMPTESLSEKTKNAISGALLVKHQSLVVYTSDSNFEGHYNHYCRKILWPSLHYQHNEIFSFFHEESNWDDYVAVNRAFADALIKNYKTGDTIWVNDYHLLLVPNMVRERIPSAIIGLFIHVSFPSSEVFRCFARRKELLQGMLGSNLIGFQTEEYKRHFLQSCSRVLYAESTFDRILLDDRYIDVYAHPIGADPVLVDKWLENPETLEVKEVLEKRYANLNIFVGCDKMDPIRGIREKLLAFEQFLYDNPEYQKNTILIQTSTFTEEQKEYGVAISDIVTRINSAFGDFSLDHLPVTILSSDLSYPQYLALLSVADAFIVTSLREGMSLTCHEFILTQRQKKSPLIVSEFIGCASMFSNGAFIVNPWSTLELSLSMKKALTLSTNERNQRYSNCLDVVLTHSASNWVTGFETKLKKSWTSQQKRDFSRLPRFTLNFIGNRYDHAKKRLLILNFDGNAVTWEGRHEFVDFHYGYMVSILSKLIADDRNIVYIASCLEEDELESLFMHVPGVGLIAENGCYVLPHYAENVHQSWIRLYKKQQMDWREPLHDIIQYYSERTPGSSLIDHGFAMEFNYVKAENRENGLRSAGELASSINETQHGCRAVPLDGRVLCEPTTISKATAANYIMTHLIKNPEELDLILVAGNNRTDESVFAWANKSKVSSFTVSMGVGNTEAKAYTDGIPSFFNVLNSLCA

SEQ ID NO: 17230 - DNA, 2550 bp, Schizosaccharomyces pombe
  CDS (1)..(2550)
atgccttcaggcgcgcaaggaaatactcaatcagctgcttataaacgtattgttaatgtctctcgaaattttcaatttaaagcagccttaaataaagatactcgcgaatggacgtttcagcatcgtagtagtggcactgccctttactcagcaattgcttcattgggagatcctagttcaccctgggacgccgtgtacgtagcttctcctggacctgtacaaatttcggaaggaaatgaccatacagtggaaactaagattgatgaagctgctgttgttcatcgttcttcgtcgattgtcataagcccagaggatcaagaaatttttctaaagaaggctactgagtattacaggaaaaagaacatagaagctgatattgtccctgtatggggcaaggttcaacgtgtaccacaagctaagtcctcgtccgcgactattactccatccgtgtctaacaaactttccacggcttatcaaagtattaaatcagaagcattgaaggatggaccaatgtatgctgatagcgtcttatgggatgtgctacattatagaattccaaccttagatggataccagcagcataatttatggaaaaactttactcgatggtctcaatattttgctgacaatattgtatctaactatcgtcctggtgatctaatattaatacatgattattccttatttcttcttcctaggcttattcgtaagcagctttcagatgctcctatcgttttctttttgcatgctcctttctgtacttctgaagtttttcgttgtttatctaaaagagctgaaattttaaagggtgtattagcatcaaatgttattgcaatgcaaaccgactcatacactaggcattttttgagtacttgttcaaatgttcttgggttagaaaccacttccacacatatagatacttctgatggattccgcgtggtagttttctcttcacatgtgagcattgatgttccacgtgtctattcccgttgtaacagtaagcctgtcagcttaaagattcaacaactcaaatcgctttatccctctgataaaaagctcattgtagggcgcgaccaattaactaaagcttgtggtgtcactcacaaactacgcgcatttcgagaactactaatacatttccctaaatggcgtggtcatgttgtccttattcaaattacgagccttcctgtaggcaataattattctaatgaagaactcaaaaaaacagaaaacttagttgcccaaattaattcagaatttggttcactggattatacaccagtcatacattttcaccagttgctagatccagatgagtattacgcccttctaagtgtggcaaatatagcatgtgtttcatctgttcgtgattcaatgaatacaatggctctagagtatgttgcttgtcagcaaaagaacaagggctcccttattttaagtgaattctcggggactgcagaacttttactatctgcttatttagtaaacccatatgactattcccgttttgcagaaactattaattactgccttaatatgaccgaaaaggaaagggagcgtagattttcgtctctttggaagcaagcaacttcccaatcttctcaacaatggatatataagctgataaatagagcagcctatgaagtgaaagcattggagagtcatatgacaaccccattgcttacttataatattttaataaagccttatagaaatgccaaaagacgtttatttcttttggattatgatggcactttaattgaatcggcaaggaattcaattgacgctgtacctacagaccgattattgcgcacattaaaacgtttagcctctgactcaaggaatattgtttggattttatctggtcgctctcaaaaatttatggaggaatggatgggagacatatctgagcttgggctttcttcagaacatggtagtgcaataagacctcctctagctggtagctggtcaagctgtgctgaaaatttggatttatcttggaaggacaccgttcgagatttctttcaatactatgtagaaagaactccaggctcctacatagaagagaaaaaacattcaatatcttggtgttatcaaaatgcaaacacaacttacagtaaattccaatctttagaatgtcaaactaatttggaagatatgttgaagcattatgacgtcgaaattagtccagcaaagtcttttcttgaggttcatccaaattacttaaacaaaggatctattgtaagacgtattttaaagcgttctggttcagtcgacttcgtcttttgtgctggtgatgataaaactgacgaaaatatgtttgaagtgttccttcctaccgcattcagtaattcacatctcatcgacgaaatagactctacggaatactcaggttcacaccatacagacgataattccgatgcaaataaagtggaaaatgttaaagtagcaacatttcgtgtacacattggattaactgacaagcctacactatctgattatcaccttcctgctcctcgtgatttaggagaacttttgcataacctatga

SEQ ID NO: 17231 - protein, 849 aa, Schizosaccharomyces pombe
MPSGAQGNTQSAAYKRIVNVSRNFQFKAALNKDTREWTFQHRSSGTALYSAIASLGDPSSPWDAVYVASPGPVQISEGNDHTVETKIDEAAVVHRSSSIVISPEDQEIFLKKATEYYRKKNIEADIVPVWGKVQRVPQAKSSSATITPSVSNKLSTAYQSIKSEALKDGPMYADSVLWDVLHYRIPTLDGYQQHNLWKNFTRWSQYFADNIVSNYRPGDLILIHDYSLFLLPRLIRKQLSDAPIVFFLHAPFCTSEVFRCLSKRAEILKGVLASNVIAMQTDSYTRHFLSTCSNVLGLETTSTHIDTSDGFRVVVFSSHVSIDVPRVYSRCNSKPVSLKIQQLKSLYPSDKKLIVGRDQLTKACGVTHKLRAFRELLIHFPKWRGHVVLIQITSLPVGNNYSNEELKKTENLVAQINSEFGSLDYTPVIHFHQLLDPDEYYALLSVANIACVSSVRDSMNTMALEYVACQQKNKGSLILSEFSGTAELLLSAYLVNPYDYSRFAETINYCLNMTEKERERRFSSLWKQATSQSSQQWIYKLINRAAYEVKALESHMTTPLLTYNILIKPYRNAKRRLFLLDYDGTLIESARNSIDAVPTDRLLRTLKRLASDSRNIVWILSGRSQKFMEEWMGDISELGLSSEHGSAIRPPLAGSWSSCAENLDLSWKDTVRDFFQYYVERTPGSYIEEKKHSISWCYQNANTTYSKFQSLECQTNLEDMLKHYDVEISPAKSFLEVHPNYLNKGSIVRRILKRSGSVDFVFCAGDDKTDENMFEVFLPTAFSNSHLIDEIDSTEYSGSHHTDDNSDANKVENVKVATFRVHIGLTDKPTLSDYHLPAPRDLGELLHNL

SEQ ID NO: 17232 - DNA, 2835 bp, Schizosaccharomyces pombe
  CDS (1)..(2835)
atggggagaattttaatagcacatttgtttcttccttcctcagttggattctccttcgatacagtcccgcacgatgaagttggatccaagtttatgcaaaaggaagagtcgaaggattggattgccgatacccctttagatgagagtgccatcgtatcggaagaggaatcagacgatgactctttgctctcagacctccccgaggagattgactcgacgaatgcacaaagtaatattgcgaccccttctcccggtacagtagctgcggcgatcagcgggattcaacctcctcctaaaacgccttcgtcggactccccgtcgttggagaattcgttgtcaaacctcaatgacttgttcaagtcgagaggccgccatatggctttttccaaaaatgacggcaccaatctctctctccctccttctcgtcaccagtctcctcctccctctagtgtccttgcgtcgcaacgccatcaccgtcgccatgacagtgaattagaagagtttgctcgtcgtgcctctcgctctttatcctttagtatgaatggaacaccccagcgacgtatgacttttgacgcagaagcttggaaaaacgttatctttaaaatcaaacccagctcctttggtaacgcaagtttttacaatgccatcagtgctgccacccgttccaagcaattcgacgaccatctttttgtcggtacctgcggcatccccaccgactctcttcccgattccctgaaagaacgtatttctcacgactacataactgaacacagcagtcttgttgtctatcccactgataccgattttgtgggtcactacaatcattactgcaagaatatcctttggcccaccttccactaccaaatccccgacaatccaaagtctaaggcatacgaggatcattcctgggctaattatgttaaagtcaacaaagcatttgctgataccattgttgataactacgaacaggacgatatgatttggattaatgactatcatttactgttagttcctgaaatggtccgtgaacgtcttcctcgcgcaaagatcggctttttcttgcacattccctttccttcctcagaagtcttccgttgtctggcgacgcgtcaagaaattttgaagggcatgctcggtgcaaacattttgggcttccagattcccgaatttgcttatcattttcttcagacctgttctcgactagtcaacattgacattcgcaagaatggcgtcgtctcttttgaaaaccgccagatagatgtgattgcccttccgatctccatcgacccaggattcatcgatcgctgccttgccagtccaccagtggagcattgggccaaggtattgcaggatcgattcagaggtaaacatattatcctttctcacgacaagcttgaccccattcgtggtttgcgctccaagttaatttcttttgagcgatttttacaaaagtaccccgagtatcgtgaaaacaccattttacttcaggttgcccccgaatccctacaggacagtgagcatcttcctcacatctccgacattgtcacccgaataaactctgcctattccaacattgcctctcgtcacgtgcccgttattttgctgagacagaaacttggttatgcacagtttttggctttaatgatgatatccgatgccttaattgacaattccttacgtgagggaattagcttgactagccatcaatttatttatgtgcagcgcaagagacacaggccattaattcttagtgaattcgttggcagcgcctctatcttgaatgacaatgccattattgtcaacccatgggattacagcaaaacagcagaggctttccgcactgcattaaccatgtctgaagaagagtgccaaaaacgcaacaaggcaatgtgtaatttgattctccgtcacgatgctgcttcttgggcagttactttccagagtttgattaaggaatcttggaaggaacaaatcgatatgcaacggattccagcattcaccgcacaacttatcaaggagccctatcaaaatgcacaaaagcgcttgattttactttattttgaaggaaccatttccacttggggttctcaataccataacgttatgacgagtttgcaacgtactatcaatttgctgaacatgttgacgtctgatcctaaaaacactgtttacgttttcagtgcgcttagctgtcaggagctggagcaactatttcaacgtgttccaaagttgggtatcgttgccgaaaatggttgctttgttagatcgcctcctaaaggtgatgcaacaatgccagtttccaagaaggaaattgccgagttgtggaaaaataaggtattaggcaccgatttaacttggatgaagacggtttctgaaattttcgagtactatgccgagcgtactaccggtgcatatgtggagaataaagatgccacagttattttgcaccttcgtgaagctgaagatgatgaggcagccatgtgggcagccaaagaatgctgtgaatctgttaacaacttcaatgttccctgtagcgctactattcaaaatgatatggtcgtttgccgatccaacaaagtatccaaacgccttgctgctgaggatatatactcggctaatggtggagattatgactttatttttgcagctagtaacgaccctgatgatgatacagtcttttcatggatgaaaaatttcaagcaaagtaagaaagaagttgtaccatttacattctctgtttgtgtctctgaacatggtaattctaccaatgccgatgctgaaagttctggtgtatttgggttcttgcaagcgcttgagaaagtttactccgcttaa

SEQ ID NO: 17233 - protein, 944 aa, Schizosaccharomyces pombe
MGRILIAHLFLPSSVGFSFDTVPHDEVGSKFMQKEESKDWIADTPLDESAIVSEEESDDDSLLSDLPEEIDSTNAQSNIATPSPGTVAAAISGIQPPPKTPSSDSPSLENSLSNLNDLFKSRGRHMAFSKNDGTNLSLPPSRHQSPPPSSVLASQRHHRRHDSELEEFARRASRSLSFSMNGTPQRRMTFDAEAWKNVIFKIKPSSFGNASFYNAISAATRSKQFDDHLFVGTCGIPTDSLPDSLKERISHDYITEHSSLVVYPTDTDFVGHYNHYCKNILWPTFHYQIPDNPKSKAYEDHSWANYVKVNKAFADTIVDNYEQDDMIWINDYHLLLVPEMVRERLPRAKIGFFLHIPFPSSEVFRCLATRQEILKGMLGANILGFQIPEFAYHFLQTCSRLVNIDIRKNGVVSFENRQIDVIALPISIDPGFIDRCLASPPVEHWAKVLQDRFRGKHIILSHDKLDPIRGLRSKLISFERFLQKYPEYRENTILLQVAPESLQDSEHLPHISDIVTRINSAYSNIASRHVPVILLRQKLGYAQFLALMMISDALIDNSLREGISLTSHQFIYVQRKRHRPLILSEFVGSASILNDNAIIVNPWDYSKTAEAFRTALTMSEEECQKRNKAMCNLILRHDAASWAVTFQSLIKESWKEQIDMQRIPAFTAQLIKEPYQNAQKRLILLYFEGTISTWGSQYHNVMTSLQRTINLLNMLTSDPKNTVYVFSALSCQELEQLFQRVPKLGIVAENGCFVRSPPKGDATMPVSKKEIAELWKNKVLGTDLTWMKTVSEIFEYYAERTTGAYVENKDATVILHLREAEDDEAAMWAAKECCESVNNFNVPCSATIQNDMVVCRSNKVSKRLAAEDIYSANGGDYDFIFAASNDPDDDTVFSWMKNFKQSKKEVVPFTFSVCVSEHGNSTNADAESSGVFGFLQALEKVYSA

SEQ ID NO: 17234 - DNA, 2580 bp, Schizosaccharomyces pombe
  CDS (52)..(2505)
aagcttaaaactgtagtttactgttttgtcaatttcgcttataatacatcaatgagtgtgtacggaaaaatcccgtctaccagtttcgagcatgaaaacacatttgagttatctggtgatttattagatccagaggagctgaaatcattaggcgtcagtggtcgcattatatacgttttgaggcacttgccttttaaaagtagtattaatgaggaaactagagaatgggaccttagcggccgccgaggtgcaacaacgatgtactcaagtatgaactggttggctaattcaacgtattggcaaactactttggtaggatggactggcgtgattccaaccgtgtccgagaaagaagaaaacaaagatgcagtgacgcgtttagattctcaggacgttaagcgatttgaagagacatacagccaatggaattccggtgaacggagtacggagtacgttcctgtgtggcttcctggtcctgaaaaaggatctgaaactatcattaatgagacacgctctcagcaatcgcgctggttagcctatgccgaaaatgttatacgacctttgatccattataaatattggccaagtagtgaagttgacgagaacgaggagcaatggtggagggattacgtgaaaatgaaccatgcattcgctgacaaaatttgtgagatatataaaccaggcgattttattattgttcaggattactcactcttcttagtcccccaacttattcgtaacaaaattgatgatgcagtcatcggcttttaccatcatcatccatttcccagttcggagattgcacgttgctttcctcgtcgtcgtgccattttacggtctgttttgggagccgactttattggttttgaagactactcttacgctcgtcatttcatcagctgctgttctcgagtccttgaccttgaaattggtcatgattgggttaacttgaatggtaataaggttaccgtccgcgctattactgtgggcattgatgtcccaagaattattcgctctagtggtaatgtctctgtgtcggagaagctggaagaactgaacaagcgttatgaaaacatgaaagtgattcttggtcgtgatcgattggatgaactatacggcgttcctcagaagctccgttcttttcagcgttttttgagaacctatcccgaatggcgcaaaaaggttgtgcttattcaaataactatttcatctgctttcaagcatcccaagctattaagcagtattaaaaaacttgttcaggcaatcaatcaagagtttggtaccgatgattacacccccgtacatcacgtcgaggaacaattggaaccggctgattatttcgctttgctcactcgtgccgatgcattatttattaacagcatacgcgaaggtgtcagtaacttggcacttgagtatgttgtttgtcaaagagaccgatatggtatggtactcttgtcagaatttactgctacttctgctatgctacatgacgttcctttgattaatccttgggattataacgaatgtgccgaaataattagcaacgctttatcaactcccttggaacgaagaaaaatgattgaacgcgaatcttataaacaggttaccacccataccatgcagtcttggacgtcatctttaatcagatctttagcaaacaagctagcagccacaaagaccgaccagcgtatacctacattaacaccagagcatgctctttctgtgtacagcaaagcctctaaaagactatttatgatggactacgatggtaccctaactccgattgtaagggaccccaatgctgctgttccttcaaagaaacttttggataatttagcaacacttgcagccgatccaaagaatcaagtctggattatttctggacgagatcagcagtttttgcgtaactggatggacgatatcaagggtctcggtctctcagctgaacatggtagttttgtccgcaagccacatagcaccacttggattaacttggcagagttgctggacatgtcttggaagaaagaagtgcgccgtattttccaatactatacggaccgcactcaaggctcctctattgaagaaaaacgatgtgccatgacttggcattatcgcaaagcagatcccgagaatggtgctttccaagctttggaatgcgaagctttgctggaagaattggtttgctctaagtatgatgttgaaattatgaggggtaaagcaaatcttgaagtgcgtccttccagtatcaacaaaggaggaattgtcaaacagattttaagttcgtatccagaagattcacttccttcttttatcttttgtgcaggtgatgatagaactgatgaagatatgttccgctctttgcataaaaacactcgtattaacaaggaaacttcatttgcagttaccattggatccgacaaaaagctttctatcgccgactggtgtatcgcagaccctgcaaatgttattgatatccttgctgatttggcaaattttactaactgaatgacaaactaactatttcaacgaagatgcccgattcatcttgttctttacaaagatttatttattgagacacac

SEQ ID NO: 17235 - protein, 817 aa, Schizosaccharomyces pombe
MSVYGKIPSTSFEHENTFELSGDLLDPEELKSLGVSGRIIYVLRHLPFKSSINEETREWDLSGRRGATTMYSSMNWLANSTYWQTTLVGWTGVIPTVSEKEENKDAVTRLDSQDVKRFEETYSQWNSGERSTEYVPVWLPGPEKGSETIINETRSQQSRWLAYAENVIRPLIHYKYWPSSEVDENEEQWWRDYVKMNHAFADKICEIYKPGDFIIVQDYSLFLVPQLIRNKIDDAVIGFYHHHPFPSSEIARCFPRRRAILRSVLGADFIGFEDYSYARHFISCCSRVLDLEIGHDWVNLNGNKVTVRAITVGIDVPRIIRSSGNVSVSEKLEELNKRYENMKVILGRDRLDELYGVPQKLRSFQRFLRTYPEWRKKVVLIQITISSAFKHPKLLSSIKKLVQAINQEFGTDDYTPVHHVEEQLEPADYFALLTRADALFINSIREGVSNLALEYVVCQRDRYGMVLLSEFTATSAMLHDVPLINPWDYNECAEIISNALSTPLERRKMIERESYKQVTTHTMQSWTSSLIRSLANKLAATKTDQRIPTLTPEHALSVYSKASKRLFMMDYDGTLTPIVRDPNAAVPSKKLLDNLATLAADPKNQVWIISGRDQQFLRNWMDDIKGLGLSAEHGSFVRKPHSTTWINLAELLDMSWKKEVRRIFQYYTDRTQGSSIEEKRCAMTWHYRKADPENGAFQALECEALLEELVCSKYDVEIMRGKANLEVRPSSINKGGIVKQILSSYPEDSLPSFIFCAGDDRTDEDMFRSLHKNTRINKETSFAVTIGSDKKLSIADWCIADPANVIDILADLANFTN

SEQ ID NO: 17236 - DNA, 1993 bp, Schizosaccharomyces pombe
  CDS (266)..(1705)
gtaattttcaaatatgtacctatagatttttccagtcgattccatttgttgtttacctatagtataatgggttagttttctctctagatacataaccaactatccctctgcatatgacattctacaatacattcgaagcaaaacctttgcaaattctaaaagattcaatcttagaatactttatcaagtttagacagttattccttgtgcttgtacttgtcaagaatctttgttttgctgaaaaaaaaaatccagaaatctcaatatgtcggatgctcatgataccataaaatcactcacgggtgatgcttctaactctcggcgtttgatcgtcgtctccaatcgtttaccaattacaattaagcgaaaggataatggcacatatgactttagtatgtcttcgggtggtctggtcagtgctttgagcggtctcaagaagctcatgacctttcaatggttgggctggtgcggtcaagagattcctgaggatgaaaaacccatgattatccagcgtttgcaagatgagtgtagcgctattcccgtctttttggatgatgagactgccgaccgccattacaacggatttagtaacagcattctttggcccttgttccactaccatcctggtgaaattaattttgacgaggaaaattgggaggcctatcgtgcggctaactacgcttttgccgaggccattgtcaaaaatctgcaggatggtgatttaatttgggtgcaggattatcatttgatggttcttcctcaaatgttgcgtgaattaatcggtgataagtttaaggatatcaaaattggcttcttcttgcacactcctttcccaagtagcgaaatctatcgtgttttacccgttagaaacgaaatccttgaaggtgtactcaactgtgatctcgttggcttccatacctacgactatgcccgtcactttttgtctgcatgctctcgtatccttaatcttagcacactacctaacggtgtggaatacaatggtcaaatggtcagcgtcggcaccttccccatcggtattgatcccgaaaagttctctgatgctctgaagtctgacgtggtaaaggatcgcattcgaagcatcgaacgtagactacaaggcgttaaggtgattgtgggtgtcgatcgtttggactacattaagggtgttccccaaaaattccatgcctttgaagtgttcttagaacaataccctgaatgggttggaaaggtcgtgttggttcaagttgccgttccttctcgtcaagatgtcgaagagtatcagaatcttagagccgttgtcaatgagcttgttggccgtattaacggtcgttttggtactgttgaatatacacctattcatttcttacataaaagtgttcgctttgaagagctggttgctctgtataacgtttcagacgtttgtttaattacctcaactcgtgatggtatgaatcttgtttcatacgagtacatttgcactcaacaagagagacatggtgccctaattcttagtgaatttgccggtgctgcccagtcactcaatggtagtattgtaattaatccatggaacacggaggaattagcaaactccattcatgatgccctcactatgccggagaaacaacgtgaggctaatgagaataaattattccgatatgttaataagtataccagtcaattctggggtccaaagctttgtcggtgagttgcaacgacttcaacactacagccaccctcaccccagaagaacgaatccgattttacgaaccaagtctgctcaagtgctgtcgatgaattctagctcgtaagagtgcattagcaacactattggtttgttttcccattaatcaagttgttgcacttttacacttttacttctataatttcattctcaaagcaattaaatcatttggtcatatatattcgatgagttagcagtttacgatacaaaggatgttgtttatactggcactttttttattgagatgaattc

SEQ ID NO: 17237 - protein, 479 aa, Schizosaccharomyces pombe
MSDAHDTIKSLTGDASNSRRLIVVSNRLPITIKRKDNGTYDFSMSSGGLVSALSGLKKLMTFQWLGWCGQEIPEDEKPMIIQRLQDECSAIPVFLDDETADRHYNGFSNSILWPLFHYHPGEINFDEENWEAYRAANYAFAEAIVKNLQDGDLIWVQDYHLMVLPQMLRELIGDKFKDIKIGFFLHTPFPSSEIYRVLPVRNEILEGVLNCDLVGFHTYDYARHFLSACSRILNLSTLPNGVEYNGQMVSVGTFPIGIDPEKFSDALKSDVVKDRIRSIERRLQGVKVIVGVDRLDYIKGVPQKFHAFEVFLEQYPEWVGKVVLVQVAVPSRQDVEEYQNLRAVVNELVGRINGRFGTVEYTPIHFLHKSVRFEELVALYNVSDVCLITSTRDGMNLVSYEYICTQQERHGALILSEFAGAAQSLNGSIVINPWNTEELANSIHDALTMPEKQREANENKLFRYVNKYTSQFWGPKLCR

SEQ ID NO: 17238 - DNA, 2621 bp, unidentified
  CDS (25)..(2487)
ctgatcctgcggtttcatcacaatatgatactcttacatctgatgccccttcagatgctcccaaataggttgattgtcgtatcgaatcagttacccataatcgctaggctaagactaacgacaatggagggtccttttgggatttcacttgggacgagagttcgatttacatgcacatcaaagatgcattacccgcagccgttgaggttttctattcttggcgatccactaagggctgacgttggccctaccgaacaagatgacgtgtcaaagacattgctcgataggtttaattgcgttgcggtttttgtccctacttcaaaatgggaccaatattatcactgcttttgtaagcagtatttgtggccgatatttcattacaaggttcccgcttctgacgtcaagagtgtcccgaatagtcgggattcatggaacgcttatgttcacgtgaacaaagagttttcccagaaggtgatggaggcagtaaccaatcgtagcaattatgtatggatacatgactaccatttaatgacgctaccgactttcttgaggcgggatttttgtcgttttaaaatcggtttttttctgcatagcccgtttccttcctcggaggtttacaagaccctaccaatgagaaacgagctcttgaagggtctgttaaatgctgatcttatcgggttccatacatacgattatgcccgtcattttctaacgtgttgtagtcgaatgtttggtttggatcatcagttgaaaagggggtacattttcttggaatataatggaaggagcattgagatcaagataaaggcgagcgggattcatgttggtcgaatggagtcgtacttgagtcagcccgatacaagattacaagttcaagaagtccaaaaacgttcgaaggaaatcgtgctactgggagttgatgatttggatatattcaaaggtgtgaacttcaaggttttagcgttggagaagttacttaaatcacacccgagttggcaagggcgtgtggaaaaggtgcaaatcttgaatcctctgcgccgttgccaagacgtcgatgagatcaatgccgagataagaacagtctgtgaaagaatcaataacgaactgggaagcccgggataccagcccgttgtgttaattgatgggcccgtttcgttaagtgaaaaagctgcttattatgctatcgccgatatggcaattgttacaccgttacgtgacggactgaatcttatcccgtacgagtacgtcgtttcccgacaaagtgttaatgacccaaatcccaatactccaaaaaagagcatgctagtggtctccgagttcatcggtgtttcactatctttaaccggggccatacgggtcaacccatgggatgagttggagacagcagaagcattatacgacgcactcatggctcctgatgaccataaagaaaccgcccacatgaaacagtatcaatacattatctcccatgatgtagctaactgggctagcttctttcaagatttagagcaagcgtgcatcgatcattctcgtaaacgatgcatgaatttaggatttgggttagatactagagtcgtctttttgatgagaagtttagcaagttggataaagatgtcttggaagaatgcttattccatggctcaaaatcgggccatacttttggactatgacggcactgttactccatctatcagtaaatctccaactgaagctgttatctccatgatcaacaaactgtgcaatgatccaaagaacatggtgttcatcgttagtggacgcagtagagagaaaatcttggcagttggttcggcgcgtgtgagaacccgccattgcactgagcacggatactttataaggtgggcgggtgatcaagaatgggaaacgtgcgcacgtgagaataatgtcgggtggatggatggaaatctgaggccggttatgaatctttatacagaaactactgacggttcgtatattgaaaagaaagaaactgcaatggtttggcactatgaagatgctgataaagatcttgggttggagcaggctaaggaactgttggaccatcttgaaaacgtgctcgctaatgagcccgttggagtgaatcgaacaggtcaatacattgtagaagttaaaccacagtcccccattaattaccttcttgttatgacattcataggcactgattgtagaatctttaacttaaatttctttaaatatgaatgcaattatagggggtcactaaaaggtatagttgcagagaagatttttgcgttcatggctaaaaagggaaaacaggctgatttcgtgttgacgttgaatgatagaagtgatgaagacatgtttgtggccattggggatggaataaaaaagggtcggataactaacaacaattcagtgtttacatgcgtagtgggagagaaaccgagtgcagctgagtactttttaaatgatgtctcgagaagctccgggtgtctcagcaaccaaggatgatccggaagcttctcgtgatctttatgagttaaaagttttcgactttttcttcatcaagattcatgggaaagttgttcaatatgaacttgtgttcttggttctggattttagggagtctatggatataacatttc

SEQ ID NO: 17239 - protein, 820 aa, unidentified
MILLHLMPLQMLPNRLIVVSNQLPIIARLRLTTMEGPFGISLGTRVRFTCTSKMHYPQPLRFSILGDPLRADVGPTEQDDVSKTLLDRFNCVAVFVPTSKWDQYYHCFCKQYLWPIFHYKVPASDVKSVPNSRDSWNAYVHVNKEFSQKVMEAVTNRSNYVWIHDYHLMTLPTFLRRDFCRFKIGFFLHSPFPSSEVYKTLPMRNELLKGLLNADLIGFHTYDYARHFLTCCSRMFGLDHQLKRGYIFLEYNGRSIEIKIKASGIHVGRMESYLSQPDTRLQVQEVQKRSKEIVLLGVDDLDIFKGVNFKVLALEKLLKSHPSWQGRVEKVQILNPLRRCQDVDEINAEIRTVCERINNELGSPGYQPVVLIDGPVSLSEKAAYYAIADMAIVTPLRDGLNLIPYEYVVSRQSVNDPNPNTPKKSMLVVSEFIGVSLSLTGAIRVNPWDELETAEALYDALMAPDDHKETAHMKQYQYIISHDVANWASFFQDLEQACIDHSRKRCMNLGFGLDTRVVFLMRSLASWIKMSWKNAYSMAQNRAILLDYDGTVTPSISKSPTEAVISMINKLCNDPKNMVFIVSGRSREKILAVGSARVRTRHCTEHGYFIRWAGDQEWETCARENNVGWMDGNLRPVMNLYTETTDGSYIEKKETAMVWHYEDADKDLGLEQAKELLDHLENVLANEPVGVNRTGQYIVEVKPQSPINYLLVMTFIGTDCRIFNLNFFKYECNYRGSLKGIVAEKIFAFMAKKGKQADFVLTLNDRSDEDMFVAIGDGIKKGRITNNNSVFTCVVGEKPSAAEYFLNDVSRSSGCLSNQG

SEQ ID NO: 17240 - DNA, 2640 bp, Helianthus annuus
  CDS (171)..(2510)
ggatcctgcggtttcatcacacaatatgatactgttacatctgatgccccttcagatgtcccaaataggttgattgtcgtatcgaatcagttacccataatcgctaggctaagactaacgacaatggagggtccttttgggatttcacttgggacgagagttcgatttacatgcacatcaaagatgcattacccgcagccgttgaggttttctatgttggcgcactaagggctgacgttggccctaccgaacaagatgacgtgtcaaagacattgctcgataggtttaattgcgttgcggtttttgtccctacttcaaaatgggaccaatattatcactgcttttgtaagcagtatttgtggccgatatttcattacaaggttcccgcttctgacgtcaagagtgtcccgaatagtcgggattcatggaacgcttatgttcacgtgaacaaagagttttcccagaaggtgatggaggcagtaaccaatgctagcaattatgtatggatacatgactaccatttaatgacgctaccgactttcttgaggcgggatttttgtcgttttaaaatcggtttttttctgcatagcccgtttccttcctcggaggtttacaagaccctaccaatgagaaacgagctcttgaagggtctgttaaatgctgatcttatcgggttccatacatacgattatgcccgtcattttctaacgtgttgtagtcgaatgtttggtttggatcatcagttgaaaagggggtacattttcttggaatataatggaaggagcattgagatcaagataaaggcgagcgggattcatgttggtcgaatggagtcgtacttgagtcagcccgatacaagattacaagttcaagaactaaaaaaacgtttcgaagggaaaatcgtgctacttggagttgatgatttggatatattcaaaggtgtgaacttcaaggttttagcgttggagaagttacttaaatcacacccgagttggcaagggcgtgtggttttggtgcaaatcttgaatcccgctcgcgcgcgttgccaagacgtcgatgagatcaatgccgagataagaacagtctgtgaaagaatcaataacgaactgggaagcccgggataccagcccgttgtgttaattgatgggcccgtttcgttaagtgaaaaagctgcttattatgctatcgccgatatggcaattgttacaccgttacgtgacggcatgaatcttatcccgtacgagtacgtcgtttcccgacaaagtgttaatgacccaaatcccaatactccaaaaaagagcatgctagtggtctccgagttcatcgggtgttcactatctttaaccggggccatacgggtcaacccatgggatgagttggagacagcagaagcattatacgacgcactcatggctcctgatgaccataaagaaaccgcccacatgaaacagtatcaatacattatctcccatgatgtagctaactgggctcgtagcttctttcaagatttagagcaagcgtgcatcgatcattctcgtaaacgatgcatgaatttaggatttgggttagatactagagtcgttctttttgatgagaagtttagcaagttggatatagatgtcttggagaatgcttattccatggctcaaaatcgggccatacttttggactatgacggcactgttactccatctatcagtaaatctccaactgaagctgttatctccatgatcaacaaactgtgcaatgatccaaagaacatggtgttcatcgttagtggacgcagtagagaaaatcttggcagttggttcggcgcgtgtgagaaacccgccattgcagctgagcacggatactttataaggtgggcgggtgatcaagaatgggaaacgtgcgcacgtgagaataatgtcgggtggatggaaatggctgagccggttatgaatctttatacagaaactactgacggttcgtatattgaaaagaaagaaactgcaatggtttggcactatgaagatgctgataaagatcttgggttggagcaggctaaggaactgttggaccatcttgaaaacgtgctcgctaatgagcccgttgaagtgaaacgaggtcaatacattgtagaagttaaaccacaggtaccccatgggttaccttcttgttatgacattcataggcacagatttgtagaatcttttaacttaaatttctttaaatatgaatgcaattatagggggtcactgaaaggtatagttgcagagaagatttttgcgttcatggctgaaaagggaaaacaggctgatttcgtgttgagcgttggagatgatagaagtgatgaagacatgtttgtggccattggggatggaataaaaaagggtcggataactaacaacaattcagtgtttacatgcgtagtgggagagaaaccgagtgcagctgagtactttttagacgagacgaaagatgtttcaatgatgctcgagaagctcgggtgtctcagcaaccaaggatgatgatccggaagcttctcgtgatctttatgagttaaaagttttcgactttttcttcatcaagattcatgggaaagttgttcaatatgaacttgtgtttcttggttctggattttagggagtctatggatcc

SEQ ID NO: 17241 - protein, 779 aa, Helianthus annuus
MHIKDALPAAVEVFYVGALRADVGPTEQDDVSKTLLDRFNCVAVFVPTSKWDQYYHCFCKQYLWPIFHYKVPASDVKSVPNSRDSWNAYVHVNKEFSQKVMEAVTNASNYVWIHDYHLMTLPTFLRRDFCRFKIGFFLHSPFPSSEVYKTLPMRNELLKGLLNADLIGFHTYDYARHFLTCCSRMFGLDHQLKRGYIFLEYNGRSIEIKIKASGIHVGRMESYLSQPDTRLQVQELKKRFEGKIVLLGVDDLDIFKGVNFKVLALEKLLKSHPSWQGRVVLVQILNPARARCQDVDEINAEIRTVCERINNELGSPGYQPVVLIDGPVSLSEKAAYYAIADMAIVTPLRDGMNLIPYEYVVSRQSVNDPNPNTPKKSMLVVSEFIGCSLSLTGAIRVNPWDELETAEALYDALMAPDDHKETAHMKQYQYIISHDVANWARSFFQDLEQACIDHSRKRCMNLGFGLDTRVVLFDEKFSKLDIDVLENAYSMAQNRAILLDYDGTVTPSISKSPTEAVISMINKLCNDPKNMVFIVSGRSRENLGSWFGACEKPAIAAEHGYFIRWAGDQEWETCARENNVGWMEMAEPVMNLYTETTDGSYIEKKETAMVWHYEDADKDLGLEQAKELLDHLENVLANEPVEVKRGQYIVEVKPQVPHGLPSCYDIHRHRFVESFNLNFFKYECNYRGSLKGIVAEKIFAFMAEKGKQADFVLSVGDDRSDEDMFVAIGDGIKKGRITNNNSVFTCVVGEKPSAAEYFLDETKDVSMMLEKLGCLSNQG

SEQ ID NO: 17242 - DNA, 1913 bp, Selaginella lepidophylla
  CDS (111)..(1913)
agtggcgatggtggccatggtttgctgaatttgtatttagttaaattgttttttgctgcgggcgggttgtttttttcttttctgctgcgccgcgtgcgtgtgcaatacctatgcctcagccttacccttcttcctcatccacaagcaatgccaaggaggcaggaggaggcgctgcggcggcggggggcggcggcggcggcgccttcagcttgccgccgtcgctagcatcatcgcgagtggagcgcctggtgcgtgagaggcagctgcggaatcaaaggcaggaggatgaacctgaggatgagcagcaggcgctggaggcggaggaagcggcggtggcggctaccgaggtgcccgatgccgtcgccgctgccacgccatcgctctccgatgagccgtccaagatttccagcggtcgaggccagcggttgcttgtggttgccaatcgccttcccttgtctgccacgaggaaaggcgagacggaatggaatttggagatgagcgccgggggccttgtaagtgcgcttttgggcgtcaagcagtttgaagtcacctggatcggatggcctggtgtctatgtacaagacgagaagggtgagaaatcgctgcgaggagctcttgaagaaaagggatttgtgcccgttcttctcgacgaggcaactgttgatcagtactacaatggctattgcaacaacgtgctttggccgcttttccactacattggtcttaggcaggaagaccggctggctgccacgcgcagcttactatcccagtttaacgcatataaacgtgctaatcgtttgtttgcggaggctgtgttcaatttctaccaggaaggggatgtggtgtggtgccacgattaccatcttatgttcctccccagctacctcaaggagaaggacagccagatgaaagtcgggtggttcctccacacgccgttcccctcgtctgagatttacagaacgctgccgctgcgggccgagctgctccaaggcgtcttagctgcggatttggtggggttccacacatacgactatgcaaggcactttgttagcgcgtgcacacggatactcgggctggaaggcactcccgagggtgtcgaggatcaagggaagaacacgcgagtggctgccttccccgtggggatcgactcggagcgatttatcgaggccgtagaaactgatgcggtcaagaaacacatgcaagagctgagccagcgttttgctggtcgtaaggttatgttgggggtggataggcttgacatgattaaaggaattccacagaagctgctagcctttgaaaaattcctcgaggagaactccgagtggcgtgataaggtcgtcctggtgcaaatcgcggtgccgactagaacggacgtcctcgagtaccaaaagcttacgagccaggttcacgagattgttggtcgcataaatggacgtttcggctccttgacggctgttcctatccatcacctcgatcgctccatgaaatttccggagctttgtgccttatatgcaatcactgatgtcctgctcgtgacatccctgcgtgatggcatgaacctcgtgagctacgagttcgttgcttgccaaaaggataagaagggcgcgcttattctgagtgagtttgcaggcgctgcgcagtctctgggtgcggggtctatcctcataaatccgtggaatataatagagtcgtccaacgccattgcggacgctctcaacatgccagaagaagaacgggaagaacggcatcgtcataacttcatgcacataactactcacagtgctcaagtatgggcggagacgtttatcagcgaactcaatgattccatcttggaagccgagctgcgcactctgcatattccgcctcaattgcctttggataaagcagtcgcaaagtactcggagtcaaagtag

SEQ ID NO: 17243 - protein, 600 aa, Selaginella lepidophylla
MPQPYPSSSSTSNAKEAGGGAAAAGGGGGGAFSLPPSLASSRVERLVRERQLRNQRQEDEPEDEQQALEAEEAAVAATEVPDAVAAATPSLSDEPSKISSGRGQRLLVVANRLPLSATRKGETEWNLEMSAGGLVSALLGVKQFEVTWIGWPGVYVQDEKGEKSLRGALEEKGFVPVLLDEATVDQYYNGYCNNVLWPLFHYIGLRQEDRLAATRSLLSQFNAYKRANRLFAEAVFNFYQEGDVVWCHDYHLMFLPSYLKEKDSQMKVGWFLHTPFPSSEIYRTLPLRAELLQGVLAADLVGFHTYDYARHFVSACTRILGLEGTPEGVEDQGKNTRVAAFPVGIDSERFIEAVETDAVKKHMQELSQRFAGRKVMLGVDRLDMIKGIPQKLLAFEKFLEENSEWRDKVVLVQIAVPTRTDVLEYQKLTSQVHEIVGRINGRFGSLTAVPIHHLDRSMKFPELCALYAITDVLLVTSLRDGMNLVSYEFVACQKDKKGALILSEFAGAAQSLGAGSILINPWNIIESSNAIADALNMPEEEREERHRHNFMHITTHSAQVWAETFISELNDSILEAELRTLHIPPQLPLDKAVAKYSESK

SEQ ID NO: 17244 - DNA, 4351 bp, Caenorhabditis elegans
  CDS (112)..(3996)
atgaccgacaccgcaacgggagtccattcaaatgcaaatggagtggagaaagtgccaacacccgttttttctatagaaggagagccaacacaggaaacagctcccacgaggatggacccatttgacaggccaaaaaatgacaatgatccgtttgaggatgcattgaagagatgtcataagatccttgagaagctcgactgtccatttgtaacgggcaaagagaaggatctcgatgaaagcgacgatatgaccgagaacgaagatcatgatgaaatggccaatgaggatgatggaattccatcgaatgaaaagaaagttgaaactaggaaaatggattgcacatctggacagttgcttgctccaaagctgccggaaaaggctgaatccatatcctcagcatcagaatcttccgaagacagtgaaagcgtcgccatactcaagtacaccgtcaggacctgttatgctatttggaaaaagcgccagaaaaattctgaaattgctctgaagggtttgatgattgttctggaattgtgtctttcgcagccgtcggctcgtgacgatgcgttctctgcactcttagaaacattaggatacaacacggtgacgttctggaaagcagtggtcccgcaaatctacaactcggatttatcctatgccacccagtatcgtgaagcactgcttttttcgttggtcttgtacgatgtcaatcacagtaaaaatcgtctgcgagaactgtatgcagcggttcctggcgtccgacaaagtatgcttggaattcgagcaaagcagtttggagagagatatcggcatcttcaaatgaagattgctcgatcccgtgccagctcgagaatgtcttccaaaatgggctccgaggagaatttgccggcaatggcatccatgatgaacgatgtagtgttcgatgaagagcctcacacacaatcacctttggtcgatatgtcgcacgacaagcaacgagttatcaatgtttcaaatgcaccgccggtatcaattagtcggaagacaagcgggtcttgggagatcaaacaaggttcgggtggactcgttgcatgtgttgatccagtgatgtcagctgataagaagaacatttggttatcgaaccttggtgtgaacatgcaagaagaattaaaggaacactcgacgagtacgaactcattgggacttccactgataaaacaagcgtgtgctggagaggttttctgcgttttggagcggaatgagaaaaaagaagagttgacaccaaagcagcaagcagtggaaagcgacatgtcacttctatcggttctcaacacttataataagcacagttatcaacttaacccggttgtggtcaatcaagatgactacaacacttattacggaggaatcagtaacgggcttctttggccagcacttcacaatttgccacaatacatctcaccttgctttgatgatccggagttgctccgcgagcagtggtgtgcctatgtacgtgtgaactacctctttgcaattaacgccgcacgcaacagtcgtgctcaggactttatttggatccatgactatcacctcatgctttgtgggcaaatcatgagatctttggaatccagtcttgatatcggattcttcattcacattccattccaaccaccagcaaacttcatgacaaagtataagacggtggctgatccaattatgagggcattgctgcgattcacaaaagttggattccaaaccagtcgtgacagagacacgtttgtgaaacttgttgccaaacacatcaagagaacaaaaattgagtatgactctcgtctggatcgatacactattgaacatgatggatggacctgctcccttggtgtcttcccggtatccataaaaatcgcggatttcgtcaatattgcaaagaatccacagacaataattgaagcagaagagatcaagaaacagattatgggaagaagtgccgatggtgggcagttgtttttctccgtcgagagattcgactacacaaaaggaatctctgaaaaactgcgtgcctggcagagatacttcgagaagtatccggaccgtataggaaaggatgttcttttccaagtcgctgtaacaaacagaagatctgttgattcttatcgtcaatatcaagatgacgtcttggcagttgccgatttgatcaatcagaaattcaaaagcgaagactaccctgaatggaagccagtgatttttgaaactgacggtcttccaagaactcgtctcattgctcactaccttgcaatggacattggtgtagtcacaccttccaaggatggaatgaacctggttgccaaggaaatgcttgtctgtaaccctacagcttcattggttctgtccaccggtgctggtactgaagttcagttaagcaatgcgcagttctattccgagcaagaagggaaatgctatcatcgagttgaagaaatctcaaatactgaagcatttgcggataatttcttcgccgcagcaaccgaaagcaaggaaactcgaactaagcatggagaaaagattaatcaattcctgtgcgttcatgacatcgatgagtggagtgatcagttcctggatcccaaatggacacatgaagttatcagtcaatgcgaggtgaaacaacttggccagttctatggacttatgagtcgcaccgctcaagttcgccgtcaaatcgtggagtgtgttctaaaaggactaccaattagaccacacttcagatattcgctggaaaacgcaaagaattctctggaaagctcatgcaaaagcggcactaaactcagtctggaagctgatgaagagtctggagaggaaaaaggttttgaaatcacctatgatattcatgacgaactgagtgaaatggaaaaagatttggcattcctagctttcattcaatctgacgagtacgaaaatgcggaagaatttattaagactctcggatcattctatgaaggtggcccagtattattcaagaatgaggtcaaacaagccgccgagatgttgcaacaaggaattcactacaatacattcttcactgaccgtgatggcacactgaagagctacgcatgctcgtaccctaccagtgtgcagccagcatactcagcagttatccaggctcagtttgcgcgtcgttgtgcaactttctgtgcaattgttactacagccccgctgcttcatactggaattttggaagtcgcaacaattccagaaggatactacgcgtatggtgcttctgctggtagagaatggtacttaaatcctgctcaacaattcaaggatcgatcgttttcggcaattgatctgaacttgatgaacaaggtgtttgacattatcgaggaactccttgaacgcccagagttccgcatcttcaaatggattggtagtggaattcaaaaacattgtgggcacattactattgccaagcaagatgtgaatggaacaattccatcccgaaaagtaatcagactttatgagcaacttgtcaagatagttaatgattttgacccgaacggcacaactctcacaatgcgcgagtcggaccttgacttcaagatttatgtaaaagcaaaactgaaggggagaatttttaacaaaggtcacggtatccgtctggttagagaacgactgaagccaaacatgtcgaagggtaactgcttggtttgcggagacaacgaatcagatatcccaatgcttgaggaatgcctgaagttggctggttcaaaggtttacacaatttgggtaaccgcagatacgaatttgcaagaaaaagtaacccaactgtgtgatcgctttagttgctccaatattcactttgtctcatgccctcaagtacttctcggagcaatggcctacgcaactgcccatacgttggttgatgagagaaaccgaaaactggattactattacgattctgacactccaatggatcaggaggaaagtagtactcttggtgcctctcttggaacttcctttggaaattgagaacaataaaatactcattatttatgattttgtttttttaacagcttcattattcgacatttctttttcttacatcaaaatatctaaattccagtattaacctctttaataatattccatccaagtccatcccgacatttcaataccgtttctttttagtttgcctggtgcacttttatgttttcatcatcataatacttgtaaatacagtgtctcttgttagattcctcatacttcccatccgcagccaaagttttgtcctcatgtatcatttctctatgagaattttatggtagatatcgtttattgaactcttgttaatgtttttttcacagaataaatgtatattttttca

SEQ ID NO: 17245 - protein, 1294 aa, Caenorhabditis elegans
MDPFDRPKNDNDPFEDALKRCHKILEKLDCPFVTGKEKDLDESDDMTENEDHDEMANEDDGIPSNEKKVETRKMDCTSGQLLAPKLPEKAESISSASESSEDSESVAILKYTVRTCYAIWKKRQKNSEIALKGLMIVLELCLSQPSARDDAFSALLETLGYNTVTFWKAVVPQIYNSDLSYATQYREALLFSLVLYDVNHSKNRLRELYAAVPGVRQSMLGIRAKQFGERYRHLQMKIARSRASSRMSSKMGSEENLPAMASMMNDVVFDEEPHTQSPLVDMSHDKQRVINVSNAPPVSISRKTSGSWEIKQGSGGLVACVDPVMSADKKNIWLSNLGVNMQEELKEHSTSTNSLGLPLIKQACAGEVFCVLERNEKKEELTPKQQAVESDMSLLSVLNTYNKHSYQLNPVVVNQDDYNTYYGGISNGLLWPALHNLPQYISPCFDDPELLREQWCAYVRVNYLFAINAARNSRAQDFIWIHDYHLMLCGQIMRSLESSLDIGFFIHIPFQPPANFMTKYKTVADPIMRALLRFTKVGFQTSRDRDTFVKLVAKHIKRTKIEYDSRLDRYTIEHDGWTCSLGVFPVSIKIADFVNIAKNPQTIIEAEEIKKQIMGRSADGGQLFFSVERFDYTKGISEKLRAWQRYFEKYPDRIGKDVLFQVAVTNRRSVDSYRQYQDDVLAVADLINQKFKSEDYPEWKPVIFETDGLPRTRLIAHYLAMDIGVVTPSKDGMNLVAKEMLVCNPTASLVLSTGAGTEVQLSNAQFYSEQEGKCYHRVEEISNTEAFADNFFAAATESKETRTKHGEKINQFLCVHDIDEWSDQFLDPKWTHEVISQCEVKQLGQFYGLMSRTAQVRRQIVECVLKGLPIRPHFRYSLENAKNSLESSCKSGTKLSLEADEESGEEKGFEITYDIHDELSEMEKDLAFLAFIQSDEYENAEEFIKTLGSFYEGGPVLFKNEVKQAAEMLQQGIHYNTFFTDRDGTLKSYACSYPTSVQPAYSAVIQAQFARRCATFCAIVTTAPLLHTGILEVATIPEGYYAYGASAGREWYLNPAQQFKDRSFSAIDLNLMNKVFDIIEELLERPEFRIFKWIGSGIQKHCGHITIAKQDVNGTIPSRKVIRLYEQLVKIVNDFDPNGTTLTMRESDLDFKIYVKAKLKGRIFNKGHGIRLVRERLKPNMSKGNCLVCGDNESDIPMLEECLKLAGSKVYTIWVTADTNLQEKVTQLCDRFSCSNIHFVSCPQVLLGAMAYATAHTLVDERNRKLDYYYDSDTPMDQEESSTLGASLGTSFGN

SEQ ID NO: 17246 - DNA, 2637 bp, Debaryomyces hansenii
  CDS (1)..(2637)
atgaccaacgctttgaatgaaattgagaacatgtcagcatttccatccgatggtaaaacggtatccccaaaggattatgccaataatgataagctaaagttgagtggtagaatcattaatgtcatgacgctgttacctacgcaaatagttaagaagactaataaatcagggaacgataattgggacgtagaacctgtgagaggaaattctgccctttattcgtcccaattttttttggcacagcagacagactgggaaagccatttagttggatggaccggagaattaataaataagtcatcgaattctaagagtattatcaatgaaaatataacggatgatccgttatatttaaacaaagaggataagacatcgttggaaggaaaaatcagggacgctaataagtctgcccatatacatccagtctggttactaaggagagatcaagaaaggtggaggaattatgcggaaaacgtcttatggcctgttttccactacatccaaggggaaccttcggatggtaaagacgaagcaagttcatggcatgattacgtcaaatttaatgaagcgtactgccagaagatcatatcgatttacaagccaggtgatgttatatggatacatgattactatttgttattacttccacagttgttaagaatggagattccgaatgctataattggtttgttcatgcatgctccatttccatcctcagaatactttagatgcctttcaaaaaggtcacatttattagatggtatgttgggtgccgataagattgcatttcaatcagaggcatttcaaagacatttttcgtcatgctgcacgagattattaggatgtgaaatttctaaggataaacttatggcgtatggttcggctatatctttggaaacattgcctattggtattgataccaaaaagattgaatatgatgcgttttcttctgactctggtattgaacagaaagttcgtgcattaggggaaatttatgccgataagaagatcattgtaggtagagatcgtttagatactgtcagaggtgtggtacaaaaattgcaagcatttgaaatgtttttgcaaatgtatcctgaatggagagataaggttgtattaattcaagtttcaagtcctggatattctcattcagcgaaggttgagcaaaaggtgacagagttagttcatcatatcaatagtgaatatggtgatttaaactctacaccaattttgcactatcagaagaggatcaacaaggatgaatatttagccttattaagggttgccgacttggctcttatcacatcagttagagacggtatgaatacgacttccttagaattcgtgttatgccaaaaagaaaattattctccattgattttatcggaatttacaggtactgcctctgtcttgagtgaagccattttggtaaacccatgggattcagttggaattgcaaaaacgatgaacgattgtttctatatgtctaaagataagaagagggcattagaagaaaggttgtataagcaagttacatcaaacacaattcagaattggacctcaaatttcataactcatttaattgatcatgttaacaatacgcatcaaacgcattatacccctgctttgaatagacccttgttattgaataattatgagaattctcatagaagattattcttatttgactatgatgggactttaacaccaattgttaaagatccagcagcagctattccttcatccagattgaatgctgtattggatattttatcatctgatcctaaaaatcaagtttgggttatctctggtagagatcaggcgttcttagataaatggttaggatctaagaatattggtctatcagctgaacatggttgtttccttaaagacattggctctacagaatggtctaatttgtctgcatctttcgacatgtcatggcagactaaagttaaagaagtcttcaaagaatatactgagaagacacctggttcaaataccgaacagaaaaaggtcgcattaacttggcattaccgtagatctgatccagaactcggtaagtatcaagctgagaagtgtttaaagttcttgaaggaaacagttgctactgagtatgatgttgaagttatgccaggcaaagcaaatattgaagttagaccaaattttgtcaacaaaggtgaaattgttaagagattagtgctaaatcctcatggtgctaagcaaatacctcatgtggtgactaattataataaagatgtcccagttgatgaattaccggactttattttatgtcttggggacgattttactgacgaagatatgtttaaatctttgaaggatattgaagcagaatggagcctgaaggatcacccaacgaaccaatatggatctcatggtgtttatcctgttgcagtaggacctgcctcgaagcaaactattgctacatcacacttaacagaaccatctgaagttttagaaactttgggcttattgtcaggcgtagtttcattatttgaaagtgcagggtcggtttctttagacgatagaggacatcttgaaaatagtacttcgtcgaataaatcgaaatctgctatcaaggaagcaactaagaaagaaggatcaaaatcttgttaa

SEQ ID NO: 17247 - protein, 878 aa, Debaryomyces hansenii
MTNALNEIENMSAFPSDGKTVSPKDYANNDKLKLSGRIINVMTLLPTQIVKKTNKSGNDNWDVEPVRGNSALYSSQFFLAQQTDWESHLVGWTGELINKSSNSKSIINENITDDPLYLNKEDKTSLEGKIRDANKSAHIHPVWLLRRDQERWRNYAENVLWPVFHYIQGEPSDGKDEASSWHDYVKFNEAYCQKIISIYKPGDVIWIHDYYLLLLPQLLRMEIPNAIIGLFMHAPFPSSEYFRCLSKRSHLLDGMLGADKIAFQSEAFQRHFSSCCTRLLGCEISKDKLMAYGSAISLETLPIGIDTKKIEYDAFSSDSGIEQKVRALGEIYADKKIIVGRDRLDTVRGVVQKLQAFEMFLQMYPEWRDKVVLIQVSSPGYSHSAKVEQKVTELVHHINSEYGDLNSTPILHYQKRINKDEYLALLRVADLALITSVRDGMNTTSLEFVLCQKENYSPLILSEFTGTASVLSEAILVNPWDSVGIAKTMNDCFYMSKDKKRALEERLYKQVTSNTIQNWTSNFITHLIDHVNNTHQTHYTPALNRPLLLNNYENSHRRLFLFDYDGTLTPIVKDPAAAIPSSRLNAVLDILSSDPKNQVWVISGRDQAFLDKWLGSKNIGLSAEHGCFLKDIGSTEWSNLSASFDMSWQTKVKEVFKEYTEKTPGSNTEQKKVALTWHYRRSDPELGKYQAEKCLKFLKETVATEYDVEVMPGKANIEVRPNFVNKGEIVKRLVLNPHGAKQIPHVVTNYNKDVPVDELPDFILCLGDDFTDEDMFKSLKDIEAEWSLKDHPTNQYGSHGVYPVAVGPASKQTIATSHLTEPSEVLETLGLLSGVVSLFESAGSVSLDDRGHLENSTSSNKSKSAIKEATKKEGSKSC

SEQ ID NO: 17248 - DNA, 1443 bp, Debaryomyces hansenii
  CDS (1)..(1443)
atgataaaaggaaaagtgttagtagtttcaaacagattaccagttacgatcaagcgatcgcctaacgggacatatgactattcaatgtcatctggaggattggttacggcattgcaagggttaaagaaatcaacggaatttcaatggttagggtggccaggacttgaaattccggaagatgaacaaagtaaggttaataaggatttaatggagaaattcaactgtactgccatatttttgagtgattcaattgctgatttacactataatggtttttctaacagtatattatggccgttgttccattaccatcctggtgaaatgaattttgatgaaaatgcatgggccgcatatatcgaagcgaataggaagtttgctatcacaattgcacagcaagttgatgataacgatatgatttgggtgcatgattaccatttaatgttattgcctcagatgttacgagaagaaatagaaaataagaaaaaaaatataagaataggattctttcttcatactccattcccatcctcggagatttatagaattttacccgttagagaagagatattggttggtgtattaagttgtgatttgattggattccatacgtacgactacgctaggcatttcttatcttcagtatcgagaattgtttcaaatgttaatatattaccaaatggaattgagtatcaaggtagatcaattggtataggtgctttcccaattggtatagatgttgataagtttaccgagggggtaactaagcctaaagtggtagaccgtattaagcaattaaaacaaaagtttactgatactaagattatagttggagtagatagattagattacatcaaaggtgttccccaaaagctacatgcatttgaaattttccttactgagaatcccgaatggataggcaaagtgatattagttcaagttgccgttccttcccgtggagacgttgaagagtatcaaagtttgagggcaactgtcaatgaattagtaggtagaattaatggaagattcggtactgttgaatttgtaccaattcatttcatgcacaaatccatcccatttgatgaattaatcagtttatatcatatatctgatgtttgcttagttagttctacaagagacggcatgaaccttgtttgttatgaatatattgcatgtcagcaagaaaataagggtgttcttatcttatcagagtttgcaggtgccgctcaatcattgaatggagcgatcgttgttaacccttggaatacagaagaattaagttatgctataaaagagagtttgacattaccagaagagaaaaaggaacttaacttcaaaaaattatttgattatatatcgaagtatacgtctggattttggggagaaagctttgtcaaggaattgcgcaaatgctcaagtcaagacaagattactgaaattagatag

SEQ ID NO: 17249 - protein, 480 aa, Debaryomyces hansenii
MIKGKVLVVSNRLPVTIKRSPNGTYDYSMSSGGLVTALQGLKKSTEFQWLGWPGLEIPEDEQSKVNKDLMEKFNCTAIFLSDSIADLHYNGFSNSILWPLFHYHPGEMNFDENAWAAYIEANRKFAITIAQQVDDNDMIWVHDYHLMLLPQMLREEIENKKKNIRIGFFLHTPFPSSEIYRILPVREEILVGVLSCDLIGFHTYDYARHFLSSVSRIVSNVNILPNGIEYQGRSIGIGAFPIGIDVDKFTEGVTKPKVVDRIKQLKQKFTDTKIIVGVDRLDYIKGVPQKLHAFEIFLTENPEWIGKVILVQVAVPSRGDVEEYQSLRATVNELVGRINGRFGTVEFVPIHFMHKSIPFDELISLYHISDVCLVSSTRDGMNLVCYEYIACQQENKGVLILSEFAGAAQSLNGAIVVNPWNTEELSYAIKESLTLPEEKKELNFKKLFDYISKYTSGFWGESFVKELRKCSSQDKITEIR

SEQ ID NO: 17250 - DNA, 2403 bp, Yarrowia lipolytica
  CDS (1)..(2403)
atgctaccggaaatcatcaccccaaccgcggcgagagcgctcaatgtgcccatatctggacgggtcatcaactgtgtcacgaccctgccgtacgaaatctaccgcgagggagcgacgtacaaaattcgaccgcgacgtggcaactcggccctctactcggcgctggattatatgcagtctggcgacggagacaccacatggacatcgtcgctggtggcgtggacgggcgaaatcgcgctgccggccgccacgtcgctgccagacctggagctgtatcagaagctcacggagcaggacaaacacatgctcgaacgggagctgaccgaggcgcagggcggcacgccgactcacccgatctggacagactcgggcgacaccgtgtccacgggctacaacgaacagctgtcgcccacccgccgctacgcagaaaacattctgtggcccattctgcactacatccagggcgaacccaccgacgggcgcgacgagaaaaaatggtggagcgactacgaagacctcaaccgcaagtactgcgacaaggttctggacatctacaacgagggcgacgtcatctggatccacgactactacctgttcctgttgcccaaaatgatccgcgaaaagctgcccgacgcccggatcggcttcttcatgcatgcgccgttcccgtcgtcagagtactttcggtgtctggcaaagcgccaggagctgctgcagggcgtgctggcgtcgaatctcatttccacccagagcgaggcccacaaacggcactttatgagcgcatgttcccgcattgtgggcgcagaaacagccacgccaacgtccgtctatgcctacggccagtccgtgtccgtggtcgctctgccaatcggcatcgacacggcaaaggtggaggcggacgccttcactgatgaaataacggaaaaagtgcgggcgattcggcagctgtaccccgacaagaagatcattgtgggccgagaccggctggattcggtccggggcgtggtgcagaagttgtatgcgttcgacgtgtttctcaaacggtaccccgagtggcgggatcgcgtggtactggtgcaggtgacgtcacataccgccacaggcacgcgcaaagtcgaaaagaaggtggccgagctggtgtcatccataaacggcagatatggtgccatccacttttcgccagtgcatcattacaccaagcacattgctcgcgaggagtatctggctctgttgcgagtggcggacctttgtctcatcacttcggttcgtgatggcatgaacaccactgccttggagtttattgtgtgccaaaacggcaacaactctccgttgattctgtccgagttcacgggatcggccggaaacctgcctggcgcgattctggtgaacccctgggacgctgttggggttgcagagcagatcaaccggacattccgaatgggccaggacgagaagctggcgatcgagcaaccgctgtaccagcgggtgaccgccaacacggtgcagcactgggtgaaccggtttgtatcgcaggtgatcagcaacaccttccgaaccgaccagtctcatctgacgccgattctcgacaatcacaaacttgtggagcggttcaagatggccaaaaagcgagtgtttttgtttgattatgacggcactctcacgcccattgtgacggaccctgccgctgccactccttcagacggtctgaagcgggaccttcgagcgctggccaaggacccccggaacgccatatggataatttccggccgtgactccacgttcctggacaagtggctcggcgatattgctgaacttggcatgtctgccgagcatggctgtttcatgaagaatccaggcaccaccgactgggagaacttggcagccaactttgacatgagctggcagaaggacgtgaacgacattttccaatactacacggagcggacacaggggtcgcacattgaacgcaagcgtgtggctctgacatggcactaccgacgagcagaccctgaatttgggctgtttcaggcccgggagtgccgggcacatctggagcaggcggtggtgcccaagtgggacgtggaggtgatgagcggcaaggccaatcttgaagtacggcccaagtcggtcaacaagggtgagattgtcaaacggctcatttctgagtactcatcagagggccggcccccgcagtttgtcctgtgtatgggtgacgaccagacggacgaggacatgttcaaggctctcaaggatgtacctgatttggacagcgagagcattttccccgtaatgattgggcctccggagaagaagaccaccgccagctggcacctgctggagcccaagggcgtcctggagacgttgaatgagctggccaagttggagggcgagagtaagatgtag

SEQ ID NO: 17251 - protein, 800 aa, Yarrowia lipolytica
MLPEIITPTAARALNVPISGRVINCVTTLPYEIYREGATYKIRPRRGNSALYSALDYMQSGDGDTTWTSSLVAWTGEIALPAATSLPDLELYQKLTEQDKHMLERELTEAQGGTPTHPIWTDSGDTVSTGYNEQLSPTRRYAENILWPILHYIQGEPTDGRDEKKWWSDYEDLNRKYCDKVLDIYNEGDVIWIHDYYLFLLPKMIREKLPDARIGFFMHAPFPSSEYFRCLAKRQELLQGVLASNLISTQSEAHKRHFMSACSRIVGAETATPTSVYAYGQSVSVVALPIGIDTAKVEADAFTDEITEKVRAIRQLYPDKKIIVGRDRLDSVRGVVQKLYAFDVFLKRYPEWRDRVVLVQVTSHTATGTRKVEKKVAELVSSINGRYGAIHFSPVHHYTKHIAREEYLALLRVADLCLITSVRDGMNTTALEFIVCQNGNNSPLILSEFTGSAGNLPGAILVNPWDAVGVAEQINRTFRMGQDEKLAIEQPLYQRVTANTVQHWVNRFVSQVISNTFRTDQSHLTPILDNHKLVERFKMAKKRVFLFDYDGTLTPIVTDPAAATPSDGLKRDLRALAKDPRNAIWIISGRDSTFLDKWLGDIAELGMSAEHGCFMKNPGTTDWENLAANFDMSWQKDVNDIFQYYTERTQGSHIERKRVALTWHYRRADPEFGLFQARECRAHLEQAVVPKWDVEVMSGKANLEVRPKSVNKGEIVKRLISEYSSEGRPPQFVLCMGDDQTDEDMFKALKDVPDLDSESIFPVMIGPPEKKTTASWHLLEPKGVLETLNELAKLEGESKM

SEQ ID NO: 17252 - DNA, 3447 bp, Kluyveromyces lactis
  CDS (1)..(3447)
atggttgttattattgcttctttgttcttaccatttcagcctcaatttgagattcattcgtcttccgttgagactgcgtcgttggtagatcaaccggttaagattcgcaatgctggttccggtgtaaaaagctctgcgaattctttgtattccggtaatccgttcgatttgggtacttctttgacgaggaaaagaagtagctcgtcgcattctcggtcttcttttgcgccattggatctgactatgagtgctgcttctggtggcgatggcatggagtcatcgcctgctccgtctggtgagttttccaatcagcatcgactcgatgaggtgacgaaacctgtgggtgctaatccgcaaatctcttccgagtcgtttatggaaagtttgacggggaaagcacactcagctgcagcttcttcttctaagaacgctctttcgaattatcctactgggtccgtggaagaattcttttctagtgggaacacacagttaggtaagaattacgataacaatacaggttcaccagattcgacatactcaatccagtcgagtcctgtgattagtgctgtgaacccgacacacgattcgacgtccaatttgttgaagaacgttaacaaatcattactctatcagatagtgttgaatgaatcaaattctgcgtctgcgttggagggtacttccaaacatttctggaatagtcccggtagtacagttattactccgagatctagggcgttaccggatgtgaatagtagtttatccggtgttgctaagggtaagggccatttgcacatcaagtcacaagctccagctattagacatgtgcatcccgctgcgcagggtcccggcaacgtgacggggacgaccggtggtggtggtggtggttcttcgaaattgaagtattcggtcaacgctaatcatgatgaggatagccaggaagagaaatatgaacagtcagaacaagaagagggcgaagaagaaaatgatgaaaacgagaacgtagtggatgatgaggacgaggatatgtatgatatagaagaattggattcttctggaaggtatcattacaatgtccccaagtttggtggctactcgaataaagcaaaacttaaaaatgcgctattaaagaagtcagagaatattttcagtaccgctccttggaccattgtgccctgtgctaaggggaatggtggtctcaagaacgccgttgccacggcgctacttgaaaagactatagatgagcaagttacttgggtcggtaccgtgggtattccaacagattgtatcccggagaaaactttggataacatatgccatgagttatacacaaactatcattcaagggctgttatctctgatgatttgacattcaaaggcgcctataaaaatttctgtaaacagattttatggccgactttgcactaccagatccctgataacccaaactcaaaggcgtttgaagaccattcgtggaattattaccaacatctaaaccaattgttcgctaacgaaattgtgaagacctacaaggaaggtgacatagtttgggtgaatgattaccatttgatgttggttccagaaatggtcagagaaaaattacccgatgccaagattggattctttttacatatctccttcccaagtagcgaggtattccgttgtttccctcagagagagaaaattttaaatggtatcttgggtgctaattccgttggattccaaacagatgaatatgctaggcatttcatgcaaactgctacaaggttgttgatgactgacgctgacgatcatcaactaaaattacaaggaagagttgtgaaagtgaataacactcctattggtgtcgatgtgttcaacttggatgaacagatcgatactgaacaagtgattcaatggaggaaactgattagagaaagatggtctgataaacgtttaatcgtttgcagggatcaattcgatcgtattcgtggtttgaaaaagaaaatgttggcatacgaaagattcttgaaagaaaacccagagtacgttgataaagtggtgatgattcaaatatgtcttgatactgcccgtgacattgacttggaaagagatatcatgtctgtagtggacagaatcaatgctttatcaaaggacatcagtatctcgcaaccggtagtatttttacatcaagatcttgagttttctcagtatttagcactcaactgcgaggccgatttatttatagtcagttctatgagagaaggtatgaacttgacttgtcatgagtttgtagtatgttccagagaacgtaatgcacctctgctactatcagaatttactggtagtacgcagatcttgaagagcggtgcattgttaatcaacccatgggatatcaagaagtttgcgcgtgctatcaaaatcggattggagatgccacctgatgaaaagagacgccgttggaagaaaatgttcaaaagtgttattaatcatgactctgacaactggatcgttcatgctcttaacaacattgattcttcttgggaattcaatcacgaaagatcccaggtgttcaacttgtctttcaaacaaatgtatgctgcttatagccaagctaagagacacatgttcgtgttgaaaatttctgagccaccaactcctagaatgttaaggatcttatctgaactaagtgccaataacattgtctatttgatgaactctaattcacgcggagtgttagagagactctacagccgtgtttccaatgttggactcattgctgaaaacggtgcatacgtgagattgaacggtaattggttcaacattgttgaagacgtatcttggaaagatgatgtcatcaaagttttcgaagacaagatggaaagactacccggttcttactgcaagatcggagattcgatggtgagattccatacagaaaatgcagaagaccgtgatcgtgtgcaaggtgttattggcgaagcaatgacacatatcaacaccttgttttcagacaagggtatccatgcctacgttaataaaaacattgtgtttgtgcaagaagtcggattagcattgaaaacgttgcaattcttggtgagctattataattctgttgatgacatttcatgttcatctcattctccagtggcgcaaccaacttctgctgaaacgtccgcatcccccctcctatctccaatatctccaaagaacggtgctggtttcttccacgttgctgccaagagggaaaatagagacccaattggattcctaacgatcactgggtccacgtctcccgttattgaaccattgttccaatacgtcaatgaactcacgaaggaaggaaagcttcagtacgggtactctgtagtacatggtgatacgtcttcaacatacgctaaagagcacattcagggtcttaacgagctattttcgatgctacaaaagttgtcttctcccaactcatcctaa

SEQ ID NO: 17253 - protein, 1148 aa, Kluyveromyces lactis
MVVIIASLFLPFQPQFEIHSSSVETASLVDQPVKIRNAGSGVKSSANSLYSGNPFDLGTSLTRKRSSSSHSRSSFAPLDLTMSAASGGDGMESSPAPSGEFSNQHRLDEVTKPVGANPQISSESFMESLTGKAHSAAASSSKNALSNYPTGSVEEFFSSGNTQLGKNYDNNTGSPDSTYSIQSSPVISAVNPTHDSTSNLLKNVNKSLLYQIVLNESNSASALEGTSKHFWNSPGSTVITPRSRALPDVNSSLSGVAKGKGHLHIKSQAPAIRHVHPAAQGPGNVTGTTGGGGGGSSKLKYSVNANHDEDSQEEKYEQSEQEEGEEENDENENVVDDEDEDMYDIEELDSSGRYHYNVPKFGGYSNKAKLKNALLKKSENIFSTAPWTIVPCAKGNGGLKNAVATALLEKTIDEQVTWVGTVGIPTDCIPEKTLDNICHELYTNYHSRAVISDDLTFKGAYKNFCKQILWPTLHYQIPDNPNSKAFEDHSWNYYQHLNQLFANEIVKTYKEGDIVWVNDYHLMLVPEMVREKLPDAKIGFFLHISFPSSEVFRCFPQREKILNGILGANSVGFQTDEYARHFMQTATRLLMTDADDHQLKLQGRVVKVNNTPIGVDVFNLDEQIDTEQVIQWRKLIRERWSDKRLIVCRDQFDRIRGLKKKMLAYERFLKENPEYVDKVVMIQICLDTARDIDLERDIMSVVDRINALSKDISISQPVVFLHQDLEFSQYLALNCEADLFIVSSMREGMNLTCHEFVVCSRERNAPLLLSEFTGSTQILKSGALLINPWDIKKFARAIKIGLEMPPDEKRRRWKKMFKSVINHDSDNWIVHALNNIDSSWEFNHERSQVFNLSFKQMYAAYSQAKRHMFVLKISEPPTPRMLRILSELSANNIVYLMNSNSRGVLERLYSRVSNVGLIAENGAYVRLNGNWFNIVEDVSWKDDVIKVFEDKMERLPGSYCKIGDSMVRFHTENAEDRDRVQGVIGEAMTHINTLFSDKGIHAYVNKNIVFVQEVGLALKTLQFLVSYYNSVDDISCSSHSPVAQPTSAETSASPLLSPISPKNGAGFFHVAAKRENRDPIGFLTITGSTSPVIEPLFQYVNELTKEGKLQYGYSVVHGDTSSTYAKEHIQGLNELFSMLQKLSSPNSS

SEQ ID NO: 17254 - DNA, 2631 bp, Kluyveromyces lactis
  CDS (1)..(2631)
atgactggagagaagaaactgtccaacaaggttatcaactgtatcacacagttgccctataagattgagaaaataagtgatgatgacacggaggctaacgatccatcctgttggtcaattgaaccaataagtggtaattccgctttgcaatcaagtctcaaatatttgaacgagtcacctaattgggaacaccatatcgttgcatggaccggtgaaatccttaactcagatgagaatcccgatagatccatgtatttgacgcaggctgaaaaggaagtcattgccaccatgttgcaagggaaagaagctgagggttgcacccacactgttcatccggtatggcttttaaggaaggatcaataccgttggaggaaatttgctgaaaacgttatctggcctgcattgcactatatcttgaatgcaccggatgacggtactttagaaaacgtttggtggtacgattacgtgaagttcaatgaagcttacgctatgaaagtggcccaaatttatcaaccaggtgatatcatctgggttcatgattactacttgatgttgcttcctcaattattaagaatgagattcaacaatgcaaccattgcatacttccatgatactccttggccatcaaacgaatatttcagatgtctttccaggaggaagcctgtcctggacggtctcttaggctccaacagaatttgtttccaaaacgacggtttcgctagacattttgtttccagttgtcaaaggcttttgggttgtactgcaacgaaatctagcaattcaaacgctaataactcagacgagtatcggataacgtcttatggtggtgacgttttggttgactctttgcctatcggtgttgatacggagcaaatacaaagggatgcgttctctccagatgtcgatgaaaaagttaacgcaatcaagaaggcttacgagggaaagaaaatcataattggtagagatcgattggatactgtcaaaggtgttttacaaaagctacaggcgtaccaggtattcctagctatgtatccggaatggcggggtaaagtggttttgattcaagtcagtggtccaacagctaaaaccgatgcaaatataaaacttgagtctcaagttaacgaattggtgtcgtccataaacggtgaatatggtaatttgaactatagtcctgtccagcattattacctgagaattccccaagatgtttattactccttgctaagagtagctgatgtttgtttgattaccagtgttagagatggtatgaatacaactgcattggaatttgtcacagttaaatcacaactatccaaatataattgttacgcatcaccattgattttgagtgagttttctggtacttctacgatcctaaccgatgcaataatcataaacccctgggatgcggttgctgtgtcaaaggctataaacaaagcactcaaattaacaccggaacaaaaagagacattagaactgaagttgcggaaagaagttcctacgatccaagattggacagataaatttttaggtaaagtggttgatcttgtcgaacataagataggaaatcaaaagattacacctgccttgaatcgtcctttgctcttaaagacttataagaaggccaaaagacgtttattcttatttgattatgatggtacattgacgcctatcgtgcaggatcctgcagctgctattccaagtgcaagattgtattctataataaccaaacttgctcaggatccgaagaataagatatggctcatttcaggtcgtgatcaacagtttttgaatagatactttggtaccaaaataccacaagtaggtttaagtgctgaacatggttgtttcatgaaggatgttagcagtgaggaatggattaatctcacatctaagtttgacatgtcgtggcaaaaagaggtggggcaaataatggaggaatacaccaagaagactccaggttcattcatcgaaaggaaaaaagttgcattgacgtggcactatagaagatctgatccacaattgggtgagtttaatgcagacgccttgaaaacttcactagagaaaataacagatggtttaggcgtcgaagttatggaaggtaaagcaaacattgaagttcgtccaagttttgtaaacaaaggtgagattgttaaaagattagtatggacacctcatggagcgaaacaattaatcgaagataacttctcaattgatgaaaatgtcctaagagatgaactgccggagtttgttctttgtctcggtgatgatgtaaccgatgaagatatgtttaaacagcttaaccacattgaagagcaatgggacgagaaataccctaatttcgaatcctctgatggctttggtatctatcctgttactgttggttctgcttccaaaaagacggtcgcaaaagcctacctcactgatccacaacaagtgctagatactctagggttacttgttggagatgtctctttattccaaagtgccggtactgttgatctagatgatagaggacatctgaaggatagtgaaagtagtttgagatctgagcaagcaagtgctgcatatgccatgaaaagatcgacatcttcaaacaatggtctgaaaaagtcatccaagaataattaa

SEQ ID NO: 17255 - protein, 876 aa, Kluyveromyces lactis
MTGEKKLSNKVINCITQLPYKIEKISDDDTEANDPSCWSIEPISGNSALQSSLKYLNESPNWEHHIVAWTGEILNSDENPDRSMYLTQAEKEVIATMLQGKEAEGCTHTVHPVWLLRKDQYRWRKFAENVIWPALHYILNAPDDGTLENVWWYDYVKFNEAYAMKVAQIYQPGDIIWVHDYYLMLLPQLLRMRFNNATIAYFHDTPWPSNEYFRCLSRRKPVLDGLLGSNRICFQNDGFARHFVSSCQRLLGCTATKSSNSNANNSDEYRITSYGGDVLVDSLPIGVDTEQIQRDAFSPDVDEKVNAIKKAYEGKKIIIGRDRLDTVKGVLQKLQAYQVFLAMYPEWRGKVVLIQVSGPTAKTDANIKLESQVNELVSSINGEYGNLNYSPVQHYYLRIPQDVYYSLLRVADVCLITSVRDGMNTTALEFVTVKSQLSKYNCYASPLILSEFSGTSTILTDAIIINPWDAVAVSKAINKALKLTPEQKETLELKLRKEVPTIQDWTDKFLGKVVDLVEHKIGNQKITPALNRPLLLKTYKKAKRRLFLFDYDGTLTPIVQDPAAAIPSARLYSIITKLAQDPKNKIWLISGRDQQFLNRYFGTKIPQVGLSAEHGCFMKDVSSEEWINLTSKFDMSWQKEVGQIMEEYTKKTPGSFIERKKVALTWHYRRSDPQLGEFNADALKTSLEKITDGLGVEVMEGKANIEVRPSFVNKGEIVKRLVWTPHGAKQLIEDNFSIDENVLRDELPEFVLCLGDDVTDEDMFKQLNHIEEQWDEKYPNFESSDGFGIYPVTVGSASKKTVAKAYLTDPQQVLDTLGLLVGDVSLFQSAGTVDLDDRGHLKDSESSLRSEQASAAYAMKRSTSSNNGLKKSSKNN

SEQ ID NO: 17256 - DNA, 1437 bp, Acinetobacter sp
  CDS (1)..(1437)
atgtctagacttattattttatccaatcgtgtgagtttacctcagactgaatgtgtagcaggtggattagctgttgccatgcaagatgcgttaagtcagcttggtggtgtttgggttggttggaatggcaaaaaaattgaacaaccatttgaacagcattttgatattttatacaaatccaaaattacttatatgacctgtgcactgacacagcaacagtatcaggattattactgtggtttttcaaataatacattatggccagcaatgcatgaccgtgaagacctgatcgagtataaccctaaagaattcaaaacttatcaagatgtgaaccgtttatttgccaccaaaattgcagaatttgcccaaccagatgatctaatctgggtacaggattatcattttctaagtgttgctcgccattgtcgtgagctgggaatgcaaaataaaatcggattctttcttcatattccttttgcctcactggaaatatggagaaagattccttgtgcagagcagcttatggatgatctatgtcattataatttaataggtttgcaaactgctcaagatcaggaaaactgtatttcagtatgtagtgtacttttaaaagctcagaaaattcaaaacaatatgatttcattgaatcaaagagtgacgcaaattcaagactatccaattggtgttgatgttaaaggtattcaaaaaacactctcaaatttatctgatcaagatcaatatttgacaaacccctctgctatcaaaacaattattggggtcgatcgaatcgattattcaaaaggtttattcgaaagatttaatgcctttgccgagtttttagatcgcaacacagcgtttcatcaaaaagttcaacatgtgcaaatagcttcaccttgccgtctggaagttgctacatataagcgactatttgaacggtttaagttgaaagtagaattaatcaatagtgaattttcccaagataactggcttccaattgtttgtcattatgattcaaaaccacatcacgaacttatgcaattttatcgtaatgcggatatctgctgggttacttcacttaaagatggtatgaatttagttgctaaagaatatattgctgcacaaaatcctgataaccctggcgtactcatcttatctgaatttgcaggggcggcagaacaaatgcaagatgctctaatcgttaatcccaagaaccgtgatgcaatgattaaagccttgaagcttgcgttaaatatgtctttggaggagcgtcaatatcgttatcataaacttataaaacaacttatagaatatgatattaatcagtggcgagatgattttctgaaagacttgaattcctcacaatacattcaaaacttcgactataatcatcgtttatcaactgtattgttttatccaaattattcttccagaatctaa

SEQ ID NO: 17257 - protein, 478 aa, Acinetobacter sp
MSRLIILSNRVSLPQTECVAGGLAVAMQDALSQLGGVWVGWNGKKIEQPFEQHFDILYKSKITYMTCALTQQQYQDYYCGFSNNTLWPAMHDREDLIEYNPKEFKTYQDVNRLFATKIAEFAQPDDLIWVQDYHFLSVARHCRELGMQNKIGFFLHIPFASLEIWRKIPCAEQLMDDLCHYNLIGLQTAQDQENCISVCSVLLKAQKIQNNMISLNQRVTQIQDYPIGVDVKGIQKTLSNLSDQDQYLTNPSAIKTIIGVDRIDYSKGLFERFNAFAEFLDRNTAFHQKVQHVQIASPCRLEVATYKRLFERFKLKVELINSEFSQDNWLPIVCHYDSKPHHELMQFYRNADICWVTSLKDGMNLVAKEYIAAQNPDNPGVLILSEFAGAAEQMQDALIVNPKNRDAMIKALKLALNMSLEERQYRYHKLIKQLIEYDINQWRDDFLKDLNSSQYIQNFDYNHRLSTVLFYPNYSSRI

SEQ ID NO: 17258 - DNA, 1476 bp, Candida glabrata
  CDS (1)..(1476)
atgacacagattgataagaaagaagtatcaggaaacattattgttgtttccaacagattgccagtgaccatctcgaaggatgacactgggaagtaccagtacaagatgtcctctggagggctggttactgctttacaaggtctgaagaagaccgctacgttcaagtggtatgggtggcccggtctagagatccctgacgatgagaaagagcaagtcaagcaggacttgctcgagcaattcaacgctgtgcctgtgtttttgagcgacgaggtcgctgacttgcactacaacgggttcagtaactctatcctgtggcctctgttccactaccacccgggtgagatcaatttcgatgagaacgcctggctggcttacaacgaggccaacagggccttcgccgaggtcatcttcgagaccatgcaggacgacgacttgatatgggtccacgactaccacttgatgctgctgccccagatgctgcaggaggagatcaccaagcgtaagctgaggaacgtcaagctgggctggttcctgcacacgccgttcccttcctccgagatctacagaatcctgcctgtcagacaggagatcctgagaggtgtgctgagctgcgacctcctcggcttccacacttacgactacgcgcgccacttcctgtcctccgtccagagagtcctgaacgtcaacactctgcccaacggtgtcgagtaccaaggcaggttcgtcaacgtcggtgccttccctatcggtatcgacgtctccaccttccaggacggcctcttgaaacaacaggtcaaggacagaataagccagttgaaggagacgttcaagggacagaaaatcatcatcggtgtcgacagactggactacatcaagggtgtcccacagaaactgcacgccatggaggtcttcctaagcgaacacccagagtggagaggcaaagtcgtcctggtgcaggtagctgtcccaagcagaggcgacgtcgaggagtaccagtacttgagatcagtcgtcaacgagctggtcggaagaatcaacggccaattcggtaccgcagagttcgtcccaatccacttcatgcacaagagtgttcctttcgaagaattgatctccctgtacgcagtcagcgacgtctgtttggtctcttccacaagagacggtatgaacttggtctcttacgaatacattgcctgccaagaagaaacaaagggctccctgatcctgagtgaattcgctggtgcagcccaatccttgaacggtgccatcatcgtcaacccatggaacatcgacgaaatgtccgacgccatcaacgaagccttaaccttgccagaagtcaagagagaagtcaactgggaaaaattgtttaagtacatctcaaagtacacttccgccttctggggtgagaactttgtccacgaactgtacaacacttcttcaagcagcggtagcataaaatcctccgaggaaaagcactga

SEQ ID NO: 17259 - protein, 491 aa, Candida glabrata
MTQIDKKEVSGNIIVVSNRLPVTISKDDTGKYQYKMSSGGLVTALQGLKKTATFKWYGWPGLEIPDDEKEQVKQDLLEQFNAVPVFLSDEVADLHYNGFSNSILWPLFHYHPGEINFDENAWLAYNEANRAFAEVIFETMQDDDLIWVHDYHLMLLPQMLQEEITKRKLRNVKLGWFLHTPFPSSEIYRILPVRQEILRGVLSCDLLGFHTYDYARHFLSSVQRVLNVNTLPNGVEYQGRFVNVGAFPIGIDVSTFQDGLLKQQVKDRISQLKETFKGQKIIIGVDRLDYIKGVPQKLHAMEVFLSEHPEWRGKVVLVQVAVPSRGDVEEYQYLRSVVNELVGRINGQFGTAEFVPIHFMHKSVPFEELISLYAVSDVCLVSSTRDGMNLVSYEYIACQEETKGSLILSEFAGAAQSLNGAIIVNPWNIDEMSDAINEALTLPEVKREVNWEKLFKYISKYTSAFWGENFVHELYNTSSSSGSIKSSEEKH

SEQ ID NO: 17260 - DNA, 3198 bp, Candida glabrata
  CDS (1)..(3198)
atgactattatagtagcctcgttgtttttgccgtttcaacctcagttcgaggtgaatgctgaccaagaacagacagctgagttggttgattccaaattggtcaaaatatccggtgaacaagaggctcatgctaataagaatttaccagatgtgagagtacaagagacagatgcatatgctactgcagcaactcagccgtttctaaatagtagaacaccgcttgcgttgagttcggctgcttcccaattgaatgttaagcagggtccattatcctcagagcaatttttggagaacttaacagcaaatgccacaacggctggcactccagttaacccaaacttgggtgttcatgggcatgcatccgcagaggatttcttcactacgaacaattcaactgccataaacaacaatgcgtcttctcctccattttctgtctcttcaatagcaccggaaatcaatgctaatgttgacggaactgatacaatggatgttaccgctgatttgttagataatgtcaataagtctttgctgttacactctgttctaaacagtggacagggagtctctagccctaatgcggtagaaggtcatacggcgacgcatttaactaacccaaacactactgttattacccctaaatctagagcagttccagagagcaatcctggtgtagttaactttgataattataaggaaagacgtgatagtcaatcgaactcagcattcccttcgatgaaaagggttgcttcaggctcacatggaccctctcacttaaaatattctcagaatgctatagatgctgctctagaatctgatgttatcgatgatgctgatgacagacagaactcagaagccgagtctgattatgaaactgacagaaaagttcattataatgttccaggctttggtggatattcttcaacttctaaaagattaaaaaactcactagaaatttttagcagagtgccttggaagatagttccttctagaaagggtaatggtgcattgaaaaacgccattaatacatcaattttagaaaaggatatcaaggatggcgttaaatgggttggtacgttgggtattcctactgatgagattcctgttgagacaacgaaaaaaatcgtgaaggatcttaatgaaaactaccaatcttcggctgttattgctgatgatgtaacttttaaaggtgcatataaaaacttttgtaagcaaatcttatggcctacacttcattatcaaattccagataatccaaattctaaagcttttgaagatcattcttggaattacttccaaaggcttaaccagtactttgctgaaaaaattgtttcgatttatgaagatggtgatattgtatgggttcatgactaccatttaatgttagttccaggtatggtgcgtcaaaaacttccgaatgcaaagataggattctttctacatgtatctttccctagtagtgaagtgttcagatgcttcgcacaaagagagaacatgttagaaggtattttgggtgccaacttcgttgggttccagactgctgagtacgcaagacatttcttgacaacagcaaacttgctattgacagccgatgtatctggtgatcatttaagatacaagggtaaggtcgtctcagtaaaatcgacaccgattggtatagatgcctttgatttagcaaatcagttactgactgaccctgttacaaaatggaggcaattgataagacaaagatgggctggtaagaaacttattgtttgccgtgatcaatttgataagattagaggacttcataagaagcttttagcttatgaaagatttctgagagagaatccagattatattgagaaagtagttttgattcaaatttgtattggaaaaagttctgatcctgaacttgagcgtaaagtgatggtggtggttgacagaatcaattctctttctatcagcatcagtgtttcacagcctgtggtctttttacatcaagatctggactttgcccaatacctagctctaagctcagaagcggatctgtttttgataaacacatttagggaaggtatgaatttaacttgtcatgaatttattgtttgttcaagagaaaagaattcaccacttctgatctcggaatttactggtagtgctgaactattgaaggatggtgccatcttaattaatccatgggatacaagacatctagctaaatgcattaagatgggtcttgagatgccattggatgaaaggaaaagaagatggaagattatgatgaaatcgttgattaacaatgactcaacgaattggattatgtcgaatctacaagctattgaacattgttgggaattcagtaaagagagctctacgttgttcagtctgtcttcagaggagttggcaagtgaataccaatctgcatcgaataaattattcatcttgaaaatctcggagcctccaagccctagaatgttagcaatcttaagggaactgagttcaaggtgtactgtttatattatgaataccttttccaagacaactcttgaaaacctttacggtcgtgttggtaatttgggtcttattgctgaaggcggtgcttatgtaaggttgaatggaacatggtacagcattgtggatcatgttgactggcttgaggaagtcactaagattttggataccaagattgaaagattgcctggctcgtactataaactagcagactctatggtcagatttcacactgaaaatgcagaagatcaagacagagttgccagtgttatcggtgaagctatgacacatattaacacattatttgccgatcgtggcattcatgcttacgtgcataagaatatattgtttgtgcagcaaaaggaattgtctttagaaactacaaagtttatcctaaagttccataatagtggtaaagtatacaatacaggtcactctactccaagtaaacacaacaacgagatgtcagcaatgttttctggtcaaagcgacaccattgatttcatctgtgtagcagggtctacgtctccaacaattgaaccgatattcaagctggtaaaagatgccacacttgctggtaatttaagatatggacatactattgtatatggtgatgctccatctacatatgccagggagcatacgagtggttggaacgaactttttaatatctttcaagatctggcaaagtcaaatgaaagacagtga

SEQ ID NO: 17261 - protein, 1065 aa, Candida glabrata
MTIIVASLFLPFQPQFEVNADQEQTAELVDSKLVKISGEQEAHANKNLPDVRVQETDAYATAATQPFLNSRTPLALSSAASQLNVKQGPLSSEQFLENLTANATTAGTPVNPNLGVHGHASAEDFFTTNNSTAINNNASSPPFSVSSIAPEINANVDGTDTMDVTADLLDNVNKSLLLHSVLNSGQGVSSPNAVEGHTATHLTNPNTTVITPKSRAVPESNPGVVNFDNYKERRDSQSNSAFPSMKRVASGSHGPSHLKYSQNAIDAALESDVIDDADDRQNSEAESDYETDRKVHYNVPGFGGYSSTSKRLKNSLEIFSRVPWKIVPSRKGNGALKNAINTSILEKDIKDGVKWVGTLGIPTDEIPVETTKKIVKDLNENYQSSAVIADDVTFKGAYKNFCKQILWPTLHYQIPDNPNSKAFEDHSWNYFQRLNQYFAEKIVSIYEDGDIVWVHDYHLMLVPGMVRQKLPNAKIGFFLHVSFPSSEVFRCFAQRENMLEGILGANFVGFQTAEYARHFLTTANLLLTADVSGDHLRYKGKVVSVKSTPIGIDAFDLANQLLTDPVTKWRQLIRQRWAGKKLIVCRDQFDKIRGLHKKLLAYERFLRENPDYIEKVVLIQICIGKSSDPELERKVMVVVDRINSLSISISVSQPVVFLHQDLDFAQYLALSSEADLFLINTFREGMNLTCHEFIVCSREKNSPLLISEFTGSAELLKDGAILINPWDTRHLAKCIKMGLEMPLDERKRRWKIMMKSLINNDSTNWIMSNLQAIEHCWEFSKESSTLFSLSSEELASEYQSASNKLFILKISEPPSPRMLAILRELSSRCTVYIMNTFSKTTLENLYGRVGNLGLIAEGGAYVRLNGTWYSIVDHVDWLEEVTKILDTKIERLPGSYYKLADSMVRFHTENAEDQDRVASVIGEAMTHINTLFADRGIHAYVHKNILFVQQKELSLETTKFILKFHNSGKVYNTGHSTPSKHNNEMSAMFSGQSDTIDFICVAGSTSPTIEPIFKLVKDATLAGNLRYGHTIVYGDAPSTYAREHTSGWNELFNIFQDLAKSNERQ

SEQ ID NO: 17262 - DNA, 3345 bp, Candida glabrata
  CDS (1)..(3345)
atgactctaattgttgcgtctttgttcttgcctcacaggccacagtttgaagtaactgcctcggctggcgagacacaggaactgattgagaacaaccttgtgaagctgaacccattggcttcgaacgaggcctctcctcaggctagacctaaccttgacaactatatcagaaacacacgcagtgcgcttaacgtcccctttgcccagggccgcaatgtctcccaggagtcgcttctgtcgctgaacaatgcgggaaacacctcgggcaacatcgatgacctggtctcctcagagcagttcctggtcaacttgaccgcaaacgctactgcttctggcacaccaaacccttcttaccacacaaagggtaacatgggcaggcccaacctcggtgccggtggctccgctgaggagttcttcagcacctccaatccgccttccaacagaggtgcgtcgccagtgctgtcaattgcctctgcgccacaggtccagaacaacttggactcgactttgaacaataggggctcccctccaccacagcaacttgacagccagatggcggacccaactgcgcatctgttgaagaacgtctccaagtcgctgctgactcagtcgttgcatgactcgacgaaagaggcgtctgcgccaatgcctagctccagtgcgaactcgatgggccagtcccgttacaaccacgccaacacttctatcggcaccgcagtgacccctaagtcgcgtccgttgcctggtcactccaacagtagctccattatagacttctcgctaagtagaaacaagcagcatgcacccgcgttgcccgcattgagacgtatccagaagaacaaggtcggctcccccaccaaaccttcccccttgaacacacaacctcaatcctccaacttaaagtactccaagacattacaccagatgcacggcgatagcgcttataactcagactggactactggcgacgacagtgatcaccttgaagaacacgaggagcctgataacgacgatgacttgagacaggaatacctggttcctcagttcggcggcttctcaactactagtaaggttagggaaactctgctaaagagctctagagagctgtttgcgcagttgccatggaccattgtcaacagcgataaagggaacggatccttgaagaatgccgttaacaccgctgttaatgaaaagaccacgaaagaaaatgtgaaatgggttggtaccatggggatccccactgatgaaattcctgatgaaatcgttgaaaacatcgctaaagtgatggaagaacaatacaactgcggggcagttgttactgatgatattaccttcaaaggtgcatacaagaactactgtaaacagattttatggccaactttgcaatatcagattcctgataatccaaagtcaaaggcctttgaagaccactcatggcaatactaccacagactgaaccaacagtttgctgaaaagattattaatgtctataaggatggtgatatcatttggattcacgattatcatttaatgctggttcctggaatggttcgtgaagttttcccagatgctaagataggtttcttcctacacgtatccttcccaagtagcgaagtctttagatgcttggcacatagagaagaaatcttggagggattgatcggtgccaattctctaggttttcaaaccaaggaatatgcaagacacttcttgcagacatctaatagattacttgcagctgatgtttctgatgatgagttaaagtatgatggtagaattgtttctgtaaaacaagtcccagttggtattgattacttcactttaagagagaaactgaaagatgaaaatgtcttgcaatggcgtcatctgattaaggaaagatggcacggtaaaaagctaattgtttgtagggaccaatttgacagaatccgtggactatacaagaaaatgttggcttatgaacggttcttaaaagacaatcctcaatacattgaaaatgtcgtcctggttcaagtctgtattggtaaaagtacggatctagagctggaacgtcaaattatggtagttgttgatagaatcaattcaatgtctccaaatattagtttgattcagcccgtggtattcttacaccaggaattggacttccctcaataccttgcattgaattctgaagccgatttatttatggttaatgctctgcgtgaaggtatgaatttaacctgtcatgaatttattggatgctcatctgataaaaatgcaccattaattttatcggagtttactggtagttcttctgtattgtccgagggtgctatgcttgtgaatccatgggatattaagcaggtagccgcttgcattaaagagggtttggaaatgtccagggaagaaaagaagaggaattggaagaaaatggtcaagagtgttataactcatgactctgatagctggttcgtaagctgtttacagaacttgaataactcatgggaattcaccaaagagagatcaactgttttcaatctcagatttgagactttctctgatgactataatgatactagcaagagattgtttatattcaagatatctgaacctccaaattcaagaatgatatctgtactgaatgaactttcttccaagaatcgtgtctatatcatgaactctttttcaaaagttgttaatgaaagtctatatagtagagtcaacaacattggattgatagctgaaaatggtgccttcgtcagactaaatggtgattggtataatattgtggaagatgttaattggagggcagaagttgttaagatcttggaagataaagttgaacgtctacctgggtcttattacaagatcgcagactctatgattaggttccacaccgaaaatgccgaggatcaagaacgtgtttcaggtgtgatcggtgaagctatcacacatattaatactttatttgatgacgcaggtatacatgcgtacttgcacaaaaacattgtatttgttcaacaaactggtctatcactaaacgcagtcaaatttcttttaaggtattacaatactgctgctagtggagacaatgtcacaccaatgataaactctgaacaatcgccacgcagcagaagtgacagtatttcagtatcccaaaaaccaatcgacttcctttgtatctctggttcttcttcacctgttattgagccattgtttaaactggtgaaggatcaaagaaactcgggaatgctacgtcacggacattccatagtctatggagacacaacatcctcatacgccagggagcatgtaaacggttcgaatggactattcaatgtgcttaacaggttaatgagatcatga

SEQ ID NO: 17263 - protein, 1114 aa, Candida glabrata
MTLIVASLFLPHRPQFEVTASAGETQELIENNLVKLNPLASNEASPQARPNLDNYIRNTRSALNVPFAQGRNVSQESLLSLNNAGNTSGNIDDLVSSEQFLVNLTANATASGTPNPSYHTKGNMGRPNLGAGGSAEEFFSTSNPPSNRGASPVLSIASAPQVQNNLDSTLNNRGSPPPQQLDSQMADPTAHLLKNVSKSLLTQSLHDSTKEASAPMPSSSANSMGQSRYNHANTSIGTAVTPKSRPLPGHSNSSSIIDFSLSRNKQHAPALPALRRIQKNKVGSPTKPSPLNTQPQSSNLKYSKTLHQMHGDSAYNSDWTTGDDSDHLEEHEEPDNDDDLRQEYLVPQFGGFSTTSKVRETLLKSSRELFAQLPWTIVNSDKGNGSLKNAVNTAVNEKTTKENVKWVGTMGIPTDEIPDEIVENIAKVMEEQYNCGAVVTDDITFKGAYKNYCKQILWPTLQYQIPDNPKSKAFEDHSWQYYHRLNQQFAEKIINVYKDGDIIWIHDYHLMLVPGMVREVFPDAKIGFFLHVSFPSSEVFRCLAHREEILEGLIGANSLGFQTKEYARHFLQTSNRLLAADVSDDELKYDGRIVSVKQVPVGIDYFTLREKLKDENVLQWRHLIKERWHGKKLIVCRDQFDRIRGLYKKMLAYERFLKDNPQYIENVVLVQVCIGKSTDLELERQIMVVVDRINSMSPNISLIQPVVFLHQELDFPQYLALNSEADLFMVNALREGMNLTCHEFIGCSSDKNAPLILSEFTGSSSVLSEGAMLVNPWDIKQVAACIKEGLEMSREEKKRNWKKMVKSVITHDSDSWFVSCLQNLNNSWEFTKERSTVFNLRFETFSDDYNDTSKRLFIFKISEPPNSRMISVLNELSSKNRVYIMNSFSKVVNESLYSRVNNIGLIAENGAFVRLNGDWYNIVEDVNWRAEVVKILEDKVERLPGSYYKIADSMIRFHTENAEDQERVSGVIGEAITHINTLFDDAGIHAYLHKNIVFVQQTGLSLNAVKFLLRYYNTAASGDNVTPMINSEQSPRSRSDSISVSQKPIDFLCISGSSSPVIEPLFKLVKDQRNSGMLRHGHSIVYGDTTSSYAREHVNGSNGLFNVLNRLMRS

SEQ ID NO: 17264 - DNA, 2673 bp, Candida glabrata
  CDS (1)..(2673)
atgaccgtgcccgctactaagaaacaaagaatcatcaattgtgtatcgcaattgccatacaagatacaactgggcgaaaccaacgatgactggaagatcacccacgtaacgggtaacagcgccctatactcctccctggactacttgaactacgacttgcaaggagaagtcgaacaccacgttgtcggctggaccggcgaggtcaccagggaagccagcgttcctaacttcactaaggaggacaaggacaagcacgatgccagtgaggaagaccccatgtacttgactaaagagcagattagcggcttgacctctacgctgcaagaccaaatgaaggtcgaggatagcaatagcacagtacacccagtctggctgttgcgcagagaccagagcaggtggagatcctacgcggaaaaggtcatctggcctacttttcactatatcttgaacccttcttctgctaatattcagcaggaaaacaattggtggtacgactacgtcaagttcaatgaggcttacgccaacaaaattgcagaaatttaccaaaagggggacatcatttggattcacgattactacctgctgctacttccacaattgctaagaatgcgttacgaccaggatgtcgccattggctacttccaccacgccccatggccaagtcatgaatacttcagatgcttgccccgtagaaagcaaatcctggacggtttgcttggtgctaacaagatctgcttccaaaacgaatccttctctagacactttgtctcaagttgtaagagactgctggactcctccgctaagaagaccaagaacgctgatggatttgaacaatatcaaattagtgcctatggtggtgatctaattgtcgattctttgccaattggtgtcaacacgaaacaactattgaaggatgcttttaccaaagacattgactcaaaggtgcttgctattaaacaggcttaccaaaataagaagattattatcggtagagaccgtcttgaccctgttcgtggtgtcctacaaaagatgagagccttcgaaacattcttggaaatgtatccttactggagagatcaagtggttttgattcaagttagttctcctactgctaacagaaattccccacaaacaatcaaattggaacaacaggtcaacgaattggtcaactccatcaactcaaagtatggatctttgaacttctctcctgtacaacactactatatgcgtattccaaaggatgtctatctatccttgctgagagttgctgatctatgtttgattaccagtgtcagagatggtatgaacaccacagctcttgaatatgtcactttgaaatcaaacaaatcgtcagcaaatgccttgagttatggtaacccattggtattgtccgaattttcaggtagcagtaccttgctaaaagatgcgattttagtcaatccatgggattcagttgccgttgcaaagtcaatcaatatggcattgaatatgactaaggatgaaaaatctgccttagaagataaattgtggtctgaggtcccaacaattcaagattggactgataagtacctgaagtctttgaaggaaattattcatgatagctctttgggaaccccaagtgccgacaagagaatcactcctgctttgaatagaccaattctgcttgaaaactacaaacaggccaaacgtcgtttattcttatttgactatgatggtactctaactccaatcgttcaagacccagccgctgctattccaacggcaagattgtactcaatcttacaaaagttagctgctgatccaaaaaatcaaatttggatcatttctggtagagatcaaaagttcttgaataaatggctaggatcaaagcttccacaactgggcttaagtgccgagcatggctgtttcatgaaagatattggtaacgaagactgggtaaacttaactgaaaaggttgatatgtcttggcaagccagagttaatgatgtgatggaagatttcaccaggcgtacaccaggctctttcattgaaagaaagaaggttgccctaacatggcattatagaagagccgtaccagaacttggtgaattccatgcaagcgaattgcaaaaggaactactaaagtttaccgatgattctgatttagaggttatggaaggtaaggctaatatcgaagtccgcccaagattcgttaataagggtgaaattgttaaacgtctggtttggcacgaacatggtaagtcacaggacatgttgaagggtatcaacgatacgttacctatcacagaaatgcctgatttcattctgtgtctaggtgatgactttactgacgaagatatgttcagacaactaaacaccattgagtctgtttgggataagaaattccctgatgaccgtaacaactttggtcactttggattctacccagttaccgttggttcagcttctaagaagactgttgccaaagctcacttaactgatcctcaacaagttctagagacacttggtttacttgttggagacgtatctttgttccaaagtgctggtactgttgagctggatgctagaggccacgttaagaacagtgaaagtagtttgaagtcagaacaagcaaccgctcaatatgttttaaagagaacggcatcatctcagaatgttaaaaaggataaataa

SEQ ID NO: 17265 - protein, 890 aa, Candida glabrata
MTVPATKKQRIINCVSQLPYKIQLGETNDDWKITHVTGNSALYSSLDYLNYDLQGEVEHHVVGWTGEVTREASVPNFTKEDKDKHDASEEDPMYLTKEQISGLTSTLQDQMKVEDSNSTVHPVWLLRRDQSRWRSYAEKVIWPTFHYILNPSSANIQQENNWWYDYVKFNEAYANKIAEIYQKGDIIWIHDYYLLLLPQLLRMRYDQDVAIGYFHHAPWPSHEYFRCLPRRKQILDGLLGANKICFQNESFSRHFVSSCKRLLDSSAKKTKNADGFEQYQISAYGGDLIVDSLPIGVNTKQLLKDAFTKDIDSKVLAIKQAYQNKKIIIGRDRLDPVRGVLQKMRAFETFLEMYPYWRDQVVLIQVSSPTANRNSPQTIKLEQQVNELVNSINSKYGSLNFSPVQHYYMRIPKDVYLSLLRVADLCLITSVRDGMNTTALEYVTLKSNKSSANALSYGNPLVLSEFSGSSTLLKDAILVNPWDSVAVAKSINMALNMTKDEKSALEDKLWSEVPTIQDWTDKYLKSLKEIIHDSSLGTPSADKRITPALNRPILLENYKQAKRRLFLFDYDGTLTPIVQDPAAAIPTARLYSILQKLAADPKNQIWIISGRDQKFLNKWLGSKLPQLGLSAEHGCFMKDIGNEDWVNLTEKVDMSWQARVNDVMEDFTRRTPGSFIERKKVALTWHYRRAVPELGEFHASELQKELLKFTDDSDLEVMEGKANIEVRPRFVNKGEIVKRLVWHEHGKSQDMLKGINDTLPITEMPDFILCLGDDFTDEDMFRQLNTIESVWDKKFPDDRNNFGHFGFYPVTVGSASKKTVAKAHLTDPQQVLETLGLLVGDVSLFQSAGTVELDARGHVKNSESSLKSEQATAQYVLKRTASSQNVKKDK

SEQ ID NO: 17266 - DNA, 2013 bp, Cryptococcus neoformans var
  CDS (1)..(2013)
atgacgacaatgtcaaacgacatccctaattcccccacttccacctcgtttacaggtactttctctccagctgccacggctgccaacacggccgccaacgctcgcacctctgatgctccttcccccactacgtcgtcgtctgggcctaagctcgaaaccagcaaagagcagaggttgatcgtcgtgtccaaccgattgccggtgacgattagtaaagatgacaatggggagtatcactttaagatgtcttctggtggactggtttccgctttgagtggatgcaagaagactatgagcttcacctggatcggatggcccggcaaagatatccccatgcaagaccgtgaaaccgtcaatcgccgattgctcgacgaatacaattgttaccccgtttacctttctgatgagcttgctgacagtcactacaatggcagtttctccaactcgatcctttggccattgttccactatcaccccggggagatgaactttgacgctgcccactggctcgcttaccgggaagccaacatgcgtttcgccgacgtcgtttcttccttggtccaagcgggcgacatggtctgggtgcaagactaccacctcatgcttctccccatgttgctccgttctatgatcaccggcgaatctgcacagggtgagatggtccgacaggagcttgggagggtaaaggagggtgtggatgatactgttgtgaaagaggtgctcaagatgggtccgggagtcgcacaggcggaggatgaaggcgtggagatgttggatgatgtagaagaggaaggtggggagatggatgtgaagtctagtcctaagaggcctcattatgcgaggggaatgagtactttccagaaacaagagttggtggcgaaggagaagggtaaagaagggatcaggattggtttctttttgcatactcctttcccgtcaagtgagatttataggatcttgcctgtgcgaagggaaatcttgctcggtgtgcttcagtgtgatcttattggattccacacatatgactatgctcgacacttcctctcatcctgcacccgtatcctcggtctcgagactcagccgaacggtattgaatttgacggccgatattgccaagtcggcaccttccccatcggtatcgaccctaaccagtttatcgaaggtcttcaaaaagaatccattgtcaaacgccttcgttcgttggaagcaaggtttgagggcgtcaaggtcatcatcggtgttgatcgtttggattatatcaaaggtatccctcaaaagctccaagcacttgagactttccttacccagcaccccgagtggatcggcaaagttgtgttggtccagctggcgattccatcccgacaagatgtggaggagtaccaagatttgcgagcttgtgtgaacgaacttgtcggtaggatcaatggtcgtttcggaacggtggagagcgtgccgattcattatatgcacaagagtgtgccgtttgaagagttgacggcaatgtatgcgttggcggatgcttgtttggtgacttcaactagggatggtatgaacttggtggcatacgaatacatttcatcacaggccgagagacatggatctatgatcctctcagagtttgctggtgcagcccaaagtttcaacggtagtcttcttatcaacccttgggacgtccaatctacggccgatgcgatcaatcaagctctcacgttatctcctcagcagagaaagacgaactggcagaaactgttcaactatgtcagcaagtacacagccgaggcttggggcgtctcattcgtcaatgaacttaaccgtctttccggccaacgcccctctggccccactggtcttgctggacgaagaaagtctggaagtttgagcaggacgagcagtaaggccagtatacaaaggagaaagtcttcacagagtggaattgtgactggtctgggtgctgcagcgggagcggctgttaactgggctcaggcgcaggtccagggcgggtctcaaacttag

SEQ ID NO: 17267 - protein, 670 aa, Cryptococcus neoformans var
MTTMSNDIPNSPTSTSFTGTFSPAATAANTAANARTSDAPSPTTSSSGPKLETSKEQRLIVVSNRLPVTISKDDNGEYHFKMSSGGLVSALSGCKKTMSFTWIGWPGKDIPMQDRETVNRRLLDEYNCYPVYLSDELADSHYNGSFSNSILWPLFHYHPGEMNFDAAHWLAYREANMRFADVVSSLVQAGDMVWVQDYHLMLLPMLLRSMITGESAQGEMVRQELGRVKEGVDDTVVKEVLKMGPGVAQAEDEGVEMLDDVEEEGGEMDVKSSPKRPHYARGMSTFQKQELVAKEKGKEGIRIGFFLHTPFPSSEIYRILPVRREILLGVLQCDLIGFHTYDYARHFLSSCTRILGLETQPNGIEFDGRYCQVGTFPIGIDPNQFIEGLQKESIVKRLRSLEARFEGVKVIIGVDRLDYIKGIPQKLQALETFLTQHPEWIGKVVLVQLAIPSRQDVEEYQDLRACVNELVGRINGRFGTVESVPIHYMHKSVPFEELTAMYALADACLVTSTRDGMNLVAYEYISSQAERHGSMILSEFAGAAQSFNGSLLINPWDVQSTADAINQALTLSPQQRKTNWQKLFNYVSKYTAEAWGVSFVNELNRLSGQRPSGPTGLAGRRKSGSLSRTSSKASIQRRKSSQSGIVTGLGAAAGAAVNWAQAQVQGGSQT

SEQ ID NO: 17268 - DNA, 1302 bp, Picrophilus torridus
  CDS (1)..(1302)
atgaaatacctggtagtgaccagccgtgggccattttcacacgaaaaaaagggtaaaaatgaaacgatagaaaataacgttggcggtgttgccacggcattgaaaatgctgttatcaaaaaacggtggcacatgggtatgctggggcagtggttcactggacattaactataaaagtgaaaacttttcaaattacgtaataaaaagaataatattaaattcaaccgagaaaaagaagttttatgatgaatactcaaacggcacgctatggcctgtgtttcattatttcagggacagaacaacattttacaaagatgcttttagatactaccttgaggttaacaggaaatttgccagggaggttattgaaaacattgatgatgatactgttatatggatacacgattaccagctggcaatgctccccgggattctaagggaaagcaatgtaaagaacaaaatcatattcacatggcacataccatgggtaagcccggaattcttttcaataataccggaatccagagaaataataaaaagcatatcaagcagcaattacattacatttcacatagataattaccgcgagaattttataaattcacagagattccttctcggttcatcgacaccttcaagggtctattcaatacctcttggcattgatacaaagtttttctcgcctaaaaatgcaaaaaagattaacaatataaaggcaaagatcatattctcaatagacaggcttgattacacaaagggtttaacgcttagggttcttgccattgaggatcttttgacagagcatcctgaattattaaaaaagtttgtttatataatgaatgtaaccccaagcaggacaacagtaagcgaatacataaacatgaaaaaggagcttgaaatgtcagttggccgggttaatggccgctttggtacaatagactggagaccaataatatacatgtacagaaagataagggataaaacactattatcatattacaaatccgcggacgttgcattaataacgccgcttatagacggtctaaatcttgtaagtaaggagttcgttgccacaacggaaaatggtgttttaataatatcaagatttgcgggcgcatcaaaggaactttcaagcgcaataactgtgaacccttataatataaaggaaactgcaaatgcaataataaaggcacttagcatggatgttaacgagagaaacaatatgatatcaaaacttaaaaacactgttgttaagagggatataaaatggtggtacaggcgtataacagcacttccgaggtaa

SEQ ID NO: 17269 - protein, 433 aa, Picrophilus torridus
MKYLVVTSRGPFSHEKKGKNETIENNVGGVATALKMLLSKNGGTWVCWGSGSLDINYKSENFSNYVIKRIILNSTEKKKFYDEYSNGTLWPVFHYFRDRTTFYKDAFRYYLEVNRKFAREVIENIDDDTVIWIHDYQLAMLPGILRESNVKNKIIFTWHIPWVSPEFFSIIPESREIIKSISSSNYITFHIDNYRENFINSQRFLLGSSTPSRVYSIPLGIDTKFFSPKNAKKINNIKAKIIFSIDRLDYTKGLTLRVLAIEDLLTEHPELLKKFVYIMNVTPSRTTVSEYINMKKELEMSVGRVNGRFGTIDWRPIIYMYRKIRDKTLLSYYKSADVALITPLIDGLNLVSKEFVATTENGVLIISRFAGASKELSSAITVNPYNIKETANAIIKALSMDVNERNNMISKLKNTVVKRDIKWWYRRITALPR

SEQ ID NO: 17270 - DNA, 1482 bp, Rhodopseudomonas palustris
  CDS (1)..(1482)
atgaacctggtcgtggtttcgaaccgagttgcccgagcgtcggggaacgaaccgatgacgggagggctggcagccgcgttgctgccagtggtggaaaaatccggggcgatatgggtcggctcgagcggtcgcgtccgtgatggcgttcaccgcgagccgttcgctgaaatcgaaccgctcggcgctggcgctctcgccatgctggatctgcccgccgcacattacggcggttactacgagggcttcgccaattcggcgctatggcctgcgctgcattcccgcccggatctgatccgggtgtcgcacgacgattatcgctcctatcgcgaagtcaacgccttcatggcgcgggcgctgctgcggttccgcaagccggataccgcgttctggattcaggactatcacttcctcgctttgggcgcggaactgcgtcagctcggcgtccagcatccgatcgggttcttcctgcatacgccatggccgtcgcgggcgacgattggatgcgtaccccatcaccgcgaactgatcgaagcgatgctgacctatgatctgatcgggttccagaccgaagaggatcgccgcaatttcctcggttacgttgaatcggaactcggcctgaagatcgacggcagcgaggtctcgaccacgcacggcaccgcgcgctgcgaggtgttcgcaatcagcatcgacgccgacgcattcgcccaacaagcacagaaggcgatgacccatcccgaagtctcccgcctccgcaagagtctgaacggcgaaaagctcgtaattggcgtcgatcgtctcgattattcgaaggggctgatcaaccgcgtcaaggcgttcgacaagatgttgaccgaccggcctgccttgcagcgggtagtgtcgctgctgcaaatcgcgaccccgtcccgcggcacgatcgaagcttacggcaatctacagggcgatctcgccaagctggtcagcgacgtcaacggccggctcggcgaggtcgactggaccccgatccgctatctcaacaaggggtatcgccagagtgtgctcgcgggcctgtaccgctcggctcatgtcgggttggtcacgccgctgcaagacgggatgaacctggtggccaaggaatacgttgcggcgcagaacccgctcgatcccggcgtgctggtgctgtcgaaattcgccggggccgccaatgagctcgacaccgccctgcaggtcaatccgcacgacatcgagggaatgtcgcgggtgatcgccaccgcgctggcgatgccgctgaccgagcggcggctgcgctgggaggcgatgatggccaagctgcgcgacaacagcatccgccgctggttcgcggacttcctcgccgcgctggaccaagcccacaccgccaatcgcagtgtcggcccgattccgctggcgccgccgccctcgatcatgatggcgggggggcggtcgcggctcgcgccgcgcgctgctggcgcagtgctgcaatag

SEQ ID NO: 17271 - protein, 493 aa, Rhodopseudomonas palustris
MNLVVVSNRVARASGNEPMTGGLAAALLPVVEKSGAIWVGSSGRVRDGVHREPFAEIEPLGAGALAMLDLPAAHYGGYYEGFANSALWPALHSRPDLIRVSHDDYRSYREVNAFMARALLRFRKPDTAFWIQDYHFLALGAELRQLGVQHPIGFFLHTPWPSRATIGCVPHHRELIEAMLTYDLIGFQTEEDRRNFLGYVESELGLKIDGSEVSTTHGTARCEVFAISIDADAFAQQAQKAMTHPEVSRLRKSLNGEKLVIGVDRLDYSKGLINRVKAFDKMLTDRPALQRVVSLLQIATPSRGTIEAYGNLQGDLAKLVSDVNGRLGEVDWTPIRYLNKGYRQSVLAGLYRSAHVGLVTPLQDGMNLVAKEYVAAQNPLDPGVLVLSKFAGAANELDTALQVNPHDIEGMSRVIATALAMPLTERRLRWEAMMAKLRDNSIRRWFADFLAALDQAHTANRSVGPIPLAPPPSIMMAGGRSRLAPRAAGAVLQ

SEQ ID NO: 17272 - DNA, 1440 bp, Corynebacterium diphtheriae
  CDS (1)..(1440)
atgtctgcgatcgaatcgaatgagggcgagcagcttttcgactttgtcgtggttgctaatcggttgcctgttgacttaagcacgtctgctgatgggtcgccgcgttgggtggctagccctggcggtttggtcactgcgttaacgcctgttcttgctggcaaccgtggttgttgggtgggctggcatggcggtactggccctgcccctgatccgtttcgtactgacacgaacatttgggtgcatccggttgcgttgagcgaccatgattttgagggcttttacgagggcttttctaatgccaccctgtggccgttgtaccacgatttgattgtgtcgccggtgtataaccgcgattggtggacggcctaccgtgaggtgaatttgaagtttgcttcggcggttgctgaggttgccgccgagggcgctgtggtgtggattcaggattatcagttacagctggtacctggtattttgcgccagattcgccctgatcttacgatcggctttttcttgcatatcccgttcccgcattcggatttgttccgccagttgccgtggcgcgaggagattgtgcgtgggttgttgggggcggatttggttggtttccatctgacatccagcgcaaataatttcttggatttggctgcggctcttggtttagaggcacagggccgtgcgaaggtccgcgaggttagtgctacggtgacagctggcgacggccatgtggtgagcgtggcggcgtatccgatttccattgatgtggagccgttgattgcttcgcatagtaatcgtgatgagatccgtgctgagtttggctacccagagacgctgattttgggtgtggatcgcctcgattacacgaagggtattttgcagcgtctattggcctttgaggagctgctggaaagcggtgctatcgatccgaataccaccgtgtttgcgcaggtggctacgccttcgcgggagcgtatcgagcattataagcaggctcgttctgaggttgaagaggccgtgggtcgtattaatggccgttttggttccattggtcgttctgtggtgcattatcaccatcgtcacatggatcgtagtgagctgaataagctgtatcgtgccgcggacgttatgctggtcacgccgtttaaagatggtatgaatttggtggccaaggagtatgtgtcttgccacagcgatggttcaggcgcaatggttcttagcgagttcgctggtgccgccgtggagcttgagcaggcatttttgtgtaatccttttgatttggagtcgatcaagcgccagattgctggtgcggtgacaacgctgaagaatcatccggaagctgcacgagatcgtatgctggctatgcatcagcaagtagtcgaccatgatgtgaatgtgtgggcttcggcgtttttgcgtgatcttagtagtgcgcatacgtcgtaa

SEQ ID NO: 17273 - protein, 479 aa, Corynebacterium diphtheriae
MSAIESNEGEQLFDFVVVANRLPVDLSTSADGSPRWVASPGGLVTALTPVLAGNRGCWVGWHGGTGPAPDPFRTDTNIWVHPVALSDHDFEGFYEGFSNATLWPLYHDLIVSPVYNRDWWTAYREVNLKFASAVAEVAAEGAVVWIQDYQLQLVPGILRQIRPDLTIGFFLHIPFPHSDLFRQLPWREEIVRGLLGADLVGFHLTSSANNFLDLAAALGLEAQGRAKVREVSATVTAGDGHVVSVAAYPISIDVEPLIASHSNRDEIRAEFGYPETLILGVDRLDYTKGILQRLLAFEELLESGAIDPNTTVFAQVATPSRERIEHYKQARSEVEEAVGRINGRFGSIGRSVVHYHHRHMDRSELNKLYRAADVMLVTPFKDGMNLVAKEYVSCHSDGSGAMVLSEFAGAAVELEQAFLCNPFDLESIKRQIAGAVTTLKNHPEAARDRMLAMHQQVVDHDVNVWASAFLRDLSSAHTS

SEQ ID NO: 17274 - DNA, 2589 bp, Oryza sativa
  CDS (1)..(2589)
atggtttcaaaatcttattcaaatctgttagaaatgagttgtggagatggagttgactttcggcaaccttttaaatctcttcctcgtgtggtaacctctcctggcattatatctgatcctgattgggacactagaagtgatggcgattcagttggttcagcatcttctgttgagaggaaaataattgttgccaacttccttccactgaactgtacaaaagatgaagctgggcaatggtccttctcaagggatgatgatgcactgctcatgcaacttaaagatggtttttcaaatgagactgatgtcatttatgtgggtagtttgaaggttcaggtagatcccagtgagcaggatcaagttgcacagaagcttcttagagattaccgatgcatacctacttttctccctcctgacctccagcagcagttctatcatggcttctgtaaacagcaattgtggccacttttccactatatgcttcccatttgtcttgacaaaggtgagctctttgatcgctccctgtttcaagcctatgtccgagctaacaaactctttgccgacaaagttatggaagctattaatacggatgatgatcatgtctgggttcatgattatcacctcatgcttctcccaacatttctgaggaagaggttacaccgaataaagctaggattttttctccacagtccatttccctcctcagaaatctacaggtcactgcctgtaagggatgagatcctgaagtcattgcttaatgctgatcttattggtttccaaacatttgactatgcccgccacttcctttcttgttgcagcagattattgggtctgcattatgaatcaaagcgcggttacattggaatagattactttggaagaacagtgagcctgaagatcctctcagtgggtgtccatgttggccgtcttgagtccatcctaaagttgcctgctacagtaaagaaggttcaagaaattgaacaaaggtataaaggcaagatgctcatgttaggtgtagatgacatggacatcttcaaaggaatcagtctaaaactgcttgggttggagctacttctagataggaacccgaaactcagagggaaggttgtccttgtacagattgtcaatccagcaagaagcacagggaaagacgtggaggaagcaataacagaatctgtctctgtagctgaaagaatcaaccttaagtatggctctgtagattacaagcctgttgtccttattgatcatcgcataccattttatgaaaagattgcattctatgctgcatctgattgttgtattgtaaatgctctgagggatggtatgaacttggtaccatatgagtacactgtttgccggcagggaaatgaggagatagataatgccagaggcagtgacacaaattgccatcacacaagcacactaattgtgtctgagtttgttggttgctcaccatctcttagtggtgctttcagggtaaatccttggagtgttgacgatgtggctgatgccttacaccatgcaacagacttgactgaatccgagaaaaggctacggcatgaaaagcactaccgttatgttagatctcatagtgttgcttactgggctcatagctttgctcaagatctggaaagggcatgcaaagatcactacagccgaaggtgctgggctattggttttggtctgaacttcagagttattgctctttctcctggctttagaaagctctctttggaacactttgcttcttcttacaacaaggctaccagaagggcaatatttcttgactatgatggcactcttgtaccccagtcatcaatcaataaagctccaagcgatgaacttattactattctcaacagcttgtgtgatgacccgaagaatgatgtattcatagtcagtggaagagcgcgtagtttgcttgatgagtggtttgctccatgtcagaagcttggtattgcagcagaacatggctattttgtcagatggaacaaagcagctgaatgggaatcaagctatccaaaccatgattttgagtggaagcacatcgctgaaccggtcatgcaagtttacaccgaaacaactgatgggtcctccatagagccaaaggaaagtgctctagtatggcattatttggatgcagaccatgacttcggttcctgccaagcaaaggaactactgggtcatcttgaaagggtgctatcaaatgaacctgttgttgtgaagtgtggtcattacattgttgaagtcaaaccacagggagttagcaagggtcttgttgtggacaaggtaattcacagattgatgaacaacgggaagacgcctgatttcgtagtgtgcatcggtaacgatcgatctgatgaggacatgttcaaaagcatcgacagcatgacctccagctccgcattccctgcagttccagaagtctttgcctgttcagttggtcagaaacccagcaaggcaaagtactatgtcgacgatgctggtgaagtagtaagattgctcaagaatgtagctggcatttcgtcgcaccgggaggccgtcagccatggacgtgtgaccttcagggatgtgatggattatgtggagtga

SEQ ID NO: 17275 - protein, 862 aa, Oryza sativa
MVSKSYSNLLEMSCGDGVDFRQPFKSLPRVVTSPGIISDPDWDTRSDGDSVGSASSVERKIIVANFLPLNCTKDEAGQWSFSRDDDALLMQLKDGFSNETDVIYVGSLKVQVDPSEQDQVAQKLLRDYRCIPTFLPPDLQQQFYHGFCKQQLWPLFHYMLPICLDKGELFDRSLFQAYVRANKLFADKVMEAINTDDDHVWVHDYHLMLLPTFLRKRLHRIKLGFFLHSPFPSSEIYRSLPVRDEILKSLLNADLIGFQTFDYARHFLSCCSRLLGLHYESKRGYIGIDYFGRTVSLKILSVGVHVGRLESILKLPATVKKVQEIEQRYKGKMLMLGVDDMDIFKGISLKLLGLELLLDRNPKLRGKVVLVQIVNPARSTGKDVEEAITESVSVAERINLKYGSVDYKPVVLIDHRIPFYEKIAFYAASDCCIVNALRDGMNLVPYEYTVCRQGNEEIDNARGSDTNCHHTSTLIVSEFVGCSPSLSGAFRVNPWSVDDVADALHHATDLTESEKRLRHEKHYRYVRSHSVAYWAHSFAQDLERACKDHYSRRCWAIGFGLNFRVIALSPGFRKLSLEHFASSYNKATRRAIFLDYDGTLVPQSSINKAPSDELITILNSLCDDPKNDVFIVSGRARSLLDEWFAPCQKLGIAAEHGYFVRWNKAAEWESSYPNHDFEWKHIAEPVMQVYTETTDGSSIEPKESALVWHYLDADHDFGSCQAKELLGHLERVLSNEPVVVKCGHYIVEVKPQGVSKGLVVDKVIHRLMNNGKTPDFVVCIGNDRSDEDMFKSIDSMTSSSAFPAVPEVFACSVGQKPSKAKYYVDDAGEVVRLLKNVAGISSHREAVSHGRVTFRDVMDYVE

SEQ ID NO: 17276 - DNA, 2812 bp, Oryza sativa
  CDS (53)..(2527)
ggtccagttccacgaaaacccaaacggccaaacccctgtgtttgccgtgacgatgccctccctccccaactccggcgacgagggcggcgccccgcctccgactccgccgccgccgggggcgcgccgcgtggtggtcgcccaccgcctccccctccgcgcggatcccaatccgggcgcgccgcacgggttcgacttctccctcgacccgcacgcgctcccgctccagctctcccatggcgtcccccgccccgtcgtcttcgtcggcgtgctcccctccgccgtcgccgaggccgtccaggcgtccgacgagctcgcggccgatctcctcgcgcggttctcatgctacctggtgttcctccccgccaagctccacgccgacttctacgacggcttctgcaagcactacatgtggccgcatctccactatctcctcccgctcgcgccctcctacggcaggggcggcggcctccccttcaacggcgacctctaccgcgccttcctcaccgtcaacacccacttcgccgagcgcgtgttcgagctcctcaaccccgacgaggacctggtgttcgtccacgactaccacctctgggcgttccccaccttcctccgccacaaatccccgcgcgcccgcataggtttcttcctccactctcccttcccctcctccgagctcttccgcgccatccccgtccgcgaggacctcctccgcgccctcctcaacgccgatctcgtgggcttccacaccttcgattacgcgcgccacttcctctccgcgtgctccagggtcctcggcctctccaaccgctcgcgccgcggctacatcgggatcgagtacttcggccgcacggtggtcgtcaagatcctctccgtcggcatcgacatgggccagctccgcgcggttctgccgttgccggagacggtcgccaaggccaacgagattgctgacaagtacaggggacgacagctgatgctcggcgtggacgacatggatttgttcaaggggattgggctcaagctcttggccatggagaggctgctggagtcgcgggcggacttgcgtggccaggtggtcctcgtgcagatcaacaacccggcgcggagccttggccgcgacgtcgacgaggtccgcgcggaggtgctggcgatccgtgaccggatcaatgcccggttcggctgggcggggtacgagccggtggttgtgatcgacggcgccatgccgatgcacgacaaggtggcgttctacacgtccgcggacatctgcatcgtgaatgccgtgcgcgacgggctgaacaggataccgtacttctacaccgtgtgccggcaggagggcccggttcccaccgctcctgccgggaagccgaggcagagcgccatcatcgtgtcagagtttgtcgggtgctcgccgtcgctgagcggcgcgatccgcgtcaacccctggaacgtggacgacgtcgcggacgccatgaacacggcgctgaggatgagcgacggcgagaagcagctgcgccaggagaagcactacaggtacgtgagcacgcacgacgtcgtctactgggcgcagtcgttcgaccaggacctgcagaaggcctgcaaggacaactcgtccatggtgatcctcaacttcggcctcggcatgggcttccgcgtcgtcgcgctcggccccagcttcaagaaactctcacccgagctcattgaccaagcataccgccagactggcaacaggctcatcttactggactacgatggcacagtgatgccacaggggctgatcaacaaggcgcccagtgaggaagtgatccgtactctgaatgaactgtgctctgatccgatgaacaccgttttcgtcgtcagcgggcggggcaaggatgaactggctgaatggtttgcaccatgcgacgagaagctggggatctctgcagagcacggctacttcacaaggtggagcagggattctccctgggagtcatgcaagttggtgacacattttaattggaagaacatcgcagggcctgtaatgaagcactacagtgatgcaaccgatgggtcatacatcgaggttaaagaaacatcactagtgtggcactatgaggaagccgatccggattttggatcatgccaggccaaagagctccaggaccacctgcagaatgtgcttgcgaacgagccagtctttgtgaagagcggccatcagattgtggaagttaatcctcagggtgtgggcaaaggagtcgccgtgcgtaatctcatttcaaccatgggaaatcgtggcagcttgccagatttcatcctctgcgtcggcgatgaccggtcggatgaagacatgttcgaggctatgatcagcccttcgcctgcgttcccggagactgcacagatcttcccctgcactgttggcaacaagccgagcttggccaagtactacctggatgacccggctgatgttgtgaagatgctccagggcctgacggactcgccgacccagcagcaaccgcggccccccgtctcgttcgaaaactcgctagatgattgaaggatcaagaagaggtcgcgtgacatatatgctcgtgagaaagagccccgttcatttcgttcatgattgctttttgtaattagcagaaagagagagagaaaaaatggttttggggggaggtgtgaaaatgggaaaagggcaaaggtgagcaaaaactgactagtgatcgatcggtaggttacagatgttcatgttttacccggtaggcagttcttttgtacaaacgtcaaaagttttttttccctgcctagatcgtcagaagaaacaaaatcatatggttcggtg

SEQ ID NO: 17277 - protein, 824 aa, Oryza sativa
MPSLPNSGDEGGAPPPTPPPPGARRVVVAHRLPLRADPNPGAPHGFDFSLDPHALPLQLSHGVPRPVVFVGVLPSAVAEAVQASDELAADLLARFSCYLVFLPAKLHADFYDGFCKHYMWPHLHYLLPLAPSYGRGGGLPFNGDLYRAFLTVNTHFAERVFELLNPDEDLVFVHDYHLWAFPTFLRHKSPRARIGFFLHSPFPSSELFRAIPVREDLLRALLNADLVGFHTFDYARHFLSACSRVLGLSNRSRRGYIGIEYFGRTVVVKILSVGIDMGQLRAVLPLPETVAKANEIADKYRGRQLMLGVDDMDLFKGIGLKLLAMERLLESRADLRGQVVLVQINNPARSLGRDVDEVRAEVLAIRDRINARFGWAGYEPVVVIDGAMPMHDKVAFYTSADICIVNAVRDGLNRIPYFYTVCRQEGPVPTAPAGKPRQSAIIVSEFVGCSPSLSGAIRVNPWNVDDVADAMNTALRMSDGEKQLRQEKHYRYVSTHDVVYWAQSFDQDLQKACKDNSSMVILNFGLGMGFRVVALGPSFKKLSPELIDQAYRQTGNRLILLDYDGTVMPQGLINKAPSEEVIRTLNELCSDPMNTVFVVSGRGKDELAEWFAPCDEKLGISAEHGYFTRWSRDSPWESCKLVTHFNWKNIAGPVMKHYSDATDGSYIEVKETSLVWHYEEADPDFGSCQAKELQDHLQNVLANEPVFVKSGHQIVEVNPQGVGKGVAVRNLISTMGNRGSLPDFILCVGDDRSDEDMFEAMISPSPAFPETAQIFPCTVGNKPSLAKYYLDDPADVVKMLQGLTDSPTQQQPRPPVSFENSLDD

SEQ ID NO: 17278 - DNA, 2208 bp, Thermoproteus tenax
  CDS (1)..(2208)
atgggaggacaagtgcgcctcatagtggtctccaacagattgcccgtcactatatcgccgagcggcgagataagggagtccgtgggcggccttgcgactgctatgaagtccttcctcggcgccgtgaacgggggcagagagctgggcctcgaggaggtcgtctgggtcggctggtcaggcgtgccctcggagagggagtccaacgatctgagggagcgcctcagagggatgggcctagagcctgtccccctctcgtctgaggaggtcgaggggttctacgagggcttttccaattcgactctctggccgctcttccacggcttctcggagtatgcgacgtatgaggagaagcactggcgcgcctacagaggcgtcaacgagaagtacgccaaagcggtcgtagctctggcgcgccccggcgacctagtgtggatccacgactaccacctcatgttggcgccggcgatagtgagagaggcggcggaggtcggagtgggcttcttcctccacatccccttcccgccggccgagcttctacagctcctgccctccgagtggcggagggagatcttggagggcctcctggggtcggacctcgtcggcttccacacatacgaatactccgcgaatttctccaggagcgtcgtcagattcctgggatacaaagtggagatgggggccatcgcagtgggccacagaagggtgagagttggcgtcttccccataggcatagacttcgatagattctacaattcctcgcaggatccctctgtagtcgaggagatggcgaagctcagagagatgttggggcgcgcgaaggttgtgttctctatagacagacttgactacactaagggcgtcctaaggagggtggccgcgtgggagaggttcttgagggagcaccccgagtggcgcggcagagccgtgttcgtgttggtggtcgtgccctcgaggacgggcgtgcccatgtacgaggaaatgaagaggcagatagacagagaggtcggcagaataaatggggagctgggggagctcaactgggtccctatagtgtacttgtaccgcttcatcccatcgcccaccctcatggcgctgtacaatatagccgacgttgctctgataactccgctgcgcgacggaatgaacttggtggcgaaggagttcgtggcctccaagagggactgccgcggagtgcttatactcagcgaactggccggcgcctccaaggagctggccgaggcgttggtgataaacccaaacgacgtggggggcactgcggaggcgatagcggaggcgctctccatgtcggaggacgagcagtgtaggaggatcagggctatgcaggagaggctgaggatgagggacgtggtcagatggggcaccgacttcatctactccctaatctcggcgaagtcggcccgagaggaggtggagaaggccctcagatatatggaggagctctcggtggacaaactcaagtctgacttcgccaaggccaagaggaggctcttgctcttggactacgacggcacgttggtcccccactatccctacccgcacatggcggttccagacggcgatctgttggagctgttgagccgccttgcggcgctccccgagacggcggtctacgtagtgagcgggaggggcagagactttctggacggctggctcggcagactgccggtcggccttgtggcggagcacggcttcttcctgaaacaccccggaggagaatggaaatcgttggggaaagtcgatccctcatggaggcagtacgccaagggcataatggaggacttcgcctctaatgtccccggaagcttcgtggaggtgaaagaggccgggatagcttggcactaccgcaacgccgatgagacaatcgccgagaaggcagtggtggagttgatcgatgcgttgtccaacgcgctggcgggctcgggcctctcgatattgaggggcaagaaggtggtggaggtgcgcccggctggatacaccaaggggacggcggccaagatgttgcttgacgagctctcgcccgactttgtgttcgtcgcaggcgacgacgagacggacgagggcatgttcgaggtcgcgccccagagcgcctacactgtgaaagtggggcctggcccaactctggccaagttcagagtcggggactacagagggctgaggtctctattggagcagttgcgccccccttag

SEQ ID NO: 17279 - protein, 735 aa, Thermoproteus tenax
MGGQVRLIVVSNRLPVTISPSGEIRESVGGLATAMKSFLGAVNGGRELGLEEVVWVGWSGVPSERESNDLRERLRGMGLEPVPLSSEEVEGFYEGFSNSTLWPLFHGFSEYATYEEKHWRAYRGVNEKYAKAVVALARPGDLVWIHDYHLMLAPAIVREAAEVGVGFFLHIPFPPAELLQLLPSEWRREILEGLLGSDLVGFHTYEYSANFSRSVVRFLGYKVEMGAIAVGHRRVRVGVFPIGIDFDRFYNSSQDPSVVEEMAKLREMLGRAKVVFSIDRLDYTKGVLRRVAAWERFLREHPEWRGRAVFVLVVVPSRTGVPMYEEMKRQIDREVGRINGELGELNWVPIVYLYRFIPSPTLMALYNIADVALITPLRDGMNLVAKEFVASKRDCRGVLILSELAGASKELAEALVINPNDVGGTAEAIAEALSMSEDEQCRRIRAMQERLRMRDVVRWGTDFIYSLISAKSAREEVEKALRYMEELSVDKLKSDFAKAKRRLLLLDYDGTLVPHYPYPHMAVPDGDLLELLSRLAALPETAVYVVSGRGRDFLDGWLGRLPVGLVAEHGFFLKHPGGEWKSLGKVDPSWRQYAKGIMEDFASNVPGSFVEVKEAGIAWHYRNADETIAEKAVVELIDALSNALAGSGLSILRGKKVVEVRPAGYTKGTAAKMLLDELSPDFVFVAGDDETDEGMFEVAPQSAYTVKVGPGPTLAKFRVGDYRGLRSLLEQLRPP

SEQ ID NO: 17280 - DNA, 1479 bp, Mycobacterium paratuberculosis
  CDS (1)..(1479)
atggctcccgggggagggcgaggctcgaagacggccggctacggcaactccgacttcgtcgtggtcgccaaccggctgccggtggatcaggagcggcttcccgacggcagcacggcctggaagcgcagccccggcggcttggtcaccgccctcgaaccgctgctgcgccgccagcgcggggcgtgggtgggctggcccgggatcgtcgacgaggacgtcgaccacgaggacgacccgatcgtccaggacgacctggagcttcggccggtcaagctgagcgccgacgacgtcgccgaatactacgagggcttctccaacgccacgctgtggccgctgtatcacgacgtcatcgtcaaaccgatctaccaccgcgaatggtgggaccgctacgtcgccgtgaaccgccgcttcgccgaggccacctcgcgcgccgccgcgcgcggcgcgaccgtgtgggtgcaggactaccagctgcagctggtgccggcgatgctgcgcgaactgcggcccgacctgaccatcggcttcttcctgcacatcccgttcccgccggtggagctgttcatgcagctgccgtggcggacggagatcgtcaagggcctgctcggcgccgatttggtcgggttccatctgaccggcggcgcccagaatttcctgttcctgtcccggcggttgatcggcgccaacacctcccgcggcgcggtggggatgcggtcacgctacggcgaggtggagctggagtcccgcgtggtccgggtgggcgccttccccatctccatcgactccacggcgctcgaccagacggcccggcaccgcgatatccggcgccgcgcccgcgagatccgggccgagctgggcaacccgcgcaaggtgctgctcggcgtcgaccggctggactacaccaagggcatcgacgttcggctgaaagccttttcggagctgctggccgagggccgcgccaagcgcgacgacaccgtgctggtgcagctggccaccccgagccgggagcgggtggacagttatcagcagctgcgcaacgacatcgaacgccaggtcggccacatcaacggcgagtacggcgaggtcgggcatccggtggtgcactacctgcaccggccggtcccccgcaacgaactcatcgcgttcttcgtggcggccgacgtcatgctggtcacgccgctgcgcgacgggatgaacctggtcgccaaggagtacgtggcctgtcgcagcgacctcggcggggcgctggtgctgtccgaattcaccggcgccgcagccgaactccggcaggcgtatctggtcaacccgcacgacctggagggcgtcaaggacaccgtcgaggccgcgctcaaccaatccgtcgaggagggccggcgccggatgcggtcgttgcgccggcaggtgctcgcgcacgacgtcgaccgctgggcgcgttcgttcctcgacgcgctcgccgagtcggggccgcgtgacggctga

SEQ ID NO: 17281 - protein, 492 aa, Mycobacterium paratuberculosis
MAPGGGRGSKTAGYGNSDFVVVANRLPVDQERLPDGSTAWKRSPGGLVTALEPLLRRQRGAWVGWPGIVDEDVDHEDDPIVQDDLELRPVKLSADDVAEYYEGFSNATLWPLYHDVIVKPIYHREWWDRYVAVNRRFAEATSRAAARGATVWVQDYQLQLVPAMLRELRPDLTIGFFLHIPFPPVELFMQLPWRTEIVKGLLGADLVGFHLTGGAQNFLFLSRRLIGANTSRGAVGMRSRYGEVELESRVVRVGAFPISIDSTALDQTARHRDIRRRAREIRAELGNPRKVLLGVDRLDYTKGIDVRLKAFSELLAEGRAKRDDTVLVQLATPSRERVDSYQQLRNDIERQVGHINGEYGEVGHPVVHYLHRPVPRNELIAFFVAADVMLVTPLRDGMNLVAKEYVACRSDLGGALVLSEFTGAAAELRQAYLVNPHDLEGVKDTVEAALNQSVEEGRRRMRSLRRQVLAHDVDRWARSFLDALAESGPRDG

SEQ ID NO: 17282 - DNA, 1461 bp, Geobacter sulfurreducens
  CDS (1)..(1461)
atgggggagcggatactggtcgtttccaaccgcgaaccctatatccatatccgcacgggcgacaccgtggaggtccatcgtccggccagcggcctggtcaccgccgtggagccggtcatgcgtgcctgctcgggaacctggatcgcccatggcagcggctccgccgaccgggagacggtcgactcccacgaccgggtccgggtgccgccccacaagcctgaatacaatctgcgacggatctggctcaccaaggaagaggaagaggggtactactacggcttcgccaacgaagggctctggcccctctgccatatcgcccacgtacgcccggtgttccgcaccagcgactggcaacagtacgtcaggatcaaccagcggttcgccgacgccgtggtcaaggaggcggacagcgacgatccggttgtgctggtacaggactaccacttcgcgcttctgcccgcgatgatccgcaaggccctgcccaaggccaccatcatcaccttctggcacattccgtggcccaacccggagtcgttcggcatctgcccctggcgggaggaactgctcaaggggatgctggggagcaccattctcggcttccacaccccgtaccattgcaagaacttcctggagacggtggaccgctacctggagacccggatcgagcatgaatcgtccaccatctcccggcgaggccaattgaccatggttgagagttacccaatctccatccagtggccgccggcctggcaggggaccctgccgccggtggacgtgacgcggagcgaaatccttggcgaactggggcttcccctggatcacctgatcggggtcggggttgaccggatggattataccaagggaatcccggagcgattcatggcggtggagcggctgttcgaactgcaccccgaactggtgggacgcttcacctttgtccagatcgccgcgccgagccggtcggccctggaggagtaccaggcgttcgaggcgagggtccattcccacgcggagcggatcaacgggcgtttcagccgcgacgggcgcccggccatcatcctcaaggccgagcaccacgaacccgagcaggtcaaccgttactaccgcgccgccgatgtctgcatggtcaccagcctccacgacggcatgaacctggtggccaaggagtacgtggcggcccgggacgacgagcggggcgccctggtgctgagccagttcaccggcgctgcccacgaactgcatgaggccctgatcgtcaacccctatcatgtggaacagaccgccgaggccctccaccgggccctcaccatgcccgattacgagcagcgggaacggatgcggagcatgcgcatgctggtgcgcgatttcaacgtctaccgctgggccggccggatgctgctggacgcggccagggtccgccagcgggagaaactggccgcccggatcgggggcgagtcgtga

SEQ ID NO: 17283 - protein, 486 aa, Geobacter sulfurreducens
MGERILVVSNREPYIHIRTGDTVEVHRPASGLVTAVEPVMRACSGTWIAHGSGSADRETVDSHDRVRVPPHKPEYNLRRIWLTKEEEEGYYYGFANEGLWPLCHIAHVRPVFRTSDWQQYVRINQRFADAVVKEADSDDPVVLVQDYHFALLPAMIRKALPKATIITFWHIPWPNPESFGICPWREELLKGMLGSTILGFHTPYHCKNFLETVDRYLETRIEHESSTISRRGQLTMVESYPISIQWPPAWQGTLPPVDVTRSEILGELGLPLDHLIGVGVDRMDYTKGIPERFMAVERLFELHPELVGRFTFVQIAAPSRSALEEYQAFEARVHSHAERINGRFSRDGRPAIILKAEHHEPEQVNRYYRAADVCMVTSLHDGMNLVAKEYVAARDDERGALVLSQFTGAAHELHEALIVNPYHVEQTAEALHRALTMPDYEQRERMRSMRMLVRDFNVYRWAGRMLLDAARVRQREKLAARIGGES

SEQ ID NO: 17284 - DNA, 3333 bp, Ashbya gossypii
  CDS (1)..(3333)
atggtggtaatagttgcgtcgttattcttgccatttcaaccacaatttgagattagtacttcgcggacggaggcagcggcactagtggactcacaggtagtgaaaatcccagcgcttggcggtccagcagaaagcgcaaatgtggtgctgaaggccaaacgcgcctcgtcgtcacatggtttgacgtctccgttcgttggaccgacagaacaaaactccgggtctgacgacgttacagatgcgagcaagacaggcgcccgagggggcatcagctcgcagctgctgatggagaatatcacgtccaatgtcaacagcgctgcgggtacgcccggtgcgcagctgggcaaccacgggaatacatccgtggaggaattttttgcttccggggggactgcgagagcgagggatgccgacccgggatcagaggtgtattccacggcgtcgtcgccggcgggggagtcgagctcgagcgtgcagccgggcgctgttttgaacaacgcggactcgaccgcgaacctgcttaagaacgtgaacaaaaagctcctgtaccaatcagtgcttgctggcagcttgtctacttcggcgcttgaggggcacaagagcacgacgagcagcaatgcccacagcactgtgatcacgccacgttcgcggcagctgcccgacgtagccagcagcgtgaccaatgtcccgaagggtaaagctatgcggcagatgcccgtgcggaggttgttgcaccgcaaatcgtcgagcagtatagccactgtgcattcgaatttgaagtaccccctgaatatcaatgactatgacgaggagtctgtggaggaagaagggggacggcagtcgtcattgccgcacatgccatacaaggaggcggaggaacaggagtcgagcgacgaggaggagctcgatctcgatgaaaatgggaaccgtaagaatgctgtgccaaagtttgggggatactcaaacactgcccggatcagggcccagctgatgatgaactcccagaatatcttcaagacagccccgtggaagattgttccaagtagcaaaggcaatggcggcctcaagaacgcgctaaccactgccctggttgagaaaactattgagcaaccagtcacttggatcggcacggtgggcattcctactgatgccgttccgccagatgttctgaaaggcattactgagcagcttgacgaggcgttcgattcgaaggcagtgattacggatgacataacgtttaagagtgcgtaccagaacttctgcaagaagatcctgtggccaactttgaattatcagattccagacaatcctaattcgaaggcatttgaggatcactcgtggaactattaccagcacttaaaccagcaattcgccgacaagattgtggaatcgtacaaagacggtgacttagtttgggttcatgactatcacttaatgcttgttcctgaaatggtacgcaagaagcttccaactgccaaaattggtttcttcctgcacgtttctttccctagcagtgaagtatttagatgttttgcacagcgggaaaagatcctggaagggattctaggtgcacactcgattggtttccaaacggaggagtatgcacggcacttccaacagacggcgaacaggctgctcatgtgcgatgtagccgaccgtattcttagatacaagggccgcattatcgccatagaaagcacacccatcggtgtcgacgcttttgaccttgaggtacagttgaaatctcaagagacacttgaatggaggaggttgatacgcgaacgctgggcaggcaaaaagctaattgttagccgtgaccagtttgaccgaatccgtggtcttcgtaagaagatgctggcctatgaacgcttcttaaagttgaatccagagtacattgatcgggttgtgctgatccaggtgtgcctaggctccggccgtgactccgaaatggagcgcgaggtcatgaccgtggtcgaccggatcaacgccctctcgcgggatatcagcgtatcacagcccgtggtattcttacatcaagatctgcagttccctcaatatcttgcgctcaactgcgaagcagacatgttcctcgttagtaccatgagagagggtatgaacttgacctgtcatgaatttgtgatatgttcacaagagaaaaatgctccattgttgctgtccgagttcacagggagcgcccgcgtgctgggatctggctccctcctgatcaacccatgggacatcaggcaggtagctgacaccatcaaggtcggtctcgaattaagcaaagagcagaggcgccgcaagtggaagcagatgttcaagagcgtgatcatgcatgattcggacaactggatggcctcgtcgcttgcaagcatcaataacagctgggaggccaaccgcgagagatccaaggtattcaatctttctctggataagattctcgacagctacgaaactgcgcggaggcacatcttcatactcaagctttcggagccaccgaccgctcgcatggtgaccgtcctttcggagctctgcacgagaagcgctgtcttcatcattaattctttctcgaggtcgatgctggagcgtctctactgcagggtccccaacatagggctcatcgccgagaatggcgcctttgttcgcctcaacggtatctggtataacatggtccaggacgtttcctggaaggaggacattatcaaggtgatcgaagataaggtcgagcgcctgcctgggtcctactacaaggtgggcgagactatgatccgcttccacaccgaaaacgcagaggaccaggaccgtgtctcgaatgtcgttggcgacgccatcacgcacgtcaacacgctctttggcgacaacggcattcacgcctacgttcataagaacatcgtgttcgtccagcagtccggcctgtccgtgcaggccctcaggttcctgctcaaccactacaactcggtcgacgacacccctggctccacccccgcgcactccccggctgtctcgcccgtcatgaccccggtcaattcctcgctggccatgtctccaagcaccgccgcatctaaaaccccctcggccgcgaccgcaacagccagctactttagcaatggccgttccaccagtcgcgtcgagtttgtctgtgtcactgggacttcatcgccggtcctggagccgctgttccagtctatcaatgaactggccaaaaagggcgacctgccctacggatacactgtcgcctacggcgacgctattaccacatacgctaaagagcacgtcgaaggttccaacgaattatttggcattctagacaaactgaccttcattggctgctga

SEQ ID NO: 17285 - protein, 1110 aa, Ashbya gossypii
MVVIVASLFLPFQPQFEISTSRTEAAALVDSQVVKIPALGGPAESANVVLKAKRASSSHGLTSPFVGPTEQNSGSDDVTDASKTGARGGISSQLLMENITSNVNSAAGTPGAQLGNHGNTSVEEFFASGGTARARDADPGSEVYSTASSPAGESSSSVQPGAVLNNADSTANLLKNVNKKLLYQSVLAGSLSTSALEGHKSTTSSNAHSTVITPRSRQLPDVASSVTNVPKGKAMRQMPVRRLLHRKSSSSIATVHSNLKYPLNINDYDEESVEEEGGRQSSLPHMPYKEAEEQESSDEEELDLDENGNRKNAVPKFGGYSNTARIRAQLMMNSQNIFKTAPWKIVPSSKGNGGLKNALTTALVEKTIEQPVTWIGTVGIPTDAVPPDVLKGITEQLDEAFDSKAVITDDITFKSAYQNFCKKILWPTLNYQIPDNPNSKAFEDHSWNYYQHLNQQFADKIVESYKDGDLVWVHDYHLMLVPEMVRKKLPTAKIGFFLHVSFPSSEVFRCFAQREKILEGILGAHSIGFQTEEYARHFQQTANRLLMCDVADRILRYKGRIIAIESTPIGVDAFDLEVQLKSQETLEWRRLIRERWAGKKLIVSRDQFDRIRGLRKKMLAYERFLKLNPEYIDRVVLIQVCLGSGRDSEMEREVMTVVDRINALSRDISVSQPVVFLHQDLQFPQYLALNCEADMFLVSTMREGMNLTCHEFVICSQEKNAPLLLSEFTGSARVLGSGSLLINPWDIRQVADTIKVGLELSKEQRRRKWKQMFKSVIMHDSDNWMASSLASINNSWEANRERSKVFNLSLDKILDSYETARRHIFILKLSEPPTARMVTVLSELCTRSAVFIINSFSRSMLERLYCRVPNIGLIAENGAFVRLNGIWYNMVQDVSWKEDIIKVIEDKVERLPGSYYKVGETMIRFHTENAEDQDRVSNVVGDAITHVNTLFGDNGIHAYVHKNIVFVQQSGLSVQALRFLLNHYNSVDDTPGSTPAHSPAVSPVMTPVNSSLAMSPSTAASKTPSAATATASYFSNGRSTSRVEFVCVTGTSSPVLEPLFQSINELAKKGDLPYGYTVAYGDAITTYAKEHVEGSNELFGILDKLTFIGC

SEQ ID NO: 17286 - DNA, 1485 bp, Ashbya gossypii
  CDS (1)..(1485)
atgacggaagaagtaaggaaacaggcgcaacagctgactctcgacacgcagcgtagcgaggagcactctggaaatgtggtggtggtctccaaccggctaccggtgacgattaagaaaaatgacagcggcgagtacgagtactccatgtcctctggagggctcgtgacagctctgcaggggctgaagaagtcgacgaagttccagtggtacgggtggcccgggctagagattcccgagggcgacagggagcaggtgcagcgggacctgctggagaagttcaatgcgattccgatcttcctgagcgacgagctggcggatctccattacaacggcttcagcaactcgattctgtggccgctgttccactaccaccccggcgagatcaacttcgacgagaacgcgtggttggcgtacaacgaggcgaaccgggcctttgcggaggccatccagaagaacctccgggatgacgacatcgtgtgggtgcacgactaccacctgatgctgcttccggagctgctgcgcaactacattgcgacggcgaatctacagaatgtaaagctgggatggttcctgcacactccgttcccatcatccgagatatatcgtatattgcctgtgcgtcaggagatcctgcgcggggtcctaagctgcgatctgttagggttccacacttacgactacgcgcgccactttctgtcgtccgtgcaccggatcttaaacgtcaacacgttacccaacggcgtaaagttccagggccgctttgtcaacgtcgcagcattccccatcgggattgacgtgaataacttcacggagggtctgcagaaggaatccgtcgtacaacgggtcaaacagctgaaagagacattcaaagactgtaaaatcattgtgggggtggaccggctggactatgtcaagggtgtaccacacaaactacacgccatagaggtgttcctgaatgagcacccagagtggatcggtaaggtggtccttgtccaggtagcagttcctagtcggggccatgtggaggagtaccagtatctgcgtaacgtcgtcaacgaactggtcggtcgcattaacgggcagtttggcaccgtggaatttgtcccaatccactttatgcacaaatctgtgccatttgaagagctaatttcactgtactccataagtgacgtctgtctggtctcgtcgaccagagacggcatgaaccttgtttcttacgagtacatcgcgtgccaggctgagaacaagggttcgctgatcctctctgaattcacgggtgctgctcaatcactaaacggtgcctttatcgttaatccgtggaacaccgatgagcttgccgaggctattcacgagtcacttaccttaccgatcgagaagcgcgaggcgaattgggagaagctttacaagtatatatccaagtacaccagcagctactggggcgagactttcgtgcacgagttgtacaagctcagctctcagaagtag

SEQ ID NO: 17287 - protein, 494 aa, Ashbya gossypii
MTEEVRKQAQQLTLDTQRSEEHSGNVVVVSNRLPVTIKKNDSGEYEYSMSSGGLVTALQGLKKSTKFQWYGWPGLEIPEGDREQVQRDLLEKFNAIPIFLSDELADLHYNGFSNSILWPLFHYHPGEINFDENAWLAYNEANRAFAEAIQKNLRDDDIVWVHDYHLMLLPELLRNYIATANLQNVKLGWFLHTPFPSSEIYRILPVRQEILRGVLSCDLLGFHTYDYARHFLSSVHRILNVNTLPNGVKFQGRFVNVAAFPIGIDVNNFTEGLQKESVVQRVKQLKETFKDCKIIVGVDRLDYVKGVPHKLHAIEVFLNEHPEWIGKVVLVQVAVPSRGHVEEYQYLRNVVNELVGRINGQFGTVEFVPIHFMHKSVPFEELISLYSISDVCLVSSTRDGMNLVSYEYIACQAENKGSLILSEFTGAAQSLNGAFIVNPWNTDELAEAIHESLTLPIEKREANWEKLYKYISKYTSSYWGETFVHELYKLSSQK

SEQ ID NO: 17288 - DNA, 3498 bp, Oryza sativa
  CDS (176)..(2875)
ttggggctcgtcttcctcgccgctcgctcgctcgcctcctccattttttttttcttctcttcttcttacgaactcgaaacgcgaaaaagggagtagatcagatcaaagacgcggaggaggaggaggaggaggagagctagggtttggatcgggagagagggctagggtttcagccatgatgtcgaggtcgtacacgaacctgctggacctcgcggcggggaacttcgaggcgctggggccggcggggggagggaggaggaggtcgttcggggcgaagcggatgacgcgggtgatgacggtgcccgggacgctgtcggagctggacgacgaggacgacgagccggcggcgacgagcagcgtcgcctccgacgtgccctcgtcggcggcgtgcgagcgcctcatcgtcgtggcgaaccagctccccgtggtggcgcggcggaggccgggcgccgcggcgggggggtgggcgttctcgtgggacgacgactcgctcctcctccgcctccgcgacggcgtccccgacgagatggaggtgctcttcatcggcacgctccgcgccgacgtgcccgcctgcgagcaggacgaggtgtcgcagagcctcatcgatggattcggatgcgcacccgtgttcctccccgcggggctctacgaccgattctaccagcacttctgcaagggttacctatggccgctgttccactacatgctccccttcgcctccgccttgccggcggccgcatccggcgatggccggtttgaccgcggcgcgtgggaggcctacgtgctcgccaacaaatacttcttcgagaaggtggtcgaggtcatcaacccggaggacgactacgtttgggtccacgattaccacctcatggcgctgcccaccttcctccgccgccgcttcaatcgcctccgcatcgggttcttcctccacagcccctttccctcatcggagatctaccgctcgctgcccgtccgagaggagatcctaagaacgctgcttaattgcgatctcattggattccacacattcgattatgcgaggcacttcctatcttgctgtagtaggatgctggggatagagtaccagtcaaagcgtggatacattggattggattactttggccgcactgttggaatcaagatcatgccagtgggaatccatatgggtcaattgcaatcagtgttgcgattgtccgagaaagaaaagaaggttgctgagctgcggcagcaattcgagggcaagtccgtgttacttggtgtggatgatatggatatcttcaagggaatcaacttaaaacttcttgcgtttgagaatatgctgaggacgcatcccaagtggaagggaagagctgtgttggtgcagattgcaaacccagcacgagggaagggaaaggatctggaggctgtccaggctgagattcgggagagttgtgatagaattaacaaggagtttggccagtcaggttacagtccagtgattttcattgaccagagcgtgccaagtgcggtgaggcttgcatattatacggttgctgagtgtgttgtggtgacggctgtgagggatgggatgaatttgaccccatatgaatacattgtctgccgggaggggatacctggctctgagtgtgcaccagaggtgagtggaccaaagaagagcatgttggttgtgtcggagtttattggttgctcaccttcactgagtggagccattcgtgttaacccgtggaatatcgaggcaactgcagaggcactgaatgaggccatctcaatgtcagagcgtgaaaagcagctgaggcacgaaaaacattaccgttatgtcagcacccatgatgttgcatattggtctaagagctttgtacaggacctggagagggcttgcaaggatcactttaggaaaccatgctggggcattggattgggatttggcttcagggtggtagccctagacccacatttcacaaagcttaatttcgattcaattataatgtcctatgagagatcaaagagtagggctatatttctcgactatgatggcacattggtgccacaggcttcgctcaacaagaatccaagtgaagaattactgaggatcattaataccctatgcgcagatagaaataacaccgtgttcattgtcagcgggagaagcaaggatgacttgagcaaaaagcttatctcatgtccaaagctaggcattgccgcagagcatggctacttcttaaggtggactagagatgaagaatggcaaaccactgcacagacctcagattttggatggatgcaaatggcgaagccagtgatggatctttatactgaatcaactgacggatccaccattgagactaaagaaactgcactggtgtggcaccatcaggatgctgaccaaggttttggctcttcccaggcaaaggaaatgcttgatcacttggaaagtgtattagcaaatgaaccagtctcagtcaagagtggccaattcattgttgaagtcaaacctcagggtgttaccaaagggctcatagctgagaaagtactcacatcaatgaaggagaaggggcaactggcagattttgtattatgcattggtgatgacaggtcagatgaggatatgtttgaaaatattgccgatgtcatgaaaaggagcattgttgcaccaaaaactccactgtttgcatgtactgtgggccagaagccaagcaaagctaggttttacctggatgatacatttgaagtcgtcaccatgttgagttcactggcggatgcttcagaaccagaccttatggcagacttggaagatgacttggccacatcagtctcatcaatagaaataagtgacagagtggtatcttttagtaatttaaggacagaaggatcttagtctggtgtttctgcgttgcttttctcgccgaaaaagttctgttggaactgagtgagggagtgttaagcaagatgaaacactgcaagattaaagatgctacagggcaaggaagtcgaattcttgggttcatgattcattttggtgaagatgagggtaagggattaaaacatgtagctgcaaatattctgaagtccggaaagagattacagtttgagtagctcccaaatagcctcattatgcgttttgttacggcggcatttactaccagtcgctgctacgaagattcttatgttcatagctgacctgccatgttctttccatttgaatacttatcccaaggctaagtaggaagcatcggcgtggcagaagtgcatcggtgcaatatgggggaatatgagggtaaatcttgtgacaggttaactgcagcttgtgatttcttgcttgttaacctggttaacagaaatcgtctagtagggaaaaaactagtgatgcttttcgtttacttgtaatgttgtggcaatgtggaggatgacatttgattcattgtttgacagcattatctgtatcatccttatatgtagctaatttatattgagttctttacaattaatcaccacttgctc

SEQ ID NO: 17289 - protein, 899 aa, Oryza sativa
MMSRSYTNLLDLAAGNFEALGPAGGGRRRSFGAKRMTRVMTVPGTLSELDDEDDEPAATSSVASDVPSSAACERLIVVANQLPVVARRRPGAAAGGWAFSWDDDSLLLRLRDGVPDEMEVLFIGTLRADVPACEQDEVSQSLIDGFGCAPVFLPAGLYDRFYQHFCKGYLWPLFHYMLPFASALPAAASGDGRFDRGAWEAYVLANKYFFEKVVEVINPEDDYVWVHDYHLMALPTFLRRRFNRLRIGFFLHSPFPSSEIYRSLPVREEILRTLLNCDLIGFHTFDYARHFLSCCSRMLGIEYQSKRGYIGLDYFGRTVGIKIMPVGIHMGQLQSVLRLSEKEKKVAELRQQFEGKSVLLGVDDMDIFKGINLKLLAFENMLRTHPKWKGRAVLVQIANPARGKGKDLEAVQAEIRESCDRINKEFGQSGYSPVIFIDQSVPSAVRLAYYTVAECVVVTAVRDGMNLTPYEYIVCREGIPGSECAPEVSGPKKSMLVVSEFIGCSPSLSGAIRVNPWNIEATAEALNEAISMSEREKQLRHEKHYRYVSTHDVAYWSKSFVQDLERACKDHFRKPCWGIGLGFGFRVVALDPHFTKLNFDSIIMSYERSKSRAIFLDYDGTLVPQASLNKNPSEELLRIINTLCADRNNTVFIVSGRSKDDLSKKLISCPKLGIAAEHGYFLRWTRDEEWQTTAQTSDFGWMQMAKPVMDLYTESTDGSTIETKETALVWHHQDADQGFGSSQAKEMLDHLESVLANEPVSVKSGQFIVEVKPQGVTKGLIAEKVLTSMKEKGQLADFVLCIGDDRSDEDMFENIADVMKRSIVAPKTPLFACTVGQKPSKARFYLDDTFEVVTMLSSLADASEPDLMADLEDDLATSVSSIEISDRVVSFSNLRTEGS

SEQ ID NO: 17290 - DNA, 3048 bp, Neurospora crassa
  CDS (1)..(3048)
atgacacaaggacaacagcagcagcagcagcagcaccggatcgtgatacccagaccagaagcctcgcgcaccgaatcctcgctcccgggccatttgcgcccctcggtcatcaatgtgcccgtcactccgggcatcagccgcgaggcctacgaagaacagctcaccgacatgctctcaggttccacgggtcctggctactttgagaggcgaattgacgagcacgacattgcccggtctccaggcaccgtcggcctggaggagacaggaagcgtggacaggcagctcgcggtgggtgccgatgccggcaaggactttatgcgccgtctgagcacggccgtcacggactccggcgcggcggccgttgggaaccaggactccctctccgacatccgccacaagttccccaacctgtcgcttagcggaaacatcatctcagccaccttcacaatcccccacctgctcaagtataccaagggcagcggcgaaaacggcaccacgggttcctgggatctaaaaccccgccggggacagtcggcgcttttcgattcgttttcgtacctctcgtctgatgacgccccatggaatcacacggttgtcgcctggactggcgagattgaggaggtcaagtccgcccagcacgccggcaaggcgcctgctaccacggtcggccaaccctcgctcaaccccctttcccgccccgtgcccatcgatggcagcgtcactcctccggcccaccccacggcagacggcctctggatccccaaggaagacatgcacttgctggagcacgacctgtcgcacaaccgcaagatcaagactgtcccagtctggctcgccgacgacatcgagggccatgacgatggcatcaggctgaaggaccaggcccgctggagacgctacgccgagcactccctctacacgcttttccactacaagcagaacgagcccgccgatggccgcgccgaaagaatccagtgggctgactactaccgcatgaaccaaaagttcgccaacaagattctcgaaaactacaagcccggcgacattgtcattgtgcatgactacaacctgatgcttctgcctagcatgttgcgccagcgggctccccacatgtacattgcctttttcctgcattcgcccttccccagttccgagttcttgcgctgccttcccaggagaaaggaagtcctggagggcgtcttgggctccaacctggtcggcttccagagctacagctactcgcgccattttgctagctgctgtacccgcgtccttggcttcccctccgatactaccggcgtcgaggcctacggcacgcgtgttgaagtcggcgtcttccccattggtatcgacgctatcaaggtcgctgccgctgcgtggaagccgtccgccactgcaaagttcgagggactgaagaagatgtacgccggcaagaagctcattgtcggccgtgataagttggatagcgtccgtggcgttccccagaagctcatggcttttgagcgcttcctcgagctctaccctgagtggagggaaaaggtcgttctcatccaggttacctcgcccactaacattgaggaggaaaaggaggattccgagaacaagatctccagccgtgtcaacgagcttgtcatgaagatcaatggcatgtacggctcgcttggcgacactcctgtgcagcattacccccagtacatttcgcaagatgagtactttgctctgctccgtgctgccgatattggcctcatcacctcggtcagagacggcatgaacacgacctcgatggagtacattatctgccagcgtgacaatgctggcccgctcattctctccgagttcagcggtaccgctggctcgctgaaggatgccatccacatcaacccctgggatcttaccgatgtcgccaagcagattaacaatgctctcaccatgtcgcaagagcgccgccaaagtatcgagaagagcttgcttgagcacgtcaccaacaagaacgtccagttctggatcaccggtctcctacgtcgtctgattagtgtcctcgctaacagaaaagacatcatcgccactcccctgctcgatcgcgccaccatgctccgcaagtaccgggcggccaacaagcgtttgttcatgttcgactacgacggcactctcacacccattgtcagggaacctagtgccgccatcccgtcggagcgcgttatcaacagcctcaaggctctggcggccgatccccgcaacgccgtctggatcatttccggccgcgaccaggagttccttcagcagcaccttggccacattaccgagttgggcttcagcgcagagcatggtagtttcatgcggcacccgggctcgacggagtgggagaacctggccgagaagtttgatatgggctggcaggccgaggttctggaagtcttccagaagtacaccgacaagactccaggctccttcattgaacgcaagcgctgtgctctcacctggcactaccgcctcgccgatcccgagcagggtctccacatggctcgcgactgccaaaaggagctcgagaccaccgtcggccgtaagtgggacgtcgaggttatggcgggcaaggccaaccttgaggtgcgtcccacgttcatcaataagggcgagatcgcgaagcgcctcgtcacggagtacaatgccgagctcaaggctcttgctgccaagtcttcggggtcgccagacaaggttgcttccgagaagctcgagtttgtgctctgcatgggtgatgatttcaccgatgaggacatgttccgcagcctgaacgtgctatccggacctggcgaagacgccgagatcaagcccgagaactgcttcactgtcacggtcggcgcaagcaccaaggttacactggctaggtggcacttgttggaacctgaggatgtaattgaatgcgtggccctccttgctggcgttggtggtgctggcgctggtggtgctggcggcgtgctgtccatgggagaggtcaaccttggagcgttgagcacggttgaggatcacattcccgatggccagacgcagtaa

SEQ ID NO: 17291 - protein, 1015 aa, Neurospora crassa
MTQGQQQQQQQHRIVIPRPEASRTESSLPGHLRPSVINVPVTPGISREAYEEQLTDMLSGSTGPGYFERRIDEHDIARSPGTVGLEETGSVDRQLAVGADAGKDFMRRLSTAVTDSGAAAVGNQDSLSDIRHKFPNLSLSGNIISATFTIPHLLKYTKGSGENGTTGSWDLKPRRGQSALFDSFSYLSSDDAPWNHTVVAWTGEIEEVKSAQHAGKAPATTVGQPSLNPLSRPVPIDGSVTPPAHPTADGLWIPKEDMHLLEHDLSHNRKIKTVPVWLADDIEGHDDGIRLKDQARWRRYAEHSLYTLFHYKQNEPADGRAERIQWADYYRMNQKFANKILENYKPGDIVIVHDYNLMLLPSMLRQRAPHMYIAFFLHSPFPSSEFLRCLPRRKEVLEGVLGSNLVGFQSYSYSRHFASCCTRVLGFPSDTTGVEAYGTRVEVGVFPIGIDAIKVAAAAWKPSATAKFEGLKKMYAGKKLIVGRDKLDSVRGVPQKLMAFERFLELYPEWREKVVLIQVTSPTNIEEEKEDSENKISSRVNELVMKINGMYGSLGDTPVQHYPQYISQDEYFALLRAADIGLITSVRDGMNTTSMEYIICQRDNAGPLILSEFSGTAGSLKDAIHINPWDLTDVAKQINNALTMSQERRQSIEKSLLEHVTNKNVQFWITGLLRRLISVLANRKDIIATPLLDRATMLRKYRAANKRLFMFDYDGTLTPIVREPSAAIPSERVINSLKALAADPRNAVWIISGRDQEFLQQHLGHITELGFSAEHGSFMRHPGSTEWENLAEKFDMGWQAEVLEVFQKYTDKTPGSFIERKRCALTWHYRLADPEQGLHMARDCQKELETTVGRKWDVEVMAGKANLEVRPTFINKGEIAKRLVTEYNAELKALAAKSSGSPDKVASEKLEFVLCMGDDFTDEDMFRSLNVLSGPGEDAEIKPENCFTVTVGASTKVTLARWHLLEPEDVIECVALLAGVGGAGAGGAGGVLSMGEVNLGALSTVEDHIPDGQTQ

SEQ ID NO: 17292 - DNA, 1572 bp, Neurospora crassa
  CDS (1)..(1572)
atgcccggtgtcatcgaaccaaccggctccggccgcttgctgctcatctccaaccgtctgcccatcaccatcaagcgcgccgatgacggccaatacaccttctccatgtcctctggcggtctcgtcactggcttgagcggcctggctaagagtacaaagttccaatggtatggatggccaggcttggaagttcccgaggccgaaaccgccggcatgaagcagcgcctgaaggaggaatacgacgccattcccgtattcgttgacgacgagctggctgatcgtcattacaacggctttgcgaactccatcctctggccgctattccactaccaccccggtgagatcacgttcgacgagtccgcctgggctgcttaccgtgaggtcaaccgcttgttcgcaaaggaagttgccaaggatgtacaggacggagatatggtctgggtccacgactatcacatgatgctgcttccccaaatgctgcgcgaggagatcggcgacaccaagaagaacgtcaagattggcttcttccttcacacccccttccccagcagtgagatctaccgcatcctgcccgtccgggaagcgcttctgttgggtatcctcgactgcgacctgattggcttccacacctacgactacgccaggcacttcttgagcagctgttccagaattctccaaacaccaaccacccctaacggtgtcgattataatggcaaatttgtcactgttggtgccttccccattggtatcgatcccgaaaagttcgtcgagggcctcaagaagcagaatgtccagcaacgtattgccgcgctcacacgcaagttcgagggcgtcaagctgattgttggtgtcgaccgtctcgattacatcaagggagtgccgcaaaagctgcacgccctcgaggtcttccttactgagcatcccgagtggattggcaaaattgtgctagtgcaggttgccgtaccaagtcgacaggacgttgaggaatatcagaacctgcgcgccgttgttaatgagcttgtcggtcgcatcaacggcaaattcggcacggtcgagttcatgcccatccacttcctacaccagtccgtctccttcgatgagctcacagccctctatgctgtcagcgacgtctgcttggtcagctccacccgtgacggaatgaacctcgtctcgtacgagtacattgccacacagcgtgaacgtcatggtgtcatgattctgtccgagttcactggcgcagcccaaagcttgaacggaagtctgattgtcaacccttggaacacggaggagctcgcgaatgcgatccacgacgccgttaccatgagtcccgagcagcgcgaggccaactatcgcaagcttgaacgctatgtcttcaagtacaccagcgcctggtggggccagagcttcgttgccgagctgacaaggataagcgcagaggctgaaaagaacgccaatgcgcaaaaagagcagcatcccatccgcgagggtattgccaacgcggccaataaggctattgagggtgtgacggatgccctgaagtcgaccaaccttactggcaatcaagagtcgtga

SEQ ID NO: 17293 - protein, 523 aa, Neurospora crassa
MPGVIEPTGSGRLLLISNRLPITIKRADDGQYTFSMSSGGLVTGLSGLAKSTKFQWYGWPGLEVPEAETAGMKQRLKEEYDAIPVFVDDELADRHYNGFANSILWPLFHYHPGEITFDESAWAAYREVNRLFAKEVAKDVQDGDMVWVHDYHMMLLPQMLREEIGDTKKNVKIGFFLHTPFPSSEIYRILPVREALLLGILDCDLIGFHTYDYARHFLSSCSRILQTPTTPNGVDYNGKFVTVGAFPIGIDPEKFVEGLKKQNVQQRIAALTRKFEGVKLIVGVDRLDYIKGVPQKLHALEVFLTEHPEWIGKIVLVQVAVPSRQDVEEYQNLRAVVNELVGRINGKFGTVEFMPIHFLHQSVSFDELTALYAVSDVCLVSSTRDGMNLVSYEYIATQRERHGVMILSEFTGAAQSLNGSLIVNPWNTEELANAIHDAVTMSPEQREANYRKLERYVFKYTSAWWGQSFVAELTRISAEAEKNANAQKEQHPIREGIANAANKAIEGVTDALKSTNLTGNQES

SEQ ID NO: 17294 - DNA, 2730 bp, Neurospora crassa
  CDS (1)..(2730)
atgactgtgtttattgcctcgctctttcttcccaagaccgttcatttcaacctgcctggtgcccggccaagaggggcttcagcctcccagaagccggccagcaaggccaaaaagctcgcccccaacactcctcctagcctcttccagcctgcgcctagtcacatcactcctccgcacacaccgacggaagaccgcaagcatcatgacccttgggcaaacgaggatgggttgaaggtgcaaattccccaaatgcccttctctcccgatggtagctaccgtgctccaatcgatcgaagctctccgacatggggcggccggccggaccagccgatgtcccgtgcgaactctcccccgcctccttccctgatcaacagcagccgtgctctgaaccagaaggcgagagaaatgggtcgccaaggcatcacgcagccacggagcctcgtgagaagtgaaagccatgatcgagtgttcgcacacgccgactggaagatcgttagcgccgatcagggtaacggtggcttgcgcaacgccgccgaggcagctgccagggacggcaagcttggagagtacacatggattggcaccttgggcatgcccacggacgccctccggggtacccagcagctccaggacatcgatgacagacttgccactgagcacgacatgctggctgttttctgttcggacaaagacttcgacggtcattattcccacttctgcaagcagatcttgtggcccgttttccactaccagattccggacaacccaaagagcaaggcctacgaggatcactcatggaagtactacgtaaacgtcaaccaggcgtttgccgacaagattgttaagaactggaaaaaaggagacacggtctggatccacgattaccacctcctcttggtccctggaatgattaggaagaagattcccgaagccaagattgggttctttctgcacgttgccttcccttcttcggaggtctttagatgtctagctgttcgcaaggagttgcttgaaggcatgctcggcgccaacctcattggattccagatccgtgagtacgccagacatttcctccagacttgcagccgcattctgagcgttgaggccaccccggatggtcttcagctcgaggaccgttttgtcgacgtcatcaacctcccgatcggtattgaccctgttagcctcagccgtcaccgtggtgagagtgaagtcaagcgctggctggacatcatgcgtgagcgctatgcaggcaagaagctcatcgtagcccgtgacaagcttgaccacgtccgcggcgtgcgccagaagctcctctcttacgagatgttcttgaacatgaaccctgagtggagggacaaagtcgttctgattcaggttgccctttcaacaagcgaaaagagcgagttggacgctaccgtttctgacattgtgacccgcgtcaactcttcgtgggccaacttggcatatcaacctgtggtctacctcaagcaggacatcgactacgcccagtaccttgcgttattgagcattgctgatgctctcatgatcaccagtcaacgtgaaggcatgaacctcacatcccatgaataccttttctgccaggatggcaagttcagcgagaagaagcacggctcattgatcctttctgagttcacgggtacttcctcgttgttcaacggaaatgagttgtcggtgaacccttgggactacagggcttgtgcagatgccatcaagaaggctctcgagatggaaggcgaggagaaggagcgccgctggaagaacctatacgaggccgtcaacgttcacaccggctcgcattggttctcagagtttatgctccgcctagataaggtctacgaggagcaacatagccgcgatcagaccgcagtacctcgcctctccatgacgacgttgttgcaacaatacgagcgcactaatcgccgccttttcatcattgactttgagggaacccttgtcagctggggccccgttaatcaaatcattccggttagccctcaacgcaccctggatgttctcaacgatcttctgctcgatgagcgcaacactatctatgttatgtctggtagacgtccagaggagctggaccgtatcttccgccgcgttaccaacctcggcttgatcgccgaaagcggatgctatctcaaggactgcggaagcaacacctggaccgaaatggccgatgccaacaagatccgctcttggaagagttcactccgggacatcatgacctactacttggagcgtacgccgggagcggcgattgaggagcgtcgctgctccttggtgttccactacaagtctgcggatgattacgagacggccgctacacaagcttccgacttggccagccacatcaatgacgcatgcgaggaccaacgcgttcacgctattccaatggacggttgcgtgcttgttgagcccatagattggaccaagagcaccgcggcccagacgatctttgatgatttgcagcaacggatggggccagatgagaagcacaaatccccggttgacttcctcatggtggttggcgacggtcgtgacgacgagaaggtcttcaagtgggccaaccagttgggcactgatggaacagtacaggaggtggtgactgttagccttggcaatagaaacactgaggctaaggcgacggtaacccagggcgttagtggcgttctcgcagctctccagaagctatcccaagtcgtgtaa

SEQ ID NO: 17295 - protein, 909 aa, Neurospora crassa
MTVFIASLFLPKTVHFNLPGARPRGASASQKPASKAKKLAPNTPPSLFQPAPSHITPPHTPTEDRKHHDPWANEDGLKVQIPQMPFSPDGSYRAPIDRSSPTWGGRPDQPMSRANSPPPPSLINSSRALNQKAREMGRQGITQPRSLVRSESHDRVFAHADWKIVSADQGNGGLRNAAEAAARDGKLGEYTWIGTLGMPTDALRGTQQLQDIDDRLATEHDMLAVFCSDKDFDGHYSHFCKQILWPVFHYQIPDNPKSKAYEDHSWKYYVNVNQAFADKIVKNWKKGDTVWIHDYHLLLVPGMIRKKIPEAKIGFFLHVAFPSSEVFRCLAVRKELLEGMLGANLIGFQIREYARHFLQTCSRILSVEATPDGLQLEDRFVDVINLPIGIDPVSLSRHRGESEVKRWLDIMRERYAGKKLIVARDKLDHVRGVRQKLLSYEMFLNMNPEWRDKVVLIQVALSTSEKSELDATVSDIVTRVNSSWANLAYQPVVYLKQDIDYAQYLALLSIADALMITSQREGMNLTSHEYLFCQDGKFSEKKHGSLILSEFTGTSSLFNGNELSVNPWDYRACADAIKKALEMEGEEKERRWKNLYEAVNVHTGSHWFSEFMLRLDKVYEEQHSRDQTAVPRLSMTTLLQQYERTNRRLFIIDFEGTLVSWGPVNQIIPVSPQRTLDVLNDLLLDERNTIYVMSGRRPEELDRIFRRVTNLGLIAESGCYLKDCGSNTWTEMADANKIRSWKSSLRDIMTYYLERTPGAAIEERRCSLVFHYKSADDYETAATQASDLASHINDACEDQRVHAIPMDGCVLVEPIDWTKSTAAQTIFDDLQQRMGPDEKHKSPVDFLMVVGDGRDDEKVFKWANQLGTDGTVQEVVTVSLGNRNTEAKATVTQGVSGVLAALQKLSQVV

SEQ ID NO: 17296 - DNA, 1488 bp, Synechococcus sp
  CDS (1)..(1488)
atgggacagagttcgttcgtcatcctttatcaccgaacgccttttgatgaggcaaaagatgcccaaggcaaccaagtctgggttgatcagaaaagtccaaacggcattatcccaaccctaagaaatctcttcaggtcacggaatgacggcacctggattgcatggcgtcatgttgatcatcctgaagagatggatgttgagcgacttgagatgaccaacccctctcccttcgcgttgtgcaggattccgctagccgacgaacagatatccagtttctatcacatcacctcaaaggaatgcttctggccaatacttcacacctttccgactcatttcaatgtcaacaatgccaattggggcatttttgaggaagtcaacaagcgcttcgctgacgcagcctgtaatgaagccgctgaaggtgccacagtctgggtccatgattacaacctttggctggcgccgggttacatccggcaacagcggccggatttaaaaattgccttctttcatcacactccctttcctggtaacgacgtcttcgccatccttccctggcgcgaacagattttggaaagtctgctctgttgtgatgtcgttggctttcatatcccccgctacaccgagaatttcgcccgtgctgcgagcaccttggtgggcgccaaacgagggccgaagatctctgttgaccagaagttcatctcagtcggcacggctctttcagaaggaacggtgaccagccatctggatcacaacggtcgacgcattcaattgctgagttccccggttgggacctcacccgatgtgatccaggagttgtcctggagtgcatccgttgaaagttatggagagatgatcgtccaggacaccaagaaaggacgcaaactgatcctttctgcaagccgggttgattacaccaaaggcaatgaagagttgctgcttgcctttgaacgcctcctcgaacgccgagaggatcttcatggggaagtagtgctgatgctggcctgcgtggcggccgccagcgggatgaagatttacgaggagacgcagcgctccattgaggaaatggccggacgcatcaatggtcgtttcagtcaggttgattggatcccagtgcgcttctccacgcggcgtattccttacgaagagatggtggcctggttctgccatgcagatgtctgctggatcacaccgcttcgggatggcttgaatcttgtcgccaaggaatacgcagctgcacgtcgccatcgtggcggtgtcctcgtgctttcggaattcaccggtgcgtcggtggtcctggaaggggctgtcctgacaaatccttattccaaccgtcggatggatgaggccatcgaggccgccctggccatgccggaacacgaacaacgccaacgcatggagaccatgtcagccgctgttgaggcttacaccgtgcaggactgggccgaagaacaactggcgggttttccggaagtcgccaccatcggttaa

SEQ ID NO: 17297 - protein, 495 aa, Synechococcus sp
MGQSSFVILYHRTPFDEAKDAQGNQVWVDQKSPNGIIPTLRNLFRSRNDGTWIAWRHVDHPEEMDVERLEMTNPSPFALCRIPLADEQISSFYHITSKECFWPILHTFPTHFNVNNANWGIFEEVNKRFADAACNEAAEGATVWVHDYNLWLAPGYIRQQRPDLKIAFFHHTPFPGNDVFAILPWREQILESLLCCDVVGFHIPRYTENFARAASTLVGAKRGPKISVDQKFISVGTALSEGTVTSHLDHNGRRIQLLSSPVGTSPDVIQELSWSASVESYGEMIVQDTKKGRKLILSASRVDYTKGNEELLLAFERLLERREDLHGEVVLMLACVAAASGMKIYEETQRSIEEMAGRINGRFSQVDWIPVRFSTRRIPYEEMVAWFCHADVCWITPLRDGLNLVAKEYAAARRHRGGVLVLSEFTGASVVLEGAVLTNPYSNRRMDEAIEAALAMPEHEQRQRMETMSAAVEAYTVQDWAEEQLAGFPEVATIG

SEQ ID NO: 17298 - DNA, 1350 bp, Thermus thermophilus
  CDS (1)..(1350)
atggggctcatcatcgtggccaaccgggcgcccttccgcctgacccccgaggggctcgtccccgcggtgggcggactcgccaccgcgcttctcccggtcctggagaggcgccatggcgtctgggtggcggccggggagtggcgggagaagggccaagccgccaccccccgggaaagccaggtccgcctggaacaggtcttcctaccggagaaggagtggcagggctactacggggggttctccaaccgggtcctctggcccctctgccactacttcttggagcgggtggagctcaggcgggacttctaccaggactaccagcgggccaaccgccgcttcgccgagcgggtggcccaggtcttccgcgagggggacacggtcttcgtccaggactaccacctcctcctccttccccgcctcctccgggagaggatcccggcgaaaatcgggttctttttccacatcccctggccctccagcggggtcttccgcatcctgccctggggcagggccttggtggagggcgttctgggggccgacctcatcggcttccacaccccggagtacgtggagaacttcctgaggaccgccgcctactacggctaccaggtggaggaaaaccgggtgcgggtgggggaaaggtgggtgcgggtggaggcccaccccttggggatagacacggggcgcttcggggagctcgcccaggacccccacatcggcctccacgcccgggccctcaagcggctcgcaggggcggagcggctcatcctcggggtggaccggctggactacaccaagggaattttggaaaggctcctcgcctacgaacgcctcctccagtcctacccccagtggcggggccgggtggccttcttccagatcgccaccccaagccgcaccagcgtccacgcctaccgggagctcaagcggcgggtggacgaggtggtggggcggatcatggggagcttcctcagggaggactgggtgcccctccgctacttctaccagacctacacccaagaggagctcgccgccttttaccgggcggcggacgtggccctcatcacccccttgagggacgggatgaacctggtggccatggagtacgcctacaccacggaggacggggtcctggtcctctccaacctggcgggggcggcggagtacctgaaggaggcccttctggtcaacccctacgacctggacgggatggcccaggccctggaccgggccctgcgcatgcccggaggggaacgccgggaaaggctttccgccttgaaggcccgcattgaggccttggacgtgcagggctgggcggagcgcttcctcgcctccttggaggagggatga

SEQ ID NO: 17299 - protein, 449 aa, Thermus thermophilus
MGLIIVANRAPFRLTPEGLVPAVGGLATALLPVLERRHGVWVAAGEWREKGQAATPRESQVRLEQVFLPEKEWQGYYGGFSNRVLWPLCHYFLERVELRRDFYQDYQRANRRFAERVAQVFREGDTVFVQDYHLLLLPRLLRERIPAKIGFFFHIPWPSSGVFRILPWGRALVEGVLGADLIGFHTPEYVENFLRTAAYYGYQVEENRVRVGERWVRVEAHPLGIDTGRFGELAQDPHIGLHARALKRLAGAERLILGVDRLDYTKGILERLLAYERLLQSYPQWRGRVAFFQIATPSRTSVHAYRELKRRVDEVVGRIMGSFLREDWVPLRYFYQTYTQEELAAFYRAADVALITPLRDGMNLVAMEYAYTTEDGVLVLSNLAGAAEYLKEALLVNPYDLDGMAQALDRALRMPGGERRERLSALKARIEALDVQGWAERFLASLEEG

SEQ ID NO: 17300 - DNA, 3862 bp, Caenorhabditis elegans
  CDS (30)..(3722)
ggtttaattacccaagtttgagatcaaaaatgggaagcgaaccaccgccatcagaaaaaaaggttcgagaaccattctctcgagccatgaaagatgtccagattagtgatgaacaacggctcaaagagctctggcatttacttgatctgctggaaattgaatacaaaaagacagcggatctgcatactctcatctcttctgtatccgaatctttgacaatggtctggaaaaggagggatcctaagtcggaattggctctgaaaggacttttacttatcctcgaatactgtctgagtcatgtttttgatggccatgctgtttttgagatttttgtgtcgtcgttgggatttaatacggttatattctggaaacactgcgccggttacattttcgactcggatctgggaagaggtacaaagttccgtgacgcgcttctcttctcccttactctgtacgacgtcaacactggtaaaaatcgattgcgagaactttatgcggcggtacccgggattcgaaagtctctacttggagtgaatgccaaacaatttggagaaaggtatcaccatttacaaaagcgtctggctcgctatggatcacacacttctctatgcagtgtttcaagtgatagtgagggagaggaagccattcacaacgttcgctctggaactcacacagaaagcgaaagcgaggaagacccaaaagctccaagaagcggccttgccacgtcacatttccaacaacgtgtcatcaacgtgtccaacgcaccacctgtttctctaaagcgtgaaaaaaccggcgactgggagatcaagcaaggttccggaggactggtcgcatgtgtggatccagttatgtcgaaggatcacgaaaacttatggttggctaatttgggaatgaacattaatgataaaaaacaaaaaagacccggatcagtagcctccatcccggaatcattcccatcaacgaatactctggggcttccacttattaagcaaacaattgcggaagtgttcttccacgttctcgctgatgacgatatggatgcaccgaagaatgagaaacagaagaaagctcgtgaagaaatgtctcttcttggtgtcctcaacaattacaatcgcggaaactacaagttgaatccggtagttgttcaagaagacgactataacgtttactatggaggcatcagtaacggactactatggcctgcacttcacaatctcccagaatacattgtcagtgagtacgacgacgagaaaattctccgagctcattggtgcgcctatgttcgagtcaattaccaattcgcaattgacgccgtgagaaacagtcggccacaagatttcatctggatccatgactaccatttgatgcttgttggaatgatcatgcagtctttagatcaacatctagaagtcggattcttcttgcacattcccttccagccacctggagagtttttctcaaagtactccactgtgggatttgcggtgctcagagggttgctgaggtttactaaagttggattccaaactcacagggatcgtacaaaatatatagaacttgttcaacattactttggaaccgcgaaaattgtgtatgacaataagatggatatttattccataacaaatgaaggatggacatgctccctcggagtcttcccggtgagcattaagaacgacgatttcttgaaatttgtggatcttcctgaaaccatcaaactcaaaaatgacctccgaaaacgcgtcatgggagacacaccagccccagacggtagattcttcttctcggtcgaaagattcgattacaccaaaggaattatggaaaagcttcaggcctataagaggtatttcgagagacatccagatcgaattggcaaggatgtactttttcaaatcgctgttacaaatcgaagaagtgtggatacgtatcgagtgtatcaggatgaatgtattgatcttgcggataagatcaatgaaatattcaaagatcccaataaccccacatggaaaccattggtcttccaaactgacgggcttccaagaagtgaactagttgctgcctatcttgcaatggacattggtgtagtaactccgaagaaggatggaatgaacctcgtcgccaaagaaatgcttgtctgtaatccgaaagctggactagtactctctacaggtgcaggatctgaaattcagttcactactgctgggctttatagcgataaggagaagaattatcatagaatttccaatgtctttgatccggactcttattgcgatgccttctactcagcggctttggaaccagaggatgtacgagcagagcatggaaagaggcttcacgagtttataatggccaatgatattgagagatggagttgtgcatttttggatccaagttggacacatgaagttatcaggccaactcaggttgaaaccctcgacgacttcttctctctgatgatgaaaactcgcaatgtccgccggcaaattgtgggtcgcgtcctgaaaggaataccaatccgttcccattttgcgatttctctccgcaatgccaaagaatccttggagcagatctgcaaacctggtacccataccgccgaatttaaatctggaccggactcaaaggaagttgctcacttcgagattgataatgaattgcaagagtttgaaagagatttgagttttatcgattatgtgcaaagtgatgatgctgacaatgtggagcagtttgtagatacactcatcagctcacatccaatttcagtggaaacctataagaaggaagttgaaaatgccgttgagctgctctacttctgcttgatcatttccactattttcttcaccgatcgagacggaactttgaaaagttattcgtgcagttatccgtcaagtattcagccagcatattctggagtcattcaggcccaatttgctcgccgctgtgctcaaacctgtgtaattctgactacagctcctctaatgcacatcggtgttcttgatgtgtcaactattccaaatggttattactattttggtgcatccggtggccgtgagtggttcatcgacaatggtcataatttcaaagacgagtcaattttgaaaggagagaaggctgatgtcctagcaagcgcgtacacacgaatctctcacttgctagaggagcccgagttccgtccattcacatgggttggctcaggactacaaaagcattacggtcacttgaccattgcgttccaagacgtctacaagacaatcaccgaggctcaaggaaaacagctacacgaagaaattgagaaaattgtgaaggatgtggatccacatggtacacgtcttcaattggctagcactgaatttgacattaaggtttatatgaagacagaaacagatggtcacgtattcgataagggagatggattaagattgctgtgtgagaaaatgcactgtgatttgacggaaggcaacgtgttggtatgcggagactcttccactgatattcctatgcttaaggaatgtctgattagaaatccaaaaggagtctacacaatttgggttactgtcaatgataaattgaaggaagaggtccgcgctctctgcgcatcctactcaaactccaacgtcgcatttgtctcgtgcccagaggttctgcttggtgccatggcccaagccaccatccgagagataaccatcacaagaacccgcaaaatgtcacgaaatattgtttgaccgcaaaaaatgaaacccaccgactaacatttttctgtctgtataggtctgactaccatttttctatgttttgtatgggttaattaattttttcgcattttccaagaaattttgagctgaaataaaggctttgtgtccca

SEQ ID NO: 17301 - protein, 1230 aa, Caenorhabditis elegans
MGSEPPPSEKKVREPFSRAMKDVQISDEQRLKELWHLLDLLEIEYKKTADLHTLISSVSESLTMVWKRRDPKSELALKGLLLILEYCLSHVFDGHAVFEIFVSSLGFNTVIFWKHCAGYIFDSDLGRGTKFRDALLFSLTLYDVNTGKNRLRELYAAVPGIRKSLLGVNAKQFGERYHHLQKRLARYGSHTSLCSVSSDSEGEEAIHNVRSGTHTESESEEDPKAPRSGLATSHFQQRVINVSNAPPVSLKREKTGDWEIKQGSGGLVACVDPVMSKDHENLWLANLGMNINDKKQKRPGSVASIPESFPSTNTLGLPLIKQTIAEVFFHVLADDDMDAPKNEKQKKAREEMSLLGVLNNYNRGNYKLNPVVVQEDDYNVYYGGISNGLLWPALHNLPEYIVSEYDDEKILRAHWCAYVRVNYQFAIDAVRNSRPQDFIWIHDYHLMLVGMIMQSLDQHLEVGFFLHIPFQPPGEFFSKYSTVGFAVLRGLLRFTKVGFQTHRDRTKYIELVQHYFGTAKIVYDNKMDIYSITNEGWTCSLGVFPVSIKNDDFLKFVDLPETIKLKNDLRKRVMGDTPAPDGRFFFSVERFDYTKGIMEKLQAYKRYFERHPDRIGKDVLFQIAVTNRRSVDTYRVYQDECIDLADKINEIFKDPNNPTWKPLVFQTDGLPRSELVAAYLAMDIGVVTPKKDGMNLVAKEMLVCNPKAGLVLSTGAGSEIQFTTAGLYSDKEKNYHRISNVFDPDSYCDAFYSAALEPEDVRAEHGKRLHEFIMANDIERWSCAFLDPSWTHEVIRPTQVETLDDFFSLMMKTRNVRRQIVGRVLKGIPIRSHFAISLRNAKESLEQICKPGTHTAEFKSGPDSKEVAHFEIDNELQEFERDLSFIDYVQSDDADNVEQFVDTLISSHPISVETYKKEVENAVELLYFCLIISTIFFTDRDGTLKSYSCSYPSSIQPAYSGVIQAQFARRCAQTCVILTTAPLMHIGVLDVSTIPNGYYYFGASGGREWFIDNGHNFKDESILKGEKADVLASAYTRISHLLEEPEFRPFTWVGSGLQKHYGHLTIAFQDVYKTITEAQGKQLHEEIEKIVKDVDPHGTRLQLASTEFDIKVYMKTETDGHVFDKGDGLRLLCEKMHCDLTEGNVLVCGDSSTDIPMLKECLIRNPKGVYTIWVTVNDKLKEEVRALCASYSNSNVAFVSCPEVLLGAMAQATIREITITRTRKMSRNIV

SEQ ID NO: 17302 - DNA, 1590 bp, Magnaporthe grisea
  CDS (1)..(1590)
atgggcagcgttgaagacgagacggcccttccttcgggcggccgacttttgctcatctcaaatcgcctgcccatcaccatcaagcgctcagatgatggccaatacagcttctccatgtcctctggtggtctggtcaccggcctgagtggtctcgccaaaaccacgagctttcaatggtacggatggccgggtctcgaagtcccagacgccgaggccggccctgtcgtgcagaggctgaagaatgaatacggcgcccacccggtgtttgtggacgacgagctcgccgacaggcactacaacgggtttgccaactcgatcctctggccacttttccactaccaccctggagagatcacttttgacgaatcggcgtggtctgcctataaggaggttaacaggctgttcgcccagacagtcgtcaaggatgtgcaggatggcgacatgatttgggtccacgactaccacctgatgctgcttcctgagatgctgcgcgaggagataggggactcgaagaagaacgtcaaaattggattcttcctccacacgcccttcccctcatccgagatatacagaatcctgccagttcgccaggccctgctccagggtgtgctgcactgcgacttgcttgggttccacacatatgattacgcacggcatttcctgagctcatgctcacgtatcttgtctgcgccaacaacccccaacggcgtccaattcgccggtcggtttgtcacagtcggcgccttccccatcggaattgacccggagaagtttgtcgagggtctccaaaaacccaaagtccagcagcgaattgcggctctcactcgcaagttcgagggcgtgaagctcatcgtaggtgtcgacaggcttgactacatcaagggcgtgccgcagaagctgcacgcgctcgaggtcttcctgacggagcacccagagtggatcggcaagatcgtgctcgtgcaggtagcggtgccttcgcgacaggacgtcgaggagtaccagaacctgcgcgccgtggtcaacgagctggttgggcgtatcaacggcaaattcggcaccatcgagttcatgcccatccacttccttcaccagtcggtcagcttcgacgagctcgccgccctgtatgccgtttcggacgtgtgcctggtcagcagcacgcgcgacggcatgaacctcgtcagctacgagtacattgccacccagcgcgaccgccatggtgtcatgatcctgtccgagttcaccggcgctgcgcagtcgctgtctggctcgcttatcgtcaacccctggaacacggaagagctggccaacgccatccacgacgccgtcaccatgggccccgagcagcgcgaggccaacttcaagaagcttgagaggtacgtcttcaagtacaccagcgcatggtggggctccagcttcgtcgccgagctcaataggcttgcagccgggattgaaggtgcggatgcggaaggctcaaagaccaagatcgccatcaggggcgttggcgatgccgttgccgacggcgccggcaaggttgcagacgccgtctcgtcagtcttgccgggtggcgacaacaagacggagggaaactga

SEQ ID NO: 17303 - protein, 529 aa, Magnaporthe grisea
MGSVEDETALPSGGRLLLISNRLPITIKRSDDGQYSFSMSSGGLVTGLSGLAKTTSFQWYGWPGLEVPDAEAGPVVQRLKNEYGAHPVFVDDELADRHYNGFANSILWPLFHYHPGEITFDESAWSAYKEVNRLFAQTVVKDVQDGDMIWVHDYHLMLLPEMLREEIGDSKKNVKIGFFLHTPFPSSEIYRILPVRQALLQGVLHCDLLGFHTYDYARHFLSSCSRILSAPTTPNGVQFAGRFVTVGAFPIGIDPEKFVEGLQKPKVQQRIAALTRKFEGVKLIVGVDRLDYIKGVPQKLHALEVFLTEHPEWIGKIVLVQVAVPSRQDVEEYQNLRAVVNELVGRINGKFGTIEFMPIHFLHQSVSFDELAALYAVSDVCLVSSTRDGMNLVSYEYIATQRDRHGVMILSEFTGAAQSLSGSLIVNPWNTEELANAIHDAVTMGPEQREANFKKLERYVFKYTSAWWGSSFVAELNRLAAGIEGADAEGSKTKIAIRGVGDAVADGAGKVADAVSSVLPGGDNKTEGN

SEQ ID NO: 17304 - DNA, 1485 bp, Bradyrhizobium japonicum
  CDS (1)..(1485)
atgaacaggaggggacgacctgtgaacttagtcgtcgtttcgaatcgtgttgcgcgcggcaaacccaacgagcccatgacgggcggcttggctgcggcattgcttcccgttgtggaacattcgggtgccatctgggtggggtcttccggccgcgtgcgtgacggccatcagaaggagccgtttgccgagatcgaggcgctgggttcgggcgcgattgcgacgctggatctgccggcggcgcattacggcggctattacgaaggttttgccaattcggcgttgtggccggcgctgcattcgcgcagcgatctgatccgcgtttcgcgcgaagactatgtcagctatcgcgaggtcaacgccttcatggcgcgcgccttgatgcgcttccgtaaaccccggaccgcattctgggtgcaggactatcatttcctcgcactcggtgcggagctgcgcgatctcggcgtcgacgatccgatcggcttcttcctgcacacgccgtggccggtggccgcggtgacgcagggcgtacccaatcatcgcgaactgatcacggcgatgctcgcctacgatctcattggcttccagaccgaggaggatcgccagaatttcctcggttatgtcgccggcgagctcggtctcgtcatcgatgatggtgttgtgctgtcgcagcacggccgcacccgctgtgaagtcttccccatcggcatcgatgcggagaagttcgcgcagtatgccgccaagtccgcctcgcatccggatgtgtcgcggctgcgccgcagcctcaacggcgagcgtctggcgatcggtgtcgaccggctcgactattccaagggcctcgtcaaccgcatcagcgcgttcgaccggctctggaccgagcagccgcaattcttgcgcagcatctcgctgctccagatcgccaatccttcgcgcggtgccatcgaggcctatggcaatcttcagaacgaggtcgcgcgtctcgtcaccgacgtcaacggccgccacggcgaggtggactggacgccgatccgctatctcaacaagggcttcagccaggccgtgctcgcggggctctatcgcaccgcgcagatcggtgtggtgacgccgctgcatgacggcatgaacctcgtcgcaaaggagtatgtcgccgcgcagaacccggccgaccccggcgtgctggtgctgtcgaaattcgccggcgcggcgaatgagctcgacacggcgctgctggtcaatccgcacgacatcgacgccatggcacgcgcgatcgcgatcgccgccgcgatgccgctcaccgagcgcaagatgcgctgggacgcgatgatgaagaagctgcgcggccacaccatccagcaatggtccgccgatttcgtcgccgagctcgaaaagtgccggatcgagaaggccgccgtcgccccgctcgcagcccagcccccgcaagcgctgcgctggttgaagtcggcgatctcgggcgtgcggttgatttag

SEQ ID NO: 17305 - protein, 494 aa, Bradyrhizobium japonicum
MNRRGRPVNLVVVSNRVARGKPNEPMTGGLAAALLPVVEHSGAIWVGSSGRVRDGHQKEPFAEIEALGSGAIATLDLPAAHYGGYYEGFANSALWPALHSRSDLIRVSREDYVSYREVNAFMARALMRFRKPRTAFWVQDYHFLALGAELRDLGVDDPIGFFLHTPWPVAAVTQGVPNHRELITAMLAYDLIGFQTEEDRQNFLGYVAGELGLVIDDGVVLSQHGRTRCEVFPIGIDAEKFAQYAAKSASHPDVSRLRRSLNGERLAIGVDRLDYSKGLVNRISAFDRLWTEQPQFLRSISLLQIANPSRGAIEAYGNLQNEVARLVTDVNGRHGEVDWTPIRYLNKGFSQAVLAGLYRTAQIGVVTPLHDGMNLVAKEYVAAQNPADPGVLVLSKFAGAANELDTALLVNPHDIDAMARAIAIAAAMPLTERKMRWDAMMKKLRGHTIQQWSADFVAELEKCRIEKAAVAPLAAQPPQALRWLKSAISGVRLI

SEQ ID NO: 17306 - DNA, 1449 bp, Corynebacterium efficiens
  CDS (1)..(1449)
atggaagaactcaacagtttcgttgtcgttgccaaccgcctcccggtggacatgaccgcccaccccgatggcacctacagcatcacccccagccccggtgggctggtcaccgggttgtccccggtgctggagcagcaccggggatgctgggtcggatggcccggaacggtcgatgtcgcccctgaccccttccgcactgacaccggcatcctcctccaccccgtgcgtctcaccgcgagtgatttcgaggggttctacgaggggttctccaatgccaccctgtggccactgttccatgacctcatcgtgccacctgtctatgacgtcgactggtggcacgatttccgtgaggtcaatctcaagttcgccgaggccgtcaaccaggttgccgcggagaacgccaccgtctgggtgcaggactaccagctgctgctggtgccgggcatcctgcgtcagatgcggcccgacctgtgcatcggtttcttcctgcacatccccttccccaacccggagctgttccggcagttgccctggcgggaggagatcgtccgtggcatgctcggcgcggatctcatcggtttccacctcccccagaatgccgacaacttcctcagtctcacccggcaggtcgccggcaccgccggttcgcacaccggccagcccgatgaactcgaggtggagggtgaggcagccatccgtgaggtcaaagcccatgtgatcaccgccgacggcaggaaggtcggggtcggggcatttcccatctccattgataccggggcggtggagcaggcgtcgcaaagcagcgtggaggcgctacgcgccgacctgggctcaccggagatcgtcttcctcggcgtcgaccgcctcgattacaccaagggcatcctgcagcggctgctggccttcgaggagctgctggaatccggtggacttgatccggcaaccaccgtgtttctgcaggtggccaccccctcccgggaacgcatcgaacactaccgcgtgtcccgatcccaggtcgaggaggccgtgggccgcatcaacggccgcttcggtcgcatgggccatcccgtggtgcactatctccaccggtcactgcccaaggatgacctccagatcctctacacggctgctgatgtaatgctggtcaccccattcaaggacggtatgaacctggtggccaaggaatacgtggccgcccaccgctccgggacgggcgcactcatcctcagtgaattcgccggtgccgccgacgaactgaccgaggcctatctctgcaaccccttcgatctggagtccatcaaacgccagatgctcgctgcggtccacgacctgcgccacaacccggattatgcggccgaacgcatgcgtgccaacagtgagcaggtgctgtcccacgatgtcaatgtgtgggcgagcagcttcctgacctgcctggaggacttcaagtga

SEQ ID NO: 17307 - protein, 482 aa, Corynebacterium efficiens
MEELNSFVVVANRLPVDMTAHPDGTYSITPSPGGLVTGLSPVLEQHRGCWVGWPGTVDVAPDPFRTDTGILLHPVRLTASDFEGFYEGFSNATLWPLFHDLIVPPVYDVDWWHDFREVNLKFAEAVNQVAAENATVWVQDYQLLLVPGILRQMRPDLCIGFFLHIPFPNPELFRQLPWREEIVRGMLGADLIGFHLPQNADNFLSLTRQVAGTAGSHTGQPDELEVEGEAAIREVKAHVITADGRKVGVGAFPISIDTGAVEQASQSSVEALRADLGSPEIVFLGVDRLDYTKGILQRLLAFEELLESGGLDPATTVFLQVATPSRERIEHYRVSRSQVEEAVGRINGRFGRMGHPVVHYLHRSLPKDDLQILYTAADVMLVTPFKDGMNLVAKEYVAAHRSGTGALILSEFAGAADELTEAYLCNPFDLESIKRQMLAAVHDLRHNPDYAAERMRANSEQVLSHDVNVWASSFLTCLEDFK

SEQ ID NO: 17308 - DNA, 2774 bp, Arabidopsis thaliana
  CDS (102)..(2690)
gaaaagaatctttttaggctctctctcgcagacttcgcactcacacactcacttccattgctccaaaaaaacattgtatctacttcacttgctgtagagatatggtatcaagatcttattcaaacctcttggatcttgcttctggtaacttccattcgttttctcgagaaaagaagaggtttccaagagtagcaactgtcactggtgtcttatctgagctagatgatgataacaacagcaacagtgtctgctctgatgctccttcttccgtcacacaagatcgaatcatcatcgttggaaaccagcttcctattaaatcacatcggaactctgctggtaaattgagttttagttgggacaatgactcgcttctcttgcagcttaaagatggtatgcgtgaagatatggaagttgtctacattggttgccttaaggaacagattgatacagttgagcaagatgatgtttctcaaaggttgcttgagaatttcaaatgtgttcctgcttatatcccacctgagctattcactaagtactatcatggattctgtaagcaacatctatggcctttgtttcactacatgcttcccttaactcctgatcttggtggtagatttgatcgttctttatggcaagcttatctttcggttaacaagatctttgctgataaagtgatggaagtgattagtcctgatgatgattttgtttgggttcatgactatcacttaatggttttgcctacatttctaaggaagaggtttaatagagtaaagcttggttttttccttcatagcccgttcccttcctctgagatttaccgtactcttccagtgagaaatgagctcttacgtgcactcctcaacgctgatttgattggctttcatacctttgactatgcaagacacttcctttcttgttgtagcaggatgcttggtttatcctatcagtccaaacgtggaaccatagggcttgagtattatggtcgaacggttagtatcaagattcttcctgtggggattcatatcagccagcttcagtcaattttaaacctcccagagactcagaccaaagttgctgagctaagagatcagttcttggatcagaaagttcttctcggtgttgatgacatggacatcttcaaaggaatcagcctcaaactcttggcaatggaacaacttctcacacagcatcccgagaagagaggtcgagttgtacttgtccagattgcaaaccctgcaagaggtcgtgggaaagacgttcaggaggttcagtctgaaactgaagccacggttaaaaggatcaatgaaatgtttggaaggccgggctaccaacccgtggttctgattgatacaccgcttcaattctttgagaggattgcttactatgtcattgcagagtgttgtcttgttacagcggtaagagatggtatgaatcttataccttatgagtacattatctgcaggcaaggtaatccgaaactcaacgagactataggccttgacccttctgctgcaaagaagagtatgcttgttgtctctgagtttattggttgttctccttctttaagcggcgccattagagtaaatccgtggaacattgatgctgtgactgaagcaatggactatgcattgatagtttcagaagcagagaagcaaatgcgtcacgagaagcatcacaaatatgttagcacacatgatgttgcttattgggcgcgtagctttatacaagatcttgaaagggcttgcggggatcatgtgaggaagaggtgttgggggattggattcgggttaggctttagagttgtggcgcttgatccgagttttaaaaagctttcgattgagcacattgtctcagcttataagagaaccaagaaccgagccattttgttggattatgatggcacaatggtgcagccaggttccattaggacaacaccaacccgcgaaacaatcgaaatcttgaacaacctgtctagtgatcccaagaatatcgtgtacctcgtcagtgggaaagacagaaggacactaactgaatggttttcttcatgtgacgatctcggtttgggtgcagagcacgggtattttataaggccaaatgatggaacagactgggaaacgtcgagtttggtatcaggttttgagtggaaacaaatagcagagccagtgatgagactttacactgagactacagatggatcaacaatagagactaaagagactgctctcgtttggaattaccaattcgcagatcctgattttggatcttgtcaagccaaagagcttatggaacacctcgaaagcgtgcttaccaatgatccagtctctgtcaagactggacaacaactcgttgaagttaaaccacagggtgtgaacaaaggtcttgtggcagagaggcttctaacaacgatgcaagaaaaagggaaacttttggatttcattctctgcgtcggtgatgatcggtctgatgaggatatgtttgaggtgataatgagtgctaaagatggtccagctttgtctcctgtggctgagatattcgcttgcaccgttggacaaaagccaagcaaagcaaaatactatttagacgatactgcggagataatcagaatgctggacggtctagccgctaccaacacaactatctctgatcaaactgattcaaccgccactgttccaactaaagatctgttttaaggatttgtgaacgaaagttttagtgggtttgttgttgtgatttgtgaatgctttttcaaatataatggattaaggtaatcaaat

SEQ ID NO: 17309 - protein, 862 aa, Arabidopsis thaliana
MVSRSYSNLLDLASGNFHSFSREKKRFPRVATVTGVLSELDDDNNSNSVCSDAPSSVTQDRIIIVGNQLPIKSHRNSAGKLSFSWDNDSLLLQLKDGMREDMEVVYIGCLKEQIDTVEQDDVSQRLLENFKCVPAYIPPELFTKYYHGFCKQHLWPLFHYMLPLTPDLGGRFDRSLWQAYLSVNKIFADKVMEVISPDDDFVWVHDYHLMVLPTFLRKRFNRVKLGFFLHSPFPSSEIYRTLPVRNELLRALLNADLIGFHTFDYARHFLSCCSRMLGLSYQSKRGTIGLEYYGRTVSIKILPVGIHISQLQSILNLPETQTKVAELRDQFLDQKVLLGVDDMDIFKGISLKLLAMEQLLTQHPEKRGRVVLVQIANPARGRGKDVQEVQSETEATVKRINEMFGRPGYQPVVLIDTPLQFFERIAYYVIAECCLVTAVRDGMNLIPYEYIICRQGNPKLNETIGLDPSAAKKSMLVVSEFIGCSPSLSGAIRVNPWNIDAVTEAMDYALIVSEAEKQMRHEKHHKYVSTHDVAYWARSFIQDLERACGDHVRKRCWGIGFGLGFRVVALDPSFKKLSIEHIVSAYKRTKNRAILLDYDGTMVQPGSIRTTPTRETIEILNNLSSDPKNIVYLVSGKDRRTLTEWFSSCDDLGLGAEHGYFIRPNDGTDWETSSLVSGFEWKQIAEPVMRLYTETTDGSTIETKETALVWNYQFADPDFGSCQAKELMEHLESVLTNDPVSVKTGQQLVEVKPQGVNKGLVAERLLTTMQEKGKLLDFILCVGDDRSDEDMFEVIMSAKDGPALSPVAEIFACTVGQKPSKAKYYLDDTAEIIRMLDGLAATNTTISDQTDSTATVPTKDLF

SEQ ID NO: 17310 - DNA, 2583 bp, Oryza sativa
  CDS (1)..(2583)
atggtttctcggtcctactccaacctgctggacctggccaccggcgcggcggaccaggcgccggcgccggcggcgctcggcgcgctccggcggcggctgccgcgggtggtgaccaccgcggggctcatcgacgactccccgctgtccccctcgacgccgtccccgtcgccgcggccgcgcaccatcgtggtcgccaaccacctccctatccgggctcaccgcccggcgtcgccgtcggagccgtggaccttctcctgggacgaggactccctcctccgccacctccagcactcgtcctcctcccccgccatggagttcatctacatcggctgcctccgcgacgacatcccgctggccgaccaggacgccgtcgcgcaggcgctcctcgagtcgtacaactgcgtgccggcgttcctgccccccgacatcgccgagcgctactaccatggcttctgcaagcagcatctgtggccgctgttccactacatgctgccgctctcccccgacctcggcggccgcttcgaccgcgcgctgtggcagtcgtacgtgtcggcgaacaagatcttcgcggacaaggtgctcgaggtgatcaacccggacgacgacttcgtgtgggtgcacgactaccacctcatggtgctcccaaccttcctccgcaagcgcttcaaccgcatcaagctcggcttcttcctccactcgccgttcccctcgtcggagatctacaagacgctccccgtccgggaggagctcctgcgcgcgctgctcaactccgacctcatcggcttccacaccttcgactacgcgcgccacttcctctcctgctgcggccggatgctggggctctcctacgagtccaagcgtggccacatctgcttggagtactacggccggacggtgagcatcaagatcctcccggtgggggtgaacatggggcagctcaagacggtgctcgcgttgccggagacggaggcgaaggtggcagagctgatggcgacttactccgggaaggggagggtcgtcatgctgggcgtcgacgacatggacatcttcaaggggatcagcctcaagctgctcgccatggaggagctgctgcggcagcaccccgagtggcgcggcaagctggtgctcgtccaggtcgcgaacccggcgcgcggccgcggcaaggacgtcgacgaggtgaagggggagacgtacgccatggtgcggcggatcaacgaggcgtacggcgcgcccgggtacgagccggtggtgctcatcgacgagccgctccagttctacgagcgcgtggcgtactacgtcgtcgccgaggtgtgcctggtgaccgcggtccgcgacggcatgaacctgatcccctacgagtacatcgtgtccaggcagggcaacgaggcgctcgacaggatgctgcagccgagcaagccggaggagaagaagagcatgctggtggtgtccgagttcatcgggtgctcgccgtcgctgagcggcgcggtgagggtgaacccgtggaacatcgaggccgtggcggacgccatggagagcgcgctcgtgctgccggagaaggagaagcggatgcgccacgacaagcactaccgctacgtggacacccacgacgtgggctactgggcgaccagcttcctgcaggacctcgagaggacgtgcaaggatcacgcgcagcggcggtgctggggcatcggcttcgggctgcggttcagggtggtgtcgcttgacctcagcttcaggaagctcgccatggagcacattgtcatggcgtaccggagggcgaagacgcgcgccatcctgctcgactacgacggcacgctcatgccgcaggcgatcaacaagagcccgagcgccaattccgtcgaaacgctgaccagcttgtgcagggacaagagcaacaaggttttcctctgcagcgggttcgagaagggaacactccatgactggttcccctgcgagaaccttggcttggcggctgagcacggttacttcctgaggtcatcgagggatgcagagtgggagatttccattccccccgcggactgcagctggaagcagatcgcggagccggtgatgtgcctgtacagggagaccacggacggctcgatcatcgagaacagggagacggtgctcgtctggaactacgaggacgcagaccctgacttcggttcatgccaagccaaggagctcgtcgaccacctcgagagcgtgctcgccaacgagcccgtctcggtgaagagcaccggccattccgttgaggtcaagccacagggcgtgagcaagggcctggtggcgcggcggctgctggcgagcatgcaggagaggggcatgtgcaccgacttcgtgctgtgcatcggggacgaccgctccgacgaggaaatgttccagatgatcacaagctccacctgcggcgagtcgctggcggccacggcggaggtcttcgcctgcaccgtcggccgcaagccgagcaaggccaagtactacctcgacgacacggcggaggtcgtcaggctgatgcagggcttggcctccgtctccaacgagctggctcgggcggcgagccccccggaggacgacgacgaatga

SEQ ID NO: 17311 - protein, 860 aa, Oryza sativa
MVSRSYSNLLDLATGAADQAPAPAALGALRRRLPRVVTTAGLIDDSPLSPSTPSPSPRPRTIVVANHLPIRAHRPASPSEPWTFSWDEDSLLRHLQHSSSSPAMEFIYIGCLRDDIPLADQDAVAQALLESYNCVPAFLPPDIAERYYHGFCKQHLWPLFHYMLPLSPDLGGRFDRALWQSYVSANKIFADKVLEVINPDDDFVWVHDYHLMVLPTFLRKRFNRIKLGFFLHSPFPSSEIYKTLPVREELLRALLNSDLIGFHTFDYARHFLSCCGRMLGLSYESKRGHICLEYYGRTVSIKILPVGVNMGQLKTVLALPETEAKVAELMATYSGKGRVVMLGVDDMDIFKGISLKLLAMEELLRQHPEWRGKLVLVQVANPARGRGKDVDEVKGETYAMVRRINEAYGAPGYEPVVLIDEPLQFYERVAYYVVAEVCLVTAVRDGMNLIPYEYIVSRQGNEALDRMLQPSKPEEKKSMLVVSEFIGCSPSLSGAVRVNPWNIEAVADAMESALVLPEKEKRMRHDKHYRYVDTHDVGYWATSFLQDLERTCKDHAQRRCWGIGFGLRFRVVSLDLSFRKLAMEHIVMAYRRAKTRAILLDYDGTLMPQAINKSPSANSVETLTSLCRDKSNKVFLCSGFEKGTLHDWFPCENLGLAAEHGYFLRSSRDAEWEISIPPADCSWKQIAEPVMCLYRETTDGSIIENRETVLVWNYEDADPDFGSCQAKELVDHLESVLANEPVSVKSTGHSVEVKPQGVSKGLVARRLLASMQERGMCTDFVLCIGDDRSDEEMFQMITSSTCGESLAATAEVFACTVGRKPSKAKYYLDDTAEVVRLMQGLASVSNELARAASPPEDDDE

SEQ ID NO: 17312 - DNA, 1458 bp, Corynebacterium glutamicum
  CDS (1)..(1458)
atggatgattccaatagctttgtagttgttgctaaccgtctgccagtggatatgactgtccacccagatggtagctatagcatctcccccagccccggtggccttgtcacggggctttcccccgttctggaacaacatcgtggatgttgggtcggatggcctggaactgtagatgttgcacccgaaccatttcgaacagatacgggtgttttgctgcaccctgttgtcctcactgcaagtgactatgaaggcttctacgagggcttttcaaacgcaacgctgtggcctcttttccacgatctgattgttactccggtgtacaacaccgattggtggcatgcgtttcgggaggtaaacctcaagttcgctgaagccgtgagccaagtggcggcacacggtgccactgtgtgggtgcaggactatcagctgttgctggttcctggcattttgcgccagatgcgccctgatttgaagatcggtttcttcctccacattcccttcccttcccctgatctgttccgtcagctgccgtggcgtgaagagattgttcgaggcatgctgggcgcagatttggtgggattccatttggttcaaaacgcagaaaacttccttgcgttaacccagcaggttgccggcactgccgggtctcatgtgggtcagccggacaccttgcaggtcagtggtgaagcattggtgcgtgagattggcgctcatgttgaaaccgctgacggaaggcgagttagcgtcggggcgttcccgatctcgattgatgttgaaatgtttggggaggcgtcgaaaagcgccgttcttgatcttttaaaaacgctcgacgagccggaaaccgtattcctgggcgttgaccgactggactacaccaagggcattttgcagcgcctgcttgcgtttgaggaactgctggaatccggcgcgttggaggccgacaaagctgtgttgctgcaggtcgcgacgccttcgcgtgagcgcattgatcactatcgtgtgtcgcgttcgcaggtcgaggaagccgtcggccgtatcaatggtcgtttcggtcgcatggggcgtcccgtggtgcattatctacacaggtcattgagcaaaaatgatctccaggtgctgtataccgcagccgatgtcatgctggttacgccttttaaagacggtatgaacttggtggctaaagaattcgtggccaaccaccgcgacggcactggtgctttggtgctgtccgaatttgccggcgcggccactgagctgaccggtgcgtatttatgcaacccatttgatgtggaatccatcaaacggcaaatggtggcagctgtccatgatttgaagcacaatccggaatctgcggcaacgcgaatgaaaacgaacagcgagcaggtctatacccacgacgtcaacgtgtgggctaatagtttcctggattgtttggcacagtcgggagaaaactcatga

SEQ ID NO: 17313 - protein, 485 aa, Corynebacterium glutamicum
MDDSNSFVVVANRLPVDMTVHPDGSYSISPSPGGLVTGLSPVLEQHRGCWVGWPGTVDVAPEPFRTDTGVLLHPVVLTASDYEGFYEGFSNATLWPLFHDLIVTPVYNTDWWHAFREVNLKFAEAVSQVAAHGATVWVQDYQLLLVPGILRQMRPDLKIGFFLHIPFPSPDLFRQLPWREEIVRGMLGADLVGFHLVQNAENFLALTQQVAGTAGSHVGQPDTLQVSGEALVREIGAHVETADGRRVSVGAFPISIDVEMFGEASKSAVLDLLKTLDEPETVFLGVDRLDYTKGILQRLLAFEELLESGALEADKAVLLQVATPSRERIDHYRVSRSQVEEAVGRINGRFGRMGRPVVHYLHRSLSKNDLQVLYTAADVMLVTPFKDGMNLVAKEFVANHRDGTGALVLSEFAGAATELTGAYLCNPFDVESIKRQMVAAVHDLKHNPESAATRMKTNSEQVYTHDVNVWANSFLDCLAQSGENS

SEQ ID NO: 17314 - DNA, 2358 bp, Xanthomonas campestris
  CDS (1)..(2358)
atgactgatcaaaccagactcccgaacacctcatccctgacccacccccgcccggatcctgccgtgatcctggccaccgacctggatggcaccttcctggccggctctgcagaacaccgtcaccagctgtatcgcctggtcgaccagcatcccgaaatccgcctgatcttcattaccgggcgcggactcgaagcggtgatgcccttgctcaccgaccccaccattccccggcccgactatgtggtgtgcgacgtgggtgccaccgtggtggacggccacacgctgcaaccgttgcagcccctgcaatcgatgatcgacgcgcactggcccggcgagcaggtggtggcgcaggcgatgcgcgcattcccgcaattgcagcgccaggacatgccgcaggagcgccgctgctcgtatttctgcgatccgcacacgctggcgccgctgcgtgcgcagatcgagcagaccgcgcgcgcgcttggttgcgacgtgctgtattcggccgaccgctatctggacattctgccgcccgataccgacaagggccgcaccctgggcgcgttggcacgccagctggagctgccgcgcgagcgcatcctggtggccggcgacacgctcaacgatctctccatgtatctggccggtttccgcggcgtctgcgtgggcgattcggaagcggccttgacgcaggccactgcgcagttggatgcgacctatcacgccagtgcgcccgggtgcggcggcatcctggaggcgattgcgcacttcggcctgcttgccgacgacgacccgcacgtgccggcggtgcaggccccgcgcaagggcggcgccgagctggtgatggtctatcaccgcctgccgtatgacgaagtggtcgagcacggcgagctggtgcgccgcgcgccgcgctcgcccaacggcatcattccctcgctgctgagcttcttcgaaggtggccagcgcggctcgtgggtggcctggagcgtggacgaccccaagcgcgggccgttccagacccacaccgaggtggatgcgcagcgctacccgacgctcaccgccgcacgcgtgccgctgagcaagagcgaggtggacatcttctacaagcggttttccaaggaagcgttctggccgatgctgcatgtgttctgggaacgcgcgcgcttccgcgaggacgactggcaggtatttcttgcagtcaaccgcaagtttgcacaggccacctcggccgaggccgcgcacggcgccacggtctggatccatgactacaacctgtggatggtgccggcgtacctgcgcgagctgcgcccggatctgaagatcgcgttcttccatcacacctacttcccctcggctgacgtgttcaatgtggtgccatggcgccgcgagatcatcggtagcctgatgtgctgcgattacgtgggcttccatatcccgcgccaggtggagaacttcgtggacgtggtgcgcggcgtgatgccggtggaacgactggcgcaggaaagctgcgcgccacggtttctcacctatggctgcgcggtgggcctggacaccatgaccacctgcctgcgtgttgccgatcgcgacgtggcgctgggcgcgcatccggtgggcaccgacctgcgccgcattcgcgccgcgctgagcaagccggacgtgcgcaacgacatcttcaagctgcgccgcgagatcggtgcgcgcaagctggtgttgtcggtggagcggctggattacaccaagggcacgctggcgaaactggaggcgttcgagcgcctgctcgacagccagcggcagctgctgggcaaggtcaccttgctgatggtgtgcgtgccggcggcgcgcgagatgaccatctaccgcaccttgcagacgcagatcgaacaggcggtgggccgcatcaacgggcggttctcgcggctggactggacgccggtgcgcttcttcgcacaggccctgccgttcgagcaggtggtggcgcattacgccgccgcgcaggtgatgtggatcacgccgctgcgcgatggcttgaatctggtggccaaggagttcgtggcggtgcaaggcatcgaaggcggcagcggcgtgctggtgctgagcgaatttgccggcgcggctgcagaactcaaaggcgcggtactgaccaacccgcacgacccggccgatctggcggccggcctgttgcaggcactggcgatgcccgatgacgaggcggccgggcgcctgcggcagctgtacgacagcgtggagtactacaacatcgaccactgggggcgcgacttcctggacgcggtggcacgtagccgtggcgcgcatgcccgtgtgcccttggcggcggccagcacggtggccgagccggtcgcctag

SEQ ID NO: 17315 - protein, 785 aa, Xanthomonas campestris
MTDQTRLPNTSSLTHPRPDPAVILATDLDGTFLAGSAEHRHQLYRLVDQHPEIRLIFITGRGLEAVMPLLTDPTIPRPDYVVCDVGATVVDGHTLQPLQPLQSMIDAHWPGEQVVAQAMRAFPQLQRQDMPQERRCSYFCDPHTLAPLRAQIEQTARALGCDVLYSADRYLDILPPDTDKGRTLGALARQLELPRERILVAGDTLNDLSMYLAGFRGVCVGDSEAALTQATAQLDATYHASAPGCGGILEAIAHFGLLADDDPHVPAVQAPRKGGAELVMVYHRLPYDEVVEHGELVRRAPRSPNGIIPSLLSFFEGGQRGSWVAWSVDDPKRGPFQTHTEVDAQRYPTLTAARVPLSKSEVDIFYKRFSKEAFWPMLHVFWERARFREDDWQVFLAVNRKFAQATSAEAAHGATVWIHDYNLWMVPAYLRELRPDLKIAFFHHTYFPSADVFNVVPWRREIIGSLMCCDYVGFHIPRQVENFVDVVRGVMPVERLAQESCAPRFLTYGCAVGLDTMTTCLRVADRDVALGAHPVGTDLRRIRAALSKPDVRNDIFKLRREIGARKLVLSVERLDYTKGTLAKLEAFERLLDSQRQLLGKVTLLMVCVPAAREMTIYRTLQTQIEQAVGRINGRFSRLDWTPVRFFAQALPFEQVVAHYAAAQVMWITPLRDGLNLVAKEFVAVQGIEGGSGVLVLSEFAGAAAELKGAVLTNPHDPADLAAGLLQALAMPDDEAAGRLRQLYDSVEYYNIDHWGRDFLDAVARSRGAHARVPLAAASTVAEPVA

SEQ ID NO: 17316 - DNA, 1368 bp, Xanthomonas axonopodis
  CDS (1)..(1368)
atgagtcgtttggtggtggtatccaaccgcgttgcggtgcccggcgagaaccgcgccggtggcttggcggttggcttgttggcggcgctcaaggagcgcggcggtgtgtggtttggctggagcggcaagaccgtgcgcggcgacagcggcggcatgcacgagcagaccgaaggcgacatcaccttcgtcaccatggacctcaacaagcgcgacatcgattcgtactacaacggcttcgccaatcgcacgctgtggccattactgcacttccgcctggacctggtcgattacgaccgcgccacgcgcgaaggctacatgcgcgtcaatcggctgtttgccgaaaaactcgcgccgctgctgaaagacagcgacacgctgtggatccacgactaccacatgattccgctcggcgcgatgctgcgcgagctgggcgtgggctgcaagatgggcttcttcctgcacgtgccgatgccgtcggccgatctggtgcaggccatgcccgatcatgcgcgtttgttcagtaccttctacgcatacgacctggtcggcttccagacccagcgcgatgccgaacgtttcaaggcctatgtgcgcctattcggcggtggccgcattctggaaggcgatctggtggaaggcccgggtgggcgccgcttcaccgcctcttcgttcccgatcgggatcgataccgacctgattgcccaccaggccaaggcctctgccggcaagcaggcggtgcgtgatctgcgcgaaagcctgcgtggccgtcagttggccatcggtgtggaccgcctggattattccaagggattgccggagcgctttcagggtttcgagcgctacctggagcggtatccggatcaatccggcagcctgacctacctgcaaattgcgccggtttcgcgcggcgatgtcaccgaataccgtcaattgcgcagccagctcgaacagatcgccggccacatcaacggcggacatgcagagccggactggacgccgctgcgctacgtcaaccagaacttcagccatgccacgctgacaggcttctatcgtgcggcctcggtgtgtctggtcacgccattgcgcgacggcatgaacctggttgccaaggaattcgtggccgcgcaggatccggcagacccgggtgtgctggtgttgtcgctgtttgcaggtgcagccgacgaaatgaaggaagcgttgctggtcaacccgcacgatctggatggcgtggccgacgcgatcgccacagcggcaagcatgccgctggcaagccgcatcgaacgctggcacgcgatgatggatcacctgcgcaagaacaacatcaaccactggcgccagcgctatctgcaagcgctctctgaggtgtag

SEQ ID NO: 17317 - protein, 455 aa, Xanthomonas axonopodis
MSRLVVVSNRVAVPGENRAGGLAVGLLAALKERGGVWFGWSGKTVRGDSGGMHEQTEGDITFVTMDLNKRDIDSYYNGFANRTLWPLLHFRLDLVDYDRATREGYMRVNRLFAEKLAPLLKDSDTLWIHDYHMIPLGAMLRELGVGCKMGFFLHVPMPSADLVQAMPDHARLFSTFYAYDLVGFQTQRDAERFKAYVRLFGGGRILEGDLVEGPGGRRFTASSFPIGIDTDLIAHQAKASAGKQAVRDLRESLRGRQLAIGVDRLDYSKGLPERFQGFERYLERYPDQSGSLTYLQIAPVSRGDVTEYRQLRSQLEQIAGHINGGHAEPDWTPLRYVNQNFSHATLTGFYRAASVCLVTPLRDGMNLVAKEFVAAQDPADPGVLVLSLFAGAADEMKEALLVNPHDLDGVADAIATAASMPLASRIERWHAMMDHLRKNNINHWRQRYLQALSEV

SEQ ID NO: 17318 - DNA, 2574 bp, Solanum tuberosum
  CDS (1)..(2574)
atgatgtctagatcgtataccaatcttttggatttggcatctgggaattttccagtaatgggaagagagagggataggcgacggatgtcgcgggtaatgacagttcctgggagtatatgtgaactggatgatgaccaggctgttagtgtttcttctgataatcaatcttcacttgctggtgatcggatgattgttgtggcaaatcagttgccattgaaagcgaaaaggagaccggataataagggctggagttttagttggaatgaggattctttgcttttgagacttaaggatggtttacctgaagatatggaagtattgtttgttgggtctttatctgttgatgttgatccaattgaacaggatgatgtttctagctatcttttggataaattcagatgtgtgccaacgtttcttccacctaatatcgtggaaaaatactatgagggattctgcaagaggcatttgtggccactttttcactacatgttaccattttcacctgaccatggaggccgctttgatcgttctatgtgggaagcatatgtttctgccaacaagatgttttcacagaaagtggttgaggtgcttaatcctgaggatgattttgtttggattcatgattatcatttgatggtgttgcccacgttcttgagaaggcggttcaatcgattgaggattgggtttttccttcacagtccatttccttcatctgagatttacaggacacttcctgttagagaggaaatacttaaggctcttctatgttctgaccttgttggattccacactttcgactatgctcgacatttcctttcgtgttgcagtcgaatgttgggtttagagtaccagtctaaaagaggttatataggattggaatattatggaaggacagtaggtatcaagattatgccagtagggatacatatgggtcatattgagtctatgaagaaaattgcagataaagagctgaagtttaaggagctcaaacaacaatttgaaggaaaaactgttctgcttggagttgatgacttggatattttcaaaggtatcaacttaaagcttctagcaatggagcacatgctcaaacagcaccccagttggcaagggcaggctgtgcttgttcagattgccaatcctatgaggggtaaaggaatagatttagaggaaatacaggctgagatacaggaaagctgcaagaggattaataagcaatttggcaagcctggatatgagcctatagtttatattgataggtccgtgtccagtagcgagcgtatggcttattatagtgttgctgaatgtgttgttgtcacagctgttagggatgggatgaacctgactccatatgaatacatcgtttgtcgacagggtgtatcgggtgcagaaacagattcaggtgtaggtgaacctgacaagagcatgctagttgtgtcagaattcattgggtgttctccttccttaagtggggcaatccgtattaatccatggaatgttgaggcaactgctgaggcaatgaatgaggctgtgtcaatggctgaacaagagaaacagctacgacatgagaagcattaccgttatgtcagcacccacgatgttgcttattggtcgagaagtttcttgcaagatatggagagaacttgtgctgatcactttaggaaaagatgctatggcattggtttaggctttgggtttagagttgtttccctagatcccaacttcaggaagctgtcaattgatgatattgtgaatgcttatatcaagtctaagagcagggccatattcctggactatgacggaactgtgatgccgcagaattctatcattaagtctcctagtgctaatgttatctccatcctgaataaactttctggtgatccaaacaacaccgtcttcattgttagtggaagagggagggaaagcctaaccaagtggttttctccttgtagaaaactaggacttgcagcagaacatggctactttttgagatgggaacgagaacagaaatgggaagtatgcagtcagacctctgattttgggtggatgcaacttgctgaacccgtgatgcaatcctatacagacgctacagatggttcttgcatagaaagaaaggaaagtgctatagtgtggcagtatcgtgatgcggattctggatttgggttttctcaggcaaaggagatgcttgatcatctggagagtgttttagcgaatgaaccggttgccgtgaaaagcggtcagcacattgtggaagtgaagcctcagggggtcaccaaaggtttagttgcagaaaaagtctttacatctttagcagtgaaaggaaaactggcggattttgtgctttgcattggtgatgatagatcagatgaagatatgtttgaaatcattggcgatgctttgtccagaaatattatttcatatgatgccaaggtatttgcttgcacagttggacaaaaacctagcaaagcaaagtattacttggatgacacatctgaggtggtgcttatgctagactcccttgctgatgccactgatactccagtgacttccgatgatgaacctgtggactccgactga

SEQ ID NO: 17319 - protein, 857 aa, Solanum tuberosum
MMSRSYTNLLDLASGNFPVMGRERDRRRMSRVMTVPGSICELDDDQAVSVSSDNQSSLAGDRMIVVANQLPLKAKRRPDNKGWSFSWNEDSLLLRLKDGLPEDMEVLFVGSLSVDVDPIEQDDVSSYLLDKFRCVPTFLPPNIVEKYYEGFCKRHLWPLFHYMLPFSPDHGGRFDRSMWEAYVSANKMFSQKVVEVLNPEDDFVWIHDYHLMVLPTFLRRRFNRLRIGFFLHSPFPSSEIYRTLPVREEILKALLCSDLVGFHTFDYARHFLSCCSRMLGLEYQSKRGYIGLEYYGRTVGIKIMPVGIHMGHIESMKKIADKELKFKELKQQFEGKTVLLGVDDLDIFKGINLKLLAMEHMLKQHPSWQGQAVLVQIANPMRGKGIDLEEIQAEIQESCKRINKQFGKPGYEPIVYIDRSVSSSERMAYYSVAECVVVTAVRDGMNLTPYEYIVCRQGVSGAETDSGVGEPDKSMLVVSEFIGCSPSLSGAIRINPWNVEATAEAMNEAVSMAEQEKQLRHEKHYRYVSTHDVAYWSRSFLQDMERTCADHFRKRCYGIGLGFGFRVVSLDPNFRKLSIDDIVNAYIKSKSRAIFLDYDGTVMPQNSIIKSPSANVISILNKLSGDPNNTVFIVSGRGRESLTKWFSPCRKLGLAAEHGYFLRWEREQKWEVCSQTSDFGWMQLAEPVMQSYTDATDGSCIERKESAIVWQYRDADSGFGFSQAKEMLDHLESVLANEPVAVKSGQHIVEVKPQGVTKGLVAEKVFTSLAVKGKLADFVLCIGDDRSDEDMFEIIGDALSRNIISYDAKVFACTVGQKPSKAKYYLDDTSEVVLMLDSLADATDTPVTSDDEPVDSD

SEQ ID NO: 17320 - DNA, 1380 bp, Encephalitozoon cuniculi
  CDS (1)..(1380)
atgaagcttttggttgtcagcaatcgcctacctctgacagtaaagaagagcaaggacggttttgagtacacaaagacaagcggggggctcgtaaccggtctgagaggcatcagcgataagatcaggttcatgtggttaggaaacataagtggtgttgagctggatgaagaggagaagaaggtgataagaaaagactgctgggaaaagttccattcgattcctgtgttcatcgaccctgtgctcaacagcaactcctacgacggcttctgcaacgccattctgtggccaataatccattcgttcaaggacgatgttgcattcaccatcaaggactacaatgcatatgtcgagtacaacacaatcttctgcgaggagatatgcaagattgtggaggacggcgatatcgtctgggtccacgactaccacttgatgatactccctgaaatgctgaggaagaagtcagataagagcttcaagatcatgtttttcctccacgcccagtttccgccggcagagataatggagactcttgcatgcaggagagagatagtgagcggcatggcacacagcgatctcattgcattccactcgtttgactacgcaatcaacttcgacgacacgtgcagggcaaacaaggtagaggtaaggtcgaagctggatgcaattccaataggaatcgatccagcgatgttccgaagcgcccttaaggaagagaagacggtggaaaggatcaaagagctccgggagatgtttagaggaagaaagattcttctgggagtggacaggacggactacataaaggggatgccacaccgtgttaagggattccaaaggtttctcgaaaagcatcctgagtttcttgacaacgtggtgttcctgcaggtcggcgttcccagcagaacaagtgtcaaggagtactcttcgtacatcaccaagatgaatgagcttgtgtcagaaacaaacagcaagttcggatccatcgagtctgtgcacctgtacttcctgaacaagagtgtggacttcaatgagctgtgtgccctgtatgcagtaagcgacatgcttcttgtgacatctcttcaggatggaatgaaccttgttgctctggagtacatttcatgccagaacgaaaataacggggtgcttctgctcagtagcaatgcaggggcgtccacgacattgcctgctgcagtggaagtgaattcgtggaacactgaagagattgcagacgggatccacagggcaatcacgatgtctctagaagagagaaccgaaagacatgagatcaacaggaaggctgttgataccttcacgtctgtggaatgggcagagaagaacctcgacgggctctgcgacgattggagggaatcactgatgctctaa

SEQ ID NO: 17321 - protein, 459 aa, Encephalitozoon cuniculi
MKLLVVSNRLPLTVKKSKDGFEYTKTSGGLVTGLRGISDKIRFMWLGNISGVELDEEEKKVIRKDCWEKFHSIPVFIDPVLNSNSYDGFCNAILWPIIHSFKDDVAFTIKDYNAYVEYNTIFCEEICKIVEDGDIVWVHDYHLMILPEMLRKKSDKSFKIMFFLHAQFPPAEIMETLACRREIVSGMAHSDLIAFHSFDYAINFDDTCRANKVEVRSKLDAIPIGIDPAMFRSALKEEKTVERIKELREMFRGRKILLGVDRTDYIKGMPHRVKGFQRFLEKHPEFLDNVVFLQVGVPSRTSVKEYSSYITKMNELVSETNSKFGSIESVHLYFLNKSVDFNELCALYAVSDMLLVTSLQDGMNLVALEYISCQNENNGVLLLSSNAGASTTLPAAVEVNSWNTEEIADGIHRAITMSLEERTERHEINRKAVDTFTSVEWAEKNLDGLCDDWRESLML

SEQ ID NO: 17322 - DNA, 1398 bp, Ralstonia solanacearum
  CDS (1)..(1398)
atgagccggctgatcgtggtctccaaccgcgtggcgcccatcgccgagggccaggcgagcgccggcgggctggcggtcggcgtgtacgacgcgctgcgcgataccggcggcgtgtggttcggctggagcggcgagatcgcgccgggcgcgtcgggcgagccgtccatcgccgccaagggcgccatcaccttcgccaccgtgggcctgagccgccgcgactacgaccagtactaccgcggcttcgccaatgccacgctgtggccggtgttccactaccgcgtcgatctggcgcgctacgagcgccaggagtaccacggctaccggcgcgtcaacacgcagttcgcgcatcagctcaaggcgctggtgcagcccgacgacatcctgtgggtgcacgactatcacctgatcccgttcgcagccgaatgccgggcgctggggctgcgcaaccgcatcggtttcttcctgcacattccgtttccgtcgccggagatcctgacgacgatcccgccgcacgaagagctgatgcgcgcgctgtgcgcctacgacctgctcggcttccagaccgagaccgatcgcgtcgccttctacgactacatcgaacgcgaggcgcgcggctacatcgagaacaaggagcacaacgggccggtgcacgcctacggcaacacgctgcgcgccgaggtctacccgatcggcgtgcatccggacgagatcgcgcggcaggcggtgtcgtcgctggcgcggcgcaatccgttcgcgcgcgaggccgatgcgagcggcggccgcccgctcaagctcatcatgagcgtggaccggctggactattccaagggcctgcccgaacgcttccgcgcgttcgagcagttgctggacgattttcccgaccaccggcggcacgtgaccttcgttcagatcgcgccgacctcgcggcaggatgtgcagagctaccagcagatccgccagcggctggaggccgaatcgggccgcatcaacggcaagcattcggaactggactggacaccgatccgctacatcaacaagcagtacgaccggcgcatgctgatggcgctgttccgcgcctcgcacatcggctatgtcacgccgctgcgcgacggcatgaacctggtggccaaggaatacgtggcggcgcaggacccggaggcgccgggcgtgctggtgctgtcgcgcttcgcgggcgcggcgcgcgagctcgatgccgcgctgatcgtcaatccgtatgacacgcgcggcatggccgaggcgctcaaccgcgcgctgacgatgccgctcgaagagcgcaaggcgcgccacgcccacatgatggaccggctgcgcgcggccgacctcacggcatggcgcgaacgctttctggccgatctgcgcggcgcatcggcccgctag

SEQ ID NO: 17323 - protein, 465 aa, Ralstonia solanacearum
MSRLIVVSNRVAPIAEGQASAGGLAVGVYDALRDTGGVWFGWSGEIAPGASGEPSIAAKGAITFATVGLSRRDYDQYYRGFANATLWPVFHYRVDLARYERQEYHGYRRVNTQFAHQLKALVQPDDILWVHDYHLIPFAAECRALGLRNRIGFFLHIPFPSPEILTTIPPHEELMRALCAYDLLGFQTETDRVAFYDYIEREARGYIENKEHNGPVHAYGNTLRAEVYPIGVHPDEIARQAVSSLARRNPFAREADASGGRPLKLIMSVDRLDYSKGLPERFRAFEQLLDDFPDHRRHVTFVQIAPTSRQDVQSYQQIRQRLEAESGRINGKHSELDWTPIRYINKQYDRRMLMALFRASHIGYVTPLRDGMNLVAKEYVAAQDPEAPGVLVLSRFAGAARELDAALIVNPYDTRGMAEALNRALTMPLEERKARHAHMMDRLRAADLTAWRERFLADLRGASAR

SEQ ID NO: 17324 - DNA, 1674 bp, Ralstonia solanacearum
  CDS (1)..(1674)
atgcgcccgattatttccacgccagccggcacgtcttccctggcgatccccgacacgcccggtgccgacgaagcccaacgcgccgatcctttccaaccggccagccggccgcgctcgcgccacccgcaattcgagcgattgccgtcgccgcccgttcgcacgcgctcacaggagttgcgcgccgcgcgcttgcggcgctgcgcctccgacgtttcggccacgcccgaggcgcggccgcggctggtcgtggtgtccaaccgcctgatcgatccgcagaggcccgccgccggcgggctcgccgtcgcgctgggcgacatgatgcgcgacaccgacggactatggttcggctggagcggcaagacggtcgacgaacccgacacggcctgcgtgcggaccgagccgttcgggcgcacgacgctggcccaggtcgatctcggccggaccgattacgagggctactacgcggggttctcgaattcggtgctctggcccatcttccacgagcgggtgaaatgggcggatttgaatccggcgtacttcaaggcgtacgaggccgtgaaccggatacttgcgtcccatctgcggcccatgctcagggacagcgacatcctgtgggtccacgactaccatctcatcccgttcgcgcaggcgctgcgcgcgctcggctgcacgcagcgcatgggtttcttcaaccatattccgctgccgtcgcccgacgtcatccggcgcattccgcagcatcggcaactgatgcgggccctggcgtcgtacgacctggtcggcatgcagagcccccgggatgtgctcaacctccagcggtactgggacgcggagaacatcgccgcgcagtccgagcgccgccatgacagcgtccacgccttcccgatcggcatcgatgtcgaaagcctgcgcgcgctggtgccgagccccgcgtcccaggccgtcatcgatgaagtccgcggtgcggccggcaggtgcgtgctgatgatcggcgtcgatcggctggattacagcaagggcatcccgacgcgcctgaaagcgtttcgccaattgctgcagacgcatgcccgcatgcggagcaaggtcacgctggtccagatcgccgcgccgacgcggcaaagcattcccgcctacgccaggctgcgcgacaagaccgagcagctggtgcgggagatcaaccgccggttcggcaccggcgactggacaccggtgatgtatttcagcgagtcggtggaccgcaccgccttgccgcagctgtaccggatgagccgggtcggcgtggtcacgcccgttgcggacggcatgaacctcgtcgccaaggaatacgtcgccgcgcaggccgccagggaccccggcgtcctggtgctgtccaggggcgcgggcgccgcgtcgcaactgcgcgacgcgctgctggttccctcgaaaaaccgggccgccaccgccgatgcctacgcgcaggccctgtccatgccgctcgaagagcgcaaggcgcggcatgccggcctgatgcgcaatatcgagaccgaagacctgcggtggtggcgcgacaactacctgaaggcgctggcctgcgcgccgtggcccgctggccccgagggcgcagaagacactcgcccggacgccgggggcgcatccgtgtccggcgcgtccgatgggggtctcacgcaggcgtag

SEQ ID NO: 17325 - protein, 557 aa, Ralstonia solanacearum
MRPIISTPAGTSSLAIPDTPGADEAQRADPFQPASRPRSRHPQFERLPSPPVRTRSQELRAARLRRCASDVSATPEARPRLVVVSNRLIDPQRPAAGGLAVALGDMMRDTDGLWFGWSGKTVDEPDTACVRTEPFGRTTLAQVDLGRTDYEGYYAGFSNSVLWPIFHERVKWADLNPAYFKAYEAVNRILASHLRPMLRDSDILWVHDYHLIPFAQALRALGCTQRMGFFNHIPLPSPDVIRRIPQHRQLMRALASYDLVGMQSPRDVLNLQRYWDAENIAAQSERRHDSVHAFPIGIDVESLRALVPSPASQAVIDEVRGAAGRCVLMIGVDRLDYSKGIPTRLKAFRQLLQTHARMRSKVTLVQIAAPTRQSIPAYARLRDKTEQLVREINRRFGTGDWTPVMYFSESVDRTALPQLYRMSRVGVVTPVADGMNLVAKEYVAAQAARDPGVLVLSRGAGAASQLRDALLVPSKNRAATADAYAQALSMPLEERKARHAGLMRNIETEDLRWWRDNYLKALACAPWPAGPEGAEDTRPDAGGASVSGASDGGLTQA

SEQ ID NO: 17326 - DNA, 2214 bp, Pyrobaculum aerophilum
  CDS (1)..(2214)
atgagattgataatagtttccaataggttgcctgtggtcctaactgttggggagaggggcatggaaattagagaggcagtgggaggcttagcaacagctgtaaagtcttttataaaagctacagaaaacggcaaagctttaggcttctcagaggttgtatgggcaggttggtcagggataaaagctgagcaggagagtgaagatctaaagtcaagacttagagaaatgggcttgttacctgtatctctaactgctgaagaagtcaactttttctacgagggattttgtaactctacgctgtggcctctatttcacggctttactgtatacaccgtatttgagagtaagtactgggaagcctatgtaaaagtaaatcagaaatacgcagagactgtcgcctcagtggccaatacaggagactttgtctggatacatgattatcacctcatgttgatgcctgctatgctgagggaaatgtcgccagacgtcagcataggctttttcctacacatccccttccccccagctgagatgtatcaactaatgccgcctccttggcgtacagctttactcgacggcgttttagcctctgatttagtaggttttcacatccacgaatatgtgaataatttcgtacgcgcagtctcaaaattcctgggctatcggactgaggcaggtgtcatttacgcggggcgtaggaaagtacacgtaggcgcctttcctattggcattgacttcgactttttctacaactcttccctagaccccgaagtggcgggacagattgaagaacttagacaaaaacttaggggtttaaaaattatattttccattgacagactggattatacgaaaggcgttataaatagagtgcatgcatgggagagatttttaaaagagcatccccagtggagaggcaaggcatcgtttatccttatagttgtgccttcaagaattggagtgcctcaatatgacgccatgaagagagaaatagagagagaggtggggcgtataaatggagagctgggcgatgtaaattggactccgattgtatacatctcccgcttcatccccaccccaacgcttctcgcactgtataatatcgcagatgtcgcgttgataacgccacttagagacggcatgaacttagtgtctaaagagtacgtcgccactaagagagattgcaaaggcgttctaattctcagcgaaacggccggcgcctcccacgagttgcttgaagcactcatagttaacccaaatgacgaaagcggcgtggtagaggcaatagccaaggctctaaccatggagcctgaggagcagtgcagacgcataaaagccatgcaagaaaaacttaggcaacaaaacgtggtgaagtgggctgtggactttttacactcgctaatgttagcatatagagaaaatacagagagcttcactacatcttcaaaactattagaccgcgaggctattgaggagatcgtaaaaatatttcacggcgcaaggtcaaggctcctgcttctcgattacgacggcacgttagtgcctcactacccctatgcttaccaggctgtgccagacggcgaattaaaacgtttactcaactctttggcgtttcagcccaatacttatgttgctgtggtaagcggtagagggagggactttttggaagcttggctgggcgatttgcccatatatattgttgcagaacacggggcgtttattagagacccagggggcaattggtcccagctatttccatttgacacaagctggaagatctcagttagaaaaataatggaagagtttacaagactcactccaggatcatatatagaggaaaaagagatttcactcgcatggcactatagaaatgtagagcctgaaattggagaaaaagccgccaataggctagctgatgccctgacagggttgcttgagagctcgccggctaatattattcgcggagttaaagtagtggaagtgagggcggccggggtcaataaaggggttgcggctaaattgttgtatgacaagctgaggccagaattggtcataattgcaggagacgactatacagatgaggagatgatgaaggcgctacctgaggccattactataaaggtcggcaaaggcgaaacctcggcgaagtacatggcgccctcgtacaggaggatacgggagctactacaagcacttctaacggctcagcgttga

SEQ ID NO: 17327 - protein, 737 aa, Pyrobaculum aerophilum
MRLIIVSNRLPVVLTVGERGMEIREAVGGLATAVKSFIKATENGKALGFSEVVWAGWSGIKAEQESEDLKSRLREMGLLPVSLTAEEVNFFYEGFCNSTLWPLFHGFTVYTVFESKYWEAYVKVNQKYAETVASVANTGDFVWIHDYHLMLMPAMLREMSPDVSIGFFLHIPFPPAEMYQLMPPPWRTALLDGVLASDLVGFHIHEYVNNFVRAVSKFLGYRTEAGVIYAGRRKVHVGAFPIGIDFDFFYNSSLDPEVAGQIEELRQKLRGLKIIFSIDRLDYTKGVINRVHAWERFLKEHPQWRGKASFILIVVPSRIGVPQYDAMKREIEREVGRINGELGDVNWTPIVYISRFIPTPTLLALYNIADVALITPLRDGMNLVSKEYVATKRDCKGVLILSETAGASHELLEALIVNPNDESGVVEAIAKALTMEPEEQCRRIKAMQEKLRQQNVVKWAVDFLHSLMLAYRENTESFTTSSKLLDREAIEEIVKIFHGARSRLLLLDYDGTLVPHYPYAYQAVPDGELKRLLNSLAFQPNTYVAVVSGRGRDFLEAWLGDLPIYIVAEHGAFIRDPGGNWSQLFPFDTSWKISVRKIMEEFTRLTPGSYIEEKEISLAWHYRNVEPEIGEKAANRLADALTGLLESSPANIIRGVKVVEVRAAGVNKGVAAKLLYDKLRPELVIIAGDDYTDEEMMKALPEAITIKVGKGETSAKYMAPSYRRIRELLQALLTAQR

SEQ ID NO: 17328 - DNA, 3001 bp, Arabidopsis thaliana
  CDS (204)..(2306)
acttttgaagctgtaataatattcttgaatctattcctttctttctctttctcatgtttaatcggtgaaggctttactctgtttctttcatcatgtttcaatcaaaagccttaactttttctttagctctttccattacaagagacctctagcttcatactttttataaaaattctctctttttctcagtttaatctcaagaaatggtttcaagatcgtattcaaatctgttggagttagcttcaggagactcaccaacgtttggacgcatgaaccgacaaatcccacgaatcatggccgttgctggaatcatgtcaaacatcgataatgactctaaagacactgatctgtctcctaaagatcgtatcatcattgtagccaatgaattacctatacgagctcagagaagggttgatggtaatggtagtggtagtagtagtagtagtacttgttgtagcaaaggttggaacttttcttgggatgagaattcacttcttctccaattgaaagatgggttaggagatgaagctattgaagttatctatgttggttgtttgaaagaagagattcctcttaatgagcaagaagaagtgtatcagattcttcttgagagtttcaagtgtgtgcctacgtttttgcctttggatttgtacactagatactaccatggattctgtaagcaacagctttggcctttgtttcattacatgttgccactttctcctgatcttggaggtaggtttgataggactttgtggcaagcttatgtctctgtgaacaagatttttgctgatagaattatggaggtgattaatcctgaggatgattttgtgtggatacatgattatcatttgatggttttgcctactttcttgaggaagaggtttaacagagtcaagcttggtttcttccttcatagtccatttccatcgtctgagatttacaaaactttgcctattcgtgaagagcttcttcgggctttgctaaactcggatttgatagggttccatacttttgactacgctaggcatttcttgtcttgttgtagtcgaatgcttggtcttacttatgaatctaagagaggatacattggacttgagtattatggtagaaccgtgagtatcaaaattctacctgttggaatccacatgggtcagcttcagtcggttttgagcttacccgagactgaaaggaaagtcggggaacttattgaacggtatggtcgaaaaggcaggacgatgctgcttggtgtggatgatatggacattttcaaagggattactttaaagctgttggctatggagcagctgcttatgcaacatcctgaatggcaagggaaggttgtgttggtgcagatagctaatccggcgagagggaaagggaaagatgttaaagagatgcaagctgagacgtattcaactgttaagcggattaatgaaacgtttgggagacccggttacgatcctatagtattgatcgatgcaccgttgaagttctatgaaagggttgcttattacgtagtagctgagtgttgtttggtgacagcggttagggatgggatgaatcttataccttatgagtacatagtttctcgtcaaggaaatgagaaactggacaaaattctgaagctggaggcgaataatcgtaacaagaaaagcatgctggtggtttctgagtttattggttgctctccatcgctaagcggagccattcgtgttaatccatggaatgttgatgcagtagctgatgcaatggatagtgcccttgaagtagctgaaccggagaagcagctaagacatgagaagcattacaagtatgtgagcacacatgatgttggctattgggctcgtagcttcctccaagatcttgagaggagttgtggtgagcatggacgaaggaggtgttggggaattgggtttggtctcagtttcagagttgtggcactagaccagagcttcaggaagctgtcaatggaacacatagtatcagcttataagaggacaaagacacgggctatccttttagactatgatgatactttaatgccacaaggctcgatcgataaaaggccttcatcgaagtcaatcgacatattgaacaccttgtgtagggacaagggcaatctggtgttcattgttagtgctaaaagccgagaaactctatcggactggtttagtccttgtgagaagcttggtattgctgctgaacatggctattttctgaggtattcaaccaaaactttttattttctagcattacctttatatcttataactcaagctccatctaactactacacaggctaaggaaggcagtagagtgggaaaactgtgtggcagcagtagattgttcttggaagcaaattgccgagcctgtgatggaactctacaccgagacaaccgatggctcaacaattgaagacaaggagactgctcttgtttggagttatgaggatgctgaccctgattttggctcatgtcaagctaaggaacttctagatcatcttgaaagtgtccttgccaatgaacctgtaacagtgaaacgaggacagaactatgttgaggtcaagccacagggcgtgagcaagggacttatagcgagaaggatgctttcgatgatgcaagaaagaggaacacttcctgagtttgttctatgtattggagatgaccggtctgacgaagacatgtttgaggtgatctgcagttccactgaaggcccttcgattgccccaagagctgagattttcgcttgtactgtcggtcaaaagcctagcaaggccaagtattacctggatgacactactgagattgtcaggttaatgcatggtttagcttctgttacagaccagatcactcctgtttaaacaatcacagagaaagtatcagagactagagatcttatgtttgtatatctaccacggaaaattgtaacaaagagagatcttatgtttgttgacaatcttagaatatatgagtaaggctttacaaaaaaaaaaaaaaaa

SEQ ID NO: 17329 - protein, 700 aa, Arabidopsis thaliana
MVSRSYSNLLELASGDSPTFGRMNRQIPRIMAVAGIMSNIDNDSKDTDLSPKDRIIIVANELPIRAQRRVDGNGSGSSSSSTCCSKGWNFSWDENSLLLQLKDGLGDEAIEVIYVGCLKEEIPLNEQEEVYQILLESFKCVPTFLPLDLYTRYYHGFCKQQLWPLFHYMLPLSPDLGGRFDRTLWQAYVSVNKIFADRIMEVINPEDDFVWIHDYHLMVLPTFLRKRFNRVKLGFFLHSPFPSSEIYKTLPIREELLRALLNSDLIGFHTFDYARHFLSCCSRMLGLTYESKRGYIGLEYYGRTVSIKILPVGIHMGQLQSVLSLPETERKVGELIERYGRKGRTMLLGVDDMDIFKGITLKLLAMEQLLMQHPEWQGKVVLVQIANPARGKGKDVKEMQAETYSTVKRINETFGRPGYDPIVLIDAPLKFYERVAYYVVAECCLVTAVRDGMNLIPYEYIVSRQGNEKLDKILKLEANNRNKKSMLVVSEFIGCSPSLSGAIRVNPWNVDAVADAMDSALEVAEPEKQLRHEKHYKYVSTHDVGYWARSFLQDLERSCGEHGRRRCWGIGFGLSFRVVALDQSFRKLSMEHIVSAYKRTKTRAILLDYDDTLMPQGSIDKRPSSKSIDILNTLCRDKGNLVFIVSAKSRETLSDWFSPCEKLGIAAEHGYFLRYSTKTFYFLALPLYLITQAPSNYYTG

SEQ ID NO: 17330 - DNA, 3272 bp, Oryza sativa
  CDS (247)..(2985)
gagttgcatttcccatttcgattcgagactcgaaaacccaccacccctctctccctccctctcgctcgcctcggctcggctcgccgtctgtctctctttcagatcacatcaaagcgggcaccagcaccagcaccagcaccaactcctctctagggtttggtaaaaacctccatttcctccgcggatcgaagggaggctagggttccgatcgagaggggaagctttcgggtactcgtttcagccatgatgtcgcggtcgtacaccaaccttctcgatctcgcggaggggaacttcgcggcgttgggcccgggaggcggcggcggcgggaggcggaggtcggggtcgttcgggctgaagcggatgtcgcgggtgatgacggtgcccgggacgctgtcggagctggacggggaggacgactcggagcacgcggcgacgaacagcgtcgcctccgacgtgccctcgtcggtggcgggggatcgagtcatagtggtctccaaccagctgcccgtcgtcgcacgccgccgtcccgacggccgcgggtggtccttctcatgggacgacgactcgctgctcctccagctccgcgacggcattcccgatgagatggaggtgttcttcgtcggttccctccgcgccgaaatccccgtcgccgaccaggaagaggtctcccaggcgctgctcgatcgcttccgatgtgctccggtgttcctccccgaccccctcaacgaacggttttaccaccgcttctgcaagcgccacctatggcctctgttccactacatgctccctttctcctcctccgcatccccgagtccctcctcctcctcctcctcctcctcctccccctcatcctcatccggcagtggccacttcgaccgcggcgcgtgggaggcctacgtgctcgcgaacaagttcttcttcgagaaggtcgtggaggtcatcaacccagaagacgactacgtatgggttcacgactaccatctcatggcgctgcccaccttccttcgccgccgcttcaaccgcctgcgcatcggcttcttcctccacagccccttcccctcgtcggagatctaccggaccctccctgttcgcgaggagatcctaaaggcgctgctcaattgtgaccttattggattccacacttttgactatgccagacatttcctctcttgttgtagtaggatgctgggaattgaataccagtcaaagcgtggatacattgggttggattactttgggcgtaccgttgggatcaaaatcatgccagtgggagttcatatgggtcaattgaagacggttctgagcttgcccgacagggaatggagggtctccgagctgcagcagcaatttgaggggaagactgtgttgctcggtgtggatgacatggatatcttcaagggtatcaacttgaagcttcttgccttcgagaatatgttgaggacacatcccaagtggcaggggcgggcagtgttggtgcaaattgctaatccggcccgtggaaagggtaaggatcttgaagccatccaggctgagattcatgagagctgcaagaggattaatggagagtttggccagtcaggatacagccctgttgtcttcattgaccgtgatgtgtcaagtgtggagaagattgcctactacacaatagcagaatgtgtggtggtgactgctgtgagggatgggatgaacttgacaccatatgaatatattgtctgtaggcaggggtctgactccacatcagaagtgaatggaccaaagaagagcatgctggtggtatcagaattcattgggtgctcaccatctctgagtggtgctatccgggttaacccatggaatatagaggcaaccgcagaggcactgaatgaggccatatcaatgtcggaacaggagaaacacctaaggcatgagaaacattaccgttatgtcagcacccacgatgttgcttattggtcgaaaagtttcatccaagatttggagagggcttgcaaggaccacttcaggaggacatgttggggcatcgggttggggtttggttttagggtggtggccttagatccccatttcacaaagcttaacatggattcaattgttatggcttatgagcggtcagagagtagggctatatttcttgattatgatggaacactggtgccacagacttccatcagtaggacacctagtgcggaagttttgaggatcatcaataccctgtgctcagataggaggaacaaagtttttcttgtcagtgggagacgcagggacaaattgggagaatggttttcctcttgtccagatctgggcattgcagcagagcatggttacttcttaaggtggactagagacgaagagtggcaaacatgtacccagacctctgacttcgggtggatggaaatggccaagccagtgatgaatctgtatacagaagcaactgatggatcttacattgatcctaaggaaagtgctttggtgtggcatcaccaggatgctgacccaggatttggatcctcccaggcaaaggagttacttgatcatctggaaagtgtattagcaaatgaacctgtttctgtcaaaagtggccagttcattgttgaagtcaaacctcagggagtaagcaagggagtagtagctgagaagatactcgtctcaatgaaggagagaggaaagcaggctgactttgtattatgcattggtgatgacaggtcggatgaggacatgtttgaaaacattgctgataccattaaaaagggtatggttgctacaaacacatcattgtttgcatgcactgtgggacaaaaaccaagcaaggccaaattttacctggatgatacgtttgaagtggtcaccatgctgagcgcactggcagatgctactgaaccagaacctgagactgatcttaccgatgagtttgatgaactggccgtgtctgtctcctcagttgatattgatgatgaacaaacgcccagtgataaactgatcggaggatagtagtcaaggttgcttatatctgcagattgtcatgattaattcaaccatctctatacaatttttgatgaatgtgaaagctgggtactcaaagaatgactaacaccaggccctacgaatgctccagtgtgaagttaataccgtggagtgctcgattctccactgggggcaaaagccaatacaatcttgtgctggaaaagtaggtccatatgtccatagctgacttcacttttctttgcacgtttctgttttaactttttccatatcaagtaaaatggaaagcttcacgg

SEQ ID NO: 17331 - protein, 912 aa, Oryza sativa
MSRSYTNLLDLAEGNFAALGPGGGGGGRRRSGSFGLKRMSRVMTVPGTLSELDGEDDSEHAATNSVASDVPSSVAGDRVIVVSNQLPVVARRRPDGRGWSFSWDDDSLLLQLRDGIPDEMEVFFVGSLRAEIPVADQEEVSQALLDRFRCAPVFLPDPLNERFYHRFCKRHLWPLFHYMLPFSSSASPSPSSSSSSSSSPSSSSGSGHFDRGAWEAYVLANKFFFEKVVEVINPEDDYVWVHDYHLMALPTFLRRRFNRLRIGFFLHSPFPSSEIYRTLPVREEILKALLNCDLIGFHTFDYARHFLSCCSRMLGIEYQSKRGYIGLDYFGRTVGIKIMPVGVHMGQLKTVLSLPDREWRVSELQQQFEGKTVLLGVDDMDIFKGINLKLLAFENMLRTHPKWQGRAVLVQIANPARGKGKDLEAIQAEIHESCKRINGEFGQSGYSPVVFIDRDVSSVEKIAYYTIAECVVVTAVRDGMNLTPYEYIVCRQGSDSTSEVNGPKKSMLVVSEFIGCSPSLSGAIRVNPWNIEATAEALNEAISMSEQEKHLRHEKHYRYVSTHDVAYWSKSFIQDLERACKDHFRRTCWGIGLGFGFRVVALDPHFTKLNMDSIVMAYERSESRAIFLDYDGTLVPQTSISRTPSAEVLRIINTLCSDRRNKVFLVSGRRRDKLGEWFSSCPDLGIAAEHGYFLRWTRDEEWQTCTQTSDFGWMEMAKPVMNLYTEATDGSYIDPKESALVWHHQDADPGFGSSQAKELLDHLESVLANEPVSVKSGQFIVEVKPQGVSKGVVAEKILVSMKERGKQADFVLCIGDDRSDEDMFENIADTIKKGMVATNTSLFACTVGQKPSKAKFYLDDTFEVVTMLSALADATEPEPETDLTDEFDELAVSVSSVDIDDEQTPSDKLIGG

SEQ ID NO: 17332 - DNA, 1681 bp, Amanita muscaria
  CDS (101)..(1552)
actgactcgccccccatagacggcgggtcatctcatcgtcgtctcaaatcgtctccccgtcaccatcaccaaggatgccagtggtgaataccatttcaagatgtcctccggaggcttggtctctgccctctccggtttcaagaaatcgctcaattttacttggatcggctggccaggttttttcattcctcccaaagatcgtcccttggtcaacaaacgcttgatggatcagtactcttgtcaggctgtatacctcgacgatgacgtagccgacaagcattacaacggtttctcctactccatcctttggcccttgttccattatcatccaggtgaaatgaactttgacgaggaaaattggctcgcctatcgccaagccaatctgcaattcgccgaggccgttctccagcagttgaccccgggagccatggtctgggtccaggattatcatctcatgctacttcctatgctactccgcgggctcatagagggtcgcgaccttggtgctgatctgtccattaccgaactctcagagatcggagagggcgcagaggagggcatacaaaatgcaaagaatctccatggtgtcaagatgggtttcttcttgcacaccccattcccaagcagcgagatctaccgtatcttgcccgtccgcagagagatcctcctcgggattctctactgcgatcttatcggcttccatacatatgattacgctcgacatttcctttcatcatgtacgaggatcttggggcttccgactatgcccaacggggtcgagtttgaaggaaggatggcccatgtcggaactttccctattggaatagagccaagctcgtttatagagaatctgaaaaaggattcagtcacggcacggattacgcagctagaacacaggttcaacggtgtcaaggtcatcgtcggagtcgatagattggattatatcaagggcgtgccgcagaaattgcatgctttagagttgtttttgacccaacacccagaatggattggaaaggtcgtcttggttcaattagccgttccctcgcgccaagacgtagaagaataccagaacttgcgttcaaccgtcaacgaactcgtgggacgcatcaatggccgctttggcaccgtagaattcatgccgattcatttcatgcacaagagtttaccatttgatgaactttgtgccctgtacgctgttagtgatgtctgcttggtgtcaagtacgcgagacggcatgaatttggtttcatatgaatacgttgcatgccaacaagctcgtcagggtgtcatgatactttccgaattcgcaggagcagcccaaagtttaaatggctccatcgtcgttaacccatgggactctcaacaggtagccgacgccatccacgaggctgtcacaatggatgctccgacgcgttcagagaaccacaagaagctgttcaaatacgtgaacaagtatagtgctgcgttctggggaagcagttttataaaggaaatggcaaggattaaagctatcgaggtaaacaagggcgccaaagaggacgctgccgtgtgagcagtggtcaagaaacaatcagaatttggtcacttattccttacataacgtgcacttatcgtaaattacaattattcatctcatccccgaattattagctattgtgctgttaaaaaaaaaaaaaaaaaa

SEQ ID NO: 17333 - protein, 483 aa, Amanita muscaria
MSSGGLVSALSGFKKSLNFTWIGWPGFFIPPKDRPLVNKRLMDQYSCQAVYLDDDVADKHYNGFSYSILWPLFHYHPGEMNFDEENWLAYRQANLQFAEAVLQQLTPGAMVWVQDYHLMLLPMLLRGLIEGRDLGADLSITELSEIGEGAEEGIQNAKNLHGVKMGFFLHTPFPSSEIYRILPVRREILLGILYCDLIGFHTYDYARHFLSSCTRILGLPTMPNGVEFEGRMAHVGTFPIGIEPSSFIENLKKDSVTARITQLEHRFNGVKVIVGVDRLDYIKGVPQKLHALELFLTQHPEWIGKVVLVQLAVPSRQDVEEYQNLRSTVNELVGRINGRFGTVEFMPIHFMHKSLPFDELCALYAVSDVCLVSSTRDGMNLVSYEYVACQQARQGVMILSEFAGAAQSLNGSIVVNPWDSQQVADAIHEAVTMDAPTRSENHKKLFKYVNKYSAAFWGSSFIKEMARIKAIEVNKGAKEDAAV

SEQ ID NO: 17334 - DNA, 1344 bp, Thermoplasma volcanium
  CDS (1)..(1344)
atgatgaggtacgtaatagcctccagtaggtgtcccttttcgcatgatgttgtaatgggtagagaacttgtcaaagagaatgttggcggcgtagctaccgcccttaaaagggcaatatctaaacatggtgggacgtggatatgctggggagacggaaaggcagataaccgatacgttaacgaggatgttgggacttataaaataaaaaggataatactgaccccacaagagaagagaggatattatgacatgtattcaaacagaactctgtggccgctcttccattattttagggagagagtacagtatacagataatggatacgagacatacagaaaggtaaatgaaaaatttgcagaggagatacttaataatacgtcacaggaagatatagtttgggtacacgattatcagctttctctcgtacctggaatactacggcaaaaaggccttaaaaacaggatcattttcacttggcacatcccgtgggtatctagagagatgtttgaaactcttactgaaagcgatgaaataaaggaaagcgttggttcagcggattttataacatttcacactgacctatacagaaagaactttgaaagcctctttgaaaatagaaaacatggtaagtctatagctgtgcctcttggtatagactaccgatacttcgaaaaggctaagtcaagtcaaattaaaagttacgctcttaaagacaaaataatgctattctctattgatagattagattacaccaaagggcttacaaatagagttctctctatagagagacttattcgaaatcatcctgaaacatcagggaaatttgtttacgtcatgatagttacaccaagcagaacttctgtatcggattacgtatcaatgaagagagaacttgaaatgaatataggtagagttaatggagaatttggaaccatttcctggatgccaatactatatatgtacagaaaaatttcagatcattcgctagtctcatactataagtccgccgatatcgctcttattaccccgcttatagatggcttaaacttggtcagcaaggaatttattgcatctactgagaaaggcatacttgtattatctaaattcgcaggagcttcaaattgcctcagaggtgcgcttatagttaacccaaatagcccggatgaggttgctgatgctatatacaaggcgatgaacatggaaagaaaggaagctgatgagaggcttttaaaaatgaaggccattgtcaaggcaagagacacggattggtggataaaaagaatatataggttagccatcgctaaagaacatgatagacgggttactaataacagaattgaataa

SEQ ID NO: 17335 - protein, 447 aa, Thermoplasma volcanium
MMRYVIASSRCPFSHDVVMGRELVKENVGGVATALKRAISKHGGTWICWGDGKADNRYVNEDVGTYKIKRIILTPQEKRGYYDMYSNRTLWPLFHYFRERVQYTDNGYETYRKVNEKFAEEILNNTSQEDIVWVHDYQLSLVPGILRQKGLKNRIIFTWHIPWVSREMFETLTESDEIKESVGSADFITFHTDLYRKNFESLFENRKHGKSIAVPLGIDYRYFEKAKSSQIKSYALKDKIMLFSIDRLDYTKGLTNRVLSIERLIRNHPETSGKFVYVMIVTPSRTSVSDYVSMKRELEMNIGRVNGEFGTISWMPILYMYRKISDHSLVSYYKSADIALITPLIDGLNLVSKEFIASTEKGILVLSKFAGASNCLRGALIVNPNSPDEVADAIYKAMNMERKEADERLLKMKAIVKARDTDWWIKRIYRLAIAKEHDRRVTNNRIE

SEQ ID NO: 17336 - DNA, 1563 bp, Rhizobium loti
  CDS (1)..(1563)
atgcaatggtcgcccgaaacgctgcgtcacatcctggcgaccgaacttcccgatgcccaggtgatcgtcgtctcaaaccgtgaaccgtatatccacaaccgcgagggcgacgacatccagctggtcgtacccgccagcgggctcgtctccgccctggagccgatcacgcgtgcctgcgcgggcacctggatcgcctatggcggtggttcggccgacaagctggttgtcgacaagaacgaccggatcgaggtgccgccggacaacccttcctacacgctgcgccgtgtctggctgagcgaggaagaacagcaaggctattatctcggctttgccaatgaaggcctctggccgctgtgccatatcgccttcacccggccgatattccgcgcctcggattgggaggcctacgaggcggtcaaccgcaaattcgccgacaccgtcgtcgcggaagcccgcaacgaacggcccatcgtgctggtccaggattatcatttcgcgctgctgccgcgaatgatccgtgaacggctgccggaggcgatcatcatcaccttctggcatattccgtggccgaattccgaggtgttcagcatctgcccatggcgcgaaaagattctcgacggcctgctcggcagttctatcgtcggtttccacacccagttccattgcaacaacttcatcgacagcgtcgaccgtttcctggaaagccggatcgagcgcgaggattcggccatttcctatggcggccagatcagcctggtccatgcctatccgatctcaatcgagtggccgccggcgcaattgggcaaactgcctgacgtggcgcaatgccgccggcaggttcgcgagaaattcggcctggccgaaaatgtcaagctgtgcgtgggcgtcgaacgtctcgactacaccaaaggcatcctcgatcgcttcaacgcgctcgacgaactgctgacgcttcatcccgaatggatcggcaaggtggcgttcctgcagatcgctgcgcccagccgcggcacgttgcctgcctatcaacaattgtacgaggagtgcctgcgccatgccgaggatctcaaccagcgctatggtcgcgaaggctacacaccagtcctgatgataacggaacatcactcgcagcagcaggtctacgaaatctaccgtgcagccgacgtttgcatggtcaccagtctgcatgacggcatgaacctggttgccaaggagtttgtcgcggcgcgtgaggacgaacagggcgtgctgttgctcagcatgttcgccggcgcctccaaagagctgctggacgcactgatcgtcaatccctatgacgcggctatgatgggagatgccttgctgcaggccttgaccatgtcgcaggaagagcaaagccagcgcatgcgacgcatgcgcgagatcgtacgcgacaacaacgtctatcggtgggccggcagcatgcttctcgatgcggcgcgcttgcgcaagcgcgacgcggtcgatcgcgccgtcagcgccgctccagcggccccagccaatgtcatatcgctgctcgatcgcagacgcgtggcggcgctatga

SEQ ID NO: 17337 - protein, 520 aa, Rhizobium loti
MQWSPETLRHILATELPDAQVIVVSNREPYIHNREGDDIQLVVPASGLVSALEPITRACAGTWIAYGGGSADKLVVDKNDRIEVPPDNPSYTLRRVWLSEEEQQGYYLGFANEGLWPLCHIAFTRPIFRASDWEAYEAVNRKFADTVVAEARNERPIVLVQDYHFALLPRMIRERLPEAIIITFWHIPWPNSEVFSICPWREKILDGLLGSSIVGFHTQFHCNNFIDSVDRFLESRIEREDSAISYGGQISLVHAYPISIEWPPAQLGKLPDVAQCRRQVREKFGLAENVKLCVGVERLDYTKGILDRFNALDELLTLHPEWIGKVAFLQIAAPSRGTLPAYQQLYEECLRHAEDLNQRYGREGYTPVLMITEHHSQQQVYEIYRAADVCMVTSLHDGMNLVAKEFVAAREDEQGVLLLSMFAGASKELLDALIVNPYDAAMMGDALLQALTMSQEEQSQRMRRMREIVRDNNVYRWAGSMLLDAARLRKRDAVDRAVSAAPAAPANVISLLDRRRVAAL

SEQ ID NO: 17338 - DNA, 2637 bp, Oryza sativa
  CDS (1)..(2637)
atgttctcgcgatcctacaccaacctggtcgatctcgccaacggcaacctctccgccctggactatggtggcggagggggagggggcggcggcggcaacggggccgggggccggccgccgcgggcgaggcggatgcagcggacgatgacgacgcccgggacgctggcggagctcgacgaggagcgggccgggagcgtcacctccgacgtgccctcgtcgctcgccagcgaccgcctcatcgtcgtcgccaacaccctccccgtgcgctgcgagcgccgccccgacgggcgcgggtggagcttctgctgggacgaggactccctcctcctccacctccgcgacggcctccccgatgacatggaggtcctctacgtcggctccctccgcgccgacgtgccgtccgccgagcaggacgacgtcgcgcaggcgctcctcgaccggttccgctgcgtcccggctttcctccccaaggacgtcttggacagattctaccatggcttctgcaagcagacgctgtggccgctcttccactacatgctccccttcacctccgaccatggcggccgcttcgatcgctcccagtgggaggcatacgtcctcgccaacaagctcttctcccagcgcgtcatcgaggtcctcaaccccgaggatgactacatctggatccacgattaccacctcctcgccctcccgtccttccttcgccgtcggttcaacaggctccgcatcggtttcttcctgcacagcccgttcccttcgtcggaactctaccgttccctccctgttcgcgacgagatcctcaaatcactgctaaactgcgatctgattgggttccacacctttgattacgcgcggcatttcctgtcctgctgcagccggatgctggggatcgagtaccagtcgaagaggggatatatcggtctcgattactttggccgcactgttgggataaagatcatgcctgttgggattaacatgacgcagctgcagacgcagatccggctgcctgatcttgagtggcgtgtcgccgaactccggaagcagtttgatgggaagactgtcatgctcggtgtggatgatatggacatatttaaggggattaatctgaaagttcttgcgtttgagcagatgctgaggacacacccaaaatggcagcgcaaggcagtgttggtgcagattgcaaacccaaggggtggtggtgggaaggaccttgaagagatacaggctgagattgatgagagttgcaggaggataaatgcacaattttcacggccaggatatgttcctgtggtgattatcaatagagccctttcaagtgtggagaggatggcttattataccgtggcagagtgtgtcgttgtaactgcagtgagggatgggatgaacctcacaccatatgagtatattgtctgtagacagggatttccagatttggatggttctggggatgatgggccaaggagaaagagtatgttagttgtgtccgaattcattggttgctcaccatcacttagtggagcaattcgggtaaacccttggaacattgatacaacagcagaggcaatgaacgagtcgattgctttatcagagaacgagaagcaactgcggcatgagaagcattacagatatgtcagctcacatgatgttgcctattggtccaagagctatattcatgatttggagagaagctgcagggaccattttaggaggaggtgctggggtattggactaggatttggatttagagtagttgctcttgaccgcaacttcaaaaagcttactgtggattctatcgttactgattacaagaattctaagagcagggttatactgctagactacgatggaacgctagtaccacaaactacaatcaacaggactccaaatgaaagtgttgttaaaatcatgaatgctctttgtgacgataagaagaatgttgtttttattgttagtggacgaggaagggatagccttgagaaatggttttccccttgccaggatcttggcattgctgccgaacatggctactttatgaggtggaccagagatgagcaatggcaattgaataaccagtgctcagaatttggatggatgcagatggccaagccagttatgaacctgtatacagaagcaaccgatggatcatatattgaaaccaaagagagtgctttggtctggcaccaccaagatgctgaccctggttttggatcttcacaagctaaagagatgctagatcatttggaaagtgttcttgctaatgagcctgtctgtgtaaagagtggccaacagattgtggaagtgaaaccgcagggtgtcagcaaaggatttgttgctgagaagatcctatcaacgctgacagagaacaagagacaggcagattttgttctctgcataggcgatgatagatcagacgaggatatgtttgaaggaattgctgatatcatgagaaggagcatagttgatccccaaacatcattatatgcgtgcacagtcggccagaagccaagcaaggctaagtactatttggacgatactaatgatgttttgaacatgcttgaggcgcttgcagatgcatcagaggagactgattcacaggaagatgcagaagagataacatctatcccggacccggaatag

SEQ ID NO: 17339 - protein, 878 aa, Oryza sativa
MFSRSYTNLVDLANGNLSALDYGGGGGGGGGGNGAGGRPPRARRMQRTMTTPGTLAELDEERAGSVTSDVPSSLASDRLIVVANTLPVRCERRPDGRGWSFCWDEDSLLLHLRDGLPDDMEVLYVGSLRADVPSAEQDDVAQALLDRFRCVPAFLPKDVLDRFYHGFCKQTLWPLFHYMLPFTSDHGGRFDRSQWEAYVLANKLFSQRVIEVLNPEDDYIWIHDYHLLALPSFLRRRFNRLRIGFFLHSPFPSSELYRSLPVRDEILKSLLNCDLIGFHTFDYARHFLSCCSRMLGIEYQSKRGYIGLDYFGRTVGIKIMPVGINMTQLQTQIRLPDLEWRVAELRKQFDGKTVMLGVDDMDIFKGINLKVLAFEQMLRTHPKWQRKAVLVQIANPRGGGGKDLEEIQAEIDESCRRINAQFSRPGYVPVVIINRALSSVERMAYYTVAECVVVTAVRDGMNLTPYEYIVCRQGFPDLDGSGDDGPRRKSMLVVSEFIGCSPSLSGAIRVNPWNIDTTAEAMNESIALSENEKQLRHEKHYRYVSSHDVAYWSKSYIHDLERSCRDHFRRRCWGIGLGFGFRVVALDRNFKKLTVDSIVTDYKNSKSRVILLDYDGTLVPQTTINRTPNESVVKIMNALCDDKKNVVFIVSGRGRDSLEKWFSPCQDLGIAAEHGYFMRWTRDEQWQLNNQCSEFGWMQMAKPVMNLYTEATDGSYIETKESALVWHHQDADPGFGSSQAKEMLDHLESVLANEPVCVKSGQQIVEVKPQGVSKGFVAEKILSTLTENKRQADFVLCIGDDRSDEDMFEGIADIMRRSIVDPQTSLYACTVGQKPSKAKYYLDDTNDVLNMLEALADASEETDSQEDAEEITSIPDPE

SEQ ID NO: 17340 - DNA, 1326 bp, Thermoplasma acidophilum
  CDS (1)..(1326)
atgaagtacatagtcgtctccagcagatgcccattttcccatgataaggctgcaggaaaggagatcataaaggaaaatgttggcggggttgctacagccctgcggagagcgatggaaaaatacggtggcacttggatttgctggggagacggcaagctggatggcaaatatctggatgaggacgttgggaaatacagaatccgcagggtcatgctcagtgtgcctgaaaaacatggctattatgatctttactctaacagaacgctgtggccgctattccattacttcagggagagggtcaagtacacagacaatggctacgaaatctacaggcgtgtcaacgaaaaattcaccaacatgatcgttcagtcgttatctccggaggacgttatatggatacatgattaccagctttcccttgttcctaagatgctccgggatcgaggaataacaaaccggataatattcacctggcacataccatgggtttccaaggagatgttcgagacgctgcctgagagcagggatataatcgacagcctttcgagatctgacttcataacattccataccgaaacctacaggaagaactttacagatcttctggacgagaactcgagagcaaagagcctggttatacctctcggaatagattaccgctacttcagcaagacaaggggtacggacataaagagctatgcgctcatggacagaaagcttatattttccatagacagactggattacacgaagggcctggtgaatcgggttctttcaatcgaggagctgcttagaaggcaccccgatctcgtgggcaagttcgtttacgttatgatagtcacacccagcaggacaaccgtgtcagattatgtggccatgaagcgcgaactcgagatgcatataggcagaataaatggagagttcggatcgatcagctggatgccgatactatacatgtacaggaagatctccgataagatgctggtatcgtattacaagaatgcggatatagctctcataacaccactgatcgatggcctgaacctggtttcaaaggagtttgtagcatcatccgataagggtatcctgatactttcaagatttgccggtgcttcaaactgcctggacggagccgtggtcgtgaatccaaatagccttggcgaagttgcggaagcgatatacagcgccatgaatatgggcgaggatgagatccgggaaaggctcaggaagatgaaggaagaggtgtcaaggagagatactgactggtggatccgacgaatcaatgcgatagcaaagaggaagataaatgatagaacagtcacttga

SEQ ID NO: 17341 - protein, 441 aa, Thermoplasma acidophilum
MKYIVVSSRCPFSHDKAAGKEIIKENVGGVATALRRAMEKYGGTWICWGDGKLDGKYLDEDVGKYRIRRVMLSVPEKHGYYDLYSNRTLWPLFHYFRERVKYTDNGYEIYRRVNEKFTNMIVQSLSPEDVIWIHDYQLSLVPKMLRDRGITNRIIFTWHIPWVSKEMFETLPESRDIIDSLSRSDFITFHTETYRKNFTDLLDENSRAKSLVIPLGIDYRYFSKTRGTDIKSYALMDRKLIFSIDRLDYTKGLVNRVLSIEELLRRHPDLVGKFVYVMIVTPSRTTVSDYVAMKRELEMHIGRINGEFGSISWMPILYMYRKISDKMLVSYYKNADIALITPLIDGLNLVSKEFVASSDKGILILSRFAGASNCLDGAVVVNPNSLGEVAEAIYSAMNMGEDEIRERLRKMKEEVSRRDTDWWIRRINAIAKRKINDRTVT

SEQ ID NO: 17342 - DNA, 1389 bp, Streptomyces coelicolor
  CDS (1)..(1389)
atggcttcaagcttcggtgctgctcaggtgctggtcgcctccaaccgggggccggtctcgtacgaggtgcgggaggacgggtcactgcacgccaaacggggcggtggcgggctcgtgtcgggactgtcggccatcgggcccgacgcgggggcgctgtgggtgtgctcggcgctgtccgacggggaccgcgaggcggtgcggcgcggggtcggcgaggacggcgtacggatgctggacgtgccggccgacgtgcacgcggacgcgtacaacgggatcgccaactcggtgctgtggttcgtgcaccacatgctctaccagacgcccctggaaccggtcttcgacgcggagttccggcggcagtgggcctcctacgaggcgtacaaccgggccttcgccgaggcgctggccgaggaggcggccgagggcgcggtcgcgatcgtgcaggactaccacctgacgctggtgcccgggatgctgcgcgagctgcgtccggatctgcgcatcggccacttctcgcacacgccctgggccccgctcgactacttccggctgctgccggacgacatcgccgagcaggtgctgcgcggcatgctgggcgccgaccggctcggcttcctcacccggcgctgggccgacgcgttcaccgcctgctgcgacgccgtggtgggcgggctcggcggcacggagatcggcgtgcacgggctcggcgccgacggggacttcctgcggaagcgctcgcacgaggccgacgtcgaggagcggatggcggagctgcgggagcagatcggggagggccgccgcaccatcgtgcgggtggaccgcaccgagctgtccaagaacatcgtgcgcggtctgctggcctaccgggagctgctggccgggcggccggagtggcgcgagcgggtcgtgcacgtcgcgttcgcctacccctcgcggcaggacctcgccgtgtaccgggagtacacggccgaggtggagcgggtcgcgaacgcggtcaacgaggagttcggcacgccggggtggacgccggtcgtgctgaatctcaaggacgacttcgcgcggtcgctggcggcgtaccggctggcggacgtggcgctcgtcaaccccgtccgggacgggatgaacctggtcgcgaaggaggtgccggtcgtctccgacacgggatgcgcgctggtgctgtcgcgggaggcgggcgcgtacgaggagctgggcgaggacgcggtggtggtcaacccgtacgacgtggtgggcacggcggacgcgctgcacgcggcgctcggtctgccggcgggggaccgggccgagcgctcgaagcggctggcggccgccggcaccgcgctgcccccggcccggtggttcctggagcagttggaggcgctgcggggctga

SEQ ID NO: 17343 - protein, 462 aa, Streptomyces coelicolor
MASSFGAAQVLVASNRGPVSYEVREDGSLHAKRGGGGLVSGLSAIGPDAGALWVCSALSDGDREAVRRGVGEDGVRMLDVPADVHADAYNGIANSVLWFVHHMLYQTPLEPVFDAEFRRQWASYEAYNRAFAEALAEEAAEGAVAIVQDYHLTLVPGMLRELRPDLRIGHFSHTPWAPLDYFRLLPDDIAEQVLRGMLGADRLGFLTRRWADAFTACCDAVVGGLGGTEIGVHGLGADGDFLRKRSHEADVEERMAELREQIGEGRRTIVRVDRTELSKNIVRGLLAYRELLAGRPEWRERVVHVAFAYPSRQDLAVYREYTAEVERVANAVNEEFGTPGWTPVVLNLKDDFARSLAAYRLADVALVNPVRDGMNLVAKEVPVVSDTGCALVLSREAGAYEELGEDAVVVNPYDVVGTADALHAALGLPAGDRAERSKRLAAAGTALPPARWFLEQLEALRG

SEQ ID NO: 17344 - DNA, 2635 bp, Arabidopsis thaliana
  CDS (1)..(2604)
atggtgtcaagatcttgtgcaaattttctagatttagcatcttgggacttattggactttcctcaaactcaaagagctcttcctcgtgtcatgactgttcctggtatcatctctgagttggatggaggctacagtgatggatcctctgatgttaattcctcaaacagctcccgtgagcggaagattatagtggctaatatgttaccattacaagctaagagagatacagaaactggacaatggtgttttagttgggatgaagattctcttctcttgcaactcagagatgggttttcttcggatacagagtttgtttatataggatcacttaatgctgatattggtattagtgaacaagaagaagtttctcataagcttttgttggatttcaattgtgttcctacgtttttacccaaggagatgcaagagaagttctatcttggtttctgtaaacatcatttgtggccgctatttcactatatgcttcctatgttccctgaccatggtgatcgttttgaccggcgtctttggcaagcgtatgtctctgcaaacaagatattttcagatagggtgatggaagttatcaaccctgaggaagattatgtttggattcatgattatcatctgatggttcttcccacattcttgaggaaacggtttaacaggatcaagcttggatttttccttcacagtccatttccatcatcagaaatttaccgtactttgccagtccgggatgatcttttgagaggattgttgaactgtgatctcattggcttccacacatttgattatgcacgccattttttgtcatgctgcagtagaatgcttgggcttgattatgaatctaagcgtgggcacatcgggcttgattactttggtcgaacggtgtttattaagatccttcctgttggcatccatatggggaggctggaatcggttttgaatcttccgtcgactgcagcgaaaatgaaagagatacaagaacagtttaaggggaaaaagttgattcttggtgttgacgacatggacatctttaaaggcataagcctcaaacttatagccatggaacgtctctttgagacatattggcatatgcgaggaaaacttgtcctgattcagatagtgaacccagcacgggccacgggtaaggatgtggaagaagcaaagaaggagacatattcaactgcaaaaaggatcaatgagcgctatggttctgctggttatcagccagtgatcttgattgatcgtcttgttcctcgttacgagaagactgcttattatgctatggcagactgctgcctggtgaatgcagtaagagacggcatgaacttagttccatataaatatatcatttgcaggcaagggaccccaggaatggataaggccatggggattagccatgactcagcccggacgagcatgcttgttgtctctgagtttatcggctgctcgccttctttgagtggtgcgatcagggtgaacccatgggatgtagatgctgttgcagaagcggtaaacttagccctcactatgggtgagactgaaaagcgattaaggcacgagaaacactatcactatgtgagtactcatgatgtgggttactgggcaaagagctttatgcaggatcttgagagggcatgccgggagcattataataaacgttgttggggtattggttttggcttgagtttcagagttctgtcactgtctccgagttttaggaagctatctatcgatcacattgtctccacgtatagaaatacacagagaagggcaatatttttggactatgatggcactctcgttcctgaaagctccatcatcaaaacccctaatgccgaagtcctgtctgttctgaaatctctgtgtggagatcctaaaaacactgtgtttgttgtcagtggaagaggatgggagtctctgagcgactggctatctccatgtgaaaatcttggaatcgcagctgaacacggatacttcataaggtggagtagcaagaaagaatgggagacttgttattcgtcggctgaggcggaatggaagacgatggtagaaccggtaatgagatcatacatggacgcaaccgatggttctactatagagtacaaagagagtgctttggtttggcatcatcaagacgcagatccagactttggagcctgtcaagcaaaagagcttctagatcatctagagagtgtactcgcaaatgagcctgtagtcgtcaagagaggccaacacattgtagaggtcaaaccacagggagtaagcaaaggtctagcagtggaaaaggtgatacaccaaatggtagaggatggaaacccaccggacatggtgatgtgtataggagatgacagatcagacgaagacatgtttgagagcatattgagcacagtgacaaacccggacctcccaatgccacctgagatctttgcctgcacggtgggaagaaaaccaagcaaagccaaatacttcttagacgatgtctctgatgtattaaagctcctaggaggattagctgctgcaacgagcagctcgaagccagagtatcaacaacaatcctcctcattgcacacgcaagtggcgtttgagagcatcatatgataataaaagtgtctttttcaagtgtgttagt

SEQ ID NO: 17345 - protein, 867 aa, Arabidopsis thaliana
MVSRSCANFLDLASWDLLDFPQTQRALPRVMTVPGIISELDGGYSDGSSDVNSSNSSRERKIIVANMLPLQAKRDTETGQWCFSWDEDSLLLQLRDGFSSDTEFVYIGSLNADIGISEQEEVSHKLLLDFNCVPTFLPKEMQEKFYLGFCKHHLWPLFHYMLPMFPDHGDRFDRRLWQAYVSANKIFSDRVMEVINPEEDYVWIHDYHLMVLPTFLRKRFNRIKLGFFLHSPFPSSEIYRTLPVRDDLLRGLLNCDLIGFHTFDYARHFLSCCSRMLGLDYESKRGHIGLDYFGRTVFIKILPVGIHMGRLESVLNLPSTAAKMKEIQEQFKGKKLILGVDDMDIFKGISLKLIAMERLFETYWHMRGKLVLIQIVNPARATGKDVEEAKKETYSTAKRINERYGSAGYQPVILIDRLVPRYEKTAYYAMADCCLVNAVRDGMNLVPYKYIICRQGTPGMDKAMGISHDSARTSMLVVSEFIGCSPSLSGAIRVNPWDVDAVAEAVNLALTMGETEKRLRHEKHYHYVSTHDVGYWAKSFMQDLERACREHYNKRCWGIGFGLSFRVLSLSPSFRKLSIDHIVSTYRNTQRRAIFLDYDGTLVPESSIIKTPNAEVLSVLKSLCGDPKNTVFVVSGRGWESLSDWLSPCENLGIAAEHGYFIRWSSKKEWETCYSSAEAEWKTMVEPVMRSYMDATDGSTIEYKESALVWHHQDADPDFGACQAKELLDHLESVLANEPVVVKRGQHIVEVKPQGVSKGLAVEKVIHQMVEDGNPPDMVMCIGDDRSDEDMFESILSTVTNPDLPMPPEIFACTVGRKPSKAKYFLDDVSDVLKLLGGLAAATSSSKPEYQQQSSSLHTQVAFESII

SEQ ID NO: 17346 - DNA, 2843 bp, Zygosaccharomyces rouxii
  CDS (24)..(2726)
gtgagacgtagtggggcctcaagatggtaaattctggtcataggaggcaaagaattatcaactgcgttgcccagttgccgtacaagattcaactgggagagaccaacgacgaatggaacatagttcccgccaccggtagcagttcgctgtattcttcgattgagtatctaaacagtgaggagaaggctaaggattacgaacaacacgttttgggatggaccggtgagataggccgtgaaagcttgccctcacgactcttcaactcaaagaatagagacaagagtgaaaacggtgaaaaaggggagaacgatttgcacgccaaggaggagcgtgagaaggaggaggatccattgtatctgactaacgaccagatcgatgggatcactaaggatctgagaagacatggcaagagcgacgatcattacaacgtagacaacgttcatcccgtgtggctactacgtagagatcagaagcggtggagaggatttgcggaaaatgtgctgtggccaacgtttcactacattttgaaattctcctctgacagcggtgagaaggagaatctgtcatggtatgactacgtcagatttaatgaagcgtatgcgatgaaaattggtgaaatttatgagaagggagatattatatggattcatgattactatttgcttcttttgccgcagctgttaaggatgaaatttaacgatcaggacttgaccattgcctatttccatcactcaccatggccaagtaatgagtactttagagtgctaccacgtaggaaacagattttagatgggctcatgggtgctgatcgtggttggttccaaaacgaaggttttgctcgtcattttgtctcgtcttgtaaaaggttattggattccacgagtaggaagtcgaaaaatagattggggatggagcagtaccagattagtgcatatggtggtgatatcgttgtcgattcgttacctattggtattaatcgtgttaaattgctggaagacacttttaccaaggatatcgcccaaaaggttctagccattaaggatgcatttcagggcaaaaagattattgtaggcagagatcggctggattctgttcgtggtgtcgtccagaagctgagggcgttcgaaactttcctctcgatgtatccagaatggagggatcaagtggttttgattcaggtcagtgtccccagtatgaagggtgggaccaaccaactcataaggttagagcaacaagtgaacgaattggtcacttccatcaacatgcaatacgggagtttaaacttttcaccggtacaccattactatatgaggattcccaaagatgtgtacctctcactgttgagggttgcagatctctgtgttattgcaagcgttagagatggtaccaataccacggcacttgaatacgtgacggtaaagtctcatatgtctaactacaattgttacggaaatcccttgatcttaagtgagttttcagggactagtacgattctcaaggatgccatgatcattaacccttgggattcggtggcggttgccaaaagtattaacagggctttgagtctatcaagggacgagaaaagagcactcgaagacaaaatctggccccaagtgcctactattcagaaatggactgatcagtttttatccactttaagcgatattgttgatgaagctcacaatacaactgatagaaaaatgacacccgctctgaacagaccagctcttttggaacattacagacaatcgaagcgtcgtctattcttgtttgattacgacgggactttgactcccattgtacaagatccagccgctgcaatcccctcagctcgcttgatttcgatcttgcaaaaacttgcatcagatccctgtaatcaaatttggatcatttccggtagagatcaagcgtttttaaacaaatggcttggtagtagattaccacagctagggcttagcgctgaacatggctgcttttacaaagatgtggacgaggaaaattggatcaacttgacagaaaaattcgacatgtcatggcaagaaaaagtcggtagtattatggaggaattcaccagaagaacaccaggttcgtttatcgaaaggaaaaaagttgcattgacttggcattacaggagagcagatcctgaactaggtgaattctatgcatccgaattgaaaaaggagttagataagatatgtgcagattacgatttagatgttatggaaggtaaagccaacattgaagttcgtcccaaatttgtcaataaaggtgaaatcgtaaagagactagtttggcatcatcatggtagacgtcaagatatgctaaacacaaagaaagaagaattacccatttcagagatgcctgatttcactttgtgtttgggtgacgatttcactgatgaagatatgttcaatcaattgaatgacattgaggccgtttggaaaaagcaatacgaagacgaagttaatcaatggggtggatttgggctttatccatgtactgtaggatctgcatcaaagaaaactgtagccaaagcgcatttgacggatcctcaacaagtacttgacaccttgggtctacttgttggcgatgtttcattgttccaaagtgcgggtacagtggaattagactctcgtggtcatgtcaaacatagtgacagtagtataagatctgaacaggcaagtgcccggtatgctatgaagagacagcagtcgtacaagaactgagtttaggtttcctaagggagttctttctcttctgtgtgtgttgttttgtacgtctaaacgatatagagacaattatatctatttgaatataggttcatgaatggaatgcatgataat

SEQ ID NO: 17347 - protein, 900 aa, Zygosaccharomyces rouxii
MVNSGHRRQRIINCVAQLPYKIQLGETNDEWNIVPATGSSSLYSSIEYLNSEEKAKDYEQHVLGWTGEIGRESLPSRLFNSKNRDKSENGEKGENDLHAKEEREKEEDPLYLTNDQIDGITKDLRRHGKSDDHYNVDNVHPVWLLRRDQKRWRGFAENVLWPTFHYILKFSSDSGEKENLSWYDYVRFNEAYAMKIGEIYEKGDIIWIHDYYLLLLPQLLRMKFNDQDLTIAYFHHSPWPSNEYFRVLPRRKQILDGLMGADRGWFQNEGFARHFVSSCKRLLDSTSRKSKNRLGMEQYQISAYGGDIVVDSLPIGINRVKLLEDTFTKDIAQKVLAIKDAFQGKKIIVGRDRLDSVRGVVQKLRAFETFLSMYPEWRDQVVLIQVSVPSMKGGTNQLIRLEQQVNELVTSINMQYGSLNFSPVHHYYMRIPKDVYLSLLRVADLCVIASVRDGTNTTALEYVTVKSHMSNYNCYGNPLILSEFSGTSTILKDAMIINPWDSVAVAKSINRALSLSRDEKRALEDKIWPQVPTIQKWTDQFLSTLSDIVDEAHNTTDRKMTPALNRPALLEHYRQSKRRLFLFDYDGTLTPIVQDPAAAIPSARLISILQKLASDPCNQIWIISGRDQAFLNKWLGSRLPQLGLSAEHGCFYKDVDEENWINLTEKFDMSWQEKVGSIMEEFTRRTPGSFIERKKVALTWHYRRADPELGEFYASELKKELDKICADYDLDVMEGKANIEVRPKFVNKGEIVKRLVWHHHGRRQDMLNTKKEELPISEMPDFTLCLGDDFTDEDMFNQLNDIEAVWKKQYEDEVNQWGGFGLYPCTVGSASKKTVAKAHLTDPQQVLDTLGLLVGDVSLFQSAGTVELDSRGHVKHSDSSIRSEQASARYAMKRQQSYKN

SEQ ID NO: 17348 - DNA, 3197 bp, Drosophila melanogaster
  CDS (662)..(3091)
cacctacgccgccacttacaatttacccgagtcgctgagttgcgatttgtacaactgcgtcatatagtcgcctttcccatacatatacatatacatacatatagtatatatatagtaagtcagcgtgggccaaaacagccaactcgcgccacatcttcatattgcttttgtgaatgacacacgcgcctgcgcagcagcgttgcggcggttattttgcggatattacttgattacttgattattccatatgtcgtattgagtattgagtaggttaactctcgtgccgaattcggcacgaggctggctctcgcgaccatcgaaactaacgtaatcgactcaccgccaatcagccaggaaaattgcctgccatttccacgtagaattgcatctgagagtagctttgataagaaggcagtgattgacttggcttcgagcagtcttcagtcatcgatcagcgcatctcgaaccaaattcggcaacggtcgctctcgcttcggaagaacggactcgttcattgataagcctggatttgaactagacggttgtctaacctccacatccgcgaattttcccatacgctgttgtcaaaaattatgtgctagacttgaccgcaggagaagattcgtttaactcttctacagctagcttaccaaggatcacgatgcccgacacggaaatcatcgttaccaatgccggggagccctccaccaaggcgagtctcatcgtggtatccaatcggttgccgtttgtgcttatccgagatccgaagaccgatgagttggaacgcagggccagtgccggtggcctggtgactgcagtgtgcccggtggtgatcaagggcagtggtctctgggtgggctggtcgggtatccacttgaaggatcctaacgaggccattcccgagtccaatcccaacgatcagactccgactgctggcctcaagtccgagcaggtggtgtccgtcaacatcgattcgaagatcttcgatagctactacaacggatgctgcaacaagatcttctggccactgttccactcgatgccgggaagagccaacttcggaggcgagcactggcacgactatgtcactgtcaacaagcacttcgccgtgcggaccatcgaggctctggagaagtgcctggccaaaaaccagggcagcgagaagagtccaccgattgtctggatccacgactaccatctcatgctggccgccaattgggtgcgcgagcacgccgaggagaagaacctgccctgccgactggctttcttcctgcacatcccattcccgccatgggacatcttccgcctgctgccctggtccgatgagatcctacagggtatgttgggttgtgacctggtaggcttccatattcaggactattgccttaactttgtggactgctgccagcgcaatctcggctgccgtgtggacagaaacaatctgctggtggaacatggcgggcgcaccgttcgcgtccgcccgcttcccattggtattccctacgaacgcttcgttaatttggccacgaccgcgcccaaggtgctaaagacatccaagatgcaaatcatcctgggagtggaccgactggactacaccaagggcctcgtccatcgccttatggcttttgaggcgctgctgctgaagtatccgcagcacaaggagaaggtgagcctgctgcagatctcggtgccgtcgcgaaccgatgtaaaagagtaccgggagctgaaggaggaggtggaccagctggtgggccgcatcaacggacgctttaccacagccaactgggcgcccatacgctacatctacgactatgtcagccaagacgagttggctgctttgtacagggatgcggctgtttgcctggtaactccacttcgcgatggcatgaacctggtggccaaggagttcgtggcctgccagatcaacgaggtgcccggcgtgctggtcatctcaccgttcgcaggagccggcgagatgatgcacgaggcgctgctctgcaatccgtacgaggtgaacgaggccgccgaggtgatccaccgagcactgaccatgcccgaggatgagcgcgtcctacgtatggctcggctgcgccgtcgtgaagccgagtgcgatgtgagccactggatgcgttgtttcctaaaggcggtgggcgctctggagatggatgatgtgggcaccaccattatgcagccagtgtccgtggacgatttcgatgactacttactgaaatacatcggctataaccacaagttggctctgctgctggactacgacggaaccttggcgcccattgctcctcatcctgatctggccacgctctcgcccgaaattaagaatgtactatataagctgtccaatcactcggacgtctacgtggccgtcatctcgggtcgcaacgtggacaatgtcaagaagatggttggcatcgagggcataacctatgcgggcaatcacggtctagagatccttcatccggacggcagcaagttcgtacaccccatgcccatggagtacgaaaagaaggtcagtgacctgctgaaggctctgcaggattccgtttgccgcgacggcgcttgggtggagaataagggggcgttgctaacgttccactaccgagagacgcccaatcatctgaggggagctatggttgacaaggcgcgctccttgatcgagaagtacggcttcaaggccacggaggcgcattgcgctctggaagctcgtccgccggtgcagtggaataagggtcgtgcctcgatctacatcctgcgcacatccttcggcgtggactggaacgaacgcatcaagattatctatgtgggtgacgatctaacagacgaggacgccatggtggctctgaagggtatggcgcgaactttccgtgtgacatcgtcggatattgtgaagaccgctgcggatcatcgactgccctccacagactccgtgtacaccctgctgaaatgggtggaacgacacttcatgggacgcaaggcgcgcgccaattcgctgacctacaggcccaccaagggcgacggtgtccagatgcagatgtccctggaggtggccgcttcagcgaacaatctggaggtgtgagcccagatatccatgcattatctatgcatgcctcgtaactcagataacttttaagattttaagaataaagaaaacggatttgtagcttaaaaaaaaaaaaaaaaaa

SEQ ID NO: 17349 - protein, 809 aa, Drosophila melanogaster
MPDTEIIVTNAGEPSTKASLIVVSNRLPFVLIRDPKTDELERRASAGGLVTAVCPVVIKGSGLWVGWSGIHLKDPNEAIPESNPNDQTPTAGLKSEQVVSVNIDSKIFDSYYNGCCNKIFWPLFHSMPGRANFGGEHWHDYVTVNKHFAVRTIEALEKCLAKNQGSEKSPPIVWIHDYHLMLAANWVREHAEEKNLPCRLAFFLHIPFPPWDIFRLLPWSDEILQGMLGCDLVGFHIQDYCLNFVDCCQRNLGCRVDRNNLLVEHGGRTVRVRPLPIGIPYERFVNLATTAPKVLKTSKMQIILGVDRLDYTKGLVHRLMAFEALLLKYPQHKEKVSLLQISVPSRTDVKEYRELKEEVDQLVGRINGRFTTANWAPIRYIYDYVSQDELAALYRDAAVCLVTPLRDGMNLVAKEFVACQINEVPGVLVISPFAGAGEMMHEALLCNPYEVNEAAEVIHRALTMPEDERVLRMARLRRREAECDVSHWMRCFLKAVGALEMDDVGTTIMQPVSVDDFDDYLLKYIGYNHKLALLLDYDGTLAPIAPHPDLATLSPEIKNVLYKLSNHSDVYVAVISGRNVDNVKKMVGIEGITYAGNHGLEILHPDGSKFVHPMPMEYEKKVSDLLKALQDSVCRDGAWVENKGALLTFHYRETPNHLRGAMVDKARSLIEKYGFKATEAHCALEARPPVQWNKGRASIYILRTSFGVDWNERIKIIYVGDDLTDEDAMVALKGMARTFRVTSSDIVKTAADHRLPSTDSVYTLLKWVERHFMGRKARANSLTYRPTKGDGVQMQMSLEVAASANNLEV

SEQ ID NO: 17350 - DNA, 1503 bp, Pseudomonas anguilliseptica
  CDS (1)..(1503)
atggtctaccaccgtctgccttacgaagaattccgcggtgccgatggtaagttgcaacgccgccgcccgacttcccccaacggcattattccgaccctgctgagcttctttggcgatggtcgcgccggctcctgggtagcctgggctgagcatgacgaaaacagcggcgaaaccttcgacagccacaccaccgtggatgccgagcgttacccaaagctgaccgccgcgcgggtggcgctgagcaaggaagaggtcgacatcttctacgagcgcttctcaaaggaagccttctggccgaccctgcacaccttctgggagcgtgcgcagttccgtgaggacgactggcaggtgttcctcaaggtcaaccgcgcttttgccgagcgcaccgccctggaagcagccgaaggcgccaccgtctggctgcacgattacaacctgtggatggtgcccggctacctgcgcgagctgcgcccggacctgcgcatcgccttcttccaccacacctacttcccatcggcggatgtgtttaacgtactgccttggcgccggcagatcatcggcagcctgctgcagtgcgactacatcggctttcatatcccgcgccaggtggaaaacttcgtcgatgccgcgcgcggcgtgatgccgctgcaaaccgtcagccggcagaactgcgcgccacgctttattacctatggctgcgccgtgggcctggagcgcatgaccaccgccgtggacactggtaaccgcgtggtcaaacttggcgcccacccggtgggcctggatatcgagcgggtacgcagcgccctggccgcaccgaagatcagggaaatgatggaacgtctgcgcagcgaacttgccggggtcaaactgattctctcggtagaacgcctcgactacaccaaaggcattctggaaaagctcaacgcttatgagcgcctgttggaagaaaaccccgagctgctcggcaaggtcaccctggtaaccgtgtgcgtgccggcggccaaggaaatgaccatttatgacgagctgcaagggcagatcgagcaggccgtgggccgcatcaacggccgcttcgcccgcatcggctggacaccactgcagttcttcttccgcagcctgccgttcgaggaagtcagcgcctggtacgccatggccgacgtgatgtggattaccccactgcgcgacggcctcaacctggtggccaaggaatttgtcgccgctcaaggcctgctggatggccgtggcgtgctggtactttcggagtttgccggcgctgccgccgagctcaaaggcgcgctactgaccaacccgcatgacccggtggatatgacgcaaacctgttatgtggcgctgaacatgcctaaggccgaggcccaggcacgcctgcgtgagctgttcgatatcgtcaactacaacgatatccgccgctggggtgatgaattcctcgccgccgtcagcgacccgcaggagcaactggaccgtgccctcgggctggtcggctag

SEQ ID NO: 17351 - protein, 500 aa, Pseudomonas anguilliseptica
MVYHRLPYEEFRGADGKLQRRRPTSPNGIIPTLLSFFGDGRAGSWVAWAEHDENSGETFDSHTTVDAERYPKLTAARVALSKEEVDIFYERFSKEAFWPTLHTFWERAQFREDDWQVFLKVNRAFAERTALEAAEGATVWLHDYNLWMVPGYLRELRPDLRIAFFHHTYFPSADVFNVLPWRRQIIGSLLQCDYIGFHIPRQVENFVDAARGVMPLQTVSRQNCAPRFITYGCAVGLERMTTAVDTGNRVVKLGAHPVGLDIERVRSALAAPKIREMMERLRSELAGVKLILSVERLDYTKGILEKLNAYERLLEENPELLGKVTLVTVCVPAAKEMTIYDELQGQIEQAVGRINGRFARIGWTPLQFFFRSLPFEEVSAWYAMADVMWITPLRDGLNLVAKEFVAAQGLLDGRGVLVLSEFAGAAAELKGALLTNPHDPVDMTQTCYVALNMPKAEAQARLRELFDIVNYNDIRRWGDEFLAAVSDPQEQLDRALGLVG

SEQ ID NO: 17352 - DNA, 1503 bp, Synechococcus sp
  CDS (1)..(1503)
atgaaatcttctctcgtcattctctaccatagggaaccctatgatgaggtgcgcgaaaacggtaaaaccttctaccgtgacaaaacaagccctaacgggatcatgccgacccttaaaagcttctttgccaacgctgaacaaagcacctgggtcgcttggaaacaaatctctggcaaacaacaagaaaatttccaagccaagatggcatttcccggtcaggaaaactccgtggttcaccgcatccccttgtccgccgaccaggtcaaaaacttctatcacatcacctcaaaagaagccttctggccgattctgcactccttcccctggcagtttacctatgactcctcagactgggaaaattttaagcaaatcaacgaaatgtttgccgaggctgcctgcgaagatgccgacgatgacgccctcttttgggtccatgactataatctctggctgaccccctactttatccgccagaagaaacccaacgctaaaattgcctttttccaccacacgccatttccgagtgttgatatttttaacattctgccgtggcgtgaagcgatcgtagacagtctcctctgctgtgacctgtgtggcttccatttgccccgctacgtgcaaaactttgtcgccgtcgcccggagtttgcgcaaggtcgaaattacccgccaagtgcccgtcgatgagcacgcctttactgccgtaggcaccgccctcgcagaacccgaaattaccacccagttgaaatataaagatcacctggtgaatttggatgctttccccgtgggcacaaaccccacccagatccgtgcccaggtagagaaagccagtacccaggagcgaatccgcaaaatccgggaagaactaggcagcaacaagctgattttgtccgctggacgggtggactacgtgaagggcaccaaggaaatgttggtctgctatgaacgcctactagaacggcgaccggagttgcaaaccaaagtgaatctggtggttgccgcggccaaggctgcctctgggatgcgagtttataaaaatgcccaaagtgaaattgagcgactcgtaggtcggatcaatggtcgctttgccaatttgaactggaccccgattttgctctttaccagtgccctctcctacgaggaacttctcggtttctttggggccgcagatattgcctggattacgccgctgcgggatggcttgaatctagtcgccaaagagtatgtggtcgcccatggttgcgatgatggggtcttgatcctgtcagaattcgccgggtcagcggtggaactgcccgatgcgatcctcaccaatccttacgcggcgaagcggatggatgaatccattgatcaagccctggccatgcccgtcgaggaacaacaacggcgtatgaagagtatgtaccaggcgatccaacgctatgacgtgcagcagtgggccaatcatatgttccgggaagccaaggcaacggcagtcctgggtaaggagccgacccccgtctag

SEQ ID NO: 17353 - protein, 500 aa, Synechococcus sp
MKSSLVILYHREPYDEVRENGKTFYRDKTSPNGIMPTLKSFFANAEQSTWVAWKQISGKQQENFQAKMAFPGQENSVVHRIPLSADQVKNFYHITSKEAFWPILHSFPWQFTYDSSDWENFKQINEMFAEAACEDADDDALFWVHDYNLWLTPYFIRQKKPNAKIAFFHHTPFPSVDIFNILPWREAIVDSLLCCDLCGFHLPRYVQNFVAVARSLRKVEITRQVPVDEHAFTAVGTALAEPEITTQLKYKDHLVNLDAFPVGTNPTQIRAQVEKASTQERIRKIREELGSNKLILSAGRVDYVKGTKEMLVCYERLLERRPELQTKVNLVVAAAKAASGMRVYKNAQSEIERLVGRINGRFANLNWTPILLFTSALSYEELLGFFGAADIAWITPLRDGLNLVAKEYVVAHGCDDGVLILSEFAGSAVELPDAILTNPYAAKRMDESIDQALAMPVEEQQRRMKSMYQAIQRYDVQQWANHMFREAKATAVLGKEPTPV

SEQ ID NO: 17354 - DNA, 1395 bp, Rhizobium sp
  CDS (1)..(1395)
atgagccgtctcgtcattgtttccaatcgcgtacctgttccggacaagggtggcattgcgccggccggtgggctggcggtcgcgctgaaagtcgccctcgaagagcagggcggcggcatatggatgggctggtcgggaaagtcgagtggcgaggacgagccggcgccgcttgcgcaactgcagcagggcaatattacctatgcactgacggatctgaccgataccgacgtagaggaatactaccacggcttcgccaaccgcgttctctggccgatttgccactaccgccttgatctcgccgaatacggtcgcaaggaaatggccgggtatttccgcgtcaaccgcttcttcgcccatcgcctggcgccgcttgtcaaacccgatgacgtcatttgggtgcacgactaccccttgattcctctcgccgcggaactgcgtcagatgggcctggagaaccgcatcggcttcttcctccacattccctggccgcctgcagacgtactcttcacgatgcccgttcacgaggagatcatgcgcggcctgtcgcactacgacgtcgtcggctttcagaccgatcatgaccttgagaacttcgccagctgcctcaggcgggaaggcatcggcgacgcacttggcggaggccgcttgagtgcctatggccgcatattcaaaggcggcgtctatgcaatcggcatcgagactgcggccttcgccgaattcgccaaaaaggcatcgaccaacagcacggtcaaaaaggcgcgtgaaagcatcgagcgccgcagcctcatcatcggtgtcgatcgcctcgattattccaagggactgacgcagcgcatcgaagcgtttgagcgcttcatcctggccaatccggcacagcgggggcgtgtcacctatctgcaaatcacgccaaagtcgcgctccgaagtgccggaatatgaagccatgcaacgcactgttgccgaacaggccggcagggtgaacggcgcgctcggcgccgtcgattgggtgcctatgcgctacatcaaccgctcggtgggccgccgcgttcttgcagggctttaccggcttggcaaagtcggcctcgtgacgccgcttcgagacggcaagaacctcgtcgcaaaggaatatgttgccgcgcaggatccggacgatccgggcgtgcttgttctttcgcgcttcgcgggcgctgcccgcgagctacagggagcacttcttgtcaatccctacgacatagagggcaccgccaacgccatggcgcgctcgctcagcatgccgctggaagagcggcaggaacgctggacgacgatgatggatcaattgctggaacacgacgtttcgcgctggtgccgggattttctcaatgatctgacggcatcatcagatcgatgtggttag

SEQ ID NO: 17355 - protein, 464 aa, Rhizobium sp
MSRLVIVSNRVPVPDKGGIAPAGGLAVALKVALEEQGGGIWMGWSGKSSGEDEPAPLAQLQQGNITYALTDLTDTDVEEYYHGFANRVLWPICHYRLDLAEYGRKEMAGYFRVNRFFAHRLAPLVKPDDVIWVHDYPLIPLAAELRQMGLENRIGFFLHIPWPPADVLFTMPVHEEIMRGLSHYDVVGFQTDHDLENFASCLRREGIGDALGGGRLSAYGRIFKGGVYAIGIETAAFAEFAKKASTNSTVKKARESIERRSLIIGVDRLDYSKGLTQRIEAFERFILANPAQRGRVTYLQITPKSRSEVPEYEAMQRTVAEQAGRVNGALGAVDWVPMRYINRSVGRRVLAGLYRLGKVGLVTPLRDGKNLVAKEYVAAQDPDDPGVLVLSRFAGAARELQGALLVNPYDIEGTANAMARSLSMPLEERQERWTTMMDQLLEHDVSRWCRDFLNDLTASSDRCG

SEQ ID NO: 17356 - DNA, 1437 bp, Candida albicans
  CDS (1)..(1437)
atggttcaaggaaaagtcttggtggtttcaaatagaatacctgttacaatcaaaagattggataatggttcatacgattattccatgtcctccggtggactcgttacagcattacaaggtttgaaaaaaacaactgagtttcaatggtatggatggcctggattggaaattccagaagatgagcaaactaaagtaaatgacgaattgaaatccaaattcaattgtacagccatatttttaagtgatacgattgctgatttacattataatgggttttcaaatagtattttatggccacttttccattatcatcctggggaaatgaactttgatgaaaatgcatgggcagcatatattgaagccaataagaaatttgcattggaaatagtcaaacaagtcaatgatgatgatatgatttgggttcatgattatcatttaatgcttttgccagaaatgttaagacaagaaattggtaacaagaagaaaaacattaaaattggattcttcttgcacacaccattcccatcatcagaaatttatcgtattttgccagttcgtaaagaaattcttgaaggtgtgttgagttgtgatttaattggattccatacctatgattacgcccgtcatttcatcagttcggtttcaagaatcgtgccaaacgtcagtactttacctaatggtataaagtaccagggacgttcgatcagcatcggggctttccccattgggattgatgttgataactttattgacggtttgaaaaaagatagtgttgtggaacgtattaaacaattgaaatctaaattcaaagacgttaaggttattgttggtgttgatagattagactatatcaaaggtgttccgcaaaaattacatgcatttgaagtctttttgaatgaaaatcccgaatggattggcaaagtagttttggtccaagttgctgttccatccagaggtgatgttgaagaatatcaaagtttaagaagtacagtgagtgaattggttggaaggatcaatggtgaatttggtactgttgaatttgtccctatacattacttgcacaaatccatcccctttgatgaattgatcagtttatacaatatcagtgatgtttgtttggttagttctactcgagatggtatgaatttggttagttacgagtatattgcttgtcaacaagatcgcaagggtgtcttgatcttatctgaatttgctggtgcagcacaatcacttaatggtgccttgattgttaacccatggaacactgaagatttaagtgaagcaatcaaagaaagtttaacattaccagaagaaaagagggaatttaatttcaagaaattgttcacctacatttcgaaatacacttcaggattttggggtgaaagttttgttaaagaattgtacaaatgtaacccacaaaagagtttgagggactag

SEQ ID NO: 17357 - protein, 478 aa, Candida albicans
MVQGKVLVVSNRIPVTIKRLDNGSYDYSMSSGGLVTALQGLKKTTEFQWYGWPGLEIPEDEQTKVNDELKSKFNCTAIFLSDTIADLHYNGFSNSILWPLFHYHPGEMNFDENAWAAYIEANKKFALEIVKQVNDDDMIWVHDYHLMLLPEMLRQEIGNKKKNIKIGFFLHTPFPSSEIYRILPVRKEILEGVLSCDLIGFHTYDYARHFISSVSRIVPNVSTLPNGIKYQGRSISIGAFPIGIDVDNFIDGLKKDSVVERIKQLKSKFKDVKVIVGVDRLDYIKGVPQKLHAFEVFLNENPEWIGKVVLVQVAVPSRGDVEEYQSLRSTVSELVGRINGEFGTVEFVPIHYLHKSIPFDELISLYNISDVCLVSSTRDGMNLVSYEYIACQQDRKGVLILSEFAGAAQSLNGALIVNPWNTEDLSEAIKESLTLPEEKREFNFKKLFTYISKYTSGFWGESFVKELYKCNPQKSLRD

SEQ ID NO: 17358 - DNA, 1515 bp, Emericella nidulans
  CDS (1)..(1515)
atgcccggcgttgagaaatcctcacaaaacgaatcgagacttcttctcgtttcaaatcggttacccatcaccataaagcgatcagaagatggcaaatatgatttttccatgtcatcaggtggcctcgttagtggtttgagtggcttatcgaaaaccacaaccttccagtggtacggctggcccggtctggaggttccggaagaggagatcccgactctgaagaaccggttaaaggaagaatataacgctattccggtctttatcgatgatgagcttgcagacagacactacaatgggttttctaactccatcctttggccacttttccattaccaccccggcgaaatcacattcgacgagtctgcttgggaagcttataaagaggcaaatcgtctatttgcacaggctgttgcgagccaagttcaggatggcgacttaatttgggtgcatgactaccatttgatgctcctacctgaaatgctccgagaagaaattggaaacaccaagaaaaacatcaagattggtttcttcctccacactccattccccagcagtgaaatttaccgaattctgccggtacgaaacgagctattgcttggacttctccactgtgacctcatcggtttccacacttatgactacacgagacatttcctcagtgcttgctcgcggttgctgggactgccaaccactcctaatgggatagaattccagggaaagataatcgcttgcggcgctttccctattggcattgatccggagaaattcaaggaaggcttgaagaaagaaaaagtccaaaagcgtattgcaactttggagcagaaattccagggcgtgaagcttatggtaggcgttgaccggctggattatatcaagggcgttcctcaaaagctccatgcccttgaagtattcctgagtgaccatcctgaatgggtgggcaaggtggttcttgtccaggtcgccgttcccagtcgtcaagatgtagaagaataccagaatttgagggctgttgtgaacgaattggtgggcaggataaacgggaaatttggaactgtcgaatttatgccgatccattttctccacaaatcggtgaatttcgatgaactcattgctctctacgccgtgtccgatgcatgcgtcgtttcttccacccgagatggaatgaacctcgtttcgtacgagtacatcgctacccaggagaagcgccacgggtcgttagtcctgtctgaatttgctggtgccgcccagagtctcaacggaagcataatcgttaacccttggaatactgaggagcttgcagcggcttaccatgaagccgtgacgatgagtgatgaacagcgagcgcttaacttctcgaaactggataaatatgtcaacaagtacacaagtgccttttggggtcaatcctttgttaccgaattgacaagaatttcggagcaagccgcagggaaacttcccaccaaagagactcctgtgaacggagagacgtcaaagctagagacttcgtcacagtag

SEQ ID NO: 17359 - protein, 504 aa, Emericella nidulans
MPGVEKSSQNESRLLLVSNRLPITIKRSEDGKYDFSMSSGGLVSGLSGLSKTTTFQWYGWPGLEVPEEEIPTLKNRLKEEYNAIPVFIDDELADRHYNGFSNSILWPLFHYHPGEITFDESAWEAYKEANRLFAQAVASQVQDGDLIWVHDYHLMLLPEMLREEIGNTKKNIKIGFFLHTPFPSSEIYRILPVRNELLLGLLHCDLIGFHTYDYTRHFLSACSRLLGLPTTPNGIEFQGKIIACGAFPIGIDPEKFKEGLKKEKVQKRIATLEQKFQGVKLMVGVDRLDYIKGVPQKLHALEVFLSDHPEWVGKVVLVQVAVPSRQDVEEYQNLRAVVNELVGRINGKFGTVEFMPIHFLHKSVNFDELIALYAVSDACVVSSTRDGMNLVSYEYIATQEKRHGSLVLSEFAGAAQSLNGSIIVNPWNTEELAAAYHEAVTMSDEQRALNFSKLDKYVNKYTSAFWGQSFVTELTRISEQAAGKLPTKETPVNGETSKLETSSQ

SEQ ID NO: 17360 - DNA, 2695 bp, Pichia angusta
  CDS (793)..(2220)
cttaaataccacaataggaaaattatcaataaagcttttcggatttcattacgttatatcgcaaaaaaatagtcgagctttctgaaccgttcgttaataaaaaaatagttttttcagatttctatgtgaggcagtcacgatagaattccatcgaactcgtcagcgccaaatgtgaatgcggctttcaaaagctttgtcgaatttgggatgggaatccatgaatcgaagatgtcaaaatgggggatcacaaaagtacactcacgaggaaaatcaaaaccttctcgtacctttaacacatacggaaatgatcgatcgatttgagaagattcctcaatgattttcgtcatatataggtatctgaggtatttatggaccgattcgtaataacatcatatacatcgcgctttgtccctgtcccagagatttcgatgaaaaaagcgaattttattctaatatttgaagcatgccaaacatggggcagttgatttgtgtgagggtaaaatatcatgaattgcacccatcaaatgcagcaagatattgaccaatcctataatagaaaacagacttaccacaaatagattgtgatgacgatattatgaatctccagatgaaaggctcgaaagctatgaagcctcttgaaacttttcatggtgagataatattttcgaaatttccacgaacttctaaaacgcaattattgaatataaaggaaaaataatatttccatatagcaagcaaatcaagctgcactcctcatccttaaaactaataaatcttacccatttgataccaatggtcaaaggtaatgttatagtggtttcaaatagaatcccagtcactattaagaagactgaagatgatgaaaatggaaaatcaagatacgactatacaatgtcatcaggcggattagtgacggcattacaagggctcaaaaatccatttcgatggtttggatggcctgggatgtctgttgatagcgaacagggacgacaaactgtcgagcgggatttgaaggaaaagttcaattgttatccgatatggttaagtgacgaaattgcagacttacattataacggctttagcaattctatactttggccattgttccactatcacccaggggagatgaattttgatgaaattgcttgggccgcttatttggaagcaaataaactgttttgccaaacgatcttaaaggagataaaagacggggacgttatctgggtacatgattatcatctcatgttgttgccttcactgctaagagaccaacttaatagtaaggggctaccgaatgtcaaaattggctttttccttcatactccttttccttcaagcgaaatatacaggatacttcctgtaaggaaagaaattctcgaaggagtgcttagttgtgatttgataggtttccacacctatgattatgtccgtcactttcttagttcggttgaaagaatattgaaattgcgaacgagcccacaaggtgttgtctataatgatagacaggtgactgtaagtgcttatccgattggcattgacgttgacaaattcttgaatggtcttaagactgatgaggtcaaaagcaggataaaacagctggaaaccagatttggtaaagattgtaaacttattattggggtggacaggctggattacatcaaaggtgtacctcaaaaactccacgcgtttgaaattttcttggagagacaccctgagtggattggaaaagttgttttgatacaggtggctgtcccctcacgaggggacgttgaagaatatcaatctttgagggcagctgtaaatgagctagtgggaagaatcaatggtagatttggtaccgtcgaatttgttcctatccatttccttcataaaagcgtgaacttccaagagctgatatctgtctacgctgctagtgatgtttgtgtagtgtcatcgacacgggacggaatgaatttggtcagttatgaatacattgcttgtcaacaagatcgaaagggatctctagtactaagtgaatttgcgggagctgctcagtcattaaatggcgctctcgtagtgaatccatggaatacagaagaactcagtgaagctatttacgaaggcttgatcatgagtgaagagaaaaggaggggcaattttcagaagatgttcaagtacattgagaaatatactgcaagttattggggagagaactttgtgaaagaattgacgagagtgtgattactgtggtttgcaggttaatttgaaatgttcacttgtacttgaagaattttatattatatacatgttatacatcaataggataaaaattaagtagacaaagttatcattttgttgggctgtaaaaattgaacgataacaatatatttgacaaaattaatttgatctaattgagctggagggcgtaatatatttggtttcctgaatcatcttgtagatcacaatatggggcagcttctttcgcagccgatcacagagaaacacatcacacttgtccaacatgatcacatatcgcattcaatcggggaaatgcaaggatacaggttgaccatggaagacgcgttctgtgatttgaacgaaagaatattcgtgacggaagagggacttgacatcagaaaacaagacgagaatacagagggtgatctggagtctcttcaaattaacatttatggtgtctttgacggacatggcggtt

SEQ ID NO: 17361 - protein, 475 aa, Pichia angusta
MVKGNVIVVSNRIPVTIKKTEDDENGKSRYDYTMSSGGLVTALQGLKNPFRWFGWPGMSVDSEQGRQTVERDLKEKFNCYPIWLSDEIADLHYNGFSNSILWPLFHYHPGEMNFDEIAWAAYLEANKLFCQTILKEIKDGDVIWVHDYHLMLLPSLLRDQLNSKGLPNVKIGFFLHTPFPSSEIYRILPVRKEILEGVLSCDLIGFHTYDYVRHFLSSVERILKLRTSPQGVVYNDRQVTVSAYPIGIDVDKFLNGLKTDEVKSRIKQLETRFGKDCKLIIGVDRLDYIKGVPQKLHAFEIFLERHPEWIGKVVLIQVAVPSRGDVEEYQSLRAAVNELVGRINGRFGTVEFVPIHFLHKSVNFQELISVYAASDVCVVSSTRDGMNLVSYEYIACQQDRKGSLVLSEFAGAAQSLNGALVVNPWNTEELSEAIYEGLIMSEEKRRGNFQKMFKYIEKYTASYWGENFVKELTRV

SEQ ID NO: 17362 - DNA, 1542 bp, Schizosaccharomyces pombe
  CDS (1)..(1542)
atgtcggatgctcatgataccataaaatcactcacgggtgatgcttctaactctcggcgtttgatcgtcgtctccaatcgtttaccaattacaattaagcgaaaggataatggcacatatgactttagtatgtcttcgggtggtctggtcagtgctttgagcggtctcaagaagctcatgacctttcaatggttgggctggtgcggtcaagagattcctgaggatgaaaaacccatgattatccagcgtttgcaagatgagtgtagcgctattcccgtctttttggatgatgagactgccgaccgccattacaacggatttagtaacagcattctttggcccttgttccactaccatcctggtgaaattaattttgacgaggaaaattgggaggcctatcgtgcggctaactacgcttttgccgaggccattgtcaaaaatctgcaggatggtgatttaatttgggtgcaggattatcatttgatggttcttcctcaaatgttgcgtgaattaatcggtgataagtttaaggatatcaaaattggcttcttcttgcacactcctttcccaagtagcgaaatctatcgtgttttacccgttagaaacgaaatccttgaaggtgtactcaactgtgatctcgttggcttccatacctacgactatgcccgtcactttttgtctgcatgctctcgtatccttaatcttagcacactacctaacggtgtggaatacaatggtcaaatggtcagcgtcggcaccttccccatcggtattgatcccgaaaagttctctgatgctctgaagtctgacgtggtaaaggatcgcattgcaagcatcgaacgtagactacaaggcgttaaggtgattgtgggtgtcgatcgtttggactacattaagggtgttccccaaaaattccatgcctttgaagtgttcttagaacaataccctgaatgggttggaaaggtcgtgttggttcaagttgccgttccttctcgtcaagatgtcgaagagtatcagaatcttagagccgttgtcaatgagcttgttggccgtattaacggtcgttttggtactgttgaatatacacctattcatttcttacataaaagtgttcgctttgaagagctggttgctctgtataacgtttcagacgtttgtttaattacctcaactcgtgatggtatgaatcttgtttcatacgagtacatttgcactcaacaagagagacatggtgccctaattcttagtgaatttgccggtgctgcccagtcactcaatggtagtattgtaattaatccatggaacacggaggaattagcaaactccattcatgatgccctcactatgccggagaaacaacgtgaggctaatgagaataaattattccgatatgttaataagtataccagtcaattctggggtcaaagctttgtcggtgagttgcaacgcattcaacactacagccaccctcaccccagaagaacgaatccgattttacgaaccaagtctgctcaagtgctgtcgatgaattctagctcgtaa

SEQ ID NO: 17363 - protein, 513 aa, Schizosaccharomyces pombe
MSDAHDTIKSLTGDASNSRRLIVVSNRLPITIKRKDNGTYDFSMSSGGLVSALSGLKKLMTFQWLGWCGQEIPEDEKPMIIQRLQDECSAIPVFLDDETADRHYNGFSNSILWPLFHYHPGEINFDEENWEAYRAANYAFAEAIVKNLQDGDLIWVQDYHLMVLPQMLRELIGDKFKDIKIGFFLHTPFPSSEIYRVLPVRNEILEGVLNCDLVGFHTYDYARHFLSACSRILNLSTLPNGVEYNGQMVSVGTFPIGIDPEKFSDALKSDVVKDRIASIERRLQGVKVIVGVDRLDYIKGVPQKFHAFEVFLEQYPEWVGKVVLVQVAVPSRQDVEEYQNLRAVVNELVGRINGRFGTVEYTPIHFLHKSVRFEELVALYNVSDVCLITSTRDGMNLVSYEYICTQQERHGALILSEFAGAAQSLNGSIVINPWNTEELANSIHDALTMPEKQREANENKLFRYVNKYTSQFWGQSFVGELQRIQHYSHPHPRRTNPILRTKSAQVLSMNSSS

SEQ ID NO: 17364 - DNA, 1520 bp, Yarrowia lipolytica
  CDS (27)..(1436)
aacgagacatttccctgacagatataatgcccaacgtgctggtcatatcgaaccgtctgccggtgaccatttcccgcgaggaagatggcacctacaagtatacaatgagctcagggggcctggtaacagcgctgtcgggcctcaagcagtcgacgaccttccaatggtttgggtggcccggattagagatccccgaaaaagacaagccgcgactcatcaatgaccttgagaccatgttctcgtgcgtgcccgtgttcatggacgacgatctcgccgacctccattacaatggcttctccaactccattctgtggcccttgttccactaccatcccggagaaatgaatttcgaccaggtggcgtgggaagcttacacacaggccaaccggctatttgccaaaaaggtggcatcaatcgtcaaacccggcgacattgtgtgggtccacgactaccacctcatgttgctacccgagatgctgcgtgaagagtgcgagaacaacagcgctctcgacggcctgaagattggattcttcctgcacacgccattcccatcttcggaaatctacagaattttgcctgtccgaaaggaggtgctgacaggtgtgctgtcgtgcaacctcattggcttccacacctacgactacgctcgccactttctgtcgtccgtctctcgaatcctggatctagaaaccatgcccaacggaacgtattacaaggggcgtcatgtcgtggtaggtgcgtttcctatcggtattgatgtcaacaagtttctcgaaggatgcaaacgaccagctgttcaggaacgaatcgcacagctccaggataagtttaagggcatcaaggtggttgtgggtgtcgacagattggattacatcaagggtgtgccccagaaacttcacgcctttgaggtcttcctgtcagaacaccccgaatggatcggcaaggtcgtgctggtgcaggtcgcagtgccttcccgaggactagtggaagagtatcagaacctgagagcagtggtgaatgagctggtcggacgtatcaacggtatgtttggtactgtcgagtttacgcccatccatttcatgcaccgatcggtggacttcaacgagctgattgctctctactcgatatcagatgtgtgtttcgtgtcgtctacgcgagacggaatgaacctagtgtcgtatgagtatgttgcttgtcaaactgagaagcacggatcgctgatcttgtctgaattcacaggtgcagctcagagtctcaacggagccctgattgtcaacccatggaacaccgaagacatggccgaggctctgtacgactctctgactttttcgcccgagaagaaggctgagaaccaccgcaagctgttcaagtacgttagtaagtacacctctcagcattggggcgaggcctttgtctccgagttgaagcggtgttgatagacatagataactatttattgggaggccaggagtagaaaataatgaaatgcaataacgagtgattagaaaaaaaaaaaaaaa

SEQ ID NO: 17365 - protein, 469 aa, Yarrowia lipolytica
MPNVLVISNRLPVTISREEDGTYKYTMSSGGLVTALSGLKQSTTFQWFGWPGLEIPEKDKPRLINDLETMFSCVPVFMDDDLADLHYNGFSNSILWPLFHYHPGEMNFDQVAWEAYTQANRLFAKKVASIVKPGDIVWVHDYHLMLLPEMLREECENNSALDGLKIGFFLHTPFPSSEIYRILPVRKEVLTGVLSCNLIGFHTYDYARHFLSSVSRILDLETMPNGTYYKGRHVVVGAFPIGIDVNKFLEGCKRPAVQERIAQLQDKFKGIKVVVGVDRLDYIKGVPQKLHAFEVFLSEHPEWIGKVVLVQVAVPSRGLVEEYQNLRAVVNELVGRINGMFGTVEFTPIHFMHRSVDFNELIALYSISDVCFVSSTRDGMNLVSYEYVACQTEKHGSLILSEFTGAAQSLNGALIVNPWNTEDMAEALYDSLTFSPEKKAENHRKLFKYVSKYTSQHWGEAFVSELKRC

SEQ ID NO: 17366 - DNA, 1645 bp, Zygosaccharomyces rouxii
  CDS (77)..(1534)
gattcctactgttaatcaattctcaatcccttaatttgtacatttgctttattcctgaaaataaggtagttgctagatgactgtatccaaaaaagatagtggtaaaacttccccgggcaatatcgttgttgtttccaacagattgcccgtaacgatcagtaaaaatgctatgggtaagtatgaatacaaattttccagtggtggtcttgttactgcattacaagggttgaaaaagacttctactttccagtggtatggttggccaagtcttgaaattcctgatgacgaaaaacctgttgtcaagaaagacttacttgaaaaattcaatgcaatcccaattttcttatcagatgaaattgcagatttgcactataatggatttagtaactcgattttatggccacttttccactaccatccgggtgagattaatttcgatgaaaatgcgtggttagcctacaacgaagcaaatgctacatttgcaagtgaaatctgtggtaatctacaagataatgatctggtttgggtccatgattatcatttgatgcttttgcctgagatgctaagtgctcacattcaaaggaaaggtttgaaaaacattaaattgggatggtttttgcatacacctttcccctcaagtgaaatttacagaattctgcctgtgagacaagagattttaaacggtgtgttgagttgtgatttaattggattccacacttacgattacgcaagacatttcttatcatcgattcaaagatgtttaaacgttaacactttgcctaatggggtggagtaccaggggaggttcgtcaacgtgggggctttccccattggtattgacgtggatacttttaaggaaggtttacaaaaggagaatgtcaaacagaggattaggactttacaagagagattcaaaggttgtaaaattatggttggtgtcgatagattggattatatcaagggggttcctcaaaaattacatgcaatggaggttttccttaacgaacatcccgaatggatcggtaaggttgttctagtgcaattggcaatccccagtagaggtgatgtggaagaatatcaatatttacgttcggtggttaacgaattagtgggacgtattaatggtcagtttggtacaattgagtttgtcccaattcattttatgcacaaatcgattcctttcgaagaattgatttcgttatatgcggtcagtgatgcttgtatcgtctcatcaactcgtgatggtatgaacttagtctcctacgagtacatcgcttgtcggaagaaaggctccctcatattgagtgaatttacgggtgctgcgcagtcattaaacggtgctctcatagtgaacccctggaacacagatgaactttcagattcgattaatgaggctctaacgctccctgatgaaaagaaggactcaaactgggaaaaactctacaagtacatctccaaatacacttctgcctactggggggaaaatttcgttcacgaattaaacgctaccggtaccatcaagacaggtcaatagataataagagggctctaaccgaacccgacagcggctactatactgtcaagatactacttattatatactctacgtactactactgtactactcacgtgaccattgagctca

SEQ ID NO: 17367 - protein, 485 aa, Zygosaccharomyces rouxii
MTVSKKDSGKTSPGNIVVVSNRLPVTISKNAMGKYEYKFSSGGLVTALQGLKKTSTFQWYGWPSLEIPDDEKPVVKKDLLEKFNAIPIFLSDEIADLHYNGFSNSILWPLFHYHPGEINFDENAWLAYNEANATFASEICGNLQDNDLVWVHDYHLMLLPEMLSAHIQRKGLKNIKLGWFLHTPFPSSEIYRILPVRQEILNGVLSCDLIGFHTYDYARHFLSSIQRCLNVNTLPNGVEYQGRFVNVGAFPIGIDVDTFKEGLQKENVKQRIRTLQERFKGCKIMVGVDRLDYIKGVPQKLHAMEVFLNEHPEWIGKVVLVQLAIPSRGDVEEYQYLRSVVNELVGRINGQFGTIEFVPIHFMHKSIPFEELISLYAVSDACIVSSTRDGMNLVSYEYIACRKKGSLILSEFTGAAQSLNGALIVNPWNTDELSDSINEALTLPDEKKDSNWEKLYKYISKYTSAYWGENFVHELNATGTIKTGQ

SEQ ID NO: 17368 - DNA, 3069 bp, Saccharomyces cerevisiae
  CDS (1)..(3069)
atgatcaaggtagactgcaacaaccaggaattgagcaacaacaagcaagaaagaagcagttctgtaacttcggcaagctctcattatattggcttacctcaggaggcgcaaattaacggtgaacccttacaaagggccaatgtgggctctcctgctacgggagttaactatcataatgagatggaaatgctttcctcagagcaattcctggaagagctgactgccaatgccactcatgcagcaaactctggtattccgccagctaataacccagtttcttctggctcaactgcccagcggccttcagtcgaggaattcttttctgctccgtctgctagagtctgttctccctcccaggaagcttctgcttcgtctatttctgctagtcgttcatcggctcaccacaacgatttgagctccagccttatgaaaaatcccaatttgtcatttgattcacatccacccagggtcagaagctcatccaagagtgctgtaatcactcccgtctctaaaagcgttccagatgtcgatcctgctgttgtagatgtcgcaaaagttagagaagagtttcaacagcaagcctccttgccttccatgaaaagagtttccggaagcaccgctggagactcttccattgcttcttcgagttctaatctcaggtactcacagcaatttcaggataactttatcgaagacactgatagtgaggatgacattgattctgatttggagaccgatgctactaagaaatacaacgtcccaaaatttggtggctattccaataacgcaaagttaagagcatctctaatgagaaactcgtatgagctattcaaacatttgccatggacaatagtcgacagtgacaaagggaacggatccttgaaaaatgcagttaatattgcagttgctgaaaagacagtgaaagaacctgtttcctgggtaggtacaatgggaatccctactgacgaacttcctcacgaagtttgccataagatttcaaagaaattagaacaggatttttcttcttttccagtggtcacggacgatattacttttaagggtgcttataagaactacgccaaacagattttatggcccactctacattatcaaattccagataatccaaattcaaaggcttttgaagaccattcttgggactactatcaaaaagtgaatcaaaagttttctgataggatagtttccgtttacaaacctggcgacacaatttggatccatgattatcatttgatgcttgtcccacaaatggtgagagagaaactgcctaaagctaagattggatttttcttacacgtatcatttccaagtagtgaggtcttcagatgccttgctaacagagaaaggattcttgaaggtattattggtgcaaactttgttgggtttcaaactaaagaatacaaaagacatttcctacaaacttgtaacagattgcttgctgcggatgtctctaatgatgaagtcaaataccattgcaatattgtttccgtgatgtatgcgccaattggtattgattattaccatttgacatcgcagttgagaaatggttctgtacttgaatggcgccaattaattaaagaaagatggcgtaataaaaaactgattgtttgtcgcgatcaatttgacagaattagaggtcttcagaaaaaaatgttagcctacgagaggtttttgatagaaaaccctgaatacatcgaaaaagttgttttgatccaaatctgcatcggtaagagttccgatcctgagtacgaacgtcaaattatggttgtcgttgatagaatcaattctttgtcttcgaacatcagtatctctcaaccagtggtctttttgcatcaagatttagattttgctcaatatttggcattgaattgtgaagctgacgttttccttgtggatgcgctgagagaaggtatgaatttaacatgtcatgagttcattgtcagttcattcgaaaaaaatgcgcctctattattatctgaattcactggtagttcttctgtcctaaaggaaggtgccatcttaataaacccatgggatataaatcatgtagcacaaagtatcaagagaagtttagaaatgtctccagaagaaaaaaggcgtaggtggaaaaaattattcaaatctgttattgaacatgattcggataattggattacaaagtgcttcgaatacataaataatgcttgggagtccaaccaagaaacgtctactgttttcaatttggctccagaaaaattctgtgctgattacaaagcctccaaaaagcatttatttatcttcaagatttcagaacctccaacgtccagaatgctatccttgctaagtgaattgagttcaaataatatagtttacgttttgagttcatttacaaagaatacattcgaaagcttatacaatggtgttctaaacatcggattgatagcggagaatggtgcctacgtaagagttaatgggtcgtggtacaacatcgtggaagagcttgattggatgaaagaggtggcaaagatctttgacgagaaagtcgagaggttacctggttcatactacaaaatcgctgattctatgatcagattccatacagaaaacgctgatgatcaagatcgagtcccaactgttattggggaagccattacgcacataaacaccttatttgatgacagggatattcacgcttatgtgcataaggatattgtcttcgttcaacaaacggggctagccttagccgccgctgagtttttgatgaaattttacaacagtggcgtcagtcctactgacaatagcagaatatctctatcaagaacatcctcttcgatgtccgtcggtaataataagaagcatttccaaaaccaggtagatttcgtttgcgtttccggttcgacatcacctattattgaaccattatttaaattagtgaagcaagaggttgaaaagaacaatctaaaatttggttacaccattctttacggtagctcaagatccacttatgccaaggaacatatcaatggtgtcaatgaactttttaccatccttcatgacttgacagccgcctaa

SEQ ID NO: 17369 - protein, 1022 aa, Saccharomyces cerevisiae
MIKVDCNNQELSNNKQERSSSVTSASSHYIGLPQEAQINGEPLQRANVGSPATGVNYHNEMEMLSSEQFLEELTANATHAANSGIPPANNPVSSGSTAQRPSVEEFFSAPSARVCSPSQEASASSISASRSSAHHNDLSSSLMKNPNLSFDSHPPRVRSSSKSAVITPVSKSVPDVDPAVVDVAKVREEFQQQASLPSMKRVSGSTAGDSSIASSSSNLRYSQQFQDNFIEDTDSEDDIDSDLETDATKKYNVPKFGGYSNNAKLRASLMRNSYELFKHLPWTIVDSDKGNGSLKNAVNIAVAEKTVKEPVSWVGTMGIPTDELPHEVCHKISKKLEQDFSSFPVVTDDITFKGAYKNYAKQILWPTLHYQIPDNPNSKAFEDHSWDYYQKVNQKFSDRIVSVYKPGDTIWIHDYHLMLVPQMVREKLPKAKIGFFLHVSFPSSEVFRCLANRERILEGIIGANFVGFQTKEYKRHFLQTCNRLLAADVSNDEVKYHCNIVSVMYAPIGIDYYHLTSQLRNGSVLEWRQLIKERWRNKKLIVCRDQFDRIRGLQKKMLAYERFLIENPEYIEKVVLIQICIGKSSDPEYERQIMVVVDRINSLSSNISISQPVVFLHQDLDFAQYLALNCEADVFLVDALREGMNLTCHEFIVSSFEKNAPLLLSEFTGSSSVLKEGAILINPWDINHVAQSIKRSLEMSPEEKRRRWKKLFKSVIEHDSDNWITKCFEYINNAWESNQETSTVFNLAPEKFCADYKASKKHLFIFKISEPPTSRMLSLLSELSSNNIVYVLSSFTKNTFESLYNGVLNIGLIAENGAYVRVNGSWYNIVEELDWMKEVAKIFDEKVERLPGSYYKIADSMIRFHTENADDQDRVPTVIGEAITHINTLFDDRDIHAYVHKDIVFVQQTGLALAAAEFLMKFYNSGVSPTDNSRISLSRTSSSMSVGNNKKHFQNQVDFVCVSGSTSPIIEPLFKLVKQEVEKNNLKFGYTILYGSSRSTYAKEHINGVNELFTILHDLTAA

SEQ ID NO: 17370 - DNA, 1554 bp, Aspergillus niger
  CDS (1)..(1554)
atgccttccctcgaaaaccccacctttcagaatgaggctcgcttgctcctcgtctccaatcggcttccaatcacgatcaagcgatcggatgacggtcgctatgacttctccatgtcctccggtggcctggtcagtggactaagtggcctgtccaaatccacaaccttccaatggtacggctggcccggtttggaggtcccggaggaggagattcccgtggtgaaggaacgcttgaagcaggagtataacgccgtgccagtgttcattgatgacgagctggcagaccgtcactacaatggcttttctaactccattctctggcccctcttccattaccatcccggtgagattacctttgacgagtccgcctgggaagcatacaaggaggccaaccgtcttttcgccaaagcggttgcgaaggaagttcaagatggcgacttgatctgggtgcatgattatcacttgatgcttctccctgagatgctgcgtgaggagatcggcgatagcaaggagaatgtcaagatcggcttcttcctccatacgcccttccctagcagcgagatctacagaattctcccagtccggaacgagttgttgctcggtgtcttgcattgcgacttgattgggttccatacctacgactatactaggcactttttgagtgcttgctcgcgactcttgggcttaacaactacgcctaatgggatcgaatttcagggcaagatcattgcctgcggtgccttccctatcggtatcgacccggagaagtttgaagaggggttgaagaaggagaaagtccagaaacgcattgcgatgctggaacaaaaattccagggcgtgaaactcatggtgggtgtggaccgcctggattacatcaaaggtgtcccccagaagttacatgcccttgaggtgttccttagcgatcatccggagtgggttggcaaggttgtcctggttcaggttgctgttcctagtcgacaagatgtggaggaataccagaacttgagggctgttgtgaatgagctggtgggccggattaacggcaaatttggcacggttgaattcatgcctatccatttcctgcacaagtcggtcaactttgacgagctaattgccctgtacgcggtttctgacgcctgcattgtttcgtcaacccgcgacgggatgaacctcgtcgcctatgagtacatcgccactcagaaaaagcgtcatggtgtcttggtgctttccgagttcgcgggtgctgctcagagccttaacggcagtatcatcataaacccctggaacaccgaagagctggcgggtgcttatcaggaagcggtaaccatgagcgacgagcagagagccctcaacttctccaagctcgacaaatatgtcaataaatatacaagtgcattctggggccagtccttcgtgacagaattgactcgcatatcggagcattcggcggagaagttccatgctaagaaggcttctttcagcgacaacaactccgagaacggggaaccttccaacggtgtagagactccggcccaggagcaggtggcacagtga

SEQ ID NO: 17371 - protein, 517 aa, Aspergillus niger
MPSLENPTFQNEARLLLVSNRLPITIKRSDDGRYDFSMSSGGLVSGLSGLSKSTTFQWYGWPGLEVPEEEIPVVKERLKQEYNAVPVFIDDELADRHYNGFSNSILWPLFHYHPGEITFDESAWEAYKEANRLFAKAVAKEVQDGDLIWVHDYHLMLLPEMLREEIGDSKENVKIGFFLHTPFPSSEIYRILPVRNELLLGVLHCDLIGFHTYDYTRHFLSACSRLLGLTTTPNGIEFQGKIIACGAFPIGIDPEKFEEGLKKEKVQKRIAMLEQKFQGVKLMVGVDRLDYIKGVPQKLHALEVFLSDHPEWVGKVVLVQVAVPSRQDVEEYQNLRAVVNELVGRINGKFGTVEFMPIHFLHKSVNFDELIALYAVSDACIVSSTRDGMNLVAYEYIATQKKRHGVLVLSEFAGAAQSLNGSIIINPWNTEELAGAYQEAVTMSDEQRALNFSKLDKYVNKYTSAFWGQSFVTELTRISEHSAEKFHAKKASFSDNNSENGEPSNGVETPAQEQVAQ

SEQ ID NO: 17372 - DNA, 25 bp, Primer
atgagtcgtttagtcgtagtatcta

SEQ ID NO: 17373 - DNA, 24 bp, Primer
ttacgcaagctttggaaaggtagc

SEQ ID NO: 17374 - DNA, 1062 bp, Escherichia coli K12; identical to SEQ ID NO: 2732
  CDS (1)..(1062)

SEQ ID NO: 17375 - protein, 353 aa, Escherichia coli K12; identical to SEQ ID NO: 2733

SEQ ID NO: 17376 - DNA, 1444 bp, Pseudomonas fluorescens; identical to SEQ ID NO: 2734
  CDS (156)..(1214)

SEQ ID NO: 17377 - protein, 352 aa, Pseudomonas fluorescens; identical to SEQ ID NO: 2735

SEQ ID NO: 17378 - DNA, 1484 bp, Haemophilus influenzae; identical to SEQ ID NO: 2736
  CDS (278)..(1342)

SEQ ID NO: 17379 - protein, 354 aa, Haemophilus influenzae; identical to SEQ ID NO: 2737

SEQ ID NO: 17380 - DNA, 1131 bp, Thermus aquaticus; identical to SEQ ID NO: 2738
  CDS (62)..(1084)

SEQ ID NO: 17381 - protein, 340 aa, Thermus aquaticus; identical to SEQ ID NO: 2739

SEQ ID NO: 17382 - DNA, 1196 bp, Aquifex pyrophilus; identical to SEQ ID NO: 2740
  CDS (51)..(1097)

SEQ ID NO: 17383 - protein, 348 aa, Aquifex pyrophilus; identical to SEQ ID NO: 2741

SEQ ID NO: 17384 - DNA, 1023 bp, Rickettsia prowazekii; identical to SEQ ID NO: 2742
  CDS (1)..(1023)

SEQ ID NO: 17385 - protein, 340 aa, Rickettsia prowazekii; identical to SEQ ID NO: 2743

SEQ ID NO: 17386 - DNA, 1329 bp, Myxococcus xanthus; identical to SEQ ID NO: 2744
  CDS (201)..(1229)

SEQ ID NO: 17387 - protein, 342 aa, Myxococcus xanthus; identical to SEQ ID NO: 2745

SEQ ID NO: 17388 - DNA, 1394 bp, Legionella pneumophila; identical to SEQ ID NO: 2746
  CDS (166)..(1212)

SEQ ID NO: 17389 - protein, 348 aa, Legionella pneumophila; identical to SEQ ID NO: 2747

SEQ ID NO: 17390 - DNA, 1224 bp, Treponema pallidum subsp. pallidum (syphilis spirochete); identical to SEQ ID NO: 2748
  CDS (1)..(1224): k means g or t/u

SEQ ID NO: 17391 - protein, 407 aa, Treponema pallidum subsp. pallidum (syphilis spirochete); identical to SEQ ID NO: 2749
  misc_feature (375)..(375): Xaa can be Cys or Phe

SEQ ID NO: 17392 - DNA, 1050 bp, Clostridium acetobutylicum; identical to SEQ ID NO: 2750
  CDS (1)..(1050)

SEQ ID NO: 17393 - protein, 349 aa, Clostridium acetobutylicum; identical to SEQ ID NO: 2751

SEQ ID NO: 17394 - DNA, 1047 bp, Listeria innocua; identical to SEQ ID NO: 2752
  CDS (1)..(1047)

SEQ ID NO: 17395 - protein, 348 aa, Listeria innocua; identical to SEQ ID NO: 2753

SEQ ID NO: 17396 - DNA, 1137 bp, Brucella melitensis; identical to SEQ ID NO: 2754
  CDS (1)..(1137)

SEQ ID NO: 17397 - protein, 378 aa, Brucella melitensis; identical to SEQ ID NO: 2755

SEQ ID NO: 17398 - DNA, 1062 bp, Salmonella enterica subsp. enterica serovar Typhi; identical to SEQ ID NO: 2756
  CDS (1)..(1062)

SEQ ID NO: 17399 - protein, 353 aa, Salmonella enterica subsp. enterica serovar Typhi; identical to SEQ ID NO: 2757

SEQ ID NO: 17400 - DNA, 1074 bp, Nostoc sp. PCC 7120; identical to SEQ ID NO: 2758
  CDS (1)..(1074)

SEQ ID NO: 17401 - protein, 357 aa, Nostoc sp. PCC 7120; identical to SEQ ID NO: 2759

SEQ ID NO: 17402 - DNA, 1044 bp, Xylella fastidiosa; identical to SEQ ID NO: 2760
  CDS (1)..(1044)

SEQ ID NO: 17403 - protein, 347 aa, Xylella fastidiosa; identical to SEQ ID NO: 2761

SEQ ID NO: 17404 - DNA, 1164 bp, Lactococcus lactis subsp. lactis; identical to SEQ ID NO: 2762
  CDS (1)..(1164)

SEQ ID NO: 17405 - protein, 387 aa, Lactococcus lactis subsp. lactis; identical to SEQ ID NO: 2763

SEQ ID NO: 17406 - DNA, 2025 bp, Borrelia burgdorferi (Lyme disease spirochete); identical to SEQ ID NO: 2764
  CDS (25)..(1122)

SEQ ID NO: 17407 - protein, 365 aa, Borrelia burgdorferi (Lyme disease spirochete); identical to SEQ ID NO: 2765

SEQ ID NO: 17408 - DNA, 1728 bp, Deinococcus radiodurans; identical to SEQ ID NO: 2766
  CDS (399)..(1490)

SEQ ID NO: 17409 - protein, 363 aa, Deinococcus radiodurans; identical to SEQ ID NO: 2767

SEQ ID NO: 17410 - DNA, 1071 bp, Caulobacter crescentus; identical to SEQ ID NO: 2768
  CDS (1)..(1071)

SEQ ID NO: 17411 - protein, 356 aa, Caulobacter crescentus; identical to SEQ ID NO: 2769

SEQ ID NO: 17412 - DNA, 1199 bp, Thermotoga maritima; identical to SEQ ID NO: 2770
  CDS (67)..(1137)

SEQ ID NO: 17413 - protein, 356 aa, Thermotoga maritima; identical to SEQ ID NO: 2771

SEQ ID NO: 17414 - DNA, 1662 bp, Arabidopsis thaliana (mouse-ear cress); identical to SEQ ID NO: 2772
  CDS (368)..(1498)

SEQ ID NO: 17415 - protein, 376 aa, Arabidopsis thaliana (mouse-ear cress); identical to SEQ ID NO: 2773

SEQ ID NO: 17416 - DNA, 1038 bp, Aquifex aeolicus; identical to SEQ ID NO: 2774
  CDS (1)..(1038)

SEQ ID NO: 17417 - protein, 345 aa, Aquifex aeolicus; identical to SEQ ID NO: 2775

SEQ ID NO: 17418 - DNA, 1062 bp, Chlamydophila pneumoniae, Chlamydia pneumoniae; identical to SEQ ID NO: 2776
  CDS (1)..(1062)

SEQ ID NO: 17419 - protein, 353 aa, Chlamydophila pneumoniae, Chlamydia pneumoniae; identical to SEQ ID NO: 2777

SEQ ID NO: 17420 - DNA, 1047 bp, Neisseria meningitidis; identical to SEQ ID NO: 2778
  CDS (1)..(1047)

SEQ ID NO: 17421 - protein, 348 aa, Neisseria meningitidis; identical to SEQ ID NO: 2779

SEQ ID NO: 17422 - DNA, 1032 bp, Campylobacter jejuni; identical to SEQ ID NO: 2780
  CDS (1)..(1032)

SEQ ID NO: 17423 - protein, 343 aa, Campylobacter jejuni; identical to SEQ ID NO: 2781

SEQ ID NO: 17424 - DNA, 1065 bp, Chlamydia muridarum, Chlamydia trachomatis MoPn; identical to SEQ ID NO: 2782
  CDS (1)..(1065)

SEQ ID NO: 17425 - protein, 354 aa, Chlamydia muridarum, Chlamydia trachomatis MoPn; identical to SEQ ID NO: 2783

SEQ ID NO: 17426 - DNA, 1050 bp, Bacillus halodurans; identical to SEQ ID NO: 2784
  CDS (1)..(1050)

SEQ ID NO: 17427 - protein, 349 aa, Bacillus halodurans; identical to SEQ ID NO: 2785

SEQ ID NO: 17428 - DNA, 1229 bp, Streptococcus pneumoniae; identical to SEQ ID NO: 2786
  CDS (26)..(1192)

SEQ ID NO: 17429 - protein, 388 aa, Streptococcus pneumoniae; identical to SEQ ID NO: 2787

SEQ ID NO: 17430 - DNA, 1251 bp, Agrobacterium tumefaciens; identical to SEQ ID NO: 2788
  CDS (1)..(1251)

SEQ ID NO: 17431 - protein, 416 aa, Agrobacterium tumefaciens; identical to SEQ ID NO: 2789

SEQ ID NO: 17432 - DNA, 1044 bp, Staphylococcus aureus; identical to SEQ ID NO: 2790
  CDS (1)..(1044)

SEQ ID NO: 17433 - protein, 347 aa, Staphylococcus aureus; identical to SEQ ID NO: 2791

SEQ ID NO: 17434 - DNA, 1506 bp, Acinetobacter calcoaceticus; identical to SEQ ID NO: 2792
  CDS (403)..(1452)

SEQ ID NO: 17435 - protein, 349 aa, Acinetobacter calcoaceticus; identical to SEQ ID NO: 2793

SEQ ID NO: 17436 - DNA, 1479 bp, Brucella abortus; identical to SEQ ID NO: 2794
  CDS (316)..(1398)

SEQ ID NO: 17437 - protein, 360 aa, Brucella abortus; identical to SEQ ID NO: 2795

SEQ ID NO: 17438 - DNA, 981 bp, Streptococcus pyogenes; identical to SEQ ID NO: 2796
  CDS (1)..(981)

SEQ ID NO: 17439 - protein, 326 aa, Streptococcus pyogenes; identical to SEQ ID NO: 2797

SEQ ID NO: 17440 - DNA, 1349 bp, Leptospira biflexa; identical to SEQ ID NO: 2798
  CDS (107)..(1270)

SEQ ID NO: 17441 - protein, 387 aa, Leptospira biflexa; identical to SEQ ID NO: 2799

SEQ ID NO: 17442 - DNA, 1762 bp, Xanthomonas campestris pv. campestris; identical to SEQ ID NO: 2800
  CDS (159)..(1190)

SEQ ID NO: 17443 - protein, 343 aa, Xanthomonas campestris pv. campestris; identical to SEQ ID NO: 2801

SEQ ID NO: 17444 - DNA, 1212 bp, Aeromonas salmonicida; identical to SEQ ID NO: 2802
  CDS (151)..(1212)

SEQ ID NO: 17445 - protein, 353 aa, Aeromonas salmonicida; identical to SEQ ID NO: 2803

SEQ ID NO: 17446 - DNA, 1433 bp, Azotobacter vinelandii; identical to SEQ ID NO: 2804
  CDS (311)..(1360)

SEQ ID NO: 17447 - protein, 349 aa, Azotobacter vinelandii; identical to SEQ ID NO: 2805

SEQ ID NO: 17448 - DNA, 1108 bp, Acetobacter polyoxogenes; identical to SEQ ID NO: 2806
  CDS (35)..(1081)

SEQ ID NO: 17449 - protein, 348 aa, Acetobacter polyoxogenes; identical to SEQ ID NO: 2807

SEQ ID NO: 17450 - DNA, 1230 bp, Neisseria gonorrhoeae; identical to SEQ ID NO: 2808
  CDS (133)..(1179)

SEQ ID NO: 17451 - protein, 348 aa, Neisseria gonorrhoeae; identical to SEQ ID NO: 2809

SEQ ID NO: 17452 - DNA, 1649 bp, Bacteroides fragilis; identical to SEQ ID NO: 2810
  CDS (351)..(1307)

SEQ ID NO: 17453 - protein, 318 aa, Bacteroides fragilis; identical to SEQ ID NO: 2811

SEQ ID NO: 17454 - DNA, 1349 bp, Methylobacillus sp; identical to SEQ ID NO: 2812
  CDS (293)..(1327)

SEQ ID NO: 17455 - protein, 344 aa, Methylobacillus sp; identical to SEQ ID NO: 2813

SEQ ID NO: 17456 - DNA, 1320 bp, Vibrio anguillarum; identical to SEQ ID NO: 2814
  CDS (166)..(1212)

SEQ ID NO: 17457 - protein, 348 aa, Vibrio anguillarum; identical to SEQ ID NO: 2815

SEQ ID NO: 17458 - DNA, 1394 bp, Anabaena variabilis; identical to SEQ ID NO: 2816
  CDS (125)..(1201)

SEQ ID NO: 17459 - protein, 358 aa, Anabaena variabilis; identical to SEQ ID NO: 2817

SEQ ID NO: 17460 - DNA, 1334 bp, Bacillus subtilis; identical to SEQ ID NO: 2818
  CDS (215)..(1258)

SEQ ID NO: 17461 - protein, 347 aa, Bacillus subtilis; identical to SEQ ID NO: 2819

SEQ ID NO: 17462 - DNA, 1348 bp, Proteus mirabilis; identical to SEQ ID NO: 2820
  CDS (151)..(1218)

SEQ ID NO: 17463 - protein, 355 aa, Proteus mirabilis; identical to SEQ ID NO: 2821

SEQ ID NO: 17464 - DNA, 1384 bp, Pseudomonas aeruginosa; identical to SEQ ID NO: 2822
  CDS (145)..(1185)

SEQ ID NO: 17465 - protein, 346 aa, Pseudomonas aeruginosa; identical to SEQ ID NO: 2823

SEQ ID NO: 17466 - DNA, 1352 bp, Pseudomonas cepacia; identical to SEQ ID NO: 2824
  CDS (223)..(1266)

SEQ ID NO: 17467 - protein, 347 aa, Pseudomonas cepacia; identical to SEQ ID NO: 2825

SEQ ID NO: 17468 - DNA, 1047 bp, Synechococcus sp; identical to SEQ ID NO: 2826
  CDS (1)..(1047)

SEQ ID NO: 17469 - protein, 348 aa, Synechococcus sp; identical to SEQ ID NO: 2827

SEQ ID NO: 17470 - DNA, 1190 bp, Aquaspirillum magnetotacticum; identical to SEQ ID NO: 2828
  CDS (112)..(1146)

SEQ ID NO: 17471 - protein, 344 aa, Aquaspirillum magnetotacticum; identical to SEQ ID NO: 2829

SEQ ID NO: 17472 - DNA, 1841 bp, Rhizobium leguminosarum bv. viciae; identical to SEQ ID NO: 2830
  CDS (32)..(1087)

SEQ ID NO: 17473 - protein, 351 aa, Rhizobium leguminosarum bv. viciae; identical to SEQ ID NO: 2831

SEQ ID NO: 17474 - DNA, 1047 bp, Rhizobium meliloti; identical to SEQ ID NO: 2832
  CDS (1)..(1047)

SEQ ID NO: 17475 - protein, 348 aa, Rhizobium meliloti; identical to SEQ ID NO: 2833

SEQ ID NO: 17476 - DNA, 2762 bp, Mycobacterium tuberculosis; identical to SEQ ID NO: 2834
  CDS (311)..(2683)

SEQ ID NO: 17477 - protein, 790 aa, Mycobacterium tuberculosis; identical to SEQ ID NO: 2835

SEQ ID NO: 17478 - DNA, 1249 bp, Methylomonas clara; identical to SEQ ID NO: 2836
  CDS (123)..(1151)

SEQ ID NO: 17479 - protein, 342 aa, Methylomonas clara; identical to SEQ ID NO: 2837

SEQ ID NO: 17480 - DNA, 1065 bp, Enterobacter agglomerans; identical to SEQ ID NO: 2838
  CDS (1)..(1065)

SEQ ID NO: 17481 - protein, 354 aa, Enterobacter agglomerans; identical to SEQ ID NO: 2839

SEQ ID NO: 17482 - DNA, 1125 bp, Streptomyces lividans; identical to SEQ ID NO: 2840
  CDS (1)..(1125)

SEQ ID NO: 17483 - protein, 374 aa, Streptomyces lividans; identical to SEQ ID NO: 2841

SEQ ID NO: 17484 - DNA, 1347 bp, Rhodobacter sphaeroides; identical to SEQ ID NO: 2842
  CDS (220)..(1251)

SEQ ID NO: 17485 - protein, 343 aa, Rhodobacter sphaeroides; identical to SEQ ID NO: 2843

SEQ ID NO: 17486 - DNA, 1065 bp, Vibrio cholerae; identical to SEQ ID NO: 2844
  CDS (1)..(1065)

SEQ ID NO: 17487 - protein, 354 aa, Vibrio cholerae; identical to SEQ ID NO: 2845

SEQ ID NO: 17488 - DNA, 1068 bp, Rhodobacter capsulatus; identical to SEQ ID NO: 2846
  CDS (1)..(1068)

SEQ ID NO: 17489 - protein, 355 aa, Rhodobacter capsulatus; identical to SEQ ID NO: 2847

SEQ ID NO: 17490 - DNA, 1533 bp, Helicobacter pylori; identical to SEQ ID NO: 2848
  CDS (275)..(1318)

SEQ ID NO: 17491 - protein, 347 aa, Helicobacter pylori; identical to SEQ ID NO: 2849

SEQ ID NO: 17492 - DNA, 1065 bp, Synechocystis sp; identical to SEQ ID NO: 2850
  CDS (1)..(1065)

SEQ ID NO: 17493 - protein, 354 aa, Synechocystis sp; identical to SEQ ID NO: 2851

SEQ ID NO: 17494 - DNA, 1351 bp, Arabidopsis thaliana (mouse-ear cress); identical to SEQ ID NO: 2852
  CDS (1)..(1320)

SEQ ID NO: 17495 - protein, 439 aa, Arabidopsis thaliana (mouse-ear cress); identical to SEQ ID NO: 2853

SEQ ID NO: 17496 - DNA, 1392 bp, Pseudomonas putida; identical to SEQ ID NO: 2854
  CDS (111)..(1178)

SEQ ID NO: 17497 - protein, 355 aa, Pseudomonas putida; identical to SEQ ID NO: 2855

SEQ ID NO: 17498 - DNA, 1053 bp, Mycobacterium tuberculosis; identical to SEQ ID NO: 2856
  CDS (1)..(1053)

SEQ ID NO: 17499 - protein, 350 aa, Mycobacterium tuberculosis; identical to SEQ ID NO: 2857

SEQ ID NO: 17500 - DNA, 1053 bp, Wolinella succinogenes; identical to SEQ ID NO: 2858
  CDS (1)..(1053)

SEQ ID NO: 17501 - protein, 350 aa, Wolinella succinogenes; identical to SEQ ID NO: 2859

SEQ ID NO: 17502 - DNA, 1110 bp, Vibrio vulnificus; identical to SEQ ID NO: 2860
  CDS (1)..(1110)

SEQ ID NO: 17503 - protein, 369 aa, Vibrio vulnificus; identical to SEQ ID NO: 2861

SEQ ID NO: 17504 - DNA, 1068 bp, Photorhabdus luminescens; identical to SEQ ID NO: 2862
  CDS (1)..(1068)

SEQ ID NO: 17505 - protein, 355 aa, Photorhabdus luminescens; identical to SEQ ID NO: 2863

SEQ ID NO: 17506 - DNA, 1110 bp, Gloeobacter violaceus; identical to SEQ ID NO: 2864
  CDS (1)..(1110)

SEQ ID NO: 17507 - protein, 369 aa, Gloeobacter violaceus; identical to SEQ ID NO: 2865

SEQ ID NO: 17508 - DNA, 1053 bp, Chromobacterium violaceum; identical to SEQ ID NO: 2866
  CDS (1)..(1053)

SEQ ID NO: 17509 - protein, 350 aa, Chromobacterium violaceum; identical to SEQ ID NO: 2867

SEQ ID NO: 17510 - DNA, 1128 bp, Synechococcus sp; identical to SEQ ID NO: 2868
  CDS (1)..(1128)

SEQ ID NO: 17511 - protein, 375 aa, Synechococcus sp; identical to SEQ ID NO: 2869

SEQ ID NO: 17512 - DNA, 1128 bp, Rhodopirellula baltica; identical to SEQ ID NO: 2870
  CDS (1)..(1128)

SEQ ID NO: 17513 - protein, 375 aa, Rhodopirellula baltica; identical to SEQ ID NO: 2871

SEQ ID NO: 17514 - DNA, 1113 bp, Prochlorococcus marinus subsp; identical to SEQ ID NO: 2872
  CDS (1)..(1113)

SEQ ID NO: 17515 - protein, 370 aa, Prochlorococcus marinus subsp; identical to SEQ ID NO: 2873

SEQ ID NO: 17516 - DNA, 1140 bp, Prochlorococcus marinus; identical to SEQ ID NO: 2874
  CDS (1)..(1140)

SEQ ID NO: 17517 - protein, 379 aa, Prochlorococcus marinus; identical to SEQ ID NO: 2875

SEQ ID NO: 17518 - DNA, 1140 bp, Prochlorococcus marinus; identical to SEQ ID NO: 2876
  CDS (1)..(1140)

SEQ ID NO: 17519 - protein, 379 aa, Prochlorococcus marinus; identical to SEQ ID NO: 2877

SEQ ID NO: 17520 - DNA, 1038 bp, Helicobacter hepaticus; identical to SEQ ID NO: 2878
  CDS (1)..(1038)

SEQ ID NO: 17521 - protein, 345 aa, Helicobacter hepaticus; identical to SEQ ID NO: 2879

SEQ ID NO: 17522 - DNA, 1119 bp, Haemophilus ducreyi; identical to SEQ ID NO: 2880
  CDS (1)..(1119)

SEQ ID NO: 17523 - protein, 372 aa, Haemophilus ducreyi; identical to SEQ ID NO: 2881

SEQ ID NO: 17524 - DNA, 1048 bp, Campylobacter lari; identical to SEQ ID NO: 2882
  CDS (9)..(1043)

SEQ ID NO: 17525 - protein, 344 aa, Campylobacter lari; identical to SEQ ID NO: 2883

SEQ ID NO: 17526 - DNA, 1077 bp, Burkholderia fungorum; identical to SEQ ID NO: 2884
  CDS (1)..(1077)

SEQ ID NO: 17527 - protein, 358 aa, Burkholderia fungorum; identical to SEQ ID NO: 2885

SEQ ID NO: 17528 - DNA, 963 bp, Mycobacteriophage CJW1; identical to SEQ ID NO: 2886
  CDS (1)..(963)

SEQ ID NO: 17529 - protein, 320 aa, Mycobacteriophage CJW1; identical to SEQ ID NO: 2887

SEQ ID NO: 17530 - DNA, 1563 bp, Zymomonas mobilis; identical to SEQ ID NO: 2888
  CDS (231)..(1250)

SEQ ID NO: 17531 - protein, 339 aa, Zymomonas mobilis; identical to SEQ ID NO: 2889

SEQ ID NO: 17532 - DNA, 1038 bp, Bacillus megaterium; identical to SEQ ID NO: 2890
  CDS (1)..(1038)

SEQ ID NO: 17533 - protein, 345 aa, Bacillus megaterium; identical to SEQ ID NO: 2891

SEQ ID NO: 17534 - DNA, 1038 bp, Bacillus megaterium; identical to SEQ ID NO: 2892
  CDS (1)..(1038)

SEQ ID NO: 17535 - protein, 345 aa, Bacillus megaterium; identical to SEQ ID NO: 2893

SEQ ID NO: 17536 - DNA, 1044 bp, Bacillus amyloliquefaciens; identical to SEQ ID NO: 2894
  CDS (1)..(1044)

SEQ ID NO: 17537 - protein, 347 aa, Bacillus amyloliquefaciens; identical to SEQ ID NO: 2895

SEQ ID NO: 17538 - DNA, 1047 bp, Listeria monocytogenes; identical to SEQ ID NO: 2896
  CDS (1)..(1047): m means a or c

SEQ ID NO: 17539 - protein, 348 aa, Listeria monocytogenes; identical to SEQ ID NO: 2897
  misc_feature (228)..(228): Xaa can be Pro or Gln

SEQ ID NO: 17540 - DNA, 1035 bp, Oryza sativa; identical to SEQ ID NO: 2898
  CDS (1)..(1035)

SEQ ID NO: 17541 - protein, 344 aa, Oryza sativa; identical to SEQ ID NO: 2899

SEQ ID NO: 17542 - DNA, 1035 bp, Campylobacter lari; identical to SEQ ID NO: 2900
  CDS (1)..(1035)

SEQ ID NO: 17543 - protein, 344 aa, Campylobacter lari; identical to SEQ ID NO: 2901

SEQ ID NO: 17544 - DNA, 2035 bp, Borrelia hermsii; identical to SEQ ID NO: 2902
  CDS (256)..(1326)

SEQ ID NO: 17545 - protein, 356 aa, Borrelia hermsii; identical to SEQ ID NO: 2903

SEQ ID NO: 17546 - DNA, 1487 bp, Chlamydomonas reinhardtii; identical to SEQ ID NO: 2904
  CDS (121)..(1365)

SEQ ID NO: 17547 - protein, 414 aa, Chlamydomonas reinhardtii; identical to SEQ ID NO: 2905

SEQ ID NO: 17548 - DNA, 1669 bp, Streptococcus suis; identical to SEQ ID NO: 2906
  CDS (469)..(1500)

SEQ ID NO: 17549 - protein, 343 aa, Streptococcus suis; identical to SEQ ID NO: 2907

SEQ ID NO: 17550 - DNA, 1439 bp, Peanut witches; identical to SEQ ID NO: 2908
  CDS (218)..(1228)

SEQ ID NO: 17551 - protein, 336 aa, Peanut witches; identical to SEQ ID NO: 2909

SEQ ID NO: 17552 - DNA, 1377 bp, Myxococcus xanthus; identical to SEQ ID NO: 2910
  CDS (201)..(1277)

SEQ ID NO: 17553 - protein, 358 aa, Myxococcus xanthus; identical to SEQ ID NO: 2911

SEQ ID NO: 17554 - DNA, 1404 bp, Acidiphilium facilis; identical to SEQ ID NO: 2912
  CDS (187)..(1251)

SEQ ID NO: 17555 - protein, 354 aa, Acidiphilium facilis; identical to SEQ ID NO: 2913

SEQ ID NO: 17556 - DNA, 1059 bp, Actinobacillus actinomycetemcomitans; identical to SEQ ID NO: 2914
  CDS (1)..(1059)

SEQ ID NO: 17557 - protein, 352 aa, Actinobacillus actinomycetemcomitans; identical to SEQ ID NO: 2915

SEQ ID NO: 17558 - DNA, 1565 bp, Alcaligenes eutrophus; identical to SEQ ID NO: 2916
  CDS (194)..(1255)

SEQ ID NO: 17559 - protein, 353 aa, Alcaligenes eutrophus; identical to SEQ ID NO: 2917

SEQ ID NO: 17560 - DNA, 1047 bp, Amycolatopsis mediterranei; identical to SEQ ID NO: 2918
  CDS (1)..(1047)

SEQ ID NO: 17561 - protein, 348 aa, Amycolatopsis mediterranei; identical to SEQ ID NO: 2919

SEQ ID NO: 17562 - DNA, 1035 bp, Bacteroides thetaiotaomicron; identical to SEQ ID NO: 2920
  CDS (1)..(1035)

SEQ ID NO: 17563 - protein, 344 aa, Bacteroides thetaiotaomicron; identical to SEQ ID NO: 2921

SEQ ID NO: 17564 - DNA, 1194 bp, Bifidobacterium longum; identical to SEQ ID NO: 2922
  CDS (1)..(1194)

SEQ ID NO: 17565 - protein, 397 aa, Bifidobacterium longum; identical to SEQ ID NO: 2923

SEQ ID NO: 17566 - DNA, 1062 bp, Bordetella pertussis; identical to SEQ ID NO: 2924
  CDS (1)..(1062)

SEQ ID NO: 17567 - protein, 353 aa, Bordetella pertussis; identical to SEQ ID NO: 2925

SEQ ID NO: 17568 - DNA, 1089 bp, Bradyrhizobium japonicum; identical to SEQ ID NO: 2926
  CDS (1)..(1089)

SEQ ID NO: 17569 - protein, 362 aa, Bradyrhizobium japonicum; identical to SEQ ID NO: 2927

SEQ ID NO: 17570 - DNA, 2058 bp, Campylobacter fetus; identical to SEQ ID NO: 2928
  CDS (401)..(1438)

SEQ ID NO: 17571 - protein, 345 aa, Campylobacter fetus; identical to SEQ ID NO: 2929

SEQ ID NO: 17572 - DNA, 1458 bp, Chloroflexus aurantiacus; identical to SEQ ID NO: 2930
  CDS (116)..(1171)

SEQ ID NO: 17573 - protein, 351 aa, Chloroflexus aurantiacus; identical to SEQ ID NO: 2931

SEQ ID NO: 17574 - DNA, 1053 bp, Chlamydophila caviae; identical to SEQ ID NO: 2932
  CDS (1)..(1053)

SEQ ID NO: 17575 - protein, 350 aa, Chlamydophila caviae; identical to SEQ ID NO: 2933

SEQ ID NO: 17576 - DNA, 1087 bp, Chromatium vinosum; identical to SEQ ID NO: 2934
  CDS (1)..(1044)

SEQ ID NO: 17577 - protein, 347 aa, Chromatium vinosum; identical to SEQ ID NO: 2935

SEQ ID NO: 17578 - DNA, 1346 bp, Clostridium perfringens; identical to SEQ ID NO: 2936
  CDS (172)..(1230)

SEQ ID NO: 17579 - protein, 352 aa, Clostridium perfringens; identical to SEQ ID NO: 2937

SEQ ID NO: 17580 - DNA, 1053 bp, Clostridium tetani; identical to SEQ ID NO: 2938
  CDS (1)..(1053)

SEQ ID NO: 17581 - protein, 350 aa, Clostridium tetani; identical to SEQ ID NO: 2939

SEQ ID NO: 17582 - DNA, 1161 bp, Corynebacterium efficiens; identical to SEQ ID NO: 2940
  CDS (1)..(1161)

SEQ ID NO: 17583 - protein, 386 aa, Corynebacterium efficiens; identical to SEQ ID NO: 2941

SEQ ID NO: 17584 - DNA, 1402 bp, Corynebacterium glutamicum; identical to SEQ ID NO: 2942
  CDS (133)..(1263)

SEQ ID NO: 17585 - protein, 376 aa, Corynebacterium glutamicum; identical to SEQ ID NO: 2943

SEQ ID NO: 17586 - DNA, 1409 bp, Corynebacterium pseudotuberculosis; identical to SEQ ID NO: 2944
  CDS (223)..(1332)

SEQ ID NO: 17587 - protein, 369 aa, Corynebacterium pseudotuberculosis; identical to SEQ ID NO: 2945

SEQ ID NO: 17588 - DNA, 1032 bp, Coxiella burnetii; identical to SEQ ID NO: 2946
  CDS (1)..(1032)

SEQ ID NO: 17589 - protein, 343 aa, Coxiella burnetii; identical to SEQ ID NO: 2947

SEQ ID NO: 17590 - DNA, 1047 bp, Enterococcus faecalis; identical to SEQ ID NO: 2948
  CDS (1)..(1047)

SEQ ID NO: 17591 - protein, 348 aa, Enterococcus faecalis; identical to SEQ ID NO: 2949

SEQ ID NO: 17592 - DNA, 1072 bp, Erwinia carotovora; identical to SEQ ID NO: 2950
  CDS (1)..(1029)

SEQ ID NO: 17593 - protein, 342 aa, Erwinia carotovora; identical to SEQ ID NO: 2951

SEQ ID NO: 17594 - DNA, 1137 bp, Fusobacterium nucleatum; identical to SEQ ID NO: 2952
  CDS (1)..(1137)

SEQ ID NO: 17595 - protein, 378 aa, Fusobacterium nucleatum; identical to SEQ ID NO: 2953

SEQ ID NO: 17596 - DNA, 1613 bp, Herbaspirillum seropedicae; identical to SEQ ID NO: 2954
  CDS (199)..(1254)

SEQ ID NO: 17597 - protein, 351 aa, Herbaspirillum seropedicae; identical to SEQ ID NO: 2955

SEQ ID NO: 17598 - DNA, 1143 bp, Lactobacillus plantarum; identical to SEQ ID NO: 2956
  CDS (1)..(1143)

SEQ ID NO: 17599 - protein, 380 aa, Lactobacillus plantarum; identical to SEQ ID NO: 2957

SEQ ID NO: 17600 - DNA, 1101 bp, Leptospira interrogans; identical to SEQ ID NO: 2958
  CDS (1)..(1101)

SEQ ID NO: 17601 - protein, 366 aa, Leptospira interrogans; identical to SEQ ID NO: 2959

SEQ ID NO: 17602 - DNA, 1126 bp, Mycoplasma mycoides; identical to SEQ ID NO: 2960
  CDS (79)..(1116)

SEQ ID NO: 17603 - protein, 345 aa, Mycoplasma mycoides; identical to SEQ ID NO: 2961

SEQ ID NO: 17604 - DNA, 1050 bp, Mycobacterium smegmatis; identical to SEQ ID NO: 2962
  CDS (1)..(1050)

SEQ ID NO: 17605 - protein, 349 aa, Mycobacterium smegmatis; identical to SEQ ID NO: 2963

SEQ ID NO: 17606 - DNA, 1044 bp, Oceanobacillus iheyensis; identical to SEQ ID NO: 2964
  CDS (1)..(1044)

SEQ ID NO: 17607 - protein, 347 aa, Oceanobacillus iheyensis; identical to SEQ ID NO: 2965

SEQ ID NO: 17608 - DNA, 1071 bp, Paracoccus denitrificans; identical to SEQ ID NO: 2966
  CDS (1)..(1071)

SEQ ID NO: 17609 - protein, 356 aa, Paracoccus denitrificans; identical to SEQ ID NO: 2967

SEQ ID NO: 17610 - DNA, 1320 bp, Pasteurella haemolytica; identical to SEQ ID NO: 2968
  CDS (157)..(1263)

SEQ ID NO: 17611 - protein, 368 aa, Pasteurella haemolytica; identical to SEQ ID NO: 2969

SEQ ID NO: 17612 - DNA, 1500 bp, Pasteurella multocida; identical to SEQ ID NO: 2970
  CDS (175)..(1239)

SEQ ID NO: 17613 - protein, 354 aa, Pasteurella multocida; identical to SEQ ID NO: 2971

SEQ ID NO: 17614 - DNA, 1023 bp, Porphyromonas gingivalis; identical to SEQ ID NO: 2972
  CDS (1)..(1023)

SEQ ID NO: 17615 - protein, 340 aa, Porphyromonas gingivalis; identical to SEQ ID NO: 2973

SEQ ID NO: 17616 - DNA, 1824 bp, Prevotella ruminicola; identical to SEQ ID NO: 2974
  CDS (501)..(1523)

SEQ ID NO: 17617 - protein, 340 aa, Prevotella ruminicola; identical to SEQ ID NO: 2975

SEQ ID NO: 17618 - DNA, 978 bp, Proteus vulgaris; identical to SEQ ID NO: 2976
  CDS (1)..(978)

SEQ ID NO: 17619 - protein, 325 aa, Proteus vulgaris; identical to SEQ ID NO: 2977

SEQ ID NO: 17620 - DNA, 1047 bp, Pseudomonas oleovorans; identical to SEQ ID NO: 2978
  CDS (1)..(1047)

SEQ ID NO: 17621 - protein, 348 aa, Pseudomonas oleovorans; identical to SEQ ID NO: 2979

SEQ ID NO: 17622 - DNA, 1068 bp, Pseudomonas putida; identical to SEQ ID NO: 2980
  CDS (1)..(1068)

SEQ ID NO: 17623 - protein, 355 aa, Pseudomonas putida; identical to SEQ ID NO: 2981

SEQ ID NO: 17624 - DNA, 1110 bp, Pseudomonas syringae; identical to SEQ ID NO: 2982
  CDS (46)..(1110)

SEQ ID NO: 17625 - protein, 354 aa, Pseudomonas syringae; identical to SEQ ID NO: 2983

SEQ ID NO: 17626 - DNA, 1980 bp, Pseudomonas tolaasii; identical to SEQ ID NO: 2984
  CDS (414)..(1472)

SEQ ID NO: 17627 - protein, 352 aa, Pseudomonas tolaasii; identical to SEQ ID NO: 2985

SEQ ID NO: 17628 - DNA, 1501 bp, Rhizobium etli; identical to SEQ ID NO: 2986
  CDS (242)..(1327)

SEQ ID NO: 17629 - protein, 361 aa, Rhizobium etli; identical to SEQ ID NO: 2987

SEQ ID NO: 17630 - DNA, 1098 bp, Rhizobium loti; identical to SEQ ID NO: 2988
  CDS (1)..(1098)

SEQ ID NO: 17631 - protein, 365 aa, Rhizobium loti; identical to SEQ ID NO: 2989

SEQ ID NO: 17632 - DNA, 1092 bp, Rhodopseudomonas palustris; identical to SEQ ID NO: 2990
  CDS (1)..(1092)

SEQ ID NO: 17633 - protein, 363 aa, Rhodopseudomonas palustris; identical to SEQ ID NO: 2991

SEQ ID NO: 17634 - DNA, 1047 bp, Rhodopseudomonas viridis; identical to SEQ ID NO: 2992
  CDS (1)..(1047)

SEQ ID NO: 17635 - protein, 348 aa, Rhodopseudomonas viridis; identical to SEQ ID NO: 2993

SEQ ID NO: 17636 - DNA, 1074 bp, Shewanella oneidensis; identical to SEQ ID NO: 2994
  CDS (1)..(1074)

SEQ ID NO: 17637 - protein, 357 aa, Shewanella oneidensis; identical to SEQ ID NO: 2995

SEQ ID NO: 17638 - DNA, 1235 bp, Spirulina platensis; identical to SEQ ID NO: 2996
  CDS (54)..(1151)

SEQ ID NO: 17639 - protein, 365 aa, Spirulina platensis; identical to SEQ ID NO: 2997

SEQ ID NO: 17640 - DNA, 1074 bp, Staphylococcus epidermidis; identical to SEQ ID NO: 2998
  CDS (25)..(1074)

SEQ ID NO: 17641 - protein, 349 aa, Staphylococcus epidermidis; identical to SEQ ID NO: 2999

SEQ ID NO: 17642 - DNA, 1140 bp, Streptococcus agalactiae; identical to SEQ ID NO: 3000
  CDS (1)..(1140)

SEQ ID NO: 17643 - protein, 379 aa, Streptococcus agalactiae; identical to SEQ ID NO: 3001

SEQ ID NO: 17644 - DNA, 1119 bp, Streptomyces ambofaciens; identical to SEQ ID NO: 3002
  CDS (1)..(1119)

SEQ ID NO: 17645 - protein, 372 aa, Streptomyces ambofaciens; identical to SEQ ID NO: 3003

SEQ ID NO: 17646 - DNA, 1134 bp, Streptomyces avermitilis; identical to SEQ ID NO: 3004
  CDS (1)..(1134)

SEQ ID NO: 17647 - protein, 377 aa, Streptomyces avermitilis; identical to SEQ ID NO: 3005

SEQ ID NO: 17648 - DNA, 1152 bp, Streptococcus mutans; identical to SEQ ID NO: 3006
  CDS (1)..(1152)

SEQ ID NO: 17649 - protein, 383 aa, Streptococcus mutans; identical to SEQ ID NO: 3007

SEQ ID NO: 17650 - DNA, 1137 bp, Streptococcus pyogenes; identical to SEQ ID NO: 3008
  CDS (1)..(1137)

SEQ ID NO: 17651 - protein, 378 aa, Streptococcus pyogenes; identical to SEQ ID NO: 3009

SEQ ID NO: 17652 - DNA, 1356 bp, Streptococcus parasanguis; identical to SEQ ID NO: 3010
  CDS (118)..(1263)

SEQ ID NO: 17653 - protein, 381 aa, Streptococcus parasanguis; identical to SEQ ID NO: 3011

SEQ ID NO: 17654 - DNA, 1416 bp, Streptomyces rimosus; identical to SEQ ID NO: 3012
  CDS (229)..(1359)

SEQ ID NO: 17655 - protein, 376 aa, Streptomyces rimosus; identical to SEQ ID NO: 3013

SEQ ID NO: 17656 - DNA, 1916 bp, Streptococcus thermophilus; identical to SEQ ID NO: 3014
  CDS (555)..(1694)

SEQ ID NO: 17657 - protein, 379 aa, Streptococcus thermophilus; identical to SEQ ID NO: 3015

SEQ ID NO: 17658 - DNA, 1271 bp, Streptomyces violaceus; identical to SEQ ID NO: 3016
  CDS (75)..(1208)

SEQ ID NO: 17659 - protein, 377 aa, Streptomyces violaceus; identical to SEQ ID NO: 3017

SEQ ID NO: 17660 - DNA, 1068 bp, Synechococcus elongatus; identical to SEQ ID NO: 3018
  CDS (1)..(1068)

SEQ ID NO: 17661 - protein, 355 aa, Synechococcus elongatus; identical to SEQ ID NO: 3019

SEQ ID NO: 17662 - DNA, 1023 bp, Thermus thermophilus; identical to SEQ ID NO: 3020
  CDS (1)..(1023)

SEQ ID NO: 17663 - protein, 340 aa, Thermus thermophilus; identical to SEQ ID NO: 3021

SEQ ID NO: 17664 - DNA, 1405 bp, Thiobacillus ferrooxidans; identical to SEQ ID NO: 3022
  CDS (196)..(1236)

SEQ ID NO: 17665 - protein, 346 aa, Thiobacillus ferrooxidans; identical to SEQ ID NO: 3023

SEQ ID NO: 17666 - DNA, 1314 bp, Tropheryma whipplei; identical to SEQ ID NO: 3024
  CDS (1)..(1314)

SEQ ID NO: 17667 - protein, 437 aa, Tropheryma whipplei; identical to SEQ ID NO: 3025

SEQ ID NO: 17668 - DNA, 1411 bp, Vibrio cholerae; identical to SEQ ID NO: 3026
  CDS (183)..(1247)

SEQ ID NO: 17669 - protein, 354 aa, Vibrio cholerae; identical to SEQ ID NO: 3027

SEQ ID NO: 17670 - DNA, 1044 bp, Vibrio parahaemolyticus; identical to SEQ ID NO: 3028
  CDS (1)..(1044)

SEQ ID NO: 17671 - protein, 347 aa, Vibrio parahaemolyticus; identical to SEQ ID NO: 3029

SEQ ID NO: 17672 - DNA, 996 bp, Wigglesworthia glossinidia brevipalpis; identical to SEQ ID NO: 3030
  CDS (1)..(996)

SEQ ID NO: 17673 - protein, 331 aa, Wigglesworthia glossinidia brevipalpis; identical to SEQ ID NO: 3031

SEQ ID NO: 17674 - DNA, 1035 bp, Xanthomonas axonopodis; identical to SEQ ID NO: 3032
  CDS (1)..(1035)

SEQ ID NO: 17675 - protein, 344 aa, Xanthomonas axonopodis; identical to SEQ ID NO: 3033

SEQ ID NO: 17676 - DNA, 1594 bp, Xenorhabdus nematophilus; identical to SEQ ID NO: 3034
  CDS (142)..(1218)

SEQ ID NO: 17677 - protein, 358 aa, Xenorhabdus nematophilus; identical to SEQ ID NO: 3035

SEQ ID NO: 17678 - DNA, 1044 bp, Xylella fastidiosa; identical to SEQ ID NO: 3036
  CDS (1)..(1044)

SEQ ID NO: 17679 - protein, 347 aa, Xylella fastidiosa; identical to SEQ ID NO: 3037

SEQ ID NO: 17680 - DNA, 1020 bp, Zymomonas mobilis; identical to SEQ ID NO: 3038
  CDS (1)..(1020)

SEQ ID NO: 17681 - protein, 339 aa, Zymomonas mobilis; identical to SEQ ID NO: 3039

SEQ ID NO: 17682 - DNA, 1660 bp, primary endosymbiont of Sitophilus oryzae; identical to SEQ ID NO: 3040
  CDS (11)..(1078)

SEQ ID NO: 17683 - protein, 355 aa, primary endosymbiont of Sitophilus oryzae; identical to SEQ ID NO: 3041

SEQ ID NO: 17684 - DNA, 1110 bp, Azospirillum lipoferum; identical to SEQ ID NO: 3042
  CDS (1)..(1110)

SEQ ID NO: 17685 - protein, 369 aa, Azospirillum lipoferum; identical to SEQ ID NO: 3043

SEQ ID NO: 17686 - DNA, 1017 bp, Geobacter sulfurreducens; identical to SEQ ID NO: 3044
  CDS (1)..(1017)

SEQ ID NO: 17687 - protein, 338 aa, Geobacter sulfurreducens; identical to SEQ ID NO: 3045

SEQ ID NO: 17688 - DNA, 1230 bp, Mycobacterium paratuberculosis; identical to SEQ ID NO: 3046
  CDS (1)..(1230)

SEQ ID NO: 17689 - protein, 409 aa, Mycobacterium paratuberculosis; identical to SEQ ID NO: 3047

SEQ ID NO: 17690 - DNA, 1083 bp, Lactobacillus johnsonii; identical to SEQ ID NO: 3048
  CDS (1)..(1083)

SEQ ID NO: 17691 - protein, 360 aa, Lactobacillus johnsonii; identical to SEQ ID NO: 3049

SEQ ID NO: 17692 - DNA, 1245 bp, Treponema denticola; identical to SEQ ID NO: 3050
  CDS (1)..(1245)

SEQ ID NO: 17693 - protein, 414 aa, Treponema denticola; identical to SEQ ID NO: 3051

SEQ ID NO: 17694 - DNA, 1068 bp, Wolbachia pipientis wMel; identical to SEQ ID NO: 3052
  CDS (1)..(1068)

SEQ ID NO: 17695 - protein, 355 aa, Wolbachia pipientis wMel; identical to SEQ ID NO: 3053

SEQ ID NO: 17696 - DNA, 1074 bp, Desulfovibrio vulgaris; identical to SEQ ID NO: 3054
  CDS (1)..(1074)

SEQ ID NO: 17697 - protein, 357 aa, Desulfovibrio vulgaris; identical to SEQ ID NO: 3055

SEQ ID NO: 17698 - DNA, 1557 bp, Bacillus licheniformis; identical to SEQ ID NO: 3056
  CDS (369)..(1415)

SEQ ID NO: 17699 - protein, 348 aa, Bacillus licheniformis; identical to SEQ ID NO: 3057

SEQ ID NO: 17700 - DNA, 1119 bp, Corynebacterium diphtheriae; identical to SEQ ID NO: 3058
  CDS (1)..(1119)

SEQ ID NO: 17701 - protein, 372 aa, Corynebacterium diphtheriae; identical to SEQ ID NO: 3059

SEQ ID NO: 17702 - DNA, 1038 bp, Mycoplasma mycoides; identical to SEQ ID NO: 3060
  CDS (1)..(1038)

SEQ ID NO: 17703 - protein, 345 aa, Mycoplasma mycoides; identical to SEQ ID NO: 3061

SEQ ID NO: 17704 - DNA, 1134 bp, Bdellovibrio bacteriovorus; identical to SEQ ID NO: 3062
  CDS (1)..(1134)

SEQ ID NO: 17705 - protein, 377 aa, Bdellovibrio bacteriovorus; identical to SEQ ID NO: 3063

SEQ ID NO: 17706 - DNA, 1086 bp, Parachlamydia sp; identical to SEQ ID NO: 3064
  CDS (1)..(1086)

SEQ ID NO: 17707 - protein, 361 aa, Parachlamydia sp; identical to SEQ ID NO: 3065

SEQ ID NO: 17708 - DNA, 1071 bp, Photobacterium profundum; identical to SEQ ID NO: 3066

SEQ ID NO: 17709 - protein, 356 aa, Photobacterium profundum; identical to SEQ ID NO: 3067

SEQ ID NO: 17710 - DNA, 24 bp, Primer
atggctatcgacgaaaacaaacag

SEQ ID NO: 17711 - DNA, 27 bp, Primer
ttaaaaatcttcgttagtttctgctac

SEQ ID NO: 17712 - DNA, 465 bp, Escherichia coli K12
  CDS (1)..(465)
atggaaaagaaattaccccgcattaaagcgctgctaacccccggcgaagtggcgaaacgcagcggtgtggcggtatcggcgctgcatttctatgaaagtaaagggttgattaccagtatccgtaacagcggcaatcagcggcgatataaacgtgatgtgttgcgatatgttgcaattatcaaaattgctcagcgtattggcattccgctggcgaccattggtgaagcgtttggcgtgttgcccgaagggcatacgttaagtgcgaaagagtggaaacagctttcgtcccaatggcgagaagagttggatcggcgcattcataccttagtggcgctgcgtgacgaactggacggatgtattggttgtggctgcctttcgcgcagtgattgcccgttgcgtaacccgggcgaccgcttaggagaagaaggtaccggcgcacgcttgctggaagatgaacaaaactaa

SEQ ID NO: 17713 - protein, 154 aa, Escherichia coli K12
MEKKLPRIKALLTPGEVAKRSGVAVSALHFYESKGLITSIRNSGNQRRYKRDVLRYVAIIKIAQRIGIPLATIGEAFGVLPEGHTLSAKEWKQLSSQWREELDRRIHTLVALRDELDGCIGCGCLSRSDCPLRNPGDRLGEEGTGARLLEDEQN

SEQ ID NO: 17714 - DNA, 402 bp, Vibrio cholerae
  CDS (1)..(402)
atgatgtttcagattggagagttagccaaacgctgcggcgtttccaccgatacactgcgtttctatgaaaaaaatgagctgattgctccggcaacgcgcaccgagtcgggctatcgactgtacgatgaaaagagccagcaacaagtcacgtttattttaaaagccaaagagttagggctgagcctcgaagagattaaagagctgctggaaattcgtttggaagcgaccgaacacagctgcgccgaggtgaaagcgatcaccagcgctaagctggcggtgatcgaccaaaagattgaagagctgacccgtattcgcagcgcgctgaaaaaaatcaatgatgcctgctgtggacatgtcgaagataatgccagccactgctcgattttagccgcgttagagtag

SEQ ID NO: 17715 - protein, 133 aa, Vibrio cholerae
MMFQIGELAKRCGVSTDTLRFYEKNELIAPATRTESGYRLYDEKSQQQVTFILKAKELGLSLEEIKELLEIRLEATEHSCAEVKAITSAKLAVIDQKIEELTRIRSALKKINDACCGHVEDNASHCSILAALE

SEQ ID NO: 17716 - DNA, 414 bp, Nostoc sp. PCC 7120
  CDS (1)..(414)
atgctagtccaagaagagccaaaactcattggtaatgttgccaagtctagcggtgtacctattaaaactattcgctactatgaagaacttggtctactcaaatcatcagcaagaacagaaggcggatttagattatttaactctgatgttttggagcgactgcactttattaaacgcgctcaaagcttaggattaagcttgtcagaaattaaggaatttttaaatgttcatgatggaggggaattaccttgtgagcatataaaaattaaactagaagataagattaaagctattgatgaacaaattcatcaattactgattttgagacaagaattatcaggattagtttctggttgggaaaccatacctgaaaatcctgaaaaaacaatttgtcctattattgaaagaaattaa

SEQ ID NO: 17717 - protein, 137 aa, Nostoc sp. PCC 7120
MLVQEEPKLIGNVAKSSGVPIKTIRYYEELGLLKSSARTEGGFRLFNSDVLERLHFIKRAQSLGLSLSEIKEFLNVHDGGELPCEHIKIKLEDKIKAIDEQIHQLLILRQELSGLVSGWETIPENPEKTICPIIERN

SEQ ID NO: 17718 - DNA, 438 bp, Listeria innocua
  CDS (1)..(438)
atggaatatattgcgcatgaagtggctgagaagttgggcattacagttcccacactgcactactatgaaaaagctggtttgcttccatcaataaaaagaaatagtgtaggaaatagaatatacacagaagagaatattgaatggctttacatgattgtgttgatgcgggaagttggcgtaccgattcgtgaaatacgctcttacatacaattattgttgaagggccctgaaacaatccctgaacgctatcaattagtaacgcagtacaagcaatctgtagaagaaaagatgaaggcaatgcaaacttctttaaaatggctgggtgctaaagtgaatttctatcaggaaatgatggatacaggggagaacaagccttgccgtacctttctggaggaatctgaactttttaggttgaagcaagcggaggagcaaaaatga

SEQ ID NO: 17719 - protein, 145 aa, Listeria innocua
MEYIAHEVAEKLGITVPTLHYYEKAGLLPSIKRNSVGNRIYTEENIEWLYMIVLMREVGVPIREIRSYIQLLLKGPETIPERYQLVTQYKQSVEEKMKAMQTSLKWLGAKVNFYQEMMDTGENKPCRTFLEESELFRLKQAEEQK

SEQ ID NO: 17720 - DNA, 411 bp, Nostoc sp. PCC 7120
  CDS (1)..(411)
atgttagcccaaacagaagcaaaacaaattggtgtagttgccaaagaaagcggcgtacccattaaaaccattcgctactatgaagaacttggtctactcacatcatcaggcagaaccgagggaggatttagattatttaattctgatgttttggcacgactgcactttattaagcgcgctcaaagtttaggattaagcttgtcagaaatcaaggaatttttaaatgtccacgatggaggagaattaccttgtgaacatatcaaaattaaactagaagataaggtaaaagctattgatgagcaaattcagcaattactaattttgaggcaagaattatcaggattactttctgggtgggaaataaagcctgataattctcataaaaccatttgccccattattgaacattaa

SEQ ID NO: 17721 - protein, 136 aa, Nostoc sp. PCC 7120
MLAQTEAKQIGVVAKESGVPIKTIRYYEELGLLTSSGRTEGGFRLFNSDVLARLHFIKRAQSLGLSLSEIKEFLNVHDGGELPCEHIKIKLEDKVKAIDEQIQQLLILRQELSGLLSGWEIKPDNSHKTICPIIEH

SEQ ID NO: 17722 - DNA, 426 bp, Agrobacterium tumefaciens
  CDS (1)..(426)
atggagaaagccatgctgtccatcggtgaactgtcgaaacgcaccggcgtgaaggtgccgacgatccgctattacgagcagatgggcctcatccgcgaggcggaccgttcggacggcaaccagcgccgttacgaaaaatccgacctcgaaaggctggccttcatccgccatgcgcgcgatctcggcctgaatatcgaggccatccgcgagctgcttgcgctcagccagcaccggcagatgccttgcgaaggtgccgaccgcatcgccgccgagcatcttgcccatgtgcgcgaaaagattgccagcctgaagaagctggaacacgagctggaacgcatcgtctcccattgccacggccattcgatcgaggattgttacgtcatccgcgcgctttccaaccacggtatgtgcgagggcgagcattga

SEQ ID NO: 17723 - protein, 141 aa, Agrobacterium tumefaciens
MEKAMLSIGELSKRTGVKVPTIRYYEQMGLIREADRSDGNQRRYEKSDLERLAFIRHARDLGLNIEAIRELLALSQHRQMPCEGADRIAAEHLAHVREKIASLKKLEHELERIVSHCHGHSIEDCYVIRALSNHGMCEGEH

SEQ ID NO: 17724 - DNA, 447 bp, Vibrio cholerae
  CDS (1)..(447)
atggagatgacagtaggcgatgtggcgcaaagagcaggggtgaaggtctcagcgttgcatttttatgaacagaaaggattgatccatagttggcgtaatcaaggcaatcaacggcgttacgatcgtagtgtactgcgcaggatcgcggtgattaaggccgcacaaatggtcggactgaccttagaagagattgccgaagctctggcacatttaccaaaacatgaagcgcccactcgtcaagattggcagcaaatggcttctcattggcaccattttctcgatcatcggatccaacaattaaacgcattgaaagaggacttaagcggctgcattggctgcggatgtttatctcttgagtcttgtgctatctacaatcccaaagatattcgcgctatgactttcgcggataaaacacgcttatcgcatccagaagagtggagccgttaa

SEQ ID NO: 17725 - protein, 148 aa, Vibrio cholerae
MEMTVGDVAQRAGVKVSALHFYEQKGLIHSWRNQGNQRRYDRSVLRRIAVIKAAQMVGLTLEEIAEALAHLPKHEAPTRQDWQQMASHWHHFLDHRIQQLNALKEDLSGCIGCGCLSLESCAIYNPKDIRAMTFADKTRLSHPEEWSR

SEQ ID NO: 17726 - DNA, 471 bp, Pseudomonas aeruginosa
  CDS (1)..(471)
atgaagaattcctgcgcatctcgtgaactgagcgtcggcgaactggccaggcgtgccggcgtggcggtctccgccctgcatttctacgaaaccaaggggctgatcagcagccagcgcaacgccggcaaccagcggcgcttcagtcgcgagacgctacgccgggtggtggtgatcaaggtcgcccagcgggtcggcattcccctcgcggagatcgctcgcgccctgcagaccctgccggcggggcgcagccctagcgcggcggactgggcgcgcctgtcggcgcagtggaaggaggatctcaccgagcgcatcgacaagctgctgctgttgcgcgaccaactggacggctgcatcggttgcggctgcctgtcgctccaggcctgcccgttgcgcaaccccggcgaccagctttccgccgaggggccgggagcgcactggctggacgccgagggccgcgagcacgacggctag

SEQ ID NO: 17727 - protein, 156 aa, Pseudomonas aeruginosa
MKNSCASRELSVGELARRAGVAVSALHFYETKGLISSQRNAGNQRRFSRETLRRVVVIKVAQRVGIPLAEIARALQTLPAGRSPSAADWARLSAQWKEDLTERIDKLLLLRDQLDGCIGCGCLSLQACPLRNPGDQLSAEGPGAHWLDAEGREHDG

SEQ ID NO: 17728 - DNA, 426 bp, Pseudomonas aeruginosa
  CDS (1)..(426)
atgcggcaactggacataggcgaggtcgcgcgacgatccggggtaccggcctcgaccctgcgctactacgaggaaaagggactgatcgcctccagcggccggcacggcctgcgccggctgttcgatgcaggcgtgctggagcggctggcgctgatcgggctgggccgcgccgccgggttgtcgctggacgagattgccggcatgggcgcagccgacggcgcgctgcggatcgaccgcgcggcgctggcggccaaggccgacgaactggaccggacgatccgccgcctcgccgccatgcgcgacggcctgcggcatgccgcggcctgtccggcgcgcgagcacatggactgcccgacgttccgccgcttgctgcgggccgctgccgcgggggccatcaagccacgccggaaagcgcccggcgcatag

SEQ ID NO: 17729 - protein, 141 aa, Pseudomonas aeruginosa
MRQLDIGEVARRSGVPASTLRYYEEKGLIASSGRHGLRRLFDAGVLERLALIGLGRAAGLSLDEIAGMGAADGALRIDRAALAAKADELDRTIRRLAAMRDGLRHAAACPAREHMDCPTFRRLLRAAAAGAIKPRRKAPGA

SEQ ID NO: 17730 - DNA, 534 bp, Agrobacterium tumefaciens
  CDS (1)..(534)
atgaggaattataccggctgctcttcgacgcttttccgcattttccgagcggaaatcattccggaagcaggagccagaatggaaaataccatcttcaaacacagcctgtcggtgggggatgttgcgcgccgcagcggtattgccgtttccaccatccatttttacgaggcgaaggggcttatcgaaggctggcgcaccgccggcaaccagcgtcgttatcatcgcgccgtcctgcggcgcatcgccatcatccgcatcgcgcaacgcgccggcatccagctcagcatcatcagggaggcgatggctgatctgccgcaggaccgcgtggcgacgacgacggactggcgcaggttctcccagtcctggcgggaaatgctccagacgcgtatcaacaatctggtcatgctaagggatcagttgaccggctgcatcggttgcggttgcctgtcgctggatgattgtccgctgcgtaatccgaatgatgttctggccgatgacggcgctggcccgcgccgcctcgtctccgctgaataa

SEQ ID NO: 17731 - protein, 177 aa, Agrobacterium tumefaciens
MRNYTGCSSTLFRIFRAEIIPEAGARMENTIFKHSLSVGDVARRSGIAVSTIHFYEAKGLIEGWRTAGNQRRYHRAVLRRIAIIRIAQRAGIQLSIIREAMADLPQDRVATTTDWRRFSQSWREMLQTRINNLVMLRDQLTGCIGCGCLSLDDCPLRNPNDVLADDGAGPRRLVSAE

SEQ ID NO: 17732 - DNA, 405 bp, Sinorhizobium meliloti
  CDS (1)..(405)
atggtacagagtcaagatcttcaagaactgacgatcgggaaacttgcggctgccggaggcgtgggtgttgaaaccatccgtttctaccagcgcaagggcctgctggcgacgccgaagcggttagaaggcgtgcgccgctatggaggcgaagacgtgcgccgactacgtttcataaaacaggcgcaggcggccggtttcacgcttgaggagatcgggcagcttctggcactggatgccgggcacaaccgctcggctgcacgggaactggcgaagaagaagcttgagcagctggatgccaggattggagagcttaatcgcgcccgggaagcactccgtaagctggtctctgaatgcgcagaggacaagaccggaccgtgtcccatcctggcttcctttggagtttga

SEQ ID NO: 17733 - protein, 134 aa, Sinorhizobium meliloti
MVQSQDLQELTIGKLAAAGGVGVETIRFYQRKGLLATPKRLEGVRRYGGEDVRRLRFIKQAQAAGFTLEEIGQLLALDAGHNRSAARELAKKKLEQLDARIGELNRAREALRKLVSECAEDKTGPCPILASFGV

SEQ ID NO: 17734 - DNA, 399 bp, Pseudomonas aeruginosa
  CDS (1)..(399)
atgaacatcggtgaagcggcgaagaaaagcggactgacgccgaagatgatccgttactacgagtccatcgagttgctccgcccagccggacgcagcgccagcggctaccgccactacaacgagaacgacctgcataccctggcgttcatccgccgttcgcgggacctcggtttctccctcgacgaagtcggcaagctgctcaccctctggcaggatcgccagcgtgccagtgccgacgtcaaggccctggcggcgcagcacgtgcgcgagctgaatcgcaagatcgaggagctcagcaccctgcgcgacaccctgcaggacctggtcgagcactgccagggcgaccaccgccccgactgcccgatcctcaaggacctggcgtctggctgctgccactag

SEQ ID NO: 17735 - protein, 132 aa, Pseudomonas aeruginosa
MNIGEAAKKSGLTPKMIRYYESIELLRPAGRSASGYRHYNENDLHTLAFIRRSRDLGFSLDEVGKLLTLWQDRQRASADVKALAAQHVRELNRKIEELSTLRDTLQDLVEHCQGDHRPDCPILKDLASGCCH

SEQ ID NO: 17736 - DNA, 528 bp, Streptomyces coelicolor
  CDS (1)..(528)
atgcctcagattccagagaagatccaagagctcacggtcggccagctcgccgaccgcagcggcgccgcggtctccgccttgcacttctacgagtccaagggtctgatcaccagtcgtcgcacctcgggcaaccagcggcgcttcgcccgtgacgcgctgcgccgggtcgccttcgtccgtgcggcgcagcgggtcggcatcccgctggccacgatccgcgaggcgctcgccgaactgccggaggggcgcacgcccaccgaggacgactgggcccggctctccgagtcctggcgctccgagctggacgagcgcatcaaacagctcaaccggctgcgcgaccacctcaccgactgcatcggctgcggctgcctgtccctggaaacctgcgtcctgtccaaccccgacgacgccttcggcgaacgcagtgcgggctcccgcctgctcgtggagcgccgcggctccaccgccaggggcggccgggcgccgagccgcgcccgggaaccggaagtgccgtgctgcggcgactga

SEQ ID NO: 17737 - protein, 175 aa, Streptomyces coelicolor
MPQIPEKIQELTVGQLADRSGAAVSALHFYESKGLITSRRTSGNQRRFARDALRRVAFVRAAQRVGIPLATIREALAELPEGRTPTEDDWARLSESWRSELDERIKQLNRLRDHLTDCIGCGCLSLETCVLSNPDDAFGERSAGSRLLVERRGSTARGGRAPSRAREPEVPCCGD

SEQ ID NO: 17738 - DNA, 591 bp, Streptomyces violaceoruber
  CDS (1)..(591)
atgaccgtcgcccggcccgcgcaccacgtcaccgaactcaccgtcggacagctgtcggcgcgcagcggcgtcgcggtcacggccctgcacttctacgagtccaaggggctcatcaagagccgccggacgcccggaaaccagcgccgctacacacgggacacgctgcgccgcatctccgtcatccgggtggcgcagcgcatgggcatcccgctgagcacggtcgccgaggcgctggccgagctgcccgaggagcgcacgcccacccgggaggactgggcccggctctcgcggcgctggcgcgcggacctcaacgagcggatcgagcagctgctcgcgctccgcgacggcctggaggactgcatcggctgtggctgtctgtcggtacgggactgcccgctgaccaatccgtacgacgagctcggcgaggagggtccggggccgcgccgcctgctgcgcgaaccgacgggcgcggcggcccgcggcggtgcccgcggccgggcgcgcacggcccgtacggcggaaaggaccgcccccgtggccgatccgtgcgggggcgtgagcccgtcctgccagggcggcgcgaccgactga

SEQ ID NO: 17739 - protein, 196 aa, Streptomyces violaceoruber
MTVARPAHHVTELTVGQLSARSGVAVTALHFYESKGLIKSRRTPGNQRRYTRDTLRRISVIRVAQRMGIPLSTVAEALAELPEERTPTREDWARLSRRWRADLNERIEQLLALRDGLEDCIGCGCLSVRDCPLTNPYDELGEEGPGPRRLLREPTGAAARGGARGRARTARTAERTAPVADPCGGVSPSCQGGATD

SEQ ID NO: 17740 - DNA, 474 bp, Erwinia carotovora subsp
  CDS (1)..(474)
atgaggtcaagcatgaaatttctggatattggcgacgtctcggagaagagcggaatcaagccttcagcgttgcgctattacgaagatatcggcctgattgcttcggtatcccggcacgggctccggcggcagttttctgaagacatactgctgcaactcaggttgatctcgatggggaaatcggcggggttttcacttcaggaaatcgctggcatgtttaacaaaaatgggatgccggatttgccgcgtaccgcgcttcatctgaaggctgacgaaatcgaccagcaaatccatgagctacgggtattgcgtgatacgctgcggcacgtcgccgactgttctgcgccatcgcatatggaatgcccaaccttcaggaaactcgttgaggtcacgcaccgaaggggccagatgcgtgaaaagacgagcaccgcagccattcgaaaagtgccgcaaagtatgaaaaagaaagtttga

SEQ ID NO: 17741 - protein, 157 aa, Erwinia carotovora subsp
MRSSMKFLDIGDVSEKSGIKPSALRYYEDIGLIASVSRHGLRRQFSEDILLQLRLISMGKSAGFSLQEIAGMFNKNGMPDLPRTALHLKADEIDQQIHELRVLRDTLRHVADCSAPSHMECPTFRKLVEVTHRRGQMREKTSTAAIRKVPQSMKKKV

SEQ ID NO: 17742 - DNA, 441 bp, Rhodococcus opacus
  CDS (1)..(441)
atgtctttggatccgaaggatctgctgtcggtgggggaggtgtcccgtcggaccggtgtcgctgtctcggcgctgcactactacgagcagctcggactgatcgcgtcgacgcggacgtccgggaatcaacgccggtacgaacggcacatgctccggcggatctcgctgatcgtggtggccaaacggctcgggatcccactggccgacgtgggaacggtgttcgagacgctcccggcagaccggatgccgtcgatccgcgactggcagcgcgtgtcgaagctgtggcgggtgcagctcgaggatcagcgcaagcgaatcgagcgcctcgaacacgagctcaccggatgcatcgggtgtggttgcctgtcgatgaaggcgtgctatctgctcaatcccgaagaccaactcgccgtagaggggtcgggaccgaaccggctctga

SEQ ID NO: 17743 - protein, 146 aa, Rhodococcus opacus
MSLDPKDLLSVGEVSRRTGVAVSALHYYEQLGLIASTRTSGNQRRYERHMLRRISLIVVAKRLGIPLADVGTVFETLPADRMPSIRDWQRVSKLWRVQLEDQRKRIERLEHELTGCIGCGCLSMKACYLLNPEDQLAVEGSGPNRL

SEQ ID NO: 17744 - DNA, 495 bp, Acinetobacter sp
  CDS (1)..(495)
atgaagcaatcaaatcaagaaaatttagggcaacagttcatcacaattggagagttggcgaaacgaagcggtgtaagtgtgccgaccatacgcttttatgaagcgaaacaattgatctggagtattcgaactaatggcaatcaacgccgatatctgcgtgcgatgctcagacgtatcgcaattattaaagtagcgcagttggtgggcatcagtcttgaagagcttaaacaagcattctcggttttacccgatcgtaaaatggcatctaaacaagactgggaaaaaatgtctaatctctggaagaatcaactcgataaaaaaattcagaccttattgcagctcagacagcaactcgactggtgtatcgggtgtggatgcctctcacttgatcaatgtccgctacgtaatcctgatgatcattatgcgagccaatcaaatggcgcacattttcagagggttcaataccagattgaacagcttgatacagaagattaa

SEQ ID NO: 17745 - protein, 164 aa, Acinetobacter sp
MKQSNQENLGQQFITIGELAKRSGVSVPTIRFYEAKQLIWSIRTNGNQRRYLRAMLRRIAIIKVAQLVGISLEELKQAFSVLPDRKMASKQDWEKMSNLWKNQLDKKIQTLLQLRQQLDWCIGCGCLSLDQCPLRNPDDHYASQSNGAHFQRVQYQIEQLDTED

SEQ ID NO: 17746 - DNA, 432 bp, Photobacterium profundum
  CDS (1)..(432)
atggatatgagcgtggggcaagttgctaaacgtgcaggcgttaccgtcgcaactcttcatttttatgaagaaaaaggtttgatttttagtgctagaaatccagcgaatcaacggagatatgagcgccaaatcttgagaagaattgcagtgattaaagcagcacagaatgtaggtttaacgtcgcaagaaatatctgtagcacttgagcatctgcccaagcataaagcaccgaataaaggtgaatgggagcagctagcaaaagaatggaatcacaagctagaagagaaaattcaaagcctgaaaagcctacaatctcaactagggagttgtattcaatgtggctgtttatcgctgggaaaatgtgcgttatacaacccagaagactcgcggggaatccaaaaagcaggggctaagttaagccccctgggttag

SEQ ID NO: 17747 - protein, 143 aa, Photobacterium profundum
MDMSVGQVAKRAGVTVATLHFYEEKGLIFSARNPANQRRYERQILRRIAVIKAAQNVGLTSQEISVALEHLPKHKAPNKGEWEQLAKEWNHKLEEKIQSLKSLQSQLGSCIQCGCLSLGKCALYNPEDSRGIQKAGAKLSPLG

SEQ ID NO: 17748 - DNA, 426 bp, Photobacterium profundum
  CDS (1)..(426)
atgtatttgattgggcagctcgcaaaattatgcggggtaagtaacgatacactgcggttttatgaaaaaaatggcttaatgaagcccgcagggcgtagcaatagcggttatcgcttatacagtgaagaaaacttgtcgcgcataaattttattattagagcgaaagcaattggattgagcttagatgaaattcgagagttattgggtattcgactagaagctagccagcatagctgcgcagaggtaaaagccatcacccaaacgaagttggatgaagttgatgtgaaaattgcagaattaacgcgcattcgagtcgcattgaagaaactcaatgatgcctgttgtggtcatgctgacgatgatgccagccattgctctatccttgaggcgcttgatgagcgagattgttgctctacattagagtaa

SEQ ID NO: 17749 - protein, 141 aa, Photobacterium profundum
MYLIGQLAKLCGVSNDTLRFYEKNGLMKPAGRSNSGYRLYSEENLSRINFIIRAKAIGLSLDEIRELLGIRLEASQHSCAEVKAITQTKLDEVDVKIAELTRIRVALKKLNDACCGHADDDASHCSILEALDERDCCSTLE

SEQ ID NO: 17750 - DNA, 474 bp, Bdellovibrio bacteriovorus
  CDS (1)..(474)
atggctgcaaaaaccacaacccctgccctcaccaccacactgtcggttggcgaagtcgccgcccgcagcggcatctcggttccgacgttgcatttctatgaatccaaaggactgattaaaagtcatcgcaacaacggcaatcagcgccgctatgaccgctcggttttacgtctgatttcaataattaagatctcccagcatctgggtatgagtctggagcaaatcaaagatcacctgtcatcgctgccgcaggatcataccccgacggcgacggaatggaaacgactgaccaagaaatggaatgacgatctagaagagcgcatcaaattgctgcagctcttacaatcgcaactagccagctgcatcgggtgtgggtgcatgtcccttaaggaatgtccgttaagaaacccggaggatcgctacggcaaaaaagggaccggcgcacaacgcttaagagaacaatgccggatataa

SEQ ID NO: 17751 - protein, 157 aa, Bdellovibrio bacteriovorus
MAAKTTTPALTTTLSVGEVAARSGISVPTLHFYESKGLIKSHRNNGNQRRYDRSVLRLISIIKISQHLGMSLEQIKDHLSSLPQDHTPTATEWKRLTKKWNDDLEERIKLLQLLQSQLASCIGCGCMSLKECPLRNPEDRYGKKGTGAQRLREQCRI

SEQ ID NO: 17752 - DNA, 402 bp, Rhodopseudomonas palustris
  CDS (1)..(402)
atgcaggcggaccatctcgcgattggggatctcgggcgtcagacggacaccaaggtggaaaccatccgctattacgagcggatcggattgctgtcggccccagcgcgcacgcccggcaactaccgcgcctacacgacggaccatctcaaccgtctgagcttcattcgtcgcgcgcgcgatctcggcttttcactcgatcagatccgcgcgctgctcgatctgtctgacgaccgcacccgatcctgcgatgccatcgacgccatcgccaagcagcatctggccgaagtcgatcgcaagatcgccgacctcaaggccctgcgccacgagctcaaccacatgatcacccaatgcagctgcggaacggtcgccgactgccgcattatcgaggcactgtcgccgtag

SEQ ID NO: 17753 - protein, 133 aa, Rhodopseudomonas palustris
MQADHLAIGDLGRQTDTKVETIRYYERIGLLSAPARTPGNYRAYTTDHLNRLSFIRRARDLGFSLDQIRALLDLSDDRTRSCDAIDAIAKQHLAEVDRKIADLKALRHELNHMITQCSCGTVADCRIIEALSP

SEQ ID NO: 17754 - DNA, 459 bp, Rhodococcus erythropolis
  CDS (1)..(459)
atggacattccagtgcgatggaaggtcaaggatctcgtgaaaattggtgaactggccgctcgaagtggcgttgccccgaaaacgctgcgtttctacgaggacagtggggtgattcccgtcccggtccgaaagtccaacggctaccgggactacggtccggaatctcttgcgcgtttgcggttcgtccgcagcgcccagtctgcaggtttcaccttgcgagagatccgcgagatcctcaccacccatgaccgcggggcggctccttgtgaacaggtcgtggagatgctctcggagcatctttcccaggttcgtggcaagatccgcgaacttgccacgctcgaaacaaaccttgttgctttgctgagtcgagcggaaggtgagattccgtcggaagccgacgatgtcggtgtgtgctggatcctggaatccgagtctcaggaaggtgttgccgaatcgtga

SEQ ID NO: 17755 - protein, 152 aa, Rhodococcus erythropolis
MDIPVRWKVKDLVKIGELAARSGVAPKTLRFYEDSGVIPVPVRKSNGYRDYGPESLARLRFVRSAQSAGFTLREIREILTTHDRGAAPCEQVVEMLSEHLSQVRGKIRELATLETNLVALLSRAEGEIPSEADDVGVCWILESESQEGVAES

SEQ ID NO: 17756 - DNA, 456 bp, Actinoplanes teichomyceticus
  CDS (1)..(456)
atgcgtatcggcgagctggccgcccgcaccggtgtcagtgtccgggcactgcgctactacgagcagcaggatctgctcagcgccgagcgcggttcgagcagccatcgccggtaccccgagagcgcggtcgaccgggtccagctgatccagcggttgtaccaggccgggctgaccagcaagaccatcgtcgagctgctgccgtgcgtcgtcggtgaccgcgccaccccggcgatgctcgagcggctggcagccgaacgcgagcagatcgatcagcgcatcaccgatctcgtccgaacccgggaccggctcgacgccgtgatcagcaacgcgaccgacagcatgcttaccggcgcctcctgccgtgacggtgacgtatccggccggcggccgggcacgaagccgcggcgatcggcgggagggaccgtgcgggaggaacacggcgggggcgaggtgtga

SEQ ID NO: 17757 - protein, 151 aa, Actinoplanes teichomyceticus
MRIGELAARTGVSVRALRYYEQQDLLSAERGSSSHRRYPESAVDRVQLIQRLYQAGLTSKTIVELLPCVVGDRATPAMLERLAAEREQIDQRITDLVRTRDRLDAVISNATDSMLTGASCRDGDVSGRRPGTKPRRSAGGTVREEHGGGEV

SEQ ID NO: 17758 - DNA, 456 bp, Listeria monocytogenes
  CDS (1)..(456)
atgaccaaaaataatattagtttttatgtagtagatgcttcggaagaattaaccatgaatatcaaagaagctagtgaaaaaagtggcgtttctgccgatacaattcgctactatgaacgcattggtttaattccacccatccaccgtaatgaaagtggggttcgtaaatttggcgcagaagacctacgatggattttatttactcgccaaatgcgccgagctggtttgtctattgaagccttaattgattacttggcacttttcagagaaggcgaacacacgctggaagctcgcgccgaattgctgaaaaagcaacgcatagagctgaaaaatcgcattgatgttatgcaagaagcgctcgatcgacttgacttcaaaatagacaattacgatacccacctcattccggctcaagaagaactaaaagattttaatgttgaaaggagtaattcataa

SEQ ID NO: 17759 - protein, 151 aa, Listeria monocytogenes
MTKNNISFYVVDASEELTMNIKEASEKSGVSADTIRYYERIGLIPPIHRNESGVRKFGAEDLRWILFTRQMRRAGLSIEALIDYLALFREGEHTLEARAELLKKQRIELKNRIDVMQEALDRLDFKIDNYDTHLIPAQEELKDFNVERSNS

SEQ ID NO: 17760 - DNA, 477 bp, Mycobacterium paratuberculosis
  CDS (1)..(477)
atggccccagtcaacgacttagagttaactctgagtcaagcacgaacccgggagccgcccatgctgaccatcggcgaggtcgcgcgccgcagcggggtcgccgcgaccaccctgcgctactacgagcagatcggcctgctgcccgccccgatccggctgggcgggcagcgccgctacgacgaggccgtgctgtcccggctcgaggtgatcgcgctgtgcaagaccgccggcttcgcgctggacgagatccagcgcctgttcgccgacgacgcgccgggacgcccggccagccgcgcgctggcccgggccaaactcgcccagatcgacgcccagctggagtcgctggcccgggcccgcgccgtcatcgagtgggggatgcggtgcacttgcccgtcgatcgacgcctgcacctgcggcattcacccaacccggcccgcacccgtcggcccggacgtccgctcagccagaaggttctga

SEQ ID NO: 17761 - protein, 158 aa, Mycobacterium paratuberculosis
MAPVNDLELTLSQARTREPPMLTIGEVARRSGVAATTLRYYEQIGLLPAPIRLGGQRRYDEAVLSRLEVIALCKTAGFALDEIQRLFADDAPGRPASRALARAKLAQIDAQLESLARARAVIEWGMRCTCPSIDACTCGIHPTRPAPVGPDVRSARRF

SEQ ID NO: 17762 - DNA, 465 bp, Bordetella pertussis
  CDS (1)..(465)
atgatgcgatccgcgcaggccgtccggcgtccggacttgctgtcggtgggcgaggtggccgcgcgcaccgggctggccgtatcggccctgcatttctacgaagccaaggggttgatcgccagcacccgcacggccggcaatcagcgccgctacgcgcgcgccgtattgcggcgggtggcggtgatacgcgtggcgcagcgcatgggtttgccgctggccgcgatcgcgcaggcgctggccaccctgccgacctcgcgcgcgcccaccgtggccgactggcggcgcctgtcgcgtgcctggcgccaggagctggaccagcgcatcctggggctgacgcaactgcgcgaccagctcgatggctgtatcggctgcggctgcctgtcgctgcgggagtgcccgttgcgcaatcccgacgacgccatggcgcgcctgggcgcggggccgcatttcccgccgcacgaatga

SEQ ID NO: 17763 - protein, 154 aa, Bordetella pertussis
MMRSAQAVRRPDLLSVGEVAARTGLAVSALHFYEAKGLIASTRTAGNQRRYARAVLRRVAVIRVAQRMGLPLAAIAQALATLPTSRAPTVADWRRLSRAWRQELDQRILGLTQLRDQLDGCIGCGCLSLRECPLRNPDDAMARLGAGPHFPPHE

SEQ ID NO: 17764 - DNA, 492 bp, Bordetella bronchiseptica
  CDS (1)..(492)
atgaagtcaactttaagtcaatggaggtcttgcatggatattgccgaagtcgccaggcgcaccggcgttccggcctcgacattgcggtactacgacaaggtgggattgatcgcgtcggtcagcccgcccggcgcgcgccgccgctatgcgccagcggtgctcgagcaactggctcttgtcgcgctgggccaggccggcggcctgtcgctggacgacatacgcgcgatgctgtcgccgcaaggcgcgccgcgggtggaccggcaggtattgctggccaaggccgaagaaatcgacgccaccgtcaagcagttgcaggccatgagccgcgggctgcggcatgccgccgcctgccccgcccccagccatgcgcaatgcccgaccttcaagcggctgctcaaggcggcggcggccggcgcgttgagccgccggcggccggcgtcaacgggcgcggcgccgcgctcgccccgcaagcgcgcacccgccaggccatag

SEQ ID NO: 17765 - protein, 163 aa, Bordetella bronchiseptica
MKSTLSQWRSCMDIAEVARRTGVPASTLRYYDKVGLIASVSPPGARRRYAPAVLEQLALVALGQAGGLSLDDIRAMLSPQGAPRVDRQVLLAKAEEIDATVKQLQAMSRGLRHAAACPAPSHAQCPTFKRLLKAAAAGALSRRRPASTGAAPRSPRKRAPARP

SEQ ID NO: 17766 - DNA, 510 bp, Streptomyces avermitilis
  CDS (1)..(510)
atgccccagattcccgagaagatccatgagctcacggtcggccagctgtcggcccgcagtggcgccgccgtctccgccctgcatttctacgagtccaagggcctgatcagcagccgccgcaccgcgggcaaccagcgccgctaccaccgcgacgcgctgcgccgggtcgctttcgtccgcgccgcgcagcgcgtcggcatcccgctggccacgatccgcgaggcgctcgccgaactccccgaggagcggaccccgacgcacgaggactgggcgcgcctctccgaggcctggcgcgccgaactcgacgagcgcatcacccagctgggccggctgcgggaccatctgacggactgcatcgggtgcggatgcctgtcgttggagacctgtgtgctctccaacccggacgacgtcttcggcgaacggcggacgggctcgcggctcatggtggaccgcgccgcgagccggccgcggcgcacaccgggtcagcagcagcccgaggactgctgctga

SEQ ID NO: 17767 - protein, 169 aa, Streptomyces avermitilis
MPQIPEKIHELTVGQLSARSGAAVSALHFYESKGLISSRRTAGNQRRYHRDALRRVAFVRAAQRVGIPLATIREALAELPEERTPTHEDWARLSEAWRAELDERITQLGRLRDHLTDCIGCGCLSLETCVLSNPDDVFGERRTGSRLMVDRAASRPRRTPGQQQPEDCC

SEQ ID NO: 17768 - DNA, 420 bp, Vibrio parahaemolyticus
  CDS (1)..(420)
atgaggaatagtatggatattgcagaagtggttataaaatcaggattgccgacctcaacgctcagatactacgaacaattggggttaattcgttcaataggaaggaatggattgagacgtcaatattcgccagaggtactcaataaactcaacttaattagtttaggacgtatcgctggaatatcacttaacgaaatggcggaaatgttgaatcactcagaaggctcaaaaccatacattgatcgtgacttactggcgaaaaaggcgcttgagattgatgagcaaataacacgtttgaaagcggtgcgagacagcctaaaccatgtagcctcctgccctcatgagtcacatatggactgctcttcatttcagaggcttatgaaggtcgtaaagcgttatgtccccaaaaaaccgagataa

SEQ ID NO: 17769 - protein, 139 aa, Vibrio parahaemolyticus
MRNSMDIAEVVIKSGLPTSTLRYYEQLGLIRSIGRNGLRRQYSPEVLNKLNLISLGRIAGISLNEMAEMLNHSEGSKPYIDRDLLAKKALEIDEQITRLKAVRDSLNHVASCPHESHMDCSSFQRLMKVVKRYVPKKPR

SEQ ID NO: 17770 - DNA, 438 bp, Vibrio parahaemolyticus
  CDS (1)..(438)
atggaaatcagcgtaggagaagtggcaaaacgttccggagtgaaagtctctgccctgcatttttatgaacaaaaaggactgatttcgagttggagaaatcaaggcaatcagcgccgctaccaccgcagcgttttgcgccgtgtcgcggtgattaaagcggctcagcaagttgggttatcgttagaagaaatcaaacatgcgctagatgagctgccgaagcaccaagctcctaacaaagagcaatgggaagtcatggcaagccattggcatgaacagttagaacaaaagattcaaaaactcaaagccttacaaaacgatttgggtggatgcattggctgcggatgtttgtcgttagaaacctgcgcactgcgaaacccagaagatgtgttaggcaaagatcactcaggttcgaatttgaccttagaagaaggggcgtaa

SEQ ID NO: 17771 - protein, 145 aa, Vibrio parahaemolyticus
MEISVGEVAKRSGVKVSALHFYEQKGLISSWRNQGNQRRYHRSVLRRVAVIKAAQQVGLSLEEIKHALDELPKHQAPNKEQWEVMASHWHEQLEQKIQKLKALQNDLGGCIGCGCLSLETCALRNPEDVLGKDHSGSNLTLEEGA

SEQ ID NO: 17772 - DNA, 399 bp, Vibrio parahaemolyticus
  CDS (1)..(399)
atgtttcagataggtgagttggcaaaacgctgtggtgtgacttcagatacactgcgtttttatgagaaaaatgcgttgataaaacccgcagggcgaagcgaatcaggctaccgactttataatgaagagaatcaaaagcaggtgcgcttcatcttaaaagcgaaagagctagggttgagtttggatgagataaaagatctattagaaattaagttagaggcgacagaacacagttgtgcagaggtaaaagccattacttctgccaagttagagctgatcgacgagaagattaatgaactgacgaaaattcgccgtgctttgaagaagattaatgatgcgtgttgtggccatacaaacgatgatgccagtcattgttcgattcttgcagcacttgagtag

SEQ ID NO: 17773 - protein, 132 aa, Vibrio parahaemolyticus
MFQIGELAKRCGVTSDTLRFYEKNALIKPAGRSESGYRLYNEENQKQVRFILKAKELGLSLDEIKDLLEIKLEATEHSCAEVKAITSAKLELIDEKINELTKIRRALKKINDACCGHTNDDASHCSILAALE

SEQ ID NO: 17774 - DNA, 402 bp, Pseudomonas syringae
  CDS (1)..(402)
atgaacatcggccaggcagccaggagcagcggcttgagcgcgaagatgattcgctattacgagtccatcggcctgctgaaagccgcgcatcgcagcgacagcggttatcggttgtacggcgccgaagacctgcacaccctggcgttcatcaaacgctcacgggacctggggttttcgctggaagaagtcagcaaactgctgaccctctggcaagaccgccaacgcgccagcgccgacgtcaaggctctggcccgccagcacatcgtccagctgaaccagaaaatcgacgagctggccagcctgcgcgacacgcttgaggaactggtgaaacactgccagggcaacgaccgccccgactgcccgatcctcaaggacctggcgtcgggtgggtgttgttcatag

SEQ ID NO: 17775 - protein, 133 aa, Pseudomonas syringae
MNIGQAARSSGLSAKMIRYYESIGLLKAAHRSDSGYRLYGAEDLHTLAFIKRSRDLGFSLEEVSKLLTLWQDRQRASADVKALARQHIVQLNQKIDELASLRDTLEELVKHCQGNDRPDCPILKDLASGGCCS

SEQ ID NO: 17776 - DNA, 420 bp, Pseudomonas putida
  CDS (1)..(420)
atggacattgccgacgtcgccaaacgcactggcgtacctgcatcgacactgcgttactacgagaagaaaggcttgctcaagtccttggccgggcgcggccagcgtcgacagtttgcagccgatgtggcagaccggttggcgctgatcgccctggggcaggctgcggggttttcgctggatgaagtgggggcgatgctggtggacctgcaggtcgaccggcagatgctgatggccaaggcggacgagctggatgcgcggatcaagcggttgcaggcgatgagcaaggggttgcggcatgccgcgcaatgccctgagaaagatcatctggcatgcccgaaattccagcagctgatgaagctgtcggcggcgggagcattgggcgaaaagcaggcaagaacgaaggcgttcgttacagattga

SEQ ID NO: 17777 - protein, 139 aa, Pseudomonas putida
MDIADVAKRTGVPASTLRYYEKKGLLKSLAGRGQRRQFAADVADRLALIALGQAAGFSLDEVGAMLVDLQVDRQMLMAKADELDARIKRLQAMSKGLRHAAQCPEKDHLACPKFQQLMKLSAAGALGEKQARTKAFVTD

SEQ ID NO: 17778 - DNA, 372 bp, Pseudomonas putida
  CDS (1)..(372)
atgaatattggagagttggagcgccggagtgggctcagccgccatacattgcgctattacgaacagctcgggcttatcgagccacaccgacaagccaacaactatcgcagttacagtgaacagaccgttgctgacttggctttcatacagagtgcccagggcggaggcttttcacttgctgagattggggacattctagtggccaggcgggggaacacgattgattgcgcgcaaggcgccgtcttggtcgccgccaagatggccgagattcaaacgaagatcaccacgctacaggccgcttatgtttttctggacgcggagcgtgccaagcttgaagccagtgctattgccaatgggaagataatgccttga

SEQ ID NO: 17779 - protein, 123 aa, Pseudomonas putida
MNIGELERRSGLSRHTLRYYEQLGLIEPHRQANNYRSYSEQTVADLAFIQSAQGGGFSLAEIGDILVARRGNTIDCAQGAVLVAAKMAEIQTKITTLQAAYVFLDAERAKLEASAIANGKIMP

SEQ ID NO: 17780 - DNA, 456 bp, Pseudomonas putida
  CDS (1)..(456)
atggcagcggacaacacacggatgctcacagtgggtgaagtggccaagcgcagcggcgtggcggtgtctgcgctgcacttctacgaaaccaaggggctgatcgccagcgtccgcacggctggcaaccagcgccgctatccctcgctggtgctgcgtaccctggcgatcatcaaggtagcccagcgcacgggaattccgcttgaggaaatcaaacaagccttcagccgttatgcccccaacagcaagctcacggccgcacaatggagcgagatgtccacggcctggcgcgaagacctgaatgcccgcattcgcacactggaagcactgcgcgacagcctcgacaactgcattggctgcggttgcctgtcgctggaggactgcccactgcgcaaccccgaggatgtgctgggcaaggaagggaccggggcgcggatcctcgaaaagaaggcacgctaa

SEQ ID NO: 17781 - protein, 151 aa, Pseudomonas putida
MAADNTRMLTVGEVAKRSGVAVSALHFYETKGLIASVRTAGNQRRYPSLVLRTLAIIKVAQRTGIPLEEIKQAFSRYAPNSKLTAAQWSEMSTAWREDLNARIRTLEALRDSLDNCIGCGCLSLEDCPLRNPEDVLGKEGTGARILEKKAR

SEQ ID NO: 17782 - DNA, 411 bp, Pseudomonas putida
  CDS (1)..(411)
atgaacatcggccaggccgcccgccgcagcgggctcagcaccaagatgatccgttactacgaatccatcggcctgctcaaacccgccactcgcagcgacagcggctaccgcctgtaccaggcgcaagacttgcacaacctggccttcatcaagcgctcccgcgacctgggcttttccctcgaggaggtcggcaagttgctgaccttgtggcaggaccgccaacgtgccagcgccgatgtgaaggcgctggccatgcaccacatcgatgaactgaaccggcgcatcgaggagctggtgagcctgcgcgacaccctcggcgagctggtttcgcactgtcagggtgacgaccgcccggactgcccgatcctcaaagacctggccaatggcgctgcaggtagctgctgtcactga

SEQ ID NO: 17783 - protein, 136 aa, Pseudomonas putida
MNIGQAARRSGLSTKMIRYYESIGLLKPATRSDSGYRLYQAQDLHNLAFIKRSRDLGFSLEEVGKLLTLWQDRQRASADVKALAMHHIDELNRRIEELVSLRDTLGELVSHCQGDDRPDCPILKDLANGAAGSCCH

SEQ ID NO: 17784 - DNA, 468 bp, Vibrio vulnificus
  CDS (1)..(468)
atggacatcagcgtaggtgaagtggcgaaacgatcgggagtgaaagtgtcgacgttgcacttttatgaacagaaagggctgatcaccagttggcgcaatccaggcaatcaaagacgctatcatcgcagtgtgttacgtcgtattgcggtgatcaaagcggctcagcaggtcgggctgtcactagaagagattacccaagcgttagaagggctccctaagcatcaagcgccgacaaaagcgcagtgggaaaccatggcaacgggctggcatgcaatgctagagcatcggattttgcaactgaaagcgttgcagagcgatttgggtggttgcattggctgtggttgtttgtctcttgaaagctgcaatttacgcaatccccaagatgaaaaagcggctaatcatcagggggaatcgttactgacaaacccagaggatgaggattttaccgcgattgttagccagctataa

SEQ ID NO: 17785 - protein, 155 aa, Vibrio vulnificus
MDISVGEVAKRSGVKVSTLHFYEQKGLITSWRNPGNQRRYHRSVLRRIAVIKAAQQVGLSLEEITQALEGLPKHQAPTKAQWETMATGWHAMLEHRILQLKALQSDLGGCIGCGCLSLESCNLRNPQDEKAANHQGESLLTNPEDEDFTAIVSQL

SEQ ID NO: 17786 - DNA, 447 bp, Xanthomonas campestris
  CDS (1)..(447)
atgcagcgtgagttgtccgtgggggatgtggccaagcgcagtggcgtggcggtatcggcgttgcatttctacgagcgcaaggggttgatccgtagcctgcgcactgccggcaatcagcgccggtatgcgcgtgatgtgctgcggcggatcgcggtgatccgcgtggcgcagcggctcggcgtcccgttgcagcaggtgctggatgcgttctcggtgctgccggaccagcgcacacccacgcgcgcggaatgggcgcgcatgtcggcacgttggcgtggccagctggacgcacgcattgccgagctgcaggcgctgcgcgaccagctcaccgactgtatcggctgcggctgcctgtcgctgcggcgctgccgcctgagcaaccccggcgacactctggccgagagcggtgacggcgcagtgcgcctgtcgggcactgtcggcggctga

SEQ ID NO: 17787 - protein, 148 aa, Xanthomonas campestris
MQRELSVGDVAKRSGVAVSALHFYERKGLIRSLRTAGNQRRYARDVLRRIAVIRVAQRLGVPLQQVLDAFSVLPDQRTPTRAEWARMSARWRGQLDARIAELQALRDQLTDCIGCGCLSLRRCRLSNPGDTLAESGDGAVRLSGTVGG

SEQ ID NO: 17788 - DNA, 435 bp, Xanthomonas axonopodis
  CDS (1)..(435)
atgcaacgtgagttgtccgtgggcgaggtcgccaagcgcagtggtgtggcggtgtcggcgctgcacttctacgagcgcaaaggcttgatcagcagcctgcgcactgccggcaaccagcgccgttatgcgcgcgatgtgctacggcggatcgcggtgattcgcgtggcgcagcgactgggcgtgccgttgcagcaggtgctcgatgccttctccgtgttgccggatcaacgcacgccgacgcgtgcggagtgggcgcgcatgtcggcgcgctggcggggccagctggacgcgcgcatcaacgaactgcaggccttgcgcgaccagctcaccgactgcatcggctgcggctgcctgtcgctgcgtcgctgccgcctgagcaatccggacgatgccatgggccacagcggtgacggggcattgcggtttggggcctga

SEQ ID NO: 17789 - protein, 144 aa, Xanthomonas axonopodis
MQRELSVGEVAKRSGVAVSALHFYERKGLISSLRTAGNQRRYARDVLRRIAVIRVAQRLGVPLQQVLDAFSVLPDQRTPTRAEWARMSARWRGQLDARINELQALRDQLTDCIGCGCLSLRRCRLSNPDDAMGHSGDGALRFGA

SEQ ID NO: 17790 - DNA, 384 bp, Listeria grayi
  CDS (1)..(384)
atgattttgtttacaatcgggacgaccgctaaaaaaactggcatcagcattggcactctgcgcttttatgaagaaaaaggattggtaagccctagccgaaatgcgtcaaaacaacgtatctacacagaagaacaaatctccttacctacctttattcggtatctgaggcgatccggcatgcctatcaatactatccattattatctacaattagcggccaccggcccggaaacactttctgagcggcaagctattttacaaagacaaaaggcgaatatcctctctgaaatcgacgaaaaacagcatgaactagcggcaatcaatttcaaaatagctaaaaacgaaaagaaaagagcagcatttagactcgacaataatatttaa

SEQ ID NO: 17791 - protein, 127 aa, Listeria grayi
MILFTIGTTAKKTGISIGTLRFYEEKGLVSPSRNASKQRIYTEEQISLPTFIRYLRRSGMPINTIHYYLQLAATGPETLSERQAILQRQKANILSEIDEKQHELAAINFKIAKNEKKRAAFRLDNNI

SEQ ID NO: 17792 - DNA, 594 bp, Enterobacter aerogenes
  CDS (69)..(527)
ttctcgattcgtcgttttgtctgctggcgagtataattcctcaagttaacttgaggtaaagcgcttttatggaaaagaaaccaacccgtatcaaaatgctgctctcccctggggaagtggcgaaacgaaccggcgtcgccgtctcggcgctgcacttttatgaaagcaaagggcttatccgcagccagcgcaacgcgggcaatcagcggcgatatcgccgcgatgtgctgcgtgcggtcgctatcatcaagattgcgcaacgtattggtattccgctggcgaccatcggcgaggcattcggcgtcctgccggaagggcataatctgagcgccaaagagtggaaacagctgtcgtcgcaatggcgggaggagctggaccggcgtattcacaccctgaccgcgttgcgcgaccagctcgacggctgcatcggttgcggctgtttatcgcgccgcgattgtccgttacgcaaccctggagataagttgggtgaagaggggaccggcgcacgcctgctggaagaggattaatggtgatacctgcaaaaaactaaagcgccacaacagggcgctttagttgttttccgggtttgtcttt

SEQ ID NO: 17793 - protein, 152 aa, Enterobacter aerogenes
MEKKPTRIKMLLSPGEVAKRTGVAVSALHFYESKGLIRSQRNAGNQRRYRRDVLRAVAIIKIAQRIGIPLATIGEAFGVLPEGHNLSAKEWKQLSSQWREELDRRIHTLTALRDQLDGCIGCGCLSRRDCPLRNPGDKLGEEGTGARLLEED

SEQ ID NO: 17794 - DNA, 480 bp, Ralstonia solanacearum
  CDS (1)..(480)
atgacccgtgccgacctgaacgatgcatcgcaagacggccccgtcaacatcggcgaggcggccagggccagcggcgtgtcggccaagatgatccgctactacgagcgcatcggtctgctgccgcccagcccgcgcaccgagggcaactaccgggtctatgatccgcgcgcgctgcacgtgctgcggttcatccaccgggcgcgttcgctcgggttttcgctcgaagagattcgcacgctgctctcgctgtggcacgaccgcgcgcgcgccagcgccgacgtgaaggccatcacgctgcgccacgtggccgacctcgacgcgcgcatccgcgagctgcaaggcatgcgcgatacgctggtgacgctcgccgatgcctgccatggcgacgaccgcccggactgcccgatcctcgagggcgtggccggggaggcttcgccctgctgcgatgcagcgctgcccgatccggaccgacacggctga

SEQ ID NO: 17795 - protein, 159 aa, Ralstonia solanacearum
MTRADLNDASQDGPVNIGEAARASGVSAKMIRYYERIGLLPPSPRTEGNYRVYDPRALHVLRFIHRARSLGFSLEEIRTLLSLWHDRARASADVKAITLRHVADLDARIRELQGMRDTLVTLADACHGDDRPDCPILEGVAGEASPCCDAALPDPDRHG

SEQ ID NO: 17796 - DNA, 465 bp, Salmonella typhimurium
  CDS (1)..(465)
atgaacatcggtaaagcagctaaagcatcgaaagtctcggccaaaatgattcgctactatgaacagattggtctgattcccgcggcaagtcggacggattccggctatcgggcctatacccaggctgatgttaatcaattgcattttatacgccgcgcgcgcgacctcggtttttcagttgctgaaatcagcgacttactgaatctttggaataaccagtcgcggcaaagcgctgacgtcaaacgcctggcgcagacgcacattgatgaactggacagacgtatccagaacatgcagcacatggcgcaaaccctcaaagcgctgattcactgctgcgccggcgacgcgctgccagattgccccattctgcatacgcttggacaacctgacgatagcgagccggaggcgcgtaccggagcggtattgcgacgtcctcgtcgccacggactggcaaagcgtctgtaa

SEQ ID NO: 17797 - protein, 154 aa, Salmonella typhimurium
MNIGKAAKASKVSAKMIRYYEQIGLIPAASRTDSGYRAYTQADVNQLHFIRRARDLGFSVAEISDLLNLWNNQSRQSADVKRLAQTHIDELDRRIQNMQHMAQTLKALIHCCAGDALPDCPILHTLGQPDDSEPEARTGAVLRRPRRHGLAKRL

SEQ ID NO: 17798 - DNA, 486 bp, Rhizobium meliloti
  CDS (1)..(486)
atgaaaaaagacaagcccaatgatatcaagcgcgagctgacggtcggcgaagtggccgaacgcagcggcctcgcggtgtcgacgcttcatttctacgaggccaaggggctcatccgcagcaatcgcagccggggcaatcagcggcgctacccgcgttccgtgctgaggcgggtggccgtgatcaaggttgcccagcgtacgggtatcccgcttgccgagatccagtcggccctgtcggtgctccccgacgaccggccgctgacggtcgaagactggggacggctctcgaagacctggcggcagcagctcgatgagcggatcgcaaacctgacggcgctgcgcgatcagctcacaggctgcatcggctgcggttgcctgtcgatgcgcgactgtcccttgcgcaatccatgggacgttcttgcctccgaaggaacggggccgcgcctcatcgatcccgccgacgggacggagcatgaggcgagctaa

SEQ ID NO: 17799 - protein, 161 aa, Rhizobium meliloti
MKKDKPNDIKRELTVGEVAERSGLAVSTLHFYEAKGLIRSNRSRGNQRRYPRSVLRRVAVIKVAQRTGIPLAEIQSALSVLPDDRPLTVEDWGRLSKTWRQQLDERIANLTALRDQLTGCIGCGCLSMRDCPLRNPWDVLASEGTGPRLIDPADGTEHEAS

SEQ ID NO: 17800 - DNA, 456 bp, Thiobacillus ferrooxidans
  CDS (1)..(456)
atggaaaacaatttggagaatctgaccatcggcgttttcgccaaggcagccggggtcaacgtggagaccatccggttctatcagcgcaggggcttattgccggagccggacaagccctatggcagcatccgccgctatggcgaggtggatgtaacacgggtgcgctttgtgaaatcagcccagcggctgggcttcagcctagacgagattgccgagttgctgcggctggaggtaggtacccattgcgtggaagccagcagtctggccgagctcaagctccaggacgtgcgcgaaaagatggccgacctggcgcgcatggaggccgtgctgtccgggcttgtgtgtgcctgtcacgcccggaaggggaatgtttcctgcccgctgattgcgtcattgcaagacggaacgaacctcaccgtatcggtgcggggtgatcacgggttgactacgccttag

SEQ ID NO: 17801 - protein, 151 aa, Thiobacillus ferrooxidans
MENNLENLTIGVFAKAAGVNVETIRFYQRRGLLPEPDKPYGSIRRYGEVDVTRVRFVKSAQRLGFSLDEIAELLRLEVGTHCVEASSLAELKLQDVREKMADLARMEAVLSGLVCACHARKGNVSCPLIASLQDGTNLTVSVRGDHGLTTP

SEQ ID NO: 17802 - DNA, 480 bp, Amycolatopsis mediterranei
  CDS (1)..(480)
atggtgaacgccacggcccggccgctgcccgacctgacggtcggcgagctctcccggcgcagcggagtccccgcctcggctttgcgcttctacgaggacgaaggtctcatccacagccgtcgcaccgcgggaaaccagcggcgctaccgccgggacacgctgcggcgggtgacgttcatccggatgtcccagcgggtcggcatgccgctgtcgaagatccgggaagtgctcggcctgctgtccgacgaccgcacgcccacccgcaccgactgggcgcggatctcccgctgctggcaggacgacctgaacgcgcggatccgccagatggaacagctgcgcgaccagctggacgactgcatcggctgcggctgcatgtcgctggccaagtgccggctcgccaaccccggtgaccggctcggcaccgacggcccggggccgcggcgcctcgccgaccaccgcggggagggctacgaagactga

SEQ ID NO: 17803 - protein, 159 aa, Amycolatopsis mediterranei
MVNATARPLPDLTVGELSRRSGVPASALRFYEDEGLIHSRRTAGNQRRYRRDTLRRVTFIRMSQRVGMPLSKIREVLGLLSDDRTPTRTDWARISRCWQDDLNARIRQMEQLRDQLDDCIGCGCMSLAKCRLANPGDRLGTDGPGPRRLADHRGEGYED

SEQ ID NO: 17804 - DNA, 372 bp, Clostridium acetobutylicum
  CDS (1)..(372)
atgtactattcaataggcgaattctcaaaacttactggtataagcatatataccttgcgttattatgaaaaggaaaatttaattacatctaagcgcaaagaaaatggcaggcgattttacgatgaaaaagatttaaaatggatagaatttataaaaagattaaaaaacactaacatgccaataaaggaaattaagaaatatgctgttttgagatcccttggaaaaacaactcttgaagaacggtttgaaatgctaattgcccatagagaaaatcttaaaaaagaaataaattcgtatattgaaaatcttaaagaattagataataagattgattactatagagaagaaataaataaaaatattaatttataa

SEQ ID NO: 17805 - protein, 123 aa, Clostridium acetobutylicum
MYYSIGEFSKLTGISIYTLRYYEKENLITSKRKENGRRFYDEKDLKWIEFIKRLKNTNMPIKEIKKYAVLRSLGKTTLEERFEMLIAHRENLKKEINSYIENLKELDNKIDYYREEINKNINL

SEQ ID NO: 17806 - DNA, 447 bp, Rhizobium loti
  CDS (1)..(447)
atggctccagcaacggaattgacggtcggccaggtggccatgcgcagtggtgtcgcggtgtcggcactgcatttttatgagacgcgcgggctgatccgcagccaccgcacgtcaggcaaccagcggcgctacggccgcgacgtgctgcgacgggtggcaatcatcaaggtcgcgcaggaggtcggcatctcgctggccgagatcggcgaggcacttgcctccctgccggaaggccgaacgccgacgcgcgacgactggagcctgttgtcgaccgcctggcgcgacgcgctcgaccacaagatcacccagctgaagaaactgcgcgacgggctgaccgactgcatcggctgcggctgcatgacgatcgacaaatgcccgctcaggaacaagggcgaccggctggcaagggagggtacgggagcgaggcgactgttggtagaatcctaa

SEQ ID NO: 17807 - protein, 148 aa, Rhizobium loti
MAPATELTVGQVAMRSGVAVSALHFYETRGLIRSHRTSGNQRRYGRDVLRRVAIIKVAQEVGISLAEIGEALASLPEGRTPTRDDWSLLSTAWRDALDHKITQLKKLRDGLTDCIGCGCMTIDKCPLRNKGDRLAREGTGARRLLVES

SEQ ID NO: 17808 - DNA, 399 bp, Streptomyces coelicolor
  CDS (1)..(399)
atgtgtgccgcggatcacagcagggagcaggtcatgcggatcggggaagtggcgtcgcgggccggagtcagcgtccggtcggtgcgctactacgaggaccagggactgctggccagcacgcgcagcgccgggggccagcgccagtacacggagcacgaggtcgagcgggtccagttcctccagcggctgtacgccgcgggcctgtccagccggaccatcgccgaactgctgccctgcgtggacgcgcccagcgaggtccattccgacgcggcgctggagcgcatggcgcaggagcgggaccggctgaccgagcacatcgccgacctcgtccgcaccagggacgcgctcaatgccctgatgacggcggcccgcgagtaccgggacgcccagtttgcctaa

SEQ ID NO: 17809 - protein, 132 aa, Streptomyces coelicolor
MCAADHSREQVMRIGEVASRAGVSVRSVRYYEDQGLLASTRSAGGQRQYTEHEVERVQFLQRLYAAGLSSRTIAELLPCVDAPSEVHSDAALERMAQERDRLTEHIADLVRTRDALNALMTAAREYRDAQFA

SEQ ID NO: 17810 - DNA, 408 bp, Streptomyces coelicolor
  CDS (1)..(408)
atgtccgggcagtccctgagcatcggcgaggtggcggagcggaccggactgagcgtgcacgcgctgcgcttctacgagcgcgagggtctgctcgtcgggccggtccggcgcacgtcgggcggcagacggcggtacagctccttcgacgtcgactggctgctgatctgcgtcaagctccgtgaatcgggcatgccgctggccgacctcaagcagttcgccgcactggtgcgccagggaccgggcaacgaggcggagcgcctgcggttgctcgacacccatcaacggcgcgtcgacgcacagatcgaggcgctggaggagtgccggaccgtcatcgcctggaaggtcggtgtctacgccgagcacctcgcgcgcggcgaagccggtgggctctgggatccgacggcctga

SEQ ID NO: 17811 - protein, 135 aa, Streptomyces coelicolor
MSGQSLSIGEVAERTGLSVHALRFYEREGLLVGPVRRTSGGRRRYSSFDVDWLLICVKLRESGMPLADLKQFAALVRQGPGNEAERLRLLDTHQRRVDAQIEALEECRTVIAWKVGVYAEHLARGEAGGLWDPTA

SEQ ID NO: 17812 - DNA, 408 bp, Escherichia coli O6
  CDS (1)..(408)
atgaacattagcgatgtagcaaaaattaccggcctgaccagcaaagccattcgcttctatgaagagaaggggctggtgacgccgccgatgcgcagcgaaaacggttatcgcacctacacgcagcagcatctcaacgaactgaccttactgcgccaggcacgccaggtgggctttaacctggaagagagcggcgaactggtaaatctgtttaacgatccgcagcgtcacagcgccgacgtcaaacgtcgtacgctggagaaagtagcggagatcgaacagcatatcgaagaactgcaatccatgcgtaaccagctgctggcgctggcgaatgcctgccccggtgatgacagcgccgactgcccgattatcgaaaatctctccggctgctgtcatcatcgggcggggtga

SEQ ID NO: 17813 - protein, 135 aa, Escherichia coli O6
MNISDVAKITGLTSKAIRFYEEKGLVTPPMRSENGYRTYTQQHLNELTLLRQARQVGFNLEESGELVNLFNDPQRHSADVKRRTLEKVAEIEQHIEELQSMRNQLLALANACPGDDSADCPIIENLSGCCHHRAG

SEQ ID NO: 17814 - DNA, 447 bp, Chromobacterium violaceum
  CDS (1)..(447)
atggaagaaagcaccatcaccataggccgactggccaagcggaccggggtggcggccagcgccttgcgcttttacgaggcgcggggcctgatccacagtgtgggcgaggcgggcaagacccggcgctaccggcgcgacgcgatccgccgggtgtccttcatccgcgtcgcccaggcgatgggcatgagcctgcaggacatcggcgcggcgctggccgacctgccttcgcagcgcacgccgacggccgacgactgggcgcggatctcgcaggcctggaagccgctgctgcaggaacggatagacgcgctgtgccggctgcgcgaccagctggacagctgcataggctgcggctgcttgtcgctggagcgctgcaagctgtacaacccggacgacaaggcgggcgagcagggctgcggaccgcgttttctgctggatgaaaaagcctga

SEQ ID NO: 17815 - protein, 148 aa, Chromobacterium violaceum
MEESTITIGRLAKRTGVAASALRFYEARGLIHSVGEAGKTRRYRRDAIRRVSFIRVAQAMGMSLQDIGAALADLPSQRTPTADDWARISQAWKPLLQERIDALCRLRDQLDSCIGCGCLSLERCKLYNPDDKAGEQGCGPRFLLDEKA

SEQ ID NO: 17816 - DNA, 25 bp, Primer
atggaaaagaaattaccccgcatta

SEQ ID NO: 17817 - DNA, 25 bp, Primer
ttagttttgttcatcttccagcaag

SEQ ID NO: 17818 - DNA, 1581 bp, Saccharomyces cerevisiae; identical to SEQ ID NO: 17
  CDS (1)..(1581)

SEQ ID NO: 17819 - protein, 526 aa, Saccharomyces cerevisiae; identical to SEQ ID NO: 18

SEQ ID NO: 17820 - DNA, 1578 bp, Neurospora crassa; identical to SEQ ID NO: 19
  CDS (1)..(1578)

SEQ ID NO: 17821 - protein, 525 aa, Neurospora crassa; identical to SEQ ID NO: 20

SEQ ID NO: 17822 - DNA, 1491 bp, Brucella melitensis; identical to SEQ ID NO: 21
  CDS (1)..(1491)

SEQ ID NO: 17823 - protein, 496 aa, Brucella melitensis; identical to SEQ ID NO: 22

SEQ ID NO: 17824 - DNA, 1497 bp, Agrobacterium tumefaciens; identical to SEQ ID NO: 23
  CDS (1)..(1497)

SEQ ID NO: 17825 - protein, 498 aa, Agrobacterium tumefaciens; identical to SEQ ID NO: 24

SEQ ID NO: 17826 - DNA, 1545 bp, Caulobacter crescentus; identical to SEQ ID NO: 25
  CDS (1)..(1545)

SEQ ID NO: 17827 - protein, 514 aa, Caulobacter crescentus; identical to SEQ ID NO: 26

SEQ ID NO: 17828 - DNA, 1479 bp, Escherichia coli; identical to SEQ ID NO: 27
  CDS (1)..(1479)

SEQ ID NO: 17829 - protein, 492 aa, Escherichia coli; identical to SEQ ID NO: 28

SEQ ID NO: 17830 - DNA, 1476 bp, Halobacterium sp. NRC-1; identical to SEQ ID NO: 29
  CDS (1)..(1476)

SEQ ID NO: 17831 - protein, 491 aa, Halobacterium sp. NRC-1; identical to SEQ ID NO: 30

SEQ ID NO: 17832 - DNA, 1672 bp, Acetobacter aceti; identical to SEQ ID NO: 31
  CDS (61)..(1536)

SEQ ID NO: 17833 - protein, 491 aa, Acetobacter aceti; identical to SEQ ID NO: 32

SEQ ID NO: 17834 - DNA, 1566 bp, Schizosaccharomyces pombe; identical to SEQ ID NO: 33
  CDS (1)..(1566)

SEQ ID NO: 17835 - protein, 521 aa, Schizosaccharomyces pombe; identical to SEQ ID NO: 34

SEQ ID NO: 17836 - DNA, 1857 bp, Clostridium thermosaccharolyticum, Clostridium tartarivorum; identical to SEQ ID NO: 35
  CDS (1)..(1497)

SEQ ID NO: 17837 - protein, 498 aa, Clostridium thermosaccharolyticum, Clostridium tartarivorum; identical to SEQ ID NO: 36

SEQ ID NO: 17838 - DNA, 1494 bp, Pseudomonas aeruginosa; identical to SEQ ID NO: 37
  CDS (1)..(1494)

SEQ ID NO: 17839 - protein, 497 aa, Pseudomonas aeruginosa; identical to SEQ ID NO: 38

SEQ ID NO: 17840 - DNA, 1912 bp, Porphyromonas gingivalis; identical to SEQ ID NO: 39
  CDS (136)..(1431)

SEQ ID NO: 17841 - protein, 431 aa, Porphyromonas gingivalis; identical to SEQ ID NO: 40

SEQ ID NO: 17842 - DNA, 1497 bp, Porphyromonas gingivalis; identical to SEQ ID NO: 41
  CDS (1)..(1497)

SEQ ID NO: 17843 - protein, 498 aa, Porphyromonas gingivalis; identical to SEQ ID NO: 42

SEQ ID NO: 17844 - DNA, 1296 bp, Porphyromonas gingivalis; identical to SEQ ID NO: 43
  CDS (1)..(1296)

SEQ ID NO: 17845 - protein, 431 aa, Porphyromonas gingivalis; identical to SEQ ID NO: 44

SEQ ID NO: 17846 - DNA, 1317 bp, Mycoplasma gallisepticum; identical to SEQ ID NO: 45
  CDS (1)..(1317)

SEQ ID NO: 17847 - protein, 438 aa, Mycoplasma gallisepticum; identical to SEQ ID NO: 46

SEQ ID NO: 17848 - DNA, 1578 bp, Neurospora crassa; identical to SEQ ID NO: 47
  CDS (1)..(1578)

SEQ ID NO: 17849 - protein, 525 aa, Neurospora crassa; identical to SEQ ID NO: 48

SEQ ID NO: 17850 - DNA, 1533 bp, Bordetella pertussis; identical to SEQ ID NO: 49
  CDS (1)..(1533)

SEQ ID NO: 17851 - protein, 510 aa, Bordetella pertussis; identical to SEQ ID NO: 50

SEQ ID NO: 17852 - DNA, 1515 bp, Bacillus cereus; identical to SEQ ID NO: 51
  CDS (1)..(1515)

SEQ ID NO: 17853 - protein, 504 aa, Bacillus cereus; identical to SEQ ID NO: 52

SEQ ID NO: 17854 - DNA, 1515 bp, Bacillus anthracis; identical to SEQ ID NO: 53
  CDS (1)..(1515)

SEQ ID NO: 17855 - protein, 504 aa, Bacillus anthracis; identical to SEQ ID NO: 54

SEQ ID NO: 17856 - DNA, 1494 bp, Pseudomonas syringae; identical to SEQ ID NO: 55
  CDS (1)..(1494)

SEQ ID NO: 17857 - protein, 497 aa, Pseudomonas syringae; identical to SEQ ID NO: 56

SEQ ID NO: 17858 - DNA, 1494 bp, Pseudomonas putida; identical to SEQ ID NO: 57
  CDS (1)..(1494)

SEQ ID NO: 17859 - protein, 497 aa, Pseudomonas putida; identical to SEQ ID NO: 58

SEQ ID NO: 17860 - DNA, 1314 bp, Clostridium tetani; identical to SEQ ID NO: 59
  CDS (1)..(1314)

SEQ ID NO: 17861 - protein, 437 aa, Clostridium tetani; identical to SEQ ID NO: 60

SEQ ID NO: 17862 - DNA, 1500 bp, Bacteroides thetaiotaomicron; identical to SEQ ID NO: 61
  CDS (1)..(1500)

SEQ ID NO: 17863 - protein, 499 aa, Bacteroides thetaiotaomicron; identical to SEQ ID NO: 62

SEQ ID NO: 17864 - DNA, 1287 bp, Shewanella oneidensis; identical to SEQ ID NO: 63
  CDS (1)..(1287)

SEQ ID NO: 17865 - protein, 428 aa, Shewanella oneidensis; identical to SEQ ID NO: 64

SEQ ID NO: 17866 - DNA, 1515 bp, Oceanobacillus iheyensis; identical to SEQ ID NO: 65
  CDS (1)..(1515)

SEQ ID NO: 17867 - protein, 504 aa, Oceanobacillus iheyensis; identical to SEQ ID NO: 66

SEQ ID NO: 17868 - DNA, 1524 bp, Corynebacterium efficiens; identical to SEQ ID NO: 67
  CDS (1)..(1524)

SEQ ID NO: 17869 - protein, 507 aa, Corynebacterium efficiens; identical to SEQ ID NO: 68

SEQ ID NO: 17870 - DNA, 1509 bp, Corynebacterium efficiens; identical to SEQ ID NO: 69
  CDS (1)..(1509)

SEQ ID NO: 17871 - protein, 502 aa, Corynebacterium efficiens; identical to SEQ ID NO: 70

SEQ ID NO: 17872 - DNA, 1515 bp, Xanthomonas campestris; identical to SEQ ID NO: 71
  CDS (1)..(1515)

SEQ ID NO: 17873 - protein, 504 aa, Xanthomonas campestris; identical to SEQ ID NO: 72

SEQ ID NO: 17874 - DNA, 1617 bp, Clostridium kluyveri; identical to SEQ ID NO: 73
  CDS (1)..(1617)

SEQ ID NO: 17875 - protein, 538 aa, Clostridium kluyveri; identical to SEQ ID NO: 74

SEQ ID NO: 17876 - DNA, 1563 bp, Geobacter sulfurreducens; identical to SEQ ID NO: 75
  CDS (1)..(1563)

SEQ ID NO: 17877 - protein, 520 aa, Geobacter sulfurreducens; identical to SEQ ID NO: 76

SEQ ID NO: 17878 - DNA, 1596 bp, Geobacter sulfurreducens; identical to SEQ ID NO: 77
  CDS (1)..(1596)

SEQ ID NO: 17879 - protein, 531 aa, Geobacter sulfurreducens; identical to SEQ ID NO: 78

SEQ ID NO: 17880 - DNA, 1515 bp, Bacillus cereus; identical to SEQ ID NO: 79
  CDS (1)..(1515)

SEQ ID NO: 17881 - protein, 504 aa, Bacillus cereus; identical to SEQ ID NO: 80

SEQ ID NO: 17882 - DNA, 1971 bp, Ashbya gossypii; identical to SEQ ID NO: 4398
  CDS (1)..(1971)

SEQ ID NO: 17883 - protein, 656 aa, Ashbya gossypii; identical to SEQ ID NO: 4399

SEQ ID NO: 17884 - DNA, 1290 bp, Leptospira interrogans; identical to SEQ ID NO: 4400
  CDS (1)..(1290)

SEQ ID NO: 17885 - protein, 429 aa, Leptospira interrogans; identical to SEQ ID NO: 4401

SEQ ID NO: 17886 - DNA, 1335 bp, Thermus thermophilus; identical to SEQ ID NO: 4402
  CDS (1)..(1335)

SEQ ID NO: 17887 - protein, 444 aa, Thermus thermophilus; identical to SEQ ID NO: 4403

SEQ ID NO: 17888 - DNA, 1560 bp, Rhodopseudomonas palustris; identical to SEQ ID NO: 4404
  CDS (1)..(1560)

SEQ ID NO: 17889 - protein, 519 aa, Rhodopseudomonas palustris; identical to SEQ ID NO: 4405

SEQ ID NO: 17890 - DNA, 1554 bp, Corynebacterium diphtheriae; identical to SEQ ID NO: 4406
  CDS (1)..(1554)

SEQ ID NO: 17891 - protein, 517 aa, Corynebacterium diphtheriae; identical to SEQ ID NO: 4407

SEQ ID NO: 17892 - DNA, 1488 bp, Bdellovibrio bacteriovorus; identical to SEQ ID NO: 4408
  CDS (1)..(1488)

SEQ ID NO: 17893 - protein, 495 aa, Bdellovibrio bacteriovorus; identical to SEQ ID NO: 4409

SEQ ID NO: 17894 - DNA, 1509 bp, Corynebacterium glutamicum; identical to SEQ ID NO: 4410
  CDS (1)..(1509)

SEQ ID NO: 17895 - protein, 502 aa, Corynebacterium glutamicum; identical to SEQ ID NO: 4411

SEQ ID NO: 17896 - DNA, 27 bp, Primer
atgacaatttctaatttgttaaagcag

SEQ ID NO: 17897 - DNA, 23 bp, Primer
ctagtcaactggttcccagctgt

SEQ ID NO: 17898 - DNA, 1062 bp, Saccharomyces cerevisiae; identical to SEQ ID NO: 12100
  CDS (1)..(1062)

SEQ ID NO: 17899 - protein, 353 aa, Saccharomyces cerevisiae; identical to SEQ ID NO: 12101

SEQ ID NO: 17900 - DNA, 813 bp, Arabidopsis thaliana (mouse-ear cress); identical to SEQ ID NO: 12102
  CDS (1)..(813)

SEQ ID NO: 17901 - protein, 270 aa, Arabidopsis thaliana (mouse-ear cress); identical to SEQ ID NO: 12103

SEQ ID NO: 17902 - DNA, 642 bp, Brucella melitensis; identical to SEQ ID NO: 12104
  CDS (1)..(642)

SEQ ID NO: 17903 - protein, 213 aa, Brucella melitensis; identical to SEQ ID NO: 12105

SEQ ID NO: 17904 - DNA, 708 bp, Schizosaccharomyces pombe; identical to SEQ ID NO: 12106
  CDS (1)..(708)

SEQ ID NO: 17905 - protein, 235 aa, Schizosaccharomyces pombe; identical to SEQ ID NO: 12107

SEQ ID NO: 17906 - DNA, 738 bp, Streptomyces avermitilis; identical to SEQ ID NO: 12108
  CDS (1)..(738)

SEQ ID NO: 17907 - protein, 245 aa, Streptomyces avermitilis; identical to SEQ ID NO: 12109

SEQ ID NO: 17908 - DNA, 735 bp, Neurospora crassa; identical to SEQ ID NO: 12110
  CDS (1)..(735)

SEQ ID NO: 17909 - protein, 244 aa, Neurospora crassa; identical to SEQ ID NO: 12111

SEQ ID NO: 17910 - DNA, 735 bp, Vibrio parahaemolyticus; identical to SEQ ID NO: 12112
  CDS (1)..(735)

SEQ ID NO: 17911 - protein, 244 aa, Vibrio parahaemolyticus; identical to SEQ ID NO: 12113

SEQ ID NO: 17912 - DNA, 699 bp, Brucella suis; identical to SEQ ID NO: 12114
  CDS (1)..(699)

SEQ ID NO: 17913 - protein, 232 aa, Brucella suis; identical to SEQ ID NO: 12115

SEQ ID NO: 17914 - DNA, 621 bp, Rhizobium meliloti; identical to SEQ ID NO: 12116
  CDS (1)..(621)

SEQ ID NO: 17915 - protein, 206 aa, Rhizobium meliloti; identical to SEQ ID NO: 12117

SEQ ID NO: 17916 - DNA, 1005 bp, Ashbya gossypii; identical to SEQ ID NO: 12118
  CDS (1)..(1005)

SEQ ID NO: 17917 - protein, 334 aa, Ashbya gossypii; identical to SEQ ID NO: 12119

SEQ ID NO: 17918 - DNA, 24 bp, Primer
atggtcgatacgcataaactagca

SEQ ID NO: 17919 - DNA, 23 bp, Primer
ctagtcgttgcggatatggacga

SEQ ID NO: 17920 - DNA, 642 bp, Saccharomyces cerevisiae; identical to SEQ ID NO: 993
  CDS (1)..(642)

SEQ ID NO: 17921 - protein, 213 aa, Saccharomyces cerevisiae; identical to SEQ ID NO: 994

SEQ ID NO: 17922 - DNA, 543 bp, Caenorhabditis elegans; identical to SEQ ID NO: 995
  CDS (1)..(543)

SEQ ID NO: 17923 - protein, 180 aa, Caenorhabditis elegans; identical to SEQ ID NO: 996

SEQ ID NO: 17924 - DNA, 552 bp, Schizosaccharomyces pombe; identical to SEQ ID NO: 997
  CDS (1)..(552)

SEQ ID NO: 17925 - protein, 183 aa, Schizosaccharomyces pombe; identical to SEQ ID NO: 998

SEQ ID NO: 17926 - DNA, 822 bp, Neurospora crassa; identical to SEQ ID NO: 999
  CDS (1)..(822)

SEQ ID NO: 17927 - protein, 273 aa, Neurospora crassa; identical to SEQ ID NO: 1000

SEQ ID NO: 17928 - DNA, 636 bp, Oryza sativa (Rice); identical to SEQ ID NO: 1001
  CDS (1)..(636)

SEQ ID NO: 17929 - protein, 211 aa, Oryza sativa (Rice); identical to SEQ ID NO: 1002

SEQ ID NO: 17930 - DNA, 831 bp, Oryza sativa (Rice); identical to SEQ ID NO: 1003
  CDS (1)..(831)

SEQ ID NO: 17931 - protein, 276 aa, Oryza sativa (Rice); identical to SEQ ID NO: 1004

SEQ ID NO: 17932 - DNA, 633 bp, Arabidopsis thaliana (Mouse-ear cress); identical to SEQ ID NO: 1005
  CDS (1)..(633)

SEQ ID NO: 17933 - protein, 210 aa, Arabidopsis thaliana (Mouse-ear cress); identical to SEQ ID NO: 1006

SEQ ID NO: 17934 - DNA, 573 bp, Brugia malayi (Filarial nematode worm); identical to SEQ ID NO: 1007
  CDS (1)..(573)

SEQ ID NO: 17935 - protein, 190 aa, Brugia malayi (Filarial nematode worm); identical to SEQ ID NO: 1008

SEQ ID NO: 17936 - DNA, 612 bp, Drosophila melanogaster (Fruit fly); identical to SEQ ID NO: 1009
  CDS (1)..(612)

SEQ ID NO: 17937 - protein, 203 aa, Drosophila melanogaster (Fruit fly); identical to SEQ ID NO: 1010

SEQ ID NO: 17938 - DNA, 528 bp, Encephalitozoon cuniculi; identical to SEQ ID NO: 1011
  CDS (1)..(528)

SEQ ID NO: 17939 - protein, 175 aa, Encephalitozoon cuniculi; identical to SEQ ID NO: 1012

SEQ ID NO: 17940 - DNA, 558 bp, Homo sapiens (Human); identical to SEQ ID NO: 1013
  CDS (1)..(558)

SEQ ID NO: 17941 - protein, 185 aa, Homo sapiens (Human); identical to SEQ ID NO: 1014

SEQ ID NO: 17942 - DNA, 558 bp, Mus musculus (Mouse); identical to SEQ ID NO: 1015
  CDS (1)..(558)

SEQ ID NO: 17943 - protein, 185 aa, Mus musculus (Mouse); identical to SEQ ID NO: 1016

SEQ ID NO: 17944 - DNA, 558 bp, Xenopus laevis (African clawed frog); identical to SEQ ID NO: 1017
  CDS (1)..(558)

SEQ ID NO: 17945 - protein, 185 aa, Xenopus laevis (African clawed frog); identical to SEQ ID NO: 1018

SEQ ID NO: 17946 - DNA, 23 bp, Primer
atgtcactaccggcacatttgca

SEQ ID NO: 17947 - DNA, 29 bp, Primer
ttaaatattgaattcttcttcatcatttt

SEQ ID NO: 17948 - DNA, 2217 bp, Saccharomyces cerevisiae; identical to SEQ ID NO: 14798
  CDS (422)..(1714)

SEQ ID NO: 17949 - protein, 430 aa, Saccharomyces cerevisiae; identical to SEQ ID NO: 14799

SEQ ID NO: 17950 - DNA, 1287 bp, Lactobacillus casei; identical to SEQ ID NO: 14800
  CDS (1)..(1287)

SEQ ID NO: 17951 - protein, 428 aa, Lactobacillus casei; identical to SEQ ID NO: 14801

SEQ ID NO: 17952 - DNA, 1254 bp, Nostoc sp. PCC 7120; identical to SEQ ID NO: 14802
  CDS (1)..(1254)

SEQ ID NO: 17953 - protein, 417 aa, Nostoc sp. PCC 7120; identical to SEQ ID NO: 14803

SEQ ID NO: 17954 - DNA, 1290 bp, Listeria innocua; identical to SEQ ID NO: 14804
  CDS (1)..(1290)

SEQ ID NO: 17955 - protein, 429 aa, Listeria innocua; identical to SEQ ID NO: 14805

SEQ ID NO: 17956 - DNA, 1800 bp, Bacillus subtilis; identical to SEQ ID NO: 14806
  CDS (231)..(1523)

SEQ ID NO: 17957 - protein, 430 aa, Bacillus subtilis; identical to SEQ ID NO: 14807

SEQ ID NO: 17958 - DNA, 1275 bp, Neisseria meningitidis; identical to SEQ ID NO: 14808
  CDS (1)..(1275)

SEQ ID NO: 17959 - protein, 424 aa, Neisseria meningitidis; identical to SEQ ID NO: 14809

SEQ ID NO: 17960 - DNA, 1323 bp, Streptococcus pneumoniae; identical to SEQ ID NO: 14810
  CDS (1)..(1323)

SEQ ID NO: 17961 - protein, 440 aa, Streptococcus pneumoniae; identical to SEQ ID NO: 14811

SEQ ID NO: 17962 - DNA, 1293 bp, Thermotoga maritima; identical to SEQ ID NO: 14812
  CDS (1)..(1293)

SEQ ID NO: 17963 - protein, 430 aa, Thermotoga maritima; identical to SEQ ID NO: 14813

SEQ ID NO: 17964 - DNA, 1272 bp, Staphylococcus aureus; identical to SEQ ID NO: 14814
  CDS (1)..(1272)

SEQ ID NO: 17965 - protein, 423 aa, Staphylococcus aureus; identical to SEQ ID NO: 14815

SEQ ID NO: 17966 - DNA, 1293 bp, Bacillus halodurans; identical to SEQ ID NO: 14816
  CDS (1)..(1293)

SEQ ID NO: 17967 - protein, 430 aa, Bacillus halodurans; identical to SEQ ID NO: 14817

SEQ ID NO: 17968 - DNA, 1284 bp, Lactococcus lactis subsp. lactis; identical to SEQ ID NO: 14818
  CDS (1)..(1284)

SEQ ID NO: 17969 - protein, 427 aa, Lactococcus lactis subsp. lactis; identical to SEQ ID NO: 14819

SEQ ID NO: 17970 - DNA, 1464 bp, Mycobacterium tuberculosis; identical to SEQ ID NO: 14820
  CDS (1)..(1464)

SEQ ID NO: 17971 - protein, 487 aa, Mycobacterium tuberculosis; identical to SEQ ID NO: 14821

SEQ ID NO: 17972 - DNA, 1296 bp, Clostridium acetobutylicum; identical to SEQ ID NO: 14822
  CDS (1)..(1296)

SEQ ID NO: 17973 - protein, 431 aa, Clostridium acetobutylicum; identical to SEQ ID NO: 14823

SEQ ID NO: 17974 - DNA, 1302 bp, Rickettsia prowazekii; identical to SEQ ID NO: 14824
  CDS (1)..(1302)

SEQ ID NO: 17975 - protein, 433 aa, Rickettsia prowazekii; identical to SEQ ID NO: 14825

SEQ ID NO: 17976 - DNA, 1458 bp, Mycobacterium leprae; identical to SEQ ID NO: 14826
  CDS (1)..(1458)

SEQ ID NO: 17977 - protein, 485 aa, Mycobacterium leprae; identical to SEQ ID NO: 14827

SEQ ID NO: 17978 - DNA, 1284 bp, Saccharomyces cerevisiae; identical to SEQ ID NO: 14828
  CDS (1)..(1284)

SEQ ID NO: 17979 - protein, 427 aa, Saccharomyces cerevisiae; identical to SEQ ID NO: 14829

SEQ ID NO: 17980 - DNA, 1287 bp, Synechocystis sp; identical to SEQ ID NO: 14830
  CDS (1)..(1287)

SEQ ID NO: 17981 - protein, 428 aa, Synechocystis sp; identical to SEQ ID NO: 14831

SEQ ID NO: 17982 - DNA, 1254 bp, Schizosaccharomyces pombe; identical to SEQ ID NO: 14832
  CDS (1)..(1254)

SEQ ID NO: 17983 - protein, 417 aa, Schizosaccharomyces pombe; identical to SEQ ID NO: 14833

SEQ ID NO: 17984 - DNA, 1341 bp, Candida glabrata; identical to SEQ ID NO: 14834
  CDS (1)..(1341)

SEQ ID NO: 17985 - protein, 446 aa, Candida glabrata; identical to SEQ ID NO: 14835

SEQ ID NO: 17986 - DNA, 1320 bp, Bartonella quintana str; identical to SEQ ID NO: 14836
  CDS (1)..(1320)

SEQ ID NO: 17987 - protein, 439 aa, Bartonella quintana str; identical to SEQ ID NO: 14837

SEQ ID NO: 17988 - DNA, 1320 bp, Bartonella henselae; identical to SEQ ID NO: 14838
  CDS (1)..(1320)

SEQ ID NO: 17989 - protein, 439 aa, Bartonella henselae; identical to SEQ ID NO: 14839

SEQ ID NO: 17990 - DNA, 1302 bp, Bacillus anthracis str; identical to SEQ ID NO: 14840
  CDS (1)..(1302)

SEQ ID NO: 17991 - protein, 433 aa, Bacillus anthracis str; identical to SEQ ID NO: 14841

SEQ ID NO: 17992 - DNA, 1308 bp, Picrophilus torridus DSM 9790; identical to SEQ ID NO: 14842
  CDS (1)..(1308)

SEQ ID NO: 17993 - protein, 435 aa, Picrophilus torridus DSM 9790; identical to SEQ ID NO: 14843

SEQ ID NO: 17994 - DNA, 1329 bp, Rhodopseudomonas palustris; identical to SEQ ID NO: 14844
  CDS (1)..(1329)

SEQ ID NO: 17995 - protein, 442 aa, Rhodopseudomonas palustris; identical to SEQ ID NO: 14845

SEQ ID NO: 17996 - DNA, 1317 bp, Onion yellows phytoplasma; identical to SEQ ID NO: 14846
  CDS (1)..(1317)

SEQ ID NO: 17997 - protein, 438 aa, Onion yellows phytoplasma; identical to SEQ ID NO: 14847

SEQ ID NO: 17998 - DNA, 1290 bp, Listeria monocytogenes str; identical to SEQ ID NO: 14848
  CDS (1)..(1290)

SEQ ID NO: 17999 - protein, 429 aa, Listeria monocytogenes str; identical to SEQ ID NO: 14849

SEQ ID NO: 18000 - DNA, 1290 bp, Wolbachia pipientis wMel; identical to SEQ ID NO: 14850
  CDS (1)..(1290)

SEQ ID NO: 18001 - protein, 429 aa, Wolbachia pipientis wMel; identical to SEQ ID NO: 14851

SEQ ID NO: 18002 - DNA, 1458 bp, Mycobacterium paratuberculosis; identical to SEQ ID NO: 14852
  CDS (1)..(1458)

SEQ ID NO: 18003 - protein, 485 aa, Mycobacterium paratuberculosis; identical to SEQ ID NO: 14853

SEQ ID NO: 18004 - DNA, 1146 bp, Geobacter sulfurreducens; identical to SEQ ID NO: 14854
  CDS (1)..(1146)

SEQ ID NO: 18005 - protein, 381 aa, Geobacter sulfurreducens; identical to SEQ ID NO: 14855

SEQ ID NO: 18006 - DNA, 1221 bp, Ashbya gossypii; identical to SEQ ID NO: 14856
  CDS (1)..(1221)

SEQ ID NO: 18007 - protein, 406 aa, Ashbya gossypii; identical to SEQ ID NO: 14857

SEQ ID NO: 18008 - DNA, 1242 bp, Gloeobacter violaceus PCC 7421; identical to SEQ ID NO: 14858
  CDS (1)..(1242)

SEQ ID NO: 18009 - protein, 413 aa, Gloeobacter violaceus PCC 7421; identical to SEQ ID NO: 14859

SEQ ID NO: 18010 - DNA, 1248 bp, Fusobacterium nucleatum subsp; identical to SEQ ID NO: 14860
  CDS (1)..(1248)

SEQ ID NO: 18011 - protein, 415 aa, Fusobacterium nucleatum subsp; identical to SEQ ID NO: 14861

SEQ ID NO: 18012 - DNA, 1281 bp, Rickettsia sibirica; identical to SEQ ID NO: 14862
  CDS (1)..(1281)

SEQ ID NO: 18013 - protein, 426 aa, Rickettsia sibirica; identical to SEQ ID NO: 14863

SEQ ID NO: 18014 - DNA, 1476 bp, Plasmodium yoelii yoelii; identical to SEQ ID NO: 14864
  CDS (1)..(1476)

SEQ ID NO: 18015 - protein, 491 aa, Plasmodium yoelii yoelii; identical to SEQ ID NO: 14865

SEQ ID NO: 18016 - DNA, 1224 bp, Synechococcus sp; identical to SEQ ID NO: 14866
  CDS (1)..(1224)

SEQ ID NO: 18017 - protein, 407 aa, Synechococcus sp; identical to SEQ ID NO: 14867

SEQ ID NO: 18018 - DNA, 1233 bp, Prochlorococcus marinus subsp; identical to SEQ ID NO: 14868
  CDS (1)..(1233)

SEQ ID NO: 18019 - protein, 410 aa, Prochlorococcus marinus subsp; identical to SEQ ID NO: 14869

SEQ ID NO: 18020 - DNA, 1242 bp, Prochlorococcus marinus; identical to SEQ ID NO: 14870
  CDS (1)..(1242)

SEQ ID NO: 18021 - protein, 413 aa, Prochlorococcus marinus; identical to SEQ ID NO: 14871

SEQ ID NO: 18022 - DNA, 1632 bp, Rhodopirellula baltica; identical to SEQ ID NO: 14872
  CDS (1)..(1632)

SEQ ID NO: 18023 - protein, 543 aa, Rhodopirellula baltica; identical to SEQ ID NO: 14873

SEQ ID NO: 18024 - DNA, 1236 bp, Prochlorococcus marinus subsp; identical to SEQ ID NO: 14874
  CDS (1)..(1236)

SEQ ID NO: 18025 - protein, 411 aa, Prochlorococcus marinus subsp; identical to SEQ ID NO: 14875

SEQ ID NO: 18026 - DNA, 1362 bp, Streptomyces avermitilis; identical to SEQ ID NO: 14876
  CDS (1)..(1362)

SEQ ID NO: 18027 - protein, 453 aa, Streptomyces avermitilis; identical to SEQ ID NO: 14877

SEQ ID NO: 18028 - DNA, 1362 bp, Enterococcus faecalis V583; identical to SEQ ID NO: 14878
  CDS (40)..(1362)

SEQ ID NO: 18029 - protein, 440 aa, Enterococcus faecalis V583; identical to SEQ ID NO: 14879

SEQ ID NO: 18030 - DNA, 1386 bp, Tropheryma whipplei; identical to SEQ ID NO: 14880
  CDS (1)..(1386)

SEQ ID NO: 18031 - protein, 461 aa, Tropheryma whipplei; identical to SEQ ID NO: 14881

SEQ ID NO: 18032 - DNA, 1362 bp, Tropheryma whipplei; identical to SEQ ID NO: 14882
  CDS (1)..(1362)

SEQ ID NO: 18033 - protein, 453 aa, Tropheryma whipplei; identical to SEQ ID NO: 14883

SEQ ID NO: 18034 - DNA, 1326 bp, Methylobacterium extorquens; identical to SEQ ID NO: 14884
  CDS (1)..(1326)

SEQ ID NO: 18035 - protein, 441 aa, Methylobacterium extorquens; identical to SEQ ID NO: 14885

SEQ ID NO: 18036 - DNA, 1365 bp, Lactobacillus plantarum WCFS1; identical to SEQ ID NO: 14886
  CDS (1)..(1365)

SEQ ID NO: 18037 - protein, 454 aa, Lactobacillus plantarum WCFS1; identical to SEQ ID NO: 14887

SEQ ID NO: 18038 - DNA, 1335 bp, Lactobacillus plantarum WCFS1; identical to SEQ ID NO: 14888
  CDS (1)..(1335)

SEQ ID NO: 18039 - protein, 444 aa, Lactobacillus plantarum WCFS1; identical to SEQ ID NO: 14889

SEQ ID NO: 18040 - DNA, 1296 bp, Clostridium tetani; identical to SEQ ID NO: 14890
  CDS (1)..(1296)

SEQ ID NO: 18041 - protein, 431 aa, Clostridium tetani; identical to SEQ ID NO: 14891

SEQ ID NO: 18042 - DNA, 1344 bp, Bradyrhizobium japonicum USDA 110; identical to SEQ ID NO: 14892
  CDS (1)..(1344)

SEQ ID NO: 18043 - protein, 447 aa, Bradyrhizobium japonicum USDA 110; identical to SEQ ID NO: 14893

SEQ ID NO: 18044 - DNA, 1266 bp, Staphylococcus epidermidis ATCC 12228; identical to SEQ ID NO: 14894
  CDS (1)..(1266)

SEQ ID NO: 18045 - protein, 421 aa, Staphylococcus epidermidis ATCC 12228; identical to SEQ ID NO: 14895

SEQ ID NO: 18046 - DNA, 1287 bp, Wigglesworthia glossinidia brevipalpis; identical to SEQ ID NO: 14896
  CDS (1)..(1287)

SEQ ID NO: 18047 - protein, 428 aa, Wigglesworthia glossinidia brevipalpis; identical to SEQ ID NO: 14897

SEQ ID NO: 18048 - DNA, 1275 bp, Thermosynechococcus elongatus BP; identical to SEQ ID NO: 14898
  CDS (1)..(1275)

SEQ ID NO: 18049 - protein, 424 aa, Thermosynechococcus elongatus BP; identical to SEQ ID NO: 14899

SEQ ID NO: 18050 - DNA, 1278 bp, Streptococcus mutans; identical to SEQ ID NO: 14900
  CDS (1)..(1278)

SEQ ID NO: 18051 - protein, 425 aa, Streptococcus mutans; identical to SEQ ID NO: 14901

SEQ ID NO: 18052 - DNA, 1257 bp, Streptococcus mutans UA159; identical to SEQ ID NO: 14902
  CDS (1)..(1257)

SEQ ID NO: 18053 - protein, 418 aa, Streptococcus mutans UA159; identical to SEQ ID NO: 14903

SEQ ID NO: 18054 - DNA, 1281 bp, Oceanobacillus iheyensis; identical to SEQ ID NO: 14904
  CDS (1)..(1281)

SEQ ID NO: 18055 - protein, 426 aa, Oceanobacillus iheyensis; identical to SEQ ID NO: 14905

SEQ ID NO: 18056 - DNA, 1521 bp, Corynebacterium efficiens YS; identical to SEQ ID NO: 14906
  CDS (1)..(1521)

SEQ ID NO: 18057 - protein, 506 aa, Corynebacterium efficiens YS; identical to SEQ ID NO: 14907

SEQ ID NO: 18058 - DNA, 1590 bp, Bifidobacterium longum; identical to SEQ ID NO: 14908
  CDS (1)..(1590)

SEQ ID NO: 18059 - protein, 529 aa, Bifidobacterium longum; identical to SEQ ID NO: 14909

SEQ ID NO: 18060 - DNA, 1284 bp, Lactococcus lactis; identical to SEQ ID NO: 14910
  CDS (1)..(1284)

SEQ ID NO: 18061 - protein, 427 aa, Lactococcus lactis; identical to SEQ ID NO: 14911

SEQ ID NO: 18062 - DNA, 1278 bp, Streptococcus pyogenes; identical to SEQ ID NO: 14912
  CDS (1)..(1278)

SEQ ID NO: 18063 - protein, 425 aa, Streptococcus pyogenes; identical to SEQ ID NO: 14913

SEQ ID NO: 18064 - DNA, 1377 bp, Corynebacterium glutamicum ATCC 13032; identical to SEQ ID NO: 14914
  CDS (1)..(1377)

SEQ ID NO: 18065 - protein, 458 aa, Corynebacterium glutamicum ATCC 13032; identical to SEQ ID NO: 14915

SEQ ID NO: 18066 - DNA, 1269 bp, Streptococcus pyogenes; identical to SEQ ID NO: 14916
  CDS (1)..(1269)

SEQ ID NO: 18067 - protein, 422 aa, Streptococcus pyogenes; identical to SEQ ID NO: 14917

SEQ ID NO: 18068 - DNA, 1296 bp, Thermoanaerobacter tengcongensis; identical to SEQ ID NO: 14918
  CDS (1)..(1296)

SEQ ID NO: 18069 - protein, 431 aa, Thermoanaerobacter tengcongensis; identical to SEQ ID NO: 14919

SEQ ID NO: 18070 - DNA, 1323 bp, Clostridium perfringens str; identical to SEQ ID NO: 14920
  CDS (1)..(1323)

SEQ ID NO: 18071 - protein, 440 aa, Clostridium perfringens str; identical to SEQ ID NO: 14921

SEQ ID NO: 18072 - DNA, 1266 bp, Streptococcus pyogenes; identical to SEQ ID NO: 14922
  CDS (1)..(1266)

SEQ ID NO: 18073 - protein, 421 aa, Streptococcus pyogenes; identical to SEQ ID NO: 14923

SEQ ID NO: 18074 - DNA, 1224 bp, Thermoplasma volcanium; identical to SEQ ID NO: 14924
  CDS (1)..(1224)

SEQ ID NO: 18075 - protein, 407 aa, Thermoplasma volcanium; identical to SEQ ID NO: 14925

SEQ ID NO: 18076 - DNA, 1257 bp, Streptococcus suis; identical to SEQ ID NO: 14926
  CDS (1)..(1257)

SEQ ID NO: 18077 - protein, 418 aa, Streptococcus suis; identical to SEQ ID NO: 14927

SEQ ID NO: 18078 - DNA, 1257 bp, Streptococcus suis; identical to SEQ ID NO: 14928
  CDS (1)..(1257)

SEQ ID NO: 18079 - protein, 418 aa, Streptococcus suis; identical to SEQ ID NO: 14929

SEQ ID NO: 18080 - DNA, 1239 bp, Neurospora crassa; identical to SEQ ID NO: 14930
  CDS (1)..(1239)

SEQ ID NO: 18081 - protein, 412 aa, Neurospora crassa; identical to SEQ ID NO: 14931

SEQ ID NO: 18082 - DNA, 1275 bp, Thermoplasma acidophilum; identical to SEQ ID NO: 14932
  CDS (1)..(1275)

SEQ ID NO: 18083 - protein, 424 aa, Thermoplasma acidophilum; identical to SEQ ID NO: 14933

SEQ ID NO: 18084 - DNA, 1569 bp, Plasmodium falciparum; identical to SEQ ID NO: 14934
  CDS (1)..(1569)

SEQ ID NO: 18085 - protein, 522 aa, Plasmodium falciparum; identical to SEQ ID NO: 14935

SEQ ID NO: 18086 - DNA, 25 bp, Primer
atggatgatataagcggaaggcaaa

SEQ ID NO: 18087 - DNA, 24 bp, Primer
ctatactggcaagtgacagttgtg

SEQ ID NO: 18088 - DNA, 474 bp, Saccharomyces cerevisiae; identical to SEQ ID NO: 13281
  CDS (1)..(474)

SEQ ID NO: 18089 - protein, 157 aa, Saccharomyces cerevisiae; identical to SEQ ID NO: 13282

SEQ ID NO: 18090 - DNA, 25 bp, Primer
atgatagaggcgttggaaatagttc

SEQ ID NO: 18091 - DNA, 26 bp, Primer
ttatatcgatcctgcgatataataac

SEQ ID NO: 18092 - DNA, 2244 bp, Saccharomyces cerevisiae; identical to SEQ ID NO: 3574
  CDS (1)..(2244)

SEQ ID NO: 18093 - protein, 747 aa, Saccharomyces cerevisiae; identical to SEQ ID NO: 3575

SEQ ID NO: 18094 - DNA, 1866 bp, Clostridium acetobutylicum; identical to SEQ ID NO: 3576
  CDS (1)..(1866)

SEQ ID NO: 18095 - protein, 621 aa, Clostridium acetobutylicum; identical to SEQ ID NO: 3577

SEQ ID NO: 18096 - DNA, 1842 bp, Nostoc sp. PCC 7120; identical to SEQ ID NO: 3578
  CDS (1)..(1842)

SEQ ID NO: 18097 - protein, 613 aa, Nostoc sp. PCC 7120; identical to SEQ ID NO: 3579

SEQ ID NO: 18098 - DNA, 1947 bp, Agrobacterium tumefaciens; identical to SEQ ID NO: 3580
  CDS (1)..(1947)

SEQ ID NO: 18099 - protein, 648 aa, Agrobacterium tumefaciens; identical to SEQ ID NO: 3581

SEQ ID NO: 18100 - DNA, 1887 bp, Nostoc sp. PCC 7120; identical to SEQ ID NO: 3582
  CDS (1)..(1887)

SEQ ID NO: 18101 - protein, 628 aa, Nostoc sp. PCC 7120; identical to SEQ ID NO: 3583

SEQ ID NO: 18102 - DNA, 2073 bp, Listeria innocua; identical to SEQ ID NO: 3584
  CDS (1)..(2073)

SEQ ID NO: 18103 - protein, 690 aa, Listeria innocua; identical to SEQ ID NO: 3585

SEQ ID NO: 18104 - DNA, 1971 bp, Nostoc sp. PCC 7120; identical to SEQ ID NO: 3586
  CDS (1)..(1971)

SEQ ID NO: 18105 - protein, 656 aa, Nostoc sp. PCC 7120; identical to SEQ ID NO: 3587

SEQ ID NO: 18106 - DNA, 1938 bp, Nostoc sp. PCC 7120; identical to SEQ ID NO: 3588
  CDS (1)..(1938)

SEQ ID NO: 18107 - protein, 645 aa, Nostoc sp. PCC 7120; identical to SEQ ID NO: 3589

SEQ ID NO: 18108 - DNA, 1905 bp, Aquifex aeolicus; identical to SEQ ID NO: 3590
  CDS (1)..(1905)

SEQ ID NO: 18109 - protein, 634 aa, Aquifex aeolicus; identical to SEQ ID NO: 3591

SEQ ID NO: 18110 - DNA, 2283 bp, Mycobacterium tuberculosis; identical to SEQ ID NO: 3592
  CDS (1)..(2283)

SEQ ID NO: 18111 - protein, 760 aa, Mycobacterium tuberculosis; identical to SEQ ID NO: 3593

SEQ ID NO: 18112 - DNA, 1914 bp, Rickettsia prowazekii; identical to SEQ ID NO: 3594
  CDS (1)..(1914)

SEQ ID NO: 18113 - protein, 637 aa, Rickettsia prowazekii; identical to SEQ ID NO: 3595

SEQ ID NO: 18114 - DNA, 2178 bp, Mycoplasma pulmonis; identical to SEQ ID NO: 3596
  CDS (1)..(2178)

SEQ ID NO: 18115 - protein, 725 aa, Mycoplasma pulmonis; identical to SEQ ID NO: 3597

SEQ ID NO: 18116 - DNA, 1920 bp, Borrelia burgdorferi (Lyme disease spirochete); identical to SEQ ID NO: 3598
  CDS (1)..(1920)

SEQ ID NO: 18117 - protein, 639 aa, Borrelia burgdorferi (Lyme disease spirochete); identical to SEQ ID NO: 3599

SEQ ID NO: 18118 - DNA, 1968 bp, Deinococcus radiodurans; identical to SEQ ID NO: 3600
  CDS (1)..(1968)

SEQ ID NO: 18119 - protein, 655 aa, Deinococcus radiodurans; identical to SEQ ID NO: 3601

SEQ ID NO: 18120 - DNA, 1857 bp, Deinococcus radiodurans; identical to SEQ ID NO: 3602
  CDS (1)..(1857)

SEQ ID NO: 18121 - protein, 618 aa, Deinococcus radiodurans; identical to SEQ ID NO: 3603

SEQ ID NO: 18122 - DNA, 1914 bp, Bacillus subtilis; identical to SEQ ID NO: 3604
  CDS (1)..(1914)

SEQ ID NO: 18123 - protein, 637 aa, Bacillus subtilis; identical to SEQ ID NO: 3605

SEQ ID NO: 18124 - DNA, 1833 bp, Thermotoga maritima; identical to SEQ ID NO: 3606
  CDS (1)..(1833)

SEQ ID NO: 18125 - protein, 610 aa, Thermotoga maritima; identical to SEQ ID NO: 3607

SEQ ID NO: 18126 - DNA, 1968 bp, Neisseria meningitidis; identical to SEQ ID NO: 3608
  CDS (1)..(1968)

SEQ ID NO: 18127 - protein, 655 aa, Neisseria meningitidis; identical to SEQ ID NO: 3609

SEQ ID NO: 18128 - DNA, 1956 bp, Vibrio cholerae; identical to SEQ ID NO: 3610
  CDS (1)..(1956)

SEQ ID NO: 18129 - protein, 651 aa, Vibrio cholerae; identical to SEQ ID NO: 3611

SEQ ID NO: 18130 - DNA, 1974 bp, Bacillus halodurans; identical to SEQ ID NO: 3612
  CDS (1)..(1974)

SEQ ID NO: 18131 - protein, 657 aa, Bacillus halodurans; identical to SEQ ID NO: 3613

SEQ ID NO: 18132 - DNA, 1959 bp, Streptococcus pneumoniae; identical to SEQ ID NO: 3614
  CDS (1)..(1959)

SEQ ID NO: 18133 - protein, 652 aa, Streptococcus pneumoniae; identical to SEQ ID NO: 3615

SEQ ID NO: 18134 - DNA, 1920 bp, Pseudomonas aeruginosa; identical to SEQ ID NO: 3616
  CDS (1)..(1920)

SEQ ID NO: 18135 - protein, 639 aa, Pseudomonas aeruginosa; identical to SEQ ID NO: 3617

SEQ ID NO: 18136 - DNA, 2088 bp, Arabidopsis thaliana (mouse-ear cress); identical to SEQ ID NO: 3618
  CDS (1)..(2088)

SEQ ID NO: 18137 - protein, 695 aa, Arabidopsis thaliana (mouse-ear cress); identical to SEQ ID NO: 3619

SEQ ID NO: 18138 - DNA, 1968 bp, Deinococcus radiodurans; identical to SEQ ID NO: 3620
  CDS (1)..(1968)

SEQ ID NO: 18139 - protein, 655 aa, Deinococcus radiodurans; identical to SEQ ID NO: 3621

SEQ ID NO: 18140 - DNA, 2151 bp, Arabidopsis thaliana (mouse-ear cress); identical to SEQ ID NO: 3622
  CDS (1)..(2151)

SEQ ID NO: 18141 - protein, 716 aa, Arabidopsis thaliana (mouse-ear cress); identical to SEQ ID NO: 3623

SEQ ID NO: 18142 - DNA, 1809 bp, Clostridium acetobutylicum; identical to SEQ ID NO: 3624
  CDS (1)..(1809)

SEQ ID NO: 18143 - protein, 602 aa, Clostridium acetobutylicum; identical to SEQ ID NO: 3625

SEQ ID NO: 18144 - DNA, 1830 bp, Treponema pallidum subsp. pallidum (syphilis spirochete); identical to SEQ ID NO: 3626
  CDS (1)..(1830)

SEQ ID NO: 18145 - protein, 609 aa, Treponema pallidum subsp. pallidum (syphilis spirochete); identical to SEQ ID NO: 3627

SEQ ID NO: 18146 - DNA, 1881 bp, Caulobacter crescentus; identical to SEQ ID NO: 3628
  CDS (1)..(1881)

SEQ ID NO: 18147 - protein, 626 aa, Caulobacter crescentus; identical to SEQ ID NO: 3629

SEQ ID NO: 18148 - DNA, 2094 bp, Staphylococcus aureus; identical to SEQ ID NO: 3630
  CDS (1)..(2094)

SEQ ID NO: 18149 - protein, 697 aa, Staphylococcus aureus; identical to SEQ ID NO: 3631

SEQ ID NO: 18150 - DNA, 1935 bp, Escherichia coli; identical to SEQ ID NO: 3632
  CDS (1)..(1935)

SEQ ID NO: 18151 - protein, 644 aa, Escherichia coli; identical to SEQ ID NO: 3633

SEQ ID NO: 18152 - DNA, 1989 bp, Schistosoma mansoni; identical to SEQ ID NO: 3634
  CDS (1)..(1989)

SEQ ID NO: 18153 - protein, 662 aa, Schistosoma mansoni; identical to SEQ ID NO: 3635

SEQ ID NO: 18154 - DNA, 2478 bp, Saccharomyces cerevisiae; identical to SEQ ID NO: 3636
  CDS (1)..(2478)

SEQ ID NO: 18155 - protein, 825 aa, Saccharomyces cerevisiae; identical to SEQ ID NO: 3637

SEQ ID NO: 18156 - DNA, 1887 bp, chloroplast Porphyra purpurea; identical to SEQ ID NO: 3638
  CDS (1)..(1887)

SEQ ID NO: 18157 - protein, 628 aa, chloroplast Porphyra purpurea; identical to SEQ ID NO: 3639

SEQ ID NO: 18158 - DNA, 1851 bp, Synechocystis sp.; identical to SEQ ID NO: 3640
  CDS (1)..(1851)

SEQ ID NO: 18159 - protein, 616 aa, Synechocystis sp.; identical to SEQ ID NO: 3641

SEQ ID NO: 18160 - DNA, 1998 bp, Synechocystis sp.; identical to SEQ ID NO: 3642
  CDS (1)..(1998)

SEQ ID NO: 18161 - protein, 665 aa, Synechocystis sp.; identical to SEQ ID NO: 3643

SEQ ID NO: 18162 - DNA, 1884 bp, Synechocystis sp.; identical to SEQ ID NO: 3644
  CDS (1)..(1884)

SEQ ID NO: 18163 - protein, 627 aa, Synechocystis sp.; identical to SEQ ID NO: 3645

SEQ ID NO: 18164 - DNA, 1887 bp, Synechocystis sp.; identical to SEQ ID NO: 3646
  CDS (1)..(1887)

SEQ ID NO: 18165 - protein, 628 aa, Synechocystis sp.; identical to SEQ ID NO: 3647

SEQ ID NO: 18166 - DNA, 1884 bp, Arabidopsis thaliana (mouse-ear cress); identical to SEQ ID NO: 3648
  CDS (1)..(1884)

SEQ ID NO: 18167 - protein, 627 aa, Arabidopsis thaliana (mouse-ear cress); identical to SEQ ID NO: 3649

SEQ ID NO: 18168 - DNA, 2031 bp, Caenorhabditis elegans; identical to SEQ ID NO: 3650
  CDS (1)..(2031)

SEQ ID NO: 18169 - protein, 676 aa, Caenorhabditis elegans; identical to SEQ ID NO: 3651

SEQ ID NO: 18170 - DNA, 1806 bp, Heliobacillus mobilis; identical to SEQ ID NO: 3652
  CDS (1)..(1806)

SEQ ID NO: 18171 - protein, 601 aa, Heliobacillus mobilis; identical to SEQ ID NO: 3653

SEQ ID NO: 18172 - DNA, 1947 bp, Streptomyces coelicolor; identical to SEQ ID NO: 3654
  CDS (1)..(1947)

SEQ ID NO: 18173 - protein, 648 aa, Streptomyces coelicolor; identical to SEQ ID NO: 3655

SEQ ID NO: 18174 - DNA, 2007 bp, Streptomyces coelicolor; identical to SEQ ID NO: 3656
  CDS (1)..(2007)

SEQ ID NO: 18175 - protein, 668 aa, Streptomyces coelicolor; identical to SEQ ID NO: 3657

SEQ ID NO: 18176 - DNA, 2130 bp, Schizosaccharomyces pombe; identical to SEQ ID NO: 3658
  CDS (1)..(2130)

SEQ ID NO: 18177 - protein, 709 aa, Schizosaccharomyces pombe; identical to SEQ ID NO: 3659

SEQ ID NO: 18178 - DNA, 2064 bp, Arabidopsis thaliana (mouse-ear cress); identical to SEQ ID NO: 3660
  CDS (1)..(2064)

SEQ ID NO: 18179 - protein, 687 aa, Arabidopsis thaliana (mouse-ear cress); identical to SEQ ID NO: 3661

SEQ ID NO: 18180 - DNA, 2310 bp, Mycobacterium smegmatis; identical to SEQ ID NO: 3662
  CDS (1)..(2310): n means a or g or c or t/u

SEQ ID NO: 18181 - protein, 769 aa, Mycobacterium smegmatis; identical to SEQ ID NO: 3663
  misc_feature (660)..(660): Xaa can be Asp or Glu

SEQ ID NO: 18182 - DNA, 2154 bp, Arabidopsis thaliana (Mouse-ear cress); identical to SEQ ID NO: 3664
  CDS (1)..(2154)

SEQ ID NO: 18183 - protein, 717 aa, Arabidopsis thaliana (Mouse-ear cress); identical to SEQ ID NO: 3665

SEQ ID NO: 18184 - DNA, 1947 bp, Wolinella succinogenes; identical to SEQ ID NO: 3666
  CDS (1)..(1947)

SEQ ID NO: 18185 - protein, 648 aa, Wolinella succinogenes; identical to SEQ ID NO: 3667

SEQ ID NO: 18186 - DNA, 2022 bp, Porphyromonas gingivalis (Bacteroides gingivalis); identical to SEQ ID NO: 3668
  CDS (1)..(2022)

SEQ ID NO: 18187 - protein, 673 aa, Porphyromonas gingivalis (Bacteroides gingivalis); identical to SEQ ID NO: 3669

SEQ ID NO: 18188 - DNA, 1881 bp, Gloeobacter violaceus; identical to SEQ ID NO: 3670
  CDS (1)..(1881)

SEQ ID NO: 18189 - protein, 626 aa, Gloeobacter violaceus; identical to SEQ ID NO: 3671

SEQ ID NO: 18190 - DNA, 1893 bp, Gloeobacter violaceus; identical to SEQ ID NO: 3672
  CDS (1)..(1893)

SEQ ID NO: 18191 - protein, 630 aa, Gloeobacter violaceus; identical to SEQ ID NO: 3673

SEQ ID NO: 18192 - DNA, 1836 bp, Gloeobacter violaceus; identical to SEQ ID NO: 3674
  CDS (1)..(1836)

SEQ ID NO: 18193 - protein, 611 aa, Gloeobacter violaceus; identical to SEQ ID NO: 3675

SEQ ID NO: 18194 - DNA, 1920 bp, Chromobacterium violaceum; identical to SEQ ID NO: 3676
  CDS (1)..(1920)

SEQ ID NO: 18195 - protein, 639 aa, Chromobacterium violaceum; identical to SEQ ID NO: 3677

SEQ ID NO: 18196 - DNA, 2022 bp, Fusobacterium nucleatum subsp. vincentii ATCC 49256; identical to SEQ ID NO: 3678
  CDS (1)..(2022)

SEQ ID NO: 18197 - protein, 673 aa, Fusobacterium nucleatum subsp. vincentii ATCC 49256; identical to SEQ ID NO: 3679

SEQ ID NO: 18198 - DNA, 1914 bp, Rickettsia sibirica; identical to SEQ ID NO: 3680
  CDS (1)..(1914)

SEQ ID NO: 18199 - protein, 637 aa, Rickettsia sibirica; identical to SEQ ID NO: 3681

SEQ ID NO: 18200 - DNA, 2604 bp, Plasmodium yoelii yoelii; identical to SEQ ID NO: 3682
  CDS (1)..(2604)

SEQ ID NO: 18201 - protein, 867 aa, Plasmodium yoelii yoelii; identical to SEQ ID NO: 3683

SEQ ID NO: 18202 - DNA, 2112 bp, Plasmodium yoelii yoelii; identical to SEQ ID NO: 3684
  CDS (1)..(2112)

SEQ ID NO: 18203 - protein, 703 aa, Plasmodium yoelii yoelii; identical to SEQ ID NO: 3685

SEQ ID NO: 18204 - DNA, 1875 bp, Synechococcus sp. (strain WH8102); identical to SEQ ID NO: 3686
  CDS (1)..(1875)

SEQ ID NO: 18205 - protein, 624 aa, Synechococcus sp. (strain WH8102); identical to SEQ ID NO: 3687

SEQ ID NO: 18206 - DNA, 1914 bp, Synechococcus sp. (strain WH8102); identical to SEQ ID NO: 3688
  CDS (1)..(1914)

SEQ ID NO: 18207 - protein, 637 aa, Synechococcus sp. (strain WH8102); identical to SEQ ID NO: 3689

SEQ ID NO: 18208 - DNA, 1848 bp, Synechococcus sp. (strain WH8102); identical to SEQ ID NO: 3690
  CDS (1)..(1848)

SEQ ID NO: 18209 - protein, 615 aa, Synechococcus sp. (strain WH8102); identical to SEQ ID NO: 3691

SEQ ID NO: 18210 - DNA, 2187 bp, Rhodopirellula baltica; identical to SEQ ID NO: 3692
  CDS (1)..(2187)

SEQ ID NO: 18211 - protein, 728 aa, Rhodopirellula baltica; identical to SEQ ID NO: 3693

SEQ ID NO: 18212 - DNA, 2019 bp, Rhodopirellula baltica; identical to SEQ ID NO: 3694
  CDS (1)..(2019)

SEQ ID NO: 18213 - protein, 672 aa, Rhodopirellula baltica; identical to SEQ ID NO: 3695

SEQ ID NO: 18214 - DNA, 1914 bp, Prochlorococcus marinus subsp. pastoris (strain CCMP 1378 / MED4); identical to SEQ ID NO: 3696
  CDS (1)..(1914)

SEQ ID NO: 18215 - protein, 637 aa, Prochlorococcus marinus subsp. pastoris (strain CCMP 1378 / MED4); identical to SEQ ID NO: 3697

SEQ ID NO: 18216 - DNA, 1857 bp, Prochlorococcus marinus subsp. pastoris (strain CCMP 1378 / MED4); identical to SEQ ID NO: 3698
  CDS (1)..(1857)

SEQ ID NO: 18217 - protein, 618 aa, Prochlorococcus marinus subsp. pastoris (strain CCMP 1378 / MED4); identical to SEQ ID NO: 3699

SEQ ID NO: 18218 - DNA, 1848 bp, Prochlorococcus marinus (strain MIT 9313); identical to SEQ ID NO: 3700
  CDS (1)..(1848)

SEQ ID NO: 18219 - protein, 615 aa, Prochlorococcus marinus (strain MIT 9313); identical to SEQ ID NO: 3701

SEQ ID NO: 18220 - DNA, 1917 bp, Prochlorococcus marinus (strain MIT 9313); identical to SEQ ID NO: 3702
  CDS (1)..(1917)

SEQ ID NO: 18221 - protein, 638 aa, Prochlorococcus marinus (strain MIT 9313); identical to SEQ ID NO: 3703

SEQ ID NO: 18222 - DNA, 1878 bp, Prochlorococcus marinus (strain MIT 9313); identical to SEQ ID NO: 3704
  CDS (1)..(1878)

SEQ ID NO: 18223 - protein, 625 aa, Prochlorococcus marinus (strain MIT 9313); identical to SEQ ID NO: 3705

SEQ ID NO: 18224 - DNA, 1917 bp, Prochlorococcus marinus; identical to SEQ ID NO: 3706
  CDS (1)..(1917)

SEQ ID NO: 18225 - protein, 638 aa, Prochlorococcus marinus; identical to SEQ ID NO: 3707

SEQ ID NO: 18226 - DNA, 1800 bp, Prochlorococcus marinus; identical to SEQ ID NO: 3708
  CDS (1)..(1800)

SEQ ID NO: 18227 - protein, 599 aa, Prochlorococcus marinus; identical to SEQ ID NO: 3709

SEQ ID NO: 18228 - DNA, 1836 bp, Helicobacter hepaticus; identical to SEQ ID NO: 3710
  CDS (1)..(1836)

SEQ ID NO: 18229 - protein, 611 aa, Helicobacter hepaticus; identical to SEQ ID NO: 3711

SEQ ID NO: 18230 - DNA, 1935 bp, Candidatus Blochmannia floridanus; identical to SEQ ID NO: 3712
  CDS (1)..(1935)

SEQ ID NO: 18231 - protein, 644 aa, Candidatus Blochmannia floridanus; identical to SEQ ID NO: 3713

SEQ ID NO: 18232 - DNA, 1887 bp, Bordetella parapertussis; identical to SEQ ID NO: 3714
  CDS (1)..(1887)

SEQ ID NO: 18233 - protein, 628 aa, Bordetella parapertussis; identical to SEQ ID NO: 3715

SEQ ID NO: 18234 - DNA, 1902 bp, Bacillus cereus (strain ATCC 14579 / DSM 31); identical to SEQ ID NO: 3716
  CDS (1)..(1902)

SEQ ID NO: 18235 - protein, 633 aa, Bacillus cereus (strain ATCC 14579 / DSM 31); identical to SEQ ID NO: 3717

SEQ ID NO: 18236 - DNA, 1932 bp, Nitrosomonas europaea; identical to SEQ ID NO: 3718
  CDS (1)..(1932)

SEQ ID NO: 18237 - protein, 643 aa, Nitrosomonas europaea; identical to SEQ ID NO: 3719

SEQ ID NO: 18238 - DNA, 1995 bp, Streptomyces avermitilis; identical to SEQ ID NO: 3720
  CDS (1)..(1995)

SEQ ID NO: 18239 - protein, 664 aa, Streptomyces avermitilis; identical to SEQ ID NO: 3721

SEQ ID NO: 18240 - DNA, 1860 bp, Nitrosomonas europaea; identical to SEQ ID NO: 3722
  CDS (1)..(1860)

SEQ ID NO: 18241 - protein, 619 aa, Nitrosomonas europaea; identical to SEQ ID NO: 3723

SEQ ID NO: 18242 - DNA, 2157 bp, Enterococcus faecalis (Streptococcus faecalis); identical to SEQ ID NO: 3724
  CDS (1)..(2157)

SEQ ID NO: 18243 - protein, 718 aa, Enterococcus faecalis (Streptococcus faecalis); identical to SEQ ID NO: 3725

SEQ ID NO: 18244 - DNA, 1944 bp, Coxiella burnetii; identical to SEQ ID NO: 3726
  CDS (1)..(1944)

SEQ ID NO: 18245 - protein, 647 aa, Coxiella burnetii; identical to SEQ ID NO: 3727

SEQ ID NO: 18246 - DNA, 2001 bp, Tropheryma whipplei (strain TW08/27) (Whipple's bacillus); identical to SEQ ID NO: 3728
  CDS (1)..(2001)

SEQ ID NO: 18247 - protein, 666 aa, Tropheryma whipplei (strain TW08/27) (Whipple's bacillus); identical to SEQ ID NO: 3729

SEQ ID NO: 18248 - DNA, 2145 bp, Lycopersicon esculentum (Tomato); identical to SEQ ID NO: 3730
  CDS (1)..(2145)

SEQ ID NO: 18249 - protein, 714 aa, Lycopersicon esculentum (Tomato); identical to SEQ ID NO: 3731

SEQ ID NO: 18250 - DNA, 1938 bp, Xylella fastidiosa (strain Temecula1 / ATCC 700964); identical to SEQ ID NO: 3732
  CDS (1)..(1938)

SEQ ID NO: 18251 - protein, 645 aa, Xylella fastidiosa (strain Temecula1 / ATCC 700964); identical to SEQ ID NO: 3733

SEQ ID NO: 18252 - DNA, 1989 bp, Vibrio parahaemolyticus; identical to SEQ ID NO: 3734
  CDS (1)..(1989)

SEQ ID NO: 18253 - protein, 662 aa, Vibrio parahaemolyticus; identical to SEQ ID NO: 3735

SEQ ID NO: 18254 - DNA, 1905 bp, Pseudomonas syringae (pv. tomato); identical to SEQ ID NO: 3736
  CDS (1)..(1905)

SEQ ID NO: 18255 - protein, 634 aa, Pseudomonas syringae (pv. tomato); identical to SEQ ID NO: 3737

SEQ ID NO: 18256 - DNA, 1914 bp, Pseudomonas putida (strain KT2440); identical to SEQ ID NO: 3738
  CDS (1)..(1914)

SEQ ID NO: 18257 - protein, 637 aa, Pseudomonas putida (strain KT2440); identical to SEQ ID NO: 3739

SEQ ID NO: 18258 - DNA, 2238 bp, Lactobacillus plantarum; identical to SEQ ID NO: 3740
  CDS (1)..(2238)

SEQ ID NO: 18259 - protein, 745 aa, Lactobacillus plantarum; identical to SEQ ID NO: 3741

SEQ ID NO: 18260 - DNA, 1875 bp, Clostridium tetani; identical to SEQ ID NO: 3742
  CDS (1)..(1875)

SEQ ID NO: 18261 - protein, 624 aa, Clostridium tetani; identical to SEQ ID NO: 3743

SEQ ID NO: 18262 - DNA, 1812 bp, Clostridium tetani; identical to SEQ ID NO: 3744
  CDS (1)..(1812)

SEQ ID NO: 18263 - protein, 603 aa, Clostridium tetani; identical to SEQ ID NO: 3745

SEQ ID NO: 18264 - DNA, 2091 bp, Bacteroides thetaiotaomicron; identical to SEQ ID NO: 3746
  CDS (1)..(2091)

SEQ ID NO: 18265 - protein, 696 aa, Bacteroides thetaiotaomicron; identical to SEQ ID NO: 3747

SEQ ID NO: 18266 - DNA, 2103 bp, Staphylococcus epidermidis; identical to SEQ ID NO: 3748
  CDS (1)..(2103)

SEQ ID NO: 18267 - protein, 700 aa, Staphylococcus epidermidis; identical to SEQ ID NO: 3749

SEQ ID NO: 18268 - DNA, 2028 bp, Oceanobacillus iheyensis; identical to SEQ ID NO: 3750
  CDS (1)..(2028)

SEQ ID NO: 18269 - protein, 675 aa, Oceanobacillus iheyensis; identical to SEQ ID NO: 3751

SEQ ID NO: 18270 - DNA, 1944 bp, Yersinia pestis; identical to SEQ ID NO: 3752
  CDS (1)..(1944)

SEQ ID NO: 18271 - protein, 647 aa, Yersinia pestis; identical to SEQ ID NO: 3753

SEQ ID NO: 18272 - DNA, 1917 bp, Wigglesworthia glossinidia brevipalpis; identical to SEQ ID NO: 3754
  CDS (1)..(1917)

SEQ ID NO: 18273 - protein, 638 aa, Wigglesworthia glossinidia brevipalpis; identical to SEQ ID NO: 3755

SEQ ID NO: 18274 - DNA, 1953 bp, Vibrio vulnificus; identical to SEQ ID NO: 3756
  CDS (1)..(1953)

SEQ ID NO: 18275 - protein, 650 aa, Vibrio vulnificus; identical to SEQ ID NO: 3757

SEQ ID NO: 18276 - DNA, 1896 bp, Synechococcus elongatus (Thermosynechococcus elongatus); identical to SEQ ID NO: 3758
  CDS (1)..(1896)

SEQ ID NO: 18277 - protein, 631 aa, Synechococcus elongatus (Thermosynechococcus elongatus); identical to SEQ ID NO: 3759

SEQ ID NO: 18278 - DNA, 1860 bp, Synechococcus elongatus (Thermosynechococcus elongatus); identical to SEQ ID NO: 3760
  CDS (1)..(1860)

SEQ ID NO: 18279 - protein, 619 aa, Synechococcus elongatus (Thermosynechococcus elongatus); identical to SEQ ID NO: 3761

SEQ ID NO: 18280 - DNA, 1971 bp, Streptococcus mutans; identical to SEQ ID NO: 3762
  CDS (1)..(1971)

SEQ ID NO: 18281 - protein, 656 aa, Streptococcus mutans; identical to SEQ ID NO: 3763

SEQ ID NO: 18282 - DNA, 1977 bp, Streptococcus agalactiae (serotype III); identical to SEQ ID NO: 3764
  CDS (1)..(1977)

SEQ ID NO: 18283 - protein, 658 aa, Streptococcus agalactiae (serotype III); identical to SEQ ID NO: 3765

SEQ ID NO: 18284 - DNA, 1935 bp, Brucella suis; identical to SEQ ID NO: 3766
  CDS (1)..(1935)

SEQ ID NO: 18285 - protein, 644 aa, Brucella suis; identical to SEQ ID NO: 3767

SEQ ID NO: 18286 - DNA, 2091 bp, Bifidobacterium longum; identical to SEQ ID NO: 3768
  CDS (1)..(2091)

SEQ ID NO: 18287 - protein, 696 aa, Bifidobacterium longum; identical to SEQ ID NO: 3769

SEQ ID NO: 18288 - DNA, 2643 bp, Plasmodium falciparum (isolate 3D7); identical to SEQ ID NO: 3770
  CDS (1)..(2643)

SEQ ID NO: 18289 - protein, 880 aa, Plasmodium falciparum (isolate 3D7); identical to SEQ ID NO: 3771

SEQ ID NO: 18290 - DNA, 2121 bp, Plasmodium falciparum (isolate 3D7); identical to SEQ ID NO: 3772
  CDS (1)..(2121)

SEQ ID NO: 18291 - protein, 706 aa, Plasmodium falciparum (isolate 3D7); identical to SEQ ID NO: 3773

SEQ ID NO: 18292 - DNA, 2409 bp, Mus musculus (Mouse); identical to SEQ ID NO: 3774
  CDS (1)..(2409)

SEQ ID NO: 18293 - protein, 802 aa, Mus musculus (Mouse); identical to SEQ ID NO: 3775

SEQ ID NO: 18294 - DNA, 1980 bp, Chlorobium tepidum; identical to SEQ ID NO: 3776
  CDS (1)..(1980)

SEQ ID NO: 18295 - protein, 659 aa, Chlorobium tepidum; identical to SEQ ID NO: 3777

SEQ ID NO: 18296 - DNA, 2121 bp, Chlorobium tepidum; identical to SEQ ID NO: 3778
  CDS (1)..(2121)

SEQ ID NO: 18297 - protein, 706 aa, Chlorobium tepidum; identical to SEQ ID NO: 3779

SEQ ID NO: 18298 - DNA, 2064 bp, Listeria monocytogenes; identical to SEQ ID NO: 3780
  CDS (1)..(2064)

SEQ ID NO: 18299 - protein, 687 aa, Listeria monocytogenes; identical to SEQ ID NO: 3781

SEQ ID NO: 18300 - DNA, 2148 bp, Oryza sativa (japonica cultivar-group); identical to SEQ ID NO: 3782
  CDS (1)..(2148)

SEQ ID NO: 18301 - protein, 715 aa, Oryza sativa (japonica cultivar-group); identical to SEQ ID NO: 3783

SEQ ID NO: 18302 - DNA, 2130 bp, Oryza sativa (japonica cultivar-group); identical to SEQ ID NO: 3784
  CDS (1)..(2130)

SEQ ID NO: 18303 - protein, 709 aa, Oryza sativa (japonica cultivar-group); identical to SEQ ID NO: 3785

SEQ ID NO: 18304 - DNA, 2211 bp, Drosophila melanogaster (Fruit fly); identical to SEQ ID NO: 3786
  CDS (1)..(2211)

SEQ ID NO: 18305 - protein, 736 aa, Drosophila melanogaster (Fruit fly); identical to SEQ ID NO: 3787

SEQ ID NO: 18306 - DNA, 1947 bp, Xanthomonas axonopodis (pv. citri); identical to SEQ ID NO: 3788
  CDS (1)..(1947)

SEQ ID NO: 18307 - protein, 648 aa, Xanthomonas axonopodis (pv. citri); identical to SEQ ID NO: 3789

SEQ ID NO: 18308 - DNA, 2145 bp, Fusobacterium nucleatum (subsp. nucleatum); identical to SEQ ID NO: 3790
  CDS (1)..(2145)

SEQ ID NO: 18309 - protein, 714 aa, Fusobacterium nucleatum (subsp. nucleatum); identical to SEQ ID NO: 3791

SEQ ID NO: 18310 - DNA, 1836 bp, Thermoanaerobacter tengcongensis; identical to SEQ ID NO: 3792
  CDS (1)..(1836)

SEQ ID NO: 18311 - protein, 611 aa, Thermoanaerobacter tengcongensis; identical to SEQ ID NO: 3793

SEQ ID NO: 18312 - DNA, 2058 bp, Arabidopsis thaliana (Mouse-ear cress); identical to SEQ ID NO: 3794
  CDS (1)..(2058)

SEQ ID NO: 18313 - protein, 685 aa, Arabidopsis thaliana (Mouse-ear cress); identical to SEQ ID NO: 3795

SEQ ID NO: 18314 - DNA, 1806 bp, Clostridium perfringens; identical to SEQ ID NO: 3796
  CDS (1)..(1806)

SEQ ID NO: 18315 - protein, 601 aa, Clostridium perfringens; identical to SEQ ID NO: 3797

SEQ ID NO: 18316 - DNA, 2154 bp, Clostridium perfringens; identical to SEQ ID NO: 3798
  CDS (1)..(2154)

SEQ ID NO: 18317 - protein, 717 aa, Clostridium perfringens; identical to SEQ ID NO: 3799

SEQ ID NO: 18318 - DNA, 1887 bp, Ralstonia solanacearum (Pseudomonas solanacearum); identical to SEQ ID NO: 3800
  CDS (1)..(1887)

SEQ ID NO: 18319 - protein, 628 aa, Ralstonia solanacearum (Pseudomonas solanacearum); identical to SEQ ID NO: 3801

SEQ ID NO: 18320 - DNA, 1938 bp, Rhizobium meliloti (Sinorhizobium meliloti); identical to SEQ ID NO: 3802
  CDS (1)..(1938)

SEQ ID NO: 18321 - protein, 645 aa, Rhizobium meliloti (Sinorhizobium meliloti); identical to SEQ ID NO: 3803

SEQ ID NO: 18322 - DNA, 1929 bp, Rhizobium loti (Mesorhizobium loti); identical to SEQ ID NO: 3804
  CDS (1)..(1929)

SEQ ID NO: 18323 - protein, 642 aa, Rhizobium loti (Mesorhizobium loti); identical to SEQ ID NO: 3805

SEQ ID NO: 18324 - DNA, 1980 bp, Streptococcus pyogenes; identical to SEQ ID NO: 3806
  CDS (1)..(1980)

SEQ ID NO: 18325 - protein, 659 aa, Streptococcus pyogenes; identical to SEQ ID NO: 3807

SEQ ID NO: 18326 - DNA, 1920 bp, Pasteurella multocida; identical to SEQ ID NO: 3808
  CDS (1)..(1920)

SEQ ID NO: 18327 - protein, 639 aa, Pasteurella multocida; identical to SEQ ID NO: 3809

SEQ ID NO: 18328 - DNA, 2421 bp, Arabidopsis thaliana (Mouse-ear cress); identical to SEQ ID NO: 3810
  CDS (1)..(2421)

SEQ ID NO: 18329 - protein, 806 aa, Arabidopsis thaliana (Mouse-ear cress); identical to SEQ ID NO: 3811

SEQ ID NO: 18330 - DNA, 2217 bp, Neurospora crassa; identical to SEQ ID NO: 3812
  CDS (1)..(2217)

SEQ ID NO: 18331 - protein, 738 aa, Neurospora crassa; identical to SEQ ID NO: 3813

SEQ ID NO: 18332 - DNA, 2322 bp, Schizosaccharomyces pombe (Fission yeast); identical to SEQ ID NO: 3814
  CDS (1)..(2322)

SEQ ID NO: 18333 - protein, 773 aa, Schizosaccharomyces pombe (Fission yeast); identical to SEQ ID NO: 3815

SEQ ID NO: 18334 - DNA, 1875 bp, Thermus thermophilus; identical to SEQ ID NO: 3816
  CDS (1)..(1875)

SEQ ID NO: 18335 - protein, 624 aa, Thermus thermophilus; identical to SEQ ID NO: 3817

SEQ ID NO: 18336 - DNA, 2151 bp, Homo sapiens (Human); identical to SEQ ID NO: 3818
  CDS (1)..(2151)

SEQ ID NO: 18337 - protein, 716 aa, Homo sapiens (Human); identical to SEQ ID NO: 3819

SEQ ID NO: 18338 - DNA, 1923 bp, Bradyrhizobium japonicum; identical to SEQ ID NO: 3820
  CDS (1)..(1923)

SEQ ID NO: 18339 - protein, 640 aa, Bradyrhizobium japonicum; identical to SEQ ID NO: 3821

SEQ ID NO: 18340 - DNA, 2394 bp, Homo sapiens (Human); identical to SEQ ID NO: 3822
  CDS (1)..(2394)

SEQ ID NO: 18341 - protein, 797 aa, Homo sapiens (Human); identical to SEQ ID NO: 3823

SEQ ID NO: 18342 - DNA, 1908 bp, Haemophilus influenzae; identical to SEQ ID NO: 3824
  CDS (1)..(1908)

SEQ ID NO: 18343 - protein, 635 aa, Haemophilus influenzae; identical to SEQ ID NO: 3825

SEQ ID NO: 18344 - DNA, 2115 bp, Arabidopsis thaliana (Mouse-ear cress); identical to SEQ ID NO: 3826
  CDS (1)..(2115)

SEQ ID NO: 18345 - protein, 704 aa, Arabidopsis thaliana (Mouse-ear cress); identical to SEQ ID NO: 3827

SEQ ID NO: 18346 - DNA, 2040 bp, Bacillus pseudofirmus; identical to SEQ ID NO: 3828
  CDS (1)..(2040)

SEQ ID NO: 18347 - protein, 679 aa, Bacillus pseudofirmus; identical to SEQ ID NO: 3829

SEQ ID NO: 18348 - DNA, 1842 bp, Buchnera aphidicola (subsp. Schizaphis graminum); identical to SEQ ID NO: 3830
  CDS (1)..(1842)

SEQ ID NO: 18349 - protein, 613 aa, Buchnera aphidicola (subsp. Schizaphis graminum); identical to SEQ ID NO: 3831

SEQ ID NO: 18350 - DNA, 1833 bp, Buchnera aphidicola (subsp. Baizongia pistaciae); identical to SEQ ID NO: 3832
  CDS (1)..(1833)

SEQ ID NO: 18351 - protein, 610 aa, Buchnera aphidicola (subsp. Baizongia pistaciae); identical to SEQ ID NO: 3833

SEQ ID NO: 18352 - DNA, 1896 bp, Guillardia theta (Cryptomonas phi); identical to SEQ ID NO: 3834
  CDS (1)..(1896)

SEQ ID NO: 18353 - protein, 631 aa, Guillardia theta (Cryptomonas phi); identical to SEQ ID NO: 3835

SEQ ID NO: 18354 - DNA, 2121 bp, Medicago sativa (Alfalfa); identical to SEQ ID NO: 3836
  CDS (1)..(2121)

SEQ ID NO: 18355 - protein, 706 aa, Medicago sativa (Alfalfa); identical to SEQ ID NO: 3837

SEQ ID NO: 18356 - DNA, 2364 bp, Mycobacterium leprae; identical to SEQ ID NO: 3838
  CDS (1)..(2364)

SEQ ID NO: 18357 - protein, 787 aa, Mycobacterium leprae; identical to SEQ ID NO: 3839

SEQ ID NO: 18358 - DNA, 2145 bp, Nicotiana tabacum (Common tobacco); identical to SEQ ID NO: 3840
  CDS (1)..(2145)

SEQ ID NO: 18359 - protein, 714 aa, Nicotiana tabacum (Common tobacco); identical to SEQ ID NO: 3841

SEQ ID NO: 18360 - DNA, 1854 bp, Geobacter sulfurreducens; identical to SEQ ID NO: 3842
  CDS (1)..(1854)

SEQ ID NO: 18361 - protein, 617 aa, Geobacter sulfurreducens; identical to SEQ ID NO: 3843

SEQ ID NO: 18362 - DNA, 1845 bp, Geobacter sulfurreducens; identical to SEQ ID NO: 3844
  CDS (1)..(1845)

SEQ ID NO: 18363 - protein, 614 aa, Geobacter sulfurreducens; identical to SEQ ID NO: 3845

SEQ ID NO: 18364 - DNA, 1806 bp, uncultured bacterium 106; identical to SEQ ID NO: 3846
  CDS (1)..(1806)

SEQ ID NO: 18365 - protein, 601 aa, uncultured bacterium 106; identical to SEQ ID NO: 3847

SEQ ID NO: 18366 - DNA, 2400 bp, Mycobacterium paratuberculosis; identical to SEQ ID NO: 3848
  CDS (1)..(2400)

SEQ ID NO: 18367 - protein, 799 aa, Mycobacterium paratuberculosis; identical to SEQ ID NO: 3849

SEQ ID NO: 18368 - DNA, 2127 bp, Lactobacillus johnsonii; identical to SEQ ID NO: 3850
  CDS (1)..(2127)

SEQ ID NO: 18369 - protein, 708 aa, Lactobacillus johnsonii; identical to SEQ ID NO: 3851

SEQ ID NO: 18370 - DNA, 1977 bp, Treponema denticola ATCC 35405; identical to SEQ ID NO: 3852
  CDS (1)..(1977)

SEQ ID NO: 18371 - protein, 658 aa, Treponema denticola ATCC 35405; identical to SEQ ID NO: 3853

SEQ ID NO: 18372 - DNA, 1842 bp, Wolbachia endosymbiont of Drosophila melanogaster; identical to SEQ ID NO: 3854
  CDS (1)..(1842)

SEQ ID NO: 18373 - protein, 613 aa, Wolbachia endosymbiont of Drosophila melanogaster; identical to SEQ ID NO: 3855

SEQ ID NO: 18374 - DNA, 2025 bp, Onion yellows phytoplasma; identical to SEQ ID NO: 3856
  CDS (1)..(2025)

SEQ ID NO: 18375 - protein, 674 aa, Onion yellows phytoplasma; identical to SEQ ID NO: 3857

SEQ ID NO: 18376 - DNA, 1947 bp, Mycoplasma mycoides; identical to SEQ ID NO: 3858
  CDS (1)..(1947)

SEQ ID NO: 18377 - protein, 648 aa, Mycoplasma mycoides; identical to SEQ ID NO: 3859

SEQ ID NO: 18378 - DNA, 26 bp, Primer
atgaacgtttcaaaaatacttgtgtc

SEQ ID NO: 18379 - DNA, 27 bp, Primer
tcatgcatttaacattgtaggaatttt

SEQ ID NO: 18380 - DNA, 1470 bp, Saccharomyces cerevisiae; identical to SEQ ID NO: 3866
  CDS (1)..(1470)

SEQ ID NO: 18381 - protein, 489 aa, Saccharomyces cerevisiae; identical to SEQ ID NO: 3867

SEQ ID NO: 18382 - DNA, 1215 bp, Bacillus subtilis; identical to SEQ ID NO: 3868
  CDS (1)..(1215)

SEQ ID NO: 18383 - protein, 404 aa, Bacillus subtilis; identical to SEQ ID NO: 3869

SEQ ID NO: 18384 - DNA, 1224 bp, Methanobacterium thermoautotrophicum; identical to SEQ ID NO: 3870
  CDS (1)..(1224)

SEQ ID NO: 18385 - protein, 407 aa, Methanobacterium thermoautotrophicum; identical to SEQ ID NO: 3871

SEQ ID NO: 18386 - DNA, 1176 bp, Archaeoglobus fulgidus; identical to SEQ ID NO: 3872
  CDS (1)..(1176)

SEQ ID NO: 18387 - protein, 391 aa, Archaeoglobus fulgidus; identical to SEQ ID NO: 3873

SEQ ID NO: 18388 - DNA, 1479 bp, Xylella fastidiosa; identical to SEQ ID NO: 3874
  CDS (1)..(1479)

SEQ ID NO: 18389 - protein, 492 aa, Xylella fastidiosa; identical to SEQ ID NO: 3875

SEQ ID NO: 18390 - DNA, 1545 bp, Arabidopsis thaliana (mouse-ear cress); identical to SEQ ID NO: 3876
  CDS (1)..(1545)

SEQ ID NO: 18391 - protein, 514 aa, Arabidopsis thaliana (mouse-ear cress); identical to SEQ ID NO: 3877

SEQ ID NO: 18392 - DNA, 1287 bp, Salmonella enterica subsp. enterica serovar Typhi; identical to SEQ ID NO: 3878
  CDS (1)..(1287)

SEQ ID NO: 18393 - protein, 428 aa, Salmonella enterica subsp. enterica serovar Typhi; identical to SEQ ID NO: 3879

SEQ ID NO: 18394 - DNA, 1206 bp, Listeria monocytogenes; identical to SEQ ID NO: 3880
  CDS (1)..(1206)

SEQ ID NO: 18395 - protein, 401 aa, Listeria monocytogenes; identical to SEQ ID NO: 3881

SEQ ID NO: 18396 - DNA, 1413 bp, Nostoc sp. PCC 7120; identical to SEQ ID NO: 3882
  CDS (1)..(1413)

SEQ ID NO: 18397 - protein, 470 aa, Nostoc sp. PCC 7120; identical to SEQ ID NO: 3883

SEQ ID NO: 18398 - DNA, 1296 bp, Yersinia pestis; identical to SEQ ID NO: 3884
  CDS (1)..(1296)

SEQ ID NO: 18399 - protein, 431 aa, Yersinia pestis; identical to SEQ ID NO: 3885

SEQ ID NO: 18400 - DNA, 1206 bp, Listeria innocua; identical to SEQ ID NO: 3886
  CDS (1)..(1206)

SEQ ID NO: 18401 - protein, 401 aa, Listeria innocua; identical to SEQ ID NO: 3887

SEQ ID NO: 18402 - DNA, 1320 bp, Deinococcus radiodurans; identical to SEQ ID NO: 3888
  CDS (1)..(1320)

SEQ ID NO: 18403 - protein, 439 aa, Deinococcus radiodurans; identical to SEQ ID NO: 3889

SEQ ID NO: 18404 - DNA, 1266 bp, Bacillus halodurans; identical to SEQ ID NO: 3890
  CDS (1)..(1266)

SEQ ID NO: 18405 - protein, 421 aa, Bacillus halodurans; identical to SEQ ID NO: 3891

SEQ ID NO: 18406 - DNA, 1239 bp, Methanobacterium thermoautotrophicum; identical to SEQ ID NO: 3892
  CDS (1)..(1239)

SEQ ID NO: 18407 - protein, 412 aa, Methanobacterium thermoautotrophicum; identical to SEQ ID NO: 3893

SEQ ID NO: 18408 - DNA, 1305 bp, Neisseria meningitidis; identical to SEQ ID NO: 3894
  CDS (1)..(1305)

SEQ ID NO: 18409 - protein, 434 aa, Neisseria meningitidis; identical to SEQ ID NO: 3895

SEQ ID NO: 18410 - DNA, 1329 bp, Pseudomonas aeruginosa; identical to SEQ ID NO: 3896
  CDS (1)..(1329)

SEQ ID NO: 18411 - protein, 442 aa, Pseudomonas aeruginosa; identical to SEQ ID NO: 3897

SEQ ID NO: 18412 - DNA, 1533 bp, Caulobacter crescentus; identical to SEQ ID NO: 3898
  CDS (1)..(1533)

SEQ ID NO: 18413 - protein, 510 aa, Caulobacter crescentus; identical to SEQ ID NO: 3899

SEQ ID NO: 18414 - DNA, 1167 bp, Archaeoglobus fulgidus; identical to SEQ ID NO: 3900
  CDS (1)..(1167)

SEQ ID NO: 18415 - protein, 388 aa, Archaeoglobus fulgidus; identical to SEQ ID NO: 3901

SEQ ID NO: 18416 - DNA, 1533 bp, Ureaplasma urealyticum; identical to SEQ ID NO: 3902
  CDS (1)..(1533)

SEQ ID NO: 18417 - protein, 510 aa, Ureaplasma urealyticum; identical to SEQ ID NO: 3903

SEQ ID NO: 18418 - DNA, 1566 bp, Ureaplasma urealyticum; identical to SEQ ID NO: 3904
  CDS (1)..(1566)

SEQ ID NO: 18419 - protein, 521 aa, Ureaplasma urealyticum; identical to SEQ ID NO: 3905

SEQ ID NO: 18420 - DNA, 1530 bp, Sulfolobus solfataricus; identical to SEQ ID NO: 3906
  CDS (1)..(1530)

SEQ ID NO: 18421 - protein, 509 aa, Sulfolobus solfataricus; identical to SEQ ID NO: 3907

SEQ ID NO: 18422 - DNA, 1272 bp, Aquifex aeolicus; identical to SEQ ID NO: 3908
  CDS (1)..(1272)

SEQ ID NO: 18423 - protein, 423 aa, Aquifex aeolicus; identical to SEQ ID NO: 3909

SEQ ID NO: 18424 - DNA, 1434 bp, Mycobacterium tuberculosis; identical to SEQ ID NO: 3910
  CDS (1)..(1434)

SEQ ID NO: 18425 - protein, 477 aa, Mycobacterium tuberculosis; identical to SEQ ID NO: 3911

SEQ ID NO: 18426 - DNA, 1308 bp, Thermotoga maritima; identical to SEQ ID NO: 3912
  CDS (1)..(1308)

SEQ ID NO: 18427 - protein, 435 aa, Thermotoga maritima; identical to SEQ ID NO: 3913

SEQ ID NO: 18428 - DNA, 1242 bp, Lactococcus lactis subsp. lactis; identical to SEQ ID NO: 3914
  CDS (1)..(1242)

SEQ ID NO: 18429 - protein, 413 aa, Lactococcus lactis subsp. lactis; identical to SEQ ID NO: 3915

SEQ ID NO: 18430 - DNA, 1218 bp, Clostridium acetobutylicum; identical to SEQ ID NO: 3916
  CDS (1)..(1218)

SEQ ID NO: 18431 - protein, 405 aa, Clostridium acetobutylicum; identical to SEQ ID NO: 3917

SEQ ID NO: 18432 - DNA, 1350 bp, Agrobacterium tumefaciens; identical to SEQ ID NO: 3918
  CDS (1)..(1350)

SEQ ID NO: 18433 - protein, 449 aa, Agrobacterium tumefaciens; identical to SEQ ID NO: 3919

SEQ ID NO: 18434 - DNA, 1479 bp, Saccharomyces cerevisiae; identical to SEQ ID NO: 3920
  CDS (1)..(1479)

SEQ ID NO: 18435 - protein, 492 aa, Saccharomyces cerevisiae; identical to SEQ ID NO: 3921

SEQ ID NO: 18436 - DNA, 1500 bp, Saccharomyces cerevisiae; identical to SEQ ID NO: 3922
  CDS (1)..(1500)

SEQ ID NO: 18437 - protein, 499 aa, Saccharomyces cerevisiae; identical to SEQ ID NO: 3923

SEQ ID NO: 18438 - DNA, 1524 bp, Synechocystis sp.; identical to SEQ ID NO: 3924
  CDS (1)..(1524)

SEQ ID NO: 18439 - protein, 507 aa, Synechocystis sp.; identical to SEQ ID NO: 3925

SEQ ID NO: 18440 - DNA, 1602 bp, Oryza sativa (rice); identical to SEQ ID NO: 3926
  CDS (1)..(1602)

SEQ ID NO: 18441 - protein, 533 aa, Oryza sativa (rice); identical to SEQ ID NO: 3927

SEQ ID NO: 18442 - DNA, 1515 bp, Arabidopsis thaliana (mouse-ear cress); identical to SEQ ID NO: 3928
  CDS (1)..(1515)

SEQ ID NO: 18443 - protein, 504 aa, Arabidopsis thaliana (mouse-ear cress); identical to SEQ ID NO: 3929

SEQ ID NO: 18444 - DNA, 1545 bp, Lycopersicon esculentum (tomato); identical to SEQ ID NO: 3930
  CDS (1)..(1545)

SEQ ID NO: 18445 - protein, 514 aa, Lycopersicon esculentum (tomato); identical to SEQ ID NO: 3931

SEQ ID NO: 18446 - DNA, 1506 bp, Arabidopsis thaliana (mouse-ear cress); identical to SEQ ID NO: 3932
  CDS (1)..(1506)

SEQ ID NO: 18447 - protein, 501 aa, Arabidopsis thaliana (mouse-ear cress); identical to SEQ ID NO: 3933

SEQ ID NO: 18448 - DNA, 1605 bp, Caenorhabditis elegans; identical to SEQ ID NO: 3934
  CDS (1)..(1605)

SEQ ID NO: 18449 - protein, 534 aa, Caenorhabditis elegans; identical to SEQ ID NO: 3935

SEQ ID NO: 18450 - DNA, 1347 bp, Streptomyces coelicolor; identical to SEQ ID NO: 3936
  CDS (1)..(1347)

SEQ ID NO: 18451 - protein, 448 aa, Streptomyces coelicolor; identical to SEQ ID NO: 3937

SEQ ID NO: 18452 - DNA, 1539 bp, Schizosaccharomyces pombe; identical to SEQ ID NO: 3938
  CDS (1)..(1539)

SEQ ID NO: 18453 - protein, 512 aa, Schizosaccharomyces pombe; identical to SEQ ID NO: 3939

SEQ ID NO: 18454 - DNA, 1425 bp, Rhizobium etli; identical to SEQ ID NO: 3940
  CDS (1)..(1425)

SEQ ID NO: 18455 - protein, 474 aa, Rhizobium etli; identical to SEQ ID NO: 3941

SEQ ID NO: 18456 - DNA, 1311 bp, Azotobacter vinelandii; identical to SEQ ID NO: 3942
  CDS (1)..(1311)

SEQ ID NO: 18457 - protein, 436 aa, Azotobacter vinelandii; identical to SEQ ID NO: 3943

SEQ ID NO: 18458 - DNA, 1482 bp, Azorhizobium caulinodans; identical to SEQ ID NO: 3944
  CDS (1)..(1482)

SEQ ID NO: 18459 - protein, 493 aa, Azorhizobium caulinodans; identical to SEQ ID NO: 3945

SEQ ID NO: 18460 - DNA, 1317 bp, Azospirillum brasilense; identical to SEQ ID NO: 3946
  CDS (1)..(1317)

SEQ ID NO: 18461 - protein, 438 aa, Azospirillum brasilense; identical to SEQ ID NO: 3947

SEQ ID NO: 18462 - DNA, 1314 bp, Wolinella succinogenes; identical to SEQ ID NO: 3948
  CDS (1)..(1314)

SEQ ID NO: 18463 - protein, 437 aa, Wolinella succinogenes; identical to SEQ ID NO: 3949

SEQ ID NO: 18464 - DNA, 1320 bp, Photorhabdus luminescens (subsp. laumondii); identical to SEQ ID NO: 3950
  CDS (1)..(1320)

SEQ ID NO: 18465 - protein, 439 aa, Photorhabdus luminescens (subsp. laumondii); identical to SEQ ID NO: 3951

SEQ ID NO: 18466 - DNA, 1437 bp, Gloeobacter violaceus; identical to SEQ ID NO: 3952
  CDS (1)..(1437)

SEQ ID NO: 18467 - protein, 478 aa, Gloeobacter violaceus; identical to SEQ ID NO: 3953

SEQ ID NO: 18468 - DNA, 1311 bp, Chromobacterium violaceum; identical to SEQ ID NO: 3954
  CDS (1)..(1311)

SEQ ID NO: 18469 - protein, 436 aa, Chromobacterium violaceum; identical to SEQ ID NO: 3955

SEQ ID NO: 18470 - DNA, 1479 bp, Neurospora crassa; identical to SEQ ID NO: 3956
  CDS (1)..(1479)

SEQ ID NO: 18471 - protein, 492 aa, Neurospora crassa; identical to SEQ ID NO: 3957

SEQ ID NO: 18472 - DNA, 1365 bp, Neurospora crassa; identical to SEQ ID NO: 3958
  CDS (1)..(1365)

SEQ ID NO: 18473 - protein, 454 aa, Neurospora crassa; identical to SEQ ID NO: 3959

SEQ ID NO: 18474 - DNA, 1533 bp, Neurospora crassa; identical to SEQ ID NO: 3960
  CDS (1)..(1533)

SEQ ID NO: 18475 - protein, 510 aa, Neurospora crassa; identical to SEQ ID NO: 3961

SEQ ID NO: 18476 - DNA, 1473 bp, Synechococcus sp. (strain WH8102); identical to SEQ ID NO: 3962
  CDS (1)..(1473)

SEQ ID NO: 18477 - protein, 490 aa, Synechococcus sp. (strain WH8102); identical to SEQ ID NO: 3963

SEQ ID NO: 18478 - DNA, 1590 bp, Rhodopirellula baltica; identical to SEQ ID NO: 3964
  CDS (1)..(1590)

SEQ ID NO: 18479 - protein, 529 aa, Rhodopirellula baltica; identical to SEQ ID NO: 3965

SEQ ID NO: 18480 - DNA, 1479 bp, Prochlorococcus marinus (strain MIT 9313); identical to SEQ ID NO: 3966
  CDS (1)..(1479)

SEQ ID NO: 18481 - protein, 492 aa, Prochlorococcus marinus (strain MIT 9313); identical to SEQ ID NO: 3967

SEQ ID NO: 18482 - DNA, 1509 bp, Prochlorococcus marinus; identical to SEQ ID NO: 3968
  CDS (1)..(1509)

SEQ ID NO: 18483 - protein, 502 aa, Prochlorococcus marinus; identical to SEQ ID NO: 3969

SEQ ID NO: 18484 - DNA, 1497 bp, Oryza sativa (Rice); identical to SEQ ID NO: 3970
  CDS (1)..(1497)

SEQ ID NO: 18485 - protein, 498 aa, Oryza sativa (Rice); identical to SEQ ID NO: 3971

SEQ ID NO: 18486 - DNA, 1557 bp, Lotus japonicus; identical to SEQ ID NO: 3972
  CDS (1)..(1557)

SEQ ID NO: 18487 - protein, 518 aa, Lotus japonicus; identical to SEQ ID NO: 3973

SEQ ID NO: 18488 - DNA, 1233 bp, Bacillus cereus (strain ATCC 14579 / DSM 31); identical to SEQ ID NO: 3974
  CDS (1)..(1233)

SEQ ID NO: 18489 - protein, 410 aa, Bacillus cereus (strain ATCC 14579 / DSM 31); identical to SEQ ID NO: 3975

SEQ ID NO: 18490 - DNA, 1311 bp, Streptomyces avermitilis; identical to SEQ ID NO: 3976
  CDS (1)..(1311)

SEQ ID NO: 18491 - protein, 436 aa, Streptomyces avermitilis; identical to SEQ ID NO: 3977

SEQ ID NO: 18492 - DNA, 1341 bp, Streptomyces avermitilis; identical to SEQ ID NO: 3978
  CDS (1)..(1341)

SEQ ID NO: 18493 - protein, 446 aa, Streptomyces avermitilis; identical to SEQ ID NO: 3979

SEQ ID NO: 18494 - DNA, 1461 bp, Oryza sativa (japonica cultivar-group); identical to SEQ ID NO: 3980
  CDS (1)..(1461)

SEQ ID NO: 18495 - protein, 486 aa, Oryza sativa (japonica cultivar-group); identical to SEQ ID NO: 3981

SEQ ID NO: 18496 - DNA, 1440 bp, Oryza sativa (japonica cultivar-group); identical to SEQ ID NO: 3982
  CDS (1)..(1440)

SEQ ID NO: 18497 - protein, 479 aa, Oryza sativa (japonica cultivar-group); identical to SEQ ID NO: 3983

SEQ ID NO: 18498 - DNA, 1455 bp, Xylella fastidiosa (strain Temecula1 / ATCC 700964); identical to SEQ ID NO: 3984
  CDS (1)..(1455)

SEQ ID NO: 18499 - protein, 484 aa, Xylella fastidiosa (strain Temecula1 / ATCC 700964); identical to SEQ ID NO: 3985

SEQ ID NO: 18500 - DNA, 1326 bp, Pseudomonas syringae (pv. tomato); identical to SEQ ID NO: 3986
  CDS (1)..(1326)

SEQ ID NO: 18501 - protein, 441 aa, Pseudomonas syringae (pv. tomato); identical to SEQ ID NO: 3987

SEQ ID NO: 18502 - DNA, 1338 bp, Pseudomonas syringae (pv. tomato); identical to SEQ ID NO: 3988
  CDS (1)..(1338)

SEQ ID NO: 18503 - protein, 445 aa, Pseudomonas syringae (pv. tomato); identical to SEQ ID NO: 3989

SEQ ID NO: 18504 - DNA, 1332 bp, Pseudomonas putida (strain KT2440); identical to SEQ ID NO: 3990
  CDS (1)..(1332)

SEQ ID NO: 18505 - protein, 443 aa, Pseudomonas putida (strain KT2440); identical to SEQ ID NO: 3991

SEQ ID NO: 18506 - DNA, 1317 bp, Lactobacillus plantarum; identical to SEQ ID NO: 3992
  CDS (1)..(1317)

SEQ ID NO: 18507 - protein, 438 aa, Lactobacillus plantarum; identical to SEQ ID NO: 3993

SEQ ID NO: 18508 - DNA, 1533 bp, Bradyrhizobium japonicum; identical to SEQ ID NO: 3994
  CDS (1)..(1533)

SEQ ID NO: 18509 - protein, 510 aa, Bradyrhizobium japonicum; identical to SEQ ID NO: 3995

SEQ ID NO: 18510 - DNA, 1251 bp, Staphylococcus epidermidis; identical to SEQ ID NO: 3996
  CDS (1)..(1251)

SEQ ID NO: 18511 - protein, 416 aa, Staphylococcus epidermidis; identical to SEQ ID NO: 3997

SEQ ID NO: 18512 - DNA, 1236 bp, Streptococcus mutans; identical to SEQ ID NO: 3998
  CDS (1)..(1236)

SEQ ID NO: 18513 - protein, 411 aa, Streptococcus mutans; identical to SEQ ID NO: 3999

SEQ ID NO: 18514 - DNA, 1371 bp, Oceanobacillus iheyensis; identical to SEQ ID NO: 4000
  CDS (1)..(1371)

SEQ ID NO: 18515 - protein, 456 aa, Oceanobacillus iheyensis; identical to SEQ ID NO: 4001

SEQ ID NO: 18516 - DNA, 1293 bp, Leptospira interrogans; identical to SEQ ID NO: 4002
  CDS (1)..(1293)

SEQ ID NO: 18517 - protein, 430 aa, Leptospira interrogans; identical to SEQ ID NO: 4003

SEQ ID NO: 18518 - DNA, 1287 bp, Escherichia coli O6; identical to SEQ ID NO: 4004
  CDS (1)..(1287)

SEQ ID NO: 18519 - protein, 428 aa, Escherichia coli O6; identical to SEQ ID NO: 4005

SEQ ID NO: 18520 - DNA, 1326 bp, Corynebacterium efficiens; identical to SEQ ID NO: 4006
  CDS (1)..(1326)

SEQ ID NO: 18521 - protein, 441 aa, Corynebacterium efficiens; identical to SEQ ID NO: 4007

SEQ ID NO: 18522 - DNA, 1320 bp, Corynebacterium efficiens; identical to SEQ ID NO: 4008
  CDS (1)..(1320)

SEQ ID NO: 18523 - protein, 439 aa, Corynebacterium efficiens; identical to SEQ ID NO: 4009

SEQ ID NO: 18524 - DNA, 1302 bp, Brucella suis; identical to SEQ ID NO: 4010
  CDS (1)..(1302)

SEQ ID NO: 18525 - protein, 433 aa, Brucella suis; identical to SEQ ID NO: 4011

SEQ ID NO: 18526 - DNA, 1296 bp, Bifidobacterium longum; identical to SEQ ID NO: 4012
  CDS (1)..(1296)

SEQ ID NO: 18527 - protein, 431 aa, Bifidobacterium longum; identical to SEQ ID NO: 4013

SEQ ID NO: 18528 - DNA, 1392 bp, Acetobacter diazotrophicus (Gluconacetobacter diazotrophicus); identical to SEQ ID NO: 4014
  CDS (1)..(1392)

SEQ ID NO: 18529 - protein, 463 aa, Acetobacter diazotrophicus (Gluconacetobacter diazotrophicus); identical to SEQ ID NO: 4015

SEQ ID NO: 18530 - DNA, 1818 bp, Medicago truncatula (Barrel medic); identical to SEQ ID NO: 4016
  CDS (47)..(1531)

SEQ ID NO: 18531 - protein, 494 aa, Medicago truncatula (Barrel medic); identical to SEQ ID NO: 4017

SEQ ID NO: 18532 - DNA, 1654 bp, Phytophthora infestans (Potato late blight fungus); identical to SEQ ID NO: 4018
  CDS (16)..(1572)

SEQ ID NO: 18533 - protein, 518 aa, Phytophthora infestans (Potato late blight fungus); identical to SEQ ID NO: 4019

SEQ ID NO: 18534 - DNA, 1332 bp, Chlorobium tepidum; identical to SEQ ID NO: 4020
  CDS (1)..(1332)

SEQ ID NO: 18535 - protein, 443 aa, Chlorobium tepidum; identical to SEQ ID NO: 4021

SEQ ID NO: 18536 - DNA, 2716 bp, Chlamydomonas reinhardtii; identical to SEQ ID NO: 4022
  CDS (26)..(1654)

SEQ ID NO: 18537 - protein, 542 aa, Chlamydomonas reinhardtii; identical to SEQ ID NO: 4023

SEQ ID NO: 18538 - DNA, 2568 bp, Chlamydomonas reinhardtii; identical to SEQ ID NO: 4024
  CDS (106)..(1845)

SEQ ID NO: 18539 - protein, 579 aa, Chlamydomonas reinhardtii; identical to SEQ ID NO: 4025

SEQ ID NO: 18540 - DNA, 1296 bp, Dictyostelium discoideum (Slime mold); identical to SEQ ID NO: 4026
  CDS (1)..(1296)

SEQ ID NO: 18541 - protein, 431 aa, Dictyostelium discoideum (Slime mold); identical to SEQ ID NO: 4027

SEQ ID NO: 18542 - DNA, 1434 bp, Hebeloma cylindrosporum; identical to SEQ ID NO: 4028
  CDS (1)..(1434)

SEQ ID NO: 18543 - protein, 477 aa, Hebeloma cylindrosporum; identical to SEQ ID NO: 4029

SEQ ID NO: 18544 - DNA, 1251 bp, Staphylococcus aureus (strain MW2); identical to SEQ ID NO: 4030
  CDS (1)..(1251)

SEQ ID NO: 18545 - protein, 416 aa, Staphylococcus aureus (strain MW2); identical to SEQ ID NO: 4031

SEQ ID NO: 18546 - DNA, 1476 bp, Xanthomonas campestris (pv. campestris); identical to SEQ ID NO: 4032
  CDS (1)..(1476)

SEQ ID NO: 18547 - protein, 491 aa, Xanthomonas campestris (pv. campestris); identical to SEQ ID NO: 4033

SEQ ID NO: 18548 - DNA, 1365 bp, Azoarcus sp. BH72; identical to SEQ ID NO: 4034
  CDS (1)..(1365)

SEQ ID NO: 18549 - protein, 454 aa, Azoarcus sp. BH72; identical to SEQ ID NO: 4035

SEQ ID NO: 18550 - DNA, 1430 bp, Azoarcus sp. BH72; identical to SEQ ID NO: 4036
  CDS (24)..(1430)

SEQ ID NO: 18551 - protein, 468 aa, Azoarcus sp. BH72; identical to SEQ ID NO: 4037

SEQ ID NO: 18552 - DNA, 1317 bp, Pseudomonas stutzeri (Pseudomonas perfectomarina); identical to SEQ ID NO: 4038
  CDS (1)..(1317)

SEQ ID NO: 18553 - protein, 438 aa, Pseudomonas stutzeri (Pseudomonas perfectomarina); identical to SEQ ID NO: 4039

SEQ ID NO: 18554 - DNA, 2195 bp, Chlamydomonas reinhardtii; identical to SEQ ID NO: 4040
  CDS (28)..(1647)

SEQ ID NO: 18555 - protein, 539 aa, Chlamydomonas reinhardtii; identical to SEQ ID NO: 4041

SEQ ID NO: 18556 - DNA, 1494 bp, Oryza sativa (japonica cultivar-group); identical to SEQ ID NO: 4042
  CDS (1)..(1494)

SEQ ID NO: 18557 - protein, 497 aa, Oryza sativa (japonica cultivar-group); identical to SEQ ID NO: 4043

SEQ ID NO: 18558 - DNA, 1883 bp, Oryza sativa (japonica cultivar-group); identical to SEQ ID NO: 4044
  CDS (87)..(1580)

SEQ ID NO: 18559 - protein, 497 aa, Oryza sativa (japonica cultivar-group); identical to SEQ ID NO: 4045

SEQ ID NO: 18560 - DNA, 1437 bp, Emericella nidulans (Aspergillus nidulans); identical to SEQ ID NO: 4046
  CDS (1)..(1437)

SEQ ID NO: 18561 - protein, 478 aa, Emericella nidulans (Aspergillus nidulans); identical to SEQ ID NO: 4047

SEQ ID NO: 18562 - DNA, 1635 bp, Emericella nidulans (Aspergillus nidulans); identical to SEQ ID NO: 4048
  CDS (1)..(1635)

SEQ ID NO: 18563 - protein, 544 aa, Emericella nidulans (Aspergillus nidulans); identical to SEQ ID NO: 4049

SEQ ID NO: 18564 - DNA, 1215 bp, Methanosarcina acetivorans; identical to SEQ ID NO: 4050
  CDS (1)..(1215)

SEQ ID NO: 18565 - protein, 404 aa, Methanosarcina acetivorans; identical to SEQ ID NO: 4051

SEQ ID NO: 18566 - DNA, 1209 bp, Methanosarcina acetivorans; identical to SEQ ID NO: 4052
  CDS (1)..(1209)

SEQ ID NO: 18567 - protein, 402 aa, Methanosarcina acetivorans; identical to SEQ ID NO: 4053

SEQ ID NO: 18568 - DNA, 2239 bp, Methanosarcina mazei (Methanosarcina frisia); identical to SEQ ID NO: 4054
  CDS (537)..(1730)

SEQ ID NO: 18569 - protein, 397 aa, Methanosarcina mazei (Methanosarcina frisia); identical to SEQ ID NO: 4055

SEQ ID NO: 18570 - DNA, 1446 bp, Neurospora crassa; identical to SEQ ID NO: 4056
  CDS (1)..(1446)

SEQ ID NO: 18571 - protein, 481 aa, Neurospora crassa; identical to SEQ ID NO: 4057

SEQ ID NO: 18572 - DNA, 2689 bp, Tuber borchii (White truffle); identical to SEQ ID NO: 4058
  CDS (386)..(1837)

SEQ ID NO: 18573 - protein, 483 aa, Tuber borchii (White truffle); identical to SEQ ID NO: 4059

SEQ ID NO: 18574 - DNA, 1311 bp, Ralstonia solanacearum (Pseudomonas solanacearum); identical to SEQ ID NO: 4060
  CDS (1)..(1311)

SEQ ID NO: 18575 - protein, 436 aa, Ralstonia solanacearum (Pseudomonas solanacearum); identical to SEQ ID NO: 4061

SEQ ID NO: 18576 - DNA, 1356 bp, Rhizobium meliloti (Sinorhizobium meliloti); identical to SEQ ID NO: 4062
  CDS (1)..(1356)

SEQ ID NO: 18577 - protein, 451 aa, Rhizobium meliloti (Sinorhizobium meliloti); identical to SEQ ID NO: 4063

SEQ ID NO: 18578 - DNA, 1655 bp, Lotus japonicus; identical to SEQ ID NO: 4064
  CDS (37)..(1497)

SEQ ID NO: 18579 - protein, 486 aa, Lotus japonicus; identical to SEQ ID NO: 4065

SEQ ID NO: 18580 - DNA, 1497 bp, Oryza sativa (Rice); identical to SEQ ID NO: 4066
  CDS (1)..(1497)

SEQ ID NO: 18581 - protein, 498 aa, Oryza sativa (Rice); identical to SEQ ID NO: 4067

SEQ ID NO: 18582 - DNA, 1479 bp, Hebeloma cylindrosporum; identical to SEQ ID NO: 4068
  CDS (1)..(1479)

SEQ ID NO: 18583 - protein, 492 aa, Hebeloma cylindrosporum; identical to SEQ ID NO: 4069

SEQ ID NO: 18584 - DNA, 1416 bp, Hebeloma cylindrosporum; identical to SEQ ID NO: 4070
  CDS (1)..(1416)

SEQ ID NO: 18585 - protein, 471 aa, Hebeloma cylindrosporum; identical to SEQ ID NO: 4071

SEQ ID NO: 18586 - DNA, 1771 bp, Ustilago maydis (Smut fungus); identical to SEQ ID NO: 4072
  CDS (149)..(1735)

SEQ ID NO: 18587 - protein, 528 aa, Ustilago maydis (Smut fungus); identical to SEQ ID NO: 4073

SEQ ID NO: 18588 - DNA, 1557 bp, Sulfolobus tokodaii; identical to SEQ ID NO: 4074
  CDS (1)..(1557)

SEQ ID NO: 18589 - protein, 518 aa, Sulfolobus tokodaii; identical to SEQ ID NO: 4075

SEQ ID NO: 18590 - DNA, 1356 bp, Rhizobium loti (Mesorhizobium loti); identical to SEQ ID NO: 4076
  CDS (1)..(1356)

SEQ ID NO: 18591 - protein, 451 aa, Rhizobium loti (Mesorhizobium loti); identical to SEQ ID NO: 4077

SEQ ID NO: 18592 - DNA, 1296 bp, Rhodospirillum rubrum; identical to SEQ ID NO: 4078
  CDS (1)..(1296)

SEQ ID NO: 18593 - protein, 431 aa, Rhodospirillum rubrum; identical to SEQ ID NO: 4079

SEQ ID NO: 18594 - DNA, 1473 bp, Dictyostelium discoideum (Slime mold); identical to SEQ ID NO: 4080
  CDS (37)..(1428)

SEQ ID NO: 18595 - protein, 463 aa, Dictyostelium discoideum (Slime mold); identical to SEQ ID NO: 4081

SEQ ID NO: 18596 - DNA, 1494 bp, Schizosaccharomyces pombe (Fission yeast); identical to SEQ ID NO: 4082
  CDS (1)..(1494)

SEQ ID NO: 18597 - protein, 497 aa, Schizosaccharomyces pombe (Fission yeast); identical to SEQ ID NO: 4083

SEQ ID NO: 18598 - DNA, 1797 bp, Lotus japonicus; identical to SEQ ID NO: 4084
  CDS (76)..(1581)

SEQ ID NO: 18599 - protein, 501 aa, Lotus japonicus; identical to SEQ ID NO: 4085

SEQ ID NO: 18600 - DNA, 1491 bp, Arabidopsis thaliana (Mouse-ear cress); identical to SEQ ID NO: 4086
  CDS (1)..(1491)

SEQ ID NO: 18601 - protein, 496 aa, Arabidopsis thaliana (Mouse-ear cress); identical to SEQ ID NO: 4087

SEQ ID NO: 18602 - DNA, 1554 bp, Schizosaccharomyces pombe (Fission yeast); identical to SEQ ID NO: 4088
  CDS (1)..(1554)

SEQ ID NO: 18603 - protein, 517 aa, Schizosaccharomyces pombe (Fission yeast); identical to SEQ ID NO: 4089

SEQ ID NO: 18604 - DNA, 1476 bp, Xanthomonas axonopodis (pv. citri), and; identical to SEQ ID NO: 4090
  CDS (1)..(1476)

SEQ ID NO: 18605 - protein, 491 aa, Xanthomonas axonopodis (pv. citri), and; identical to SEQ ID NO: 4091

SEQ ID NO: 18606 - DNA, 1482 bp, Prochlorococcus sp. (strain PCC 9511); identical to SEQ ID NO: 4092
  CDS (1)..(1482)

SEQ ID NO: 18607 - protein, 493 aa, Prochlorococcus sp. (strain PCC 9511); identical to SEQ ID NO: 4093

SEQ ID NO: 18608 - DNA, 1317 bp, Corynebacterium glutamicum (Brevibacterium flavum); identical to SEQ ID NO: 4094
  CDS (1)..(1317)

SEQ ID NO: 18609 - protein, 438 aa, Corynebacterium glutamicum (Brevibacterium flavum); identical to SEQ ID NO: 4095

SEQ ID NO: 18610 - DNA, 1690 bp, Ustilago violacea (Smut fungus) (Microbotryum violaceum); identical to SEQ ID NO: 4096
  CDS (19)..(1500)

SEQ ID NO: 18611 - protein, 493 aa, Ustilago violacea (Smut fungus) (Microbotryum violaceum); identical to SEQ ID NO: 4097

SEQ ID NO: 18612 - DNA, 1658 bp, Arabidopsis thaliana (Mouse-ear cress); identical to SEQ ID NO: 4098
  CDS (63)..(1490): n means a or g or c or t/u

SEQ ID NO: 18613 - protein, 475 aa, Arabidopsis thaliana (Mouse-ear cress); identical to SEQ ID NO: 4099

SEQ ID NO: 18614 - DNA, 1359 bp, Corynebacterium glutamicum (Brevibacterium flavum); identical to SEQ ID NO: 4100
  CDS (1)..(1359)

SEQ ID NO: 18615 - protein, 452 aa, Corynebacterium glutamicum (Brevibacterium flavum); identical to SEQ ID NO: 4101

SEQ ID NO: 18616 - DNA, 1751 bp, Lycopersicon esculentum (Tomato); identical to SEQ ID NO: 4102
  CDS (56)..(1522)

SEQ ID NO: 18617 - protein, 488 aa, Lycopersicon esculentum (Tomato); identical to SEQ ID NO: 4103

SEQ ID NO: 18618 - DNA, 1671 bp, Arabidopsis thaliana (Mouse-ear cress); identical to SEQ ID NO: 4104
  CDS (10)..(1569)

SEQ ID NO: 18619 - protein, 519 aa, Arabidopsis thaliana (Mouse-ear cress); identical to SEQ ID NO: 4105

SEQ ID NO: 18620 - DNA, 1659 bp, Lycopersicon esculentum (Tomato); identical to SEQ ID NO: 4106
  CDS (179)..(1561)

SEQ ID NO: 18621 - protein, 460 aa, Lycopersicon esculentum (Tomato); identical to SEQ ID NO: 4107

SEQ ID NO: 18622 - DNA, 1603 bp, Ustilago maydis (Smut fungus); identical to SEQ ID NO: 4108
  CDS (91)..(1554)

SEQ ID NO: 18623 - protein, 487 aa, Ustilago maydis (Smut fungus); identical to SEQ ID NO: 4109

SEQ ID NO: 18624 - DNA, 1470 bp, Geobacter sulfurreducens; identical to SEQ ID NO: 4110
  CDS (1)..(1470)

SEQ ID NO: 18625 - protein, 489 aa, Geobacter sulfurreducens; identical to SEQ ID NO: 4111

SEQ ID NO: 18626 - DNA, 1221 bp, Geobacter sulfurreducens; identical to SEQ ID NO: 4112
  CDS (1)..(1221)

SEQ ID NO: 18627 - protein, 406 aa, Geobacter sulfurreducens; identical to SEQ ID NO: 4113

SEQ ID NO: 18628 - DNA, 1656 bp, Triticum aestivum (Wheat); identical to SEQ ID NO: 4114
  CDS (93)..(1505)

SEQ ID NO: 18629 - protein, 470 aa, Triticum aestivum (Wheat); identical to SEQ ID NO: 4115

SEQ ID NO: 18630 - DNA, 1278 bp, Mycobacterium paratuberculosis; identical to SEQ ID NO: 4116
  CDS (1)..(1278)

SEQ ID NO: 18631 - protein, 425 aa, Mycobacterium paratuberculosis; identical to SEQ ID NO: 4117

SEQ ID NO: 18632 - DNA, 1440 bp, Mycobacterium paratuberculosis; identical to SEQ ID NO: 4118
  CDS (1)..(1440)

SEQ ID NO: 18633 - protein, 479 aa, Mycobacterium paratuberculosis; identical to SEQ ID NO: 4119

SEQ ID NO: 18634 - DNA, 1236 bp, Bacillus cereus ATCC 10987; identical to SEQ ID NO: 4120
  CDS (1)..(1236)

SEQ ID NO: 18635 - protein, 411 aa, Bacillus cereus ATCC 10987; identical to SEQ ID NO: 4121

SEQ ID NO: 18636 - DNA, 1332 bp, Rhodopseudomonas palustris; identical to SEQ ID NO: 4122
  CDS (1)..(1332)

SEQ ID NO: 18637 - protein, 443 aa, Rhodopseudomonas palustris; identical to SEQ ID NO: 4123

SEQ ID NO: 18638 - DNA, 1443 bp, Rhodopseudomonas palustris; identical to SEQ ID NO: 4124
  CDS (1)..(1443)

SEQ ID NO: 18639 - protein, 480 aa, Rhodopseudomonas palustris; identical to SEQ ID NO: 4125

SEQ ID NO: 18640 - DNA, 21 bp, Primer
atggctcggggtgacggacat

SEQ ID NO: 18641 - DNA, 25 bp, Primer
tcatgcttcttttgcgtgatgcaat

SEQ ID NO: 18642 - protein, 62 aa, consensus
  MISC_FEATURE (1)..(62): consensus for the disclosure of xaa see table XV
XXXXXXXXXXXXXPXXXXXXXXXXXXXXXXXXXXXXXXXXXXXXXXXXXXGXXXXXXGXXXX

SEQ ID NO: 18643 - protein, 1000 aa, consensus
  MISC_FEATURE (1)..(1000): Xaa in all Positions is any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXXXXXXXGXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXPXXVXXXXXQXXXXXXXXXXXXXXXXXXXXXXXXXXXGXXXXYXGXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 18644 - protein, 71 aa, consensus
  MISC_FEATURE (1)..(71): consensus for the disclosure of xaa see table XV
XLXXXXXXLXXXXXXXXXXXXXXXXXXXXXXXXXXXXXXXXXXFXXWXXLXXXXXXXXXXXXALXXXNXXX

SEQ ID NO: 18645 - protein, 27 aa, consensus
  MISC_FEATURE (1)..(27): consensus for the disclosure of xaa see table XV
XLXXXXXXXGWXXXXXXXXXXFXXXXX

SEQ ID NO: 18646 - protein, 55 aa, consensus
  MISC_FEATURE (1)..(55): consensus for the disclosure of xaa see table XV
KRXCXXWXXXXFXXXYXDLXXXXXXXXXXXXXXXXXXXXXXXXXEWXXXGXXXXR

SEQ ID NO: 18647 - protein, 1038 aa, consensus
  MISC_FEATURE (1)..(1038): Xaa in all Positions is any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXGXDXSXXXXXXXXXXXXXXXXXXXXXXXXXXXXXXXXXXXXXXXXNXFXXXDXXXXXXXXXXXXXXXXDXXXXXXXXXXXXXXXXXXXXXXXXXXXXXXXXXXXWXEXXXSXXXRXXXXXXXXXXXXXXXXXXXXXXXXXXXXXXXXXXXXXXXXXXXLXXXXXXXXXXXXXXXXXXXXXXXXNYLXXXLXXXXXXXXXXXXXXXXXXXXXLXXXXXXXXXXXXXXXXXXXXXXXXXEXXXXXXXXXXXXXXXXXXXXXXXXXXXXXXXXXXXXXXLXXQXXFLXXXXXXXXXXXXXXXXYXLAXXXXXXXXXXXXXXFXXWXXLXXXYXXXXXXXXALLXXNXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYXLLXXXXXXXGWXXLLXXRXXXFVMXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKRLCEXWLDXLFXXXYEDLXXXXXXXXXXXXXXXXXXXXXXXXXEWEXXGLXXXRXXXXXXXXXXXXAXXXXXXXXXXRFXXXXXXXLLXXXXXXXXXXXXXXXXXXXXXXXXXXXXXXXXXXXXXXXXXXXXXXXXXXXXXXXXXXXXXXXXXRXYXXXXXXXXXXXXXXXXXXXXXXXXXXXXXXXXXXXXXXXXXXXXXXXXXXXXXXXXXXXXXXXXXXXXXXXXXXXXXX

SEQ ID NO: 18648 - protein, 94 aa, consensus
  MISC_FEATURE (1)..(94): consensus for the disclosure of xaa see table XV
XXXRKXXXXXXXXXXXXXXGXXGXXXEXXXXXXXXXXXXXXXXXXXXXXXXXXXXXXXXXXXXXXXXXXXXXXXXXXXXXXXXXXXXXXXXXXX

SEQ ID NO: 18649 - protein, 571 aa, consensus
  MISC_FEATURE (1)..(571): Xaa in all Positions is any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXCGXXXXXXXXXXXXXXXXXXXXXXXXXXXXXXXXXXXXXXXXXXLVXGGXXXGXMGXXXXXXXXXGXXXXXXGXXPXXLXXXXXXXXXXXXXXXXXXXXXXXXXXXXXXXXXXXXXXXXXXXXXXXXXXXXXXXXXXXMXXRKXXMXXXXDXFXXLPGGXGTXEEXXEXXXWXXXGXHXKPXXXXXXXXXXXXXXXXXXXXXXXXXXXXXGXXXXLXXXXXXXXXXXXXFXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 18650 - protein, 101 aa, consensus
  MISC_FEATURE (1)..(101): consensus for the disclosure of xaa see table XV
GXXXXXXXXXXXXXXXXXXXXXXXXXXXXXHXDGARXXXAXXXXXXXXXXXXXXXXXDXXXXCXSKXXXXPXGSXXXGXXXXXXXAXXXXKXXGGGXRQXG

SEQ ID NO: 18651 - protein, 146 aa, consensus
  MISC_FEATURE (1)..(146): consensus for the disclosure of xaa see table XV
XXXXDGXXDXXHXXXXXXXXXXXXXXXXXXXXXXXXXXXGXXXXXXXXXXXXXXXXXXXXXRXXXXXXXXXXXXXXXXXPXXXXXXXXXXXXXXXXXXXXXXXXXXXXXXXXXXXXXXXXXXXXXXXXXXXXXXXXXXXXXXXXXX

SEQ ID NO: 18652 - protein, 907 aa, consensus
  MISC_FEATURE (1)..(907): Xaa in all Positions is any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRVXXDGXXDXXHXGHXXXLXQAKXXXXXXXXXXXXXLXVGXXXDXXXXXXKGXXXVXXXXERXXXXXXXXXVDEVXXXAPXXXXXXXXXXXXXXXXXDXXXHXXXXXXXXXXXXXDXYXXXKXXGXXXXXXRTXGXSTXDXXXRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 18653 - protein, 51 aa, consensus
  MISC_FEATURE (1)..(51): consensus for the disclosure of xaa see table XV
EXXXXXXIXXXXXXXXXXXXXXXXXXXXXXXXXXXXXXXXXXXXXXPXXYP

SEQ ID NO: 18654 - protein, 111 aa, consensus
  MISC_FEATURE (1)..(111): consensus for the disclosure of xaa see table XV
XXXXXSXFXAXXXXVXXXXXXXXXXXXLXXXXXXXXXXXHXXXAXRXXXXXXXXXXXXXDXXDDGEXXAXXXXXXLXXXXXXXXXXVXVXRWXGGXXXGPXRFXXINXXXR

SEQ ID NO: 18655 - protein, 327 aa, consensus
  MISC_FEATURE (1)..(327): Xaa in all Positions is any amino acid
XXXXXXXXXXXXXXEXXXXXXIYXXXXXXXXXXXXXXXXXXXXXXXXXXXXXXXXXXXXXPXXYPXXXPPXXXXXXXXXXXXXXXXXXXXXXXXXXXXXXXXXXXXXXXXXXDXXXXXXXXXXXXXXXXXXXXXXXXXXXXXXXXXXXXXXXXXXXXXXXXXXXXXXXXXXXXXXXXXXXPXXDRXSTFXAXXAXVXXXXXXXXXXXXLXXXXXKXXXAXHXXXAXRIXXXXXXXXXXXXDXXDDGEXAAGXRXLHLXXXXXXXXVXVXVXRWXGGXXXGPDRFXHINXXXRXXXXXXXXXXXXXXXXXXXXXXXXXXXXXXXXXXX

SEQ ID NO: 18656 - protein, 91 aa, consensus
  MISC_FEATURE (1)..(91): consensus for the disclosure of xaa see table XV
GXXXXXXXLXXXXXXXXXXXXXXXXXXXXXXXXXXXXXXXXXXXXXXXXXXXXXXXXXXXXXXXXXXXXLXXXXXXYXXLRXXXXXXXKXX

SEQ ID NO: 18657 - protein, 109 aa, consensus
  MISC_FEATURE (1)..(109): consensus for the disclosure of xaa see table XV
EXXKXXXXSXXDXXXXXLXXAXXXXNXXXXDWXQYXLXIXYGDXERXLXXXEXPXXXFKXLXXXGXXPXXMLRXXXXXXXXXXXXXXXXXXXXXXXXXXXXXXXPGGXL

SEQ ID NO: 18658 - protein, 520 aa, consensus
  MISC_FEATURE (1)..(520): Xaa in all Positions is any amino acid
XXXXXXXXXXXXXXXXXXXXXXXXXXXXXXXXXXXXXXXXXXXXXXXXXXXXXXXXXXXXXXXXXXWXXXXXXXWXXXXXXXXXXXXXXXXXXXXXXXXXXXXXXXXXXXXXXXXXXXXXXXXXXXXXXXXXXXXXXXXXXGXXXXXXXLXXXXXXXXXXXXXXXXXXXXXXXXXXXXXXXXXXXXXXXXXXXXXXXXXXXXXXXXXXXXLXXXXXXYXXLRXXXXXXXKXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXSPXXXXXXXXXXXXXSXXXXXXXXXXXXXXXXXXXXXXXXXXXXXXXXXXXXXXXXXXXXXXXXXXXXXXEXXKXXXXSXXDXXXXXLXXAXXXXNXXXXDWXQYXLXIXYGDXERXLXXXEXPXXXFKXLXXXGXXPXXMLRXXXXXXXXXXXXXXXXXXXXXXXXXXXXXXXPGGXL

SEQ ID NO: 18659 - protein, 50 aa, consensus
  MISC_FEATURE (1)..(50): consensus for the disclosure of xaa see table XV
RXEXDXXGXXXXXXXXXXGXXXXRXXXNXXXXXXXXXXXXXXXXXXXXXK

SEQ ID NO: 18660 - protein, 57 aa, consensus
  MISC_FEATURE (1)..(57): consensus for the disclosure of xaa see table XV
XXGXGTXXXMNXNEVXXNXXXXXXXXXXXXXXXXXPXXXXNXXQSXNXXXXXXXXXX

SEQ ID NO: 18661 - protein, 56 aa, consensus
  MISC_FEATURE (1)..(56): consensus for the disclosure of xaa see table XV
XXXXRTXXXDXXPXXXGXXFXXXXXXXXXXXXXXXXXXXXXXXXXXXGXXXXGTXX

SEQ ID NO: 18662 - protein, 105 aa, consensus
  MISC_FEATURE (1)..(105): consensus for the disclosure of xaa see table XV
XXXXDXRXXXSGPXXXXXXXXXXXXXXGSSIMPXKXNPXXXEXXXXXXXXXXXXXXXXXXXXXXXXXXLNXXXPXXXXXXXXXXXXXXXXXXXXXXXXXXXXXXX

SEQ ID NO: 18663 - protein, 550 aa, consensus
  MISC_FEATURE (1)..(550): Xaa in all Positions is any amino acid
XXXXXXXXXXXXXXXXXXXXXXXXXXXXXXXXXXXXXXXXXXXXXXXXXXXXXXXXXXXXXXXXXXXXRXEXDXXGXXXXPXXXYXGXXTXRAXXNFXIXXXXXXXXXXXXXXXXXXKXAXAXXNXXXXXXXXXXXXXIXXAXXXXXXXXXXXXXXFXXDXXQGGAGTSXNMNXNEVXANXAXEXXGXXXGXYXXXXPNXXVNXXQSTNDXXPTXXXXXXXXXXXXXLXXXXXXLXXXXXXKXXEFXXXXKXGRTXLQDAVPXXXGQEFXXXXXXXXXXXXXXXXXXXXXXXXXNXGXTAXGTGXNXXXXYXXXXXXXLXXXXXXXXXXAXXLXXATXXXXXXXXXXXXLKXXAXXXXKXXNDLRLLXSGPRXGXXEXXLPXXQXGSSIMPXKVNPVXXEXXNQXXXXVXGNDXXXXXAXXXGQLXLNXXXPXXXXXXXXSXXXXXXXXXXXXXXCXXGIXXNXXXXXXXXXXSXXXXTXLNPXXGXXXXXXXXXXXXXXGXXXXXXXXXXXXXXLXXXXXXXXXXXXXXXXPXXXXXXXXXXXXXXXXX

SEQ ID NO: 18664 - protein, 108 aa, consensus
  MISC_FEATURE (1)..(108): consensus for the disclosure of xaa see table XV
XXXKXXXXXXXXXXXXXXXXXXXXXXXXXXRXXXXXXXXXXXXXXXQXXXXXXXXXXXXXXXXXXXXXXXXXXXXXXTXXEXXDXXXXXXXXXXXXXXXXXXXXGXXP

SEQ ID NO: 18665 - protein, 968 aa, consensus
  MISC_FEATURE (1)..(968): Xaa in all Positions is any amino acid
XXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXIXXTXGPXXXXXXXXXXXXXXXXXXXXXXXXXXXXXXXXXXXGXXXXXRXNFSHGXXXXHXXXXXXXXXXXXXXXXXXXXXXXXXXXXDXXGPXIRXXXXXXXXXXXXXXXXXGXXXXXXXXXXXXXXXXXXXXXXXXXXXYXXXXXXXXXGXXXXXDDGXXXXXVXXXXXXXXXXXXXXXXXXXXXXXGXXXXXXXXXXXXKGXNXXXXXXXXXXXXXKDXXDXXXXXXXXXXXDXXXXSFXXXXXDXXXXXXXXXXXXXXXXXXXXXXXXKXEXXXXXXXXXXXXXIXXXXDXXMVARGDLGXEXXXXXXXXXQKXXIXXXXXXXKXVIXATQMLXSMXXXPXPTRAEXXDVANAXXDGXDXXMLSXEXAXGXXPXXXVXXMXXXXXXXEXXXXXXXXXXXXXXXXXXXXXXXXXXXXXXXXXXXXXXXXXXXXXXXXXXXXXTXXGXXXXXXXXXXXXXXXIXXXXXXXXXXXXXXXXXXXXXXXXXXXXXXXXXGXXXXXXXXXXXXXXXXXXXXXXXXXXXXXXXXXXXXXXXXXGDXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 18666 - protein, 64 aa, consensus
  MISC_FEATURE (1)..(64): consensus for the disclosure of xaa see table XV
XXXXXXQXGXGTXXNMNXNXVXXXXXXXXXXXXXXXXXXXXXPNXXXNXXXSXNDXXPXXXXXX

SEQ ID NO: 18667 - protein, 55 aa, consensus
  MISC_FEATURE (1)..(55): consensus for the disclosure of xaa see table XV
KXGRTHXXDAXPXXXXXXXXXXXXXXXXXXXXXXXXXXXXXXXXXXXTXXGXXXX

SEQ ID NO: 18668 - protein, 101 aa, consensus
  MISC_FEATURE (1)..(101): consensus for the disclosure of xaa see table XV
XXXXXXXXXXXXXXXDXXXXXXGPXXXXXEXXXXXXXXXXGSSXMPGKXNPXXXEXXXXXXXXXXXXXXXXXXXXXXXGXXXXXXXXPXXXXXXXXXXXXX

SEQ ID NO: 18669 - protein, 594 aa, consensus
  MISC_FEATURE (1)..(594): Xaa in all positions is any amino acid
XXXXXXXXXXXXXXXXXXXXXXXXXXXXXXXXXXXXXXXXXXXXXXXXXXXXXXXXXXXXXXXXXXXXXXXXXRXEXDXXGXXXVXXXXXXGAQTXRXXXNFXIXXXXXXXPXXXXXAXXXXKXXAAXXNXXXGXLXXXXXXXXXXXXXXXIXXAXXXXXXGXXXXXXXXFPXXXXQTGSGTXXNMNXNEVXXXXAXXXXXXXXXXXXXXXHPNDXVNXXQSSNDXXPTAXXXXXXXXXXXXLXPXXXXLXXXXXXKXXXXXXXXXXKXGRTHLXDAXPXTLGQEXXXXXXXXXXXXXXXXXXXXXXXXLXXGGTAVGTGXNXXXXXXXXXXXXXXXXTXXXFXXXXXNXFXXXXXXXXXXXXXGXXXXXAXXLXKIANDXRXXXSGPXXGXXEXXXPXXXXXPGSSIMPGKVNPXXXEAXXMXXXQVXGNXXXXXXXXXXXGXFXLNVXXPXXXXNXLXSXXLLXXXXXXXXXXXXXXXXXXXXXXXXXXFXXXXXXGXXXXXXXXXXXXXXSXXLVTXLXXXIGYXXAAXXAKXAXXXXXXXXXXXXXXXXXXXXXXXXXXXXXXXXPXXMXXXXXXXXXXXXXXXXXXXXX

SEQ ID NO: 18670 - protein, 194 aa, consensus; identical to SEQ ID NO: 4334
  MISC_FEATURE (1)..(194): consensus for the disclosure of xaa see table XV

SEQ ID NO: 18671 - protein, 61 aa, consensus; identical to SEQ ID NO: 4335
  MISC_FEATURE (1)..(61): consensus for the disclosure of xaa see table XV

SEQ ID NO: 18672 - protein, 15 aa, consensus
  MISC_FEATURE (1)..(15): consensus for the disclosure of xaa see table XV
LXXXXXXNXXXNAXX

SEQ ID NO: 18673 - protein, 922 aa, consensus
  MISC_FEATURE (1)..(922): Xaa in all positions is any amino acid.
GXLXXXXGXXXGVGKTXXMLXXAXXXXXXGXDXXXGXXEXHXRXXTXXLXXGXXXXPXXXXXXXXXXXXEXDXDXXXXXXXPXXXLXDELAHXNXXXXRXXKRXXDXXEXLXXGIDVXTTXNXQHXESLXDXVXXXTXXXXXETXPDXXXXXAXXXXLXDXXPXXLXXRLXXGXVYXXXXXXXAXXXXFXXXNLXALRELAXXXXAXXVXXXXXXXXXXXXXXXXXXXXXXXXXXXXXXXXXXXXXRXAXRXAXXXXXXXXXXXXXXXXXXXXXXXXXXXXXXXXXXLAXXLGXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXXXXXXXXXXXXXXXXXXXXXXXXFXXPXXXXXXXXXXXXXXXXXXXXXXXXXXXLXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXWXXXXXXXXGXXXXTXXXXXXXXXPXXXXXXXXXXXXXXXXXXXXXXXXXXXXXLXXXXXXXAXAXXXXXLXXXXXXXXXXXXXXXXXXXXXXXXRXXLLXXXSHDLRTPLXXXXGXXXXLXXXXXXXXXXXXXXXXXXXXXXXXXXXXXXXNLLDXXXXXXXXXXXXXXXXXXXXXXXXAXXXXXXXXXXXXXXXXXXXXXXXXXXXXXXDXXLXEXXXXNXXXNAXXXXXXXXXXXXXXXXXXXXXXXXXXXXXXXDXGXGXXXXXXXXXFXXFXXXXXXXXXXXXXXGXGLGLXXXXXXXXXXXGXXXXXXXXXXXXG

SEQ ID NO: 18674 - protein, 23 aa, consensus
  MISC_FEATURE (1)..(23): consensus for the disclosure of xaa see table XV
SXXTXXXXXXXLXXXXXXXXXXG

SEQ ID NO: 18675 - protein, 222 aa, consensus; identical to SEQ ID NO: 5291
  MISC_FEATURE (1)..(222): Xaa in all positions is any amino acid.

SEQ ID NO: 18676 - protein, 98 aa, consensus
  MISC_FEATURE (1)..(98): consensus for the disclosure of xaa see table XV
XXXXXXWXXXHXXXXXXXXXXXXXXXXXXXXXXXXXXXXXXXXXXXXXXXXXXXNXXXXXXXXXXXXXXXXXXXXXXXXXXXXXXXDYXXXXXXXXXX

SEQ ID NO: 18677 - protein, 47 aa, consensus
  MISC_FEATURE (1)..(47): consensus for the disclosure of xaa see table XV
XXXXXXXXXXXXXXXXXXXXXXXXXXXXXXXXXXXXXXXXXXXXXXX

SEQ ID NO: 18678 - protein, 117 aa, consensus
  MISC_FEATURE (1)..(117): consensus for the disclosure of xaa see table XV
XXXXXXXXXXXXXXXXXXXXXXXXXXXXXXXXXXXXXXXXXXXXXXXXXXXXXXXXXXXXXXXNXXXXXXXXXXXXXXXXXXXXXXXXXXXXXXXXXXXXXXXXXXXGXXXXXXXXX

SEQ ID NO: 18679 - protein, 75 aa, consensus
  MISC_FEATURE (1)..(75): consensus for the disclosure of xaa see table XV
XXXSXXXXXXXXXXXXXXXXXXXXXXXXXXXXXXXXXXXXXXXXXXXXXXXXXXXXXXXXXXXXXXXXXXXXXXW

SEQ ID NO: 18680 - protein, 33 aa, consensus; identical to SEQ ID NO: 4356
  MISC_FEATURE (1)..(33): consensus for the disclosure of xaa see table XV

SEQ ID NO: 18681 - protein, 36 aa, consensus; identical to SEQ ID NO: 4357
  MISC_FEATURE (1)..(36): consensus for the disclosure of xaa see table XV

SEQ ID NO: 18682 - protein, 39 aa, consensus; identical to SEQ ID NO: 4358
  MISC_FEATURE (1)..(39): consensus for the disclosure of xaa see table XV

SEQ ID NO: 18683 - protein, 323 aa, consensus; identical to SEQ ID NO: 5813
  MISC_FEATURE (1)..(323): Xaa in all positions is any amino acid.

SEQ ID NO: 18684 - protein, 62 aa, consensus
  MISC_FEATURE (1)..(62): consensus for the disclosure of xaa see table XV
XXXXXXXXGXXXXXXXXYXXXXXXXXXXXXXXXXXRXXXXXXXXXXXXXXXXXXXGXXXXXX

SEQ ID NO: 18685 - protein, 224 aa, consensus
  MISC_FEATURE (1)..(224): Xaa in all Positions is any amino acid.
XXXXXXXXXXXXXXXXXXXXXXXXXXXXXXXXXXXXXXGXXAXXXGXXXXXXXXYEXXGLXXXXXXRXXXXXRXYXXXXXXXXXXIXXXXXXGXXLXXXXXXXXXXXXXXXXXXXXXXXXXXXXXXXXXXXIXXLXXXXXXLXXXXXXXXXXXXXXXXXXXXXXXXXXXXXXXXXXXXXXXXXXXXXXXXXXXXXXXXXXXXXXXXXXXXXXXXXXXXXXXXXX

SEQ ID NO: 18686 - protein, 37 aa, consensus; identical to SEQ ID NO: 4448
  MISC_FEATURE (1)..(37): consensus for the disclosure of xaa see table XV

SEQ ID NO: 18687 - protein, 46 aa, consensus; identical to SEQ ID NO: 4449
  MISC_FEATURE (1)..(46): consensus for the disclosure of xaa see table XV

SEQ ID NO: 18688 - protein, 50 aa, consensus; identical to SEQ ID NO: 4450
  MISC_FEATURE (1)..(50): consensus for the disclosure of xaa see table XV

SEQ ID NO: 18689 - protein, 38 aa, consensus; identical to SEQ ID NO: 4451
  MISC_FEATURE (1)..(38): consensus for the disclosure of xaa see table XV

SEQ ID NO: 18690 - protein, 470 aa, consensus
  MISC_FEATURE (1)..(470): Xaa in all positions is any amino acid.
GXXXXXSXXXXXXXXXXXXXAXXXXXXXXXXXXXXXXXXXXXXXXXXXXXXXXXXXXXXXXXXXXRXPXXXXXXXRXXXNXGXXXXXDXHLSXXXXXXXXXXXXXXXXXXXXXDXAXXXXXXXXXXGXXXXXXSXGXXXXXXXXAXXXIXEXNXXXXXXXXXXXDXXXXXXXXXXXRXXXXXXXXXXXXGXXXXXXXXXKXXXXVXXXXXXXXXXXXXXXXXXXXIXXXXXXXXXXXXXXXXXXXXXXXLQXGXGXXXNAVXXXXXXXXXXXXXXXXXXXEVXQDXXXXLXXXGXXXXXXXXXXXXXXXXXXXXXXXXXXXXXXXXXXXXXXRXXXXXNXXXXXXRXGXXXXNXXXEXDXXGXXNSTXXXGXXXXNGXGGSXDFXRXXXXXXXXXXXXXXXSXXXXXXXXXXIXXXVPXXXHXDXXXXXXXXXXTEXGXADLRGXXPXXRAXXXIXXXXHPXXXXXLXXY

SEQ ID NO: 18691 - protein, 16 aa, consensus
  MISC_FEATURE (1)..(16): consensus for the disclosure of xaa see table XV
XXXXXXXXXXXXXXXX

SEQ ID NO: 18692 - protein, 60 aa, consensus
  MISC_FEATURE (1)..(60): consensus for the disclosure of xaa see table XV
XXXXXXXXXXXXXXXXXXXXXXXXXXRXPXXXXXXXXXXXNXXXXXXXDXXXXXXXXXXX

SEQ ID NO: 18693 - protein, 50 aa, consensus; identical to SEQ ID NO: 4455
  MISC_FEATURE (1)..(50): consensus for the disclosure of xaa see table XV

SEQ ID NO: 18694 - protein, 35 aa, consensus; identical to SEQ ID NO: 4456
  MISC_FEATURE (1)..(35): consensus for the disclosure of xaa see table XV

SEQ ID NO: 18695 - protein, 62 aa, consensus; identical to SEQ ID NO: 4457
  MISC_FEATURE (1)..(62): consensus for the disclosure of xaa see table XV

SEQ ID NO: 18696 - protein, 54 aa, consensus; identical to SEQ ID NO: 4458
  MISC_FEATURE (1)..(54): consensus for the disclosure of xaa see table XV

SEQ ID NO: 18697 - protein, 521 aa, consensus
  MISC_FEATURE (1)..(521): Xaa in all positions is any amino acid.
RXXXXXXXXXXXXXXXXXXXXXXXGXXXGXSGFTXXGXXKXXPXAXXXXXXXXXXXXXXXXXXXXXGASXXXXXXXXXXXXXXXXXXXXRXPXQXXXXXXXXINXGXXXXXDXHLSXXXXXXXXXXXXXXXXXXXXXDXAXXEXXXIXEXGXXXXXXSXGXXXXXXXXAXXXIXEXNXXXXXXXXGXHDXXXXXXXXXPXRXXXXXXXXXXRXGXXXXXXDXXKXXXXVXXXXXDXXXXXXXXDXXXXXIAXXXXXFXXXEVXXGRXXXXXXPLQXGXGXXXNAVXXGXXXXXXXXFXXXXXXXEVXQDXXXXLXXXGXXXXASXXSXXXSXXXXXXXXXXXXXXXXXXXXLRXQXXSNXPEXXRRLGXIXXNXXXEXDIYXXXNSTXVXGXXXXNGXGGSXDFXRNXXXXXXXXXSXXXXXXXXXXISXXVPXXXHXDHXEHDXXXXXTEXGXADLRGLXPXXRXXXIIXXCXHPXYXXXLXXYXXXAXXXXXXXXXXXXPHXLXXAXXXHXXXXXXGXM

SEQ ID NO: 18698 - protein, 396 aa, consensus
  MISC_FEATURE (1)..(396): Xaa in all positions is any amino acid.
RXPXXXXXXXXXXXNXXXXXXXDXXXXXXXXXXXXXXXXXXXXXXXXXXXXXXXXXXXXXXGXXXXXXXXGXXXXXXXXXXXXXXEXNXXXXXXXXXXXDXXXXXXXXXXXRXXXXXXXXXXXXGXXXXXXXXXXXXXXXXXXXXXXXXXXXXXXXXXXXXXXXXXXXXXXXXXXXXXXXXXXXXQXGXGXXXNAXXXXXXXXXXXXXXXXXXXXEVXQXXXXXXXXXXXXXXXXXXXXXXXXXXXXXXXXXXXXXXXXXXXXRXXXXXNXXXXXXRXGXXXXNXXXXXDXXXXXNSTXXXGXXXXNGXGGSXDFXRXXXXXXXXXXXXXXXXXXXXXXXXXVPXXXHXDXXXXXXXXXXXXXGXXDXRXXXPXXXXXXXXXXXXXXXXXXXLXXY

SEQ ID NO: 18699 - protein, 21 aa, consensus
  MISC_FEATURE (1)..(21): consensus for the disclosure of xaa see table XV
XXXXXXXXXPGXGKXTXXXXX

SEQ ID NO: 18700 - protein, 17 aa, consensus
  MISC_FEATURE (1)..(17): consensus for the disclosure of xaa see table XV
XXXXXXDGFHXXXXXXX

SEQ ID NO: 18701 - protein, 18 aa, consensus
  MISC_FEATURE (1)..(18): consensus for the disclosure of xaa see table XV
XGXXXTFXXXXXXXXXXX

SEQ ID NO: 18702 - protein, 94 aa, consensus; identical to SEQ ID NO: 12133
  MISC_FEATURE (1)..(94): consensus for the disclosure of xaa see table XV

SEQ ID NO: 18703 - protein, 312 aa, consensus; identical to SEQ ID NO: 12134
  MISC_FEATURE (1)..(312): Xaa in all positions is any amino acid.

SEQ ID NO: 18704 - protein, 212 aa, consensus; identical to SEQ ID NO: 1948
  MISC_FEATURE (1)..(212): consensus for the disclosure of xaa see table XV

SEQ ID NO: 18705 - protein, 223 aa, consensus
  MISC_FEATURE (1)..(223): Xaa in all positions is any amino acid.
FXAXXEXXXXXPXXXXXXXXXXXXXXXXXXXXXXXXXXXXXXXXXXXXXXXXXXPLWXAXXLKXXXXCXXXXPXWXXXXXLXXXXXXXXXXXXXXXXXXXXXXXXXXXXXXXXXXXXXXXXXXXXXXXXXXXXXXXXXXXXXXXXXXXXXXXXXXXXPXXXXXXXXXLXXXXXXDXXXXXXXXRXXXXDXXXXRXXKXXXXXXXXXXXXXXXXXXXXNXXXXE

SEQ ID NO: 18706 - protein, 20 aa, consensus
  MISC_FEATURE (1)..(20): consensus for the disclosure of xaa see table XV
PXXXXXXXXXXXXGXNGKXX

SEQ ID NO: 18707 - protein, 74 aa, consensus; identical to SEQ ID NO: 15683
  MISC_FEATURE (1)..(74): consensus for the disclosure of xaa see table XV

SEQ ID NO: 18708 - protein, 8 aa, consensus
  MISC_FEATURE (1)..(8): consensus for the disclosure of xaa see table XV
XXXDXXHN

SEQ ID NO: 18709 - protein, 542 aa, consensus; identical to SEQ ID NO: 15685
  MISC_FEATURE (1)..(542): Xaa in all positions is any amino acid.

SEQ ID NO: 18710 - protein, 80 aa, consensus; identical to SEQ ID NO: 4378
  MISC_FEATURE (1)..(80): consensus for the disclosure of xaa see table XV

SEQ ID NO: 18711 - protein, 58 aa, consensus; identical to SEQ ID NO: 4379
  MISC_FEATURE (1)..(58): consensus for the disclosure of xaa see table XV

SEQ ID NO: 18712 - protein, 86 aa, consensus; identical to SEQ ID NO: 4380
  MISC_FEATURE (1)..(86): consensus for the disclosure of xaa see table XV

SEQ ID NO: 18713 - protein, 451 aa, consensus
  MISC_FEATURE (1)..(451): Xaa in all positions is any amino acid.
  for the disclosure of the amendment in position 44 see table XVI
FXDVAGXXEXKXEXXEXVXFLXXPXXXXXXGXXXPXGXLLXGPPGTGKTLLAXAXAGEAXVPFFXXSGSXFXEMFVGVGAXRVRDXFXXAKXXXPCIXFIDEIDAXGXXRXXXXXXXGGXDEREQTLNELLXEMDGFXXXXXXXXXXIXXAATNRXDXLDXALLRPGRFDRXXXVXXPDXXGRXXILXXHXXXXXXXXXXXXXXXXXXXAXXTPGXXGADLXNXXNEAAXXAXRXXXXXXXXXXXXXAXXXXXXGXXXXXXXXXXXXXXXXXAYHEXGHXXXXXXXXXXXXXXXKXXIXPRGXXAXGXXXXXPXXXXXXXXXXXXXXXXXXXXXXXGGRXAEEXXXXXXXXXXGAXXDXXXXTXXAXXMVXXXGXSXXXGXXXXXXXXXXXXXXXXXXXXXXXXXSXXXXXXIDXEXXXXXXXXXXXXXXXXXXXXXXXXXXXXXLXXXET

SEQ ID NO: 18714 - protein, 26 aa, consensus
  MISC_FEATURE (1)..(26): consensus for the disclosure of xaa see table XV
XXXGXXXXXXXXXXXXXXXXXXXXXX

SEQ ID NO: 18715 - protein, 16 aa, consensus
  MISC_FEATURE (1)..(16): consensus for the disclosure of xaa see table XV
XXXXXXXXXXXXXXXX

SEQ ID NO: 18716 - protein, 22 aa, consensus
  MISC_FEATURE (1)..(22): consensus for the disclosure of xaa see table XV
XXXXXXXXXHXXXGXXXXXXXX

SEQ ID NO: 18717 - protein, 547 aa, consensus
  MISC_FEATURE (1)..(547): Xaa in all positions is any amino acid.
LVXXMXXXGXXXXXXGXXRXKXXXXXXXXXXXXXXXXXXXXXXXGXXXXFXXXXXXXXXXXXXXXXXXXXXXXXXXXXXXXXXXXXXXXXXXXXXXXXXXXXXXXXXXXXXQXXFAXXXXXXXXGXXXXRXXXXXXXXFXXXXXXXXYXXXXXXXWXXXXXXXXXXXXXXXXXXXXXXXXXXXXXXXXXXXXXXXXXXXXGXXDFAGGXXVHXXXGXXXLXXXXXXGXRXXXXXXXXXXXXXXXXXXXXXXXXXXXXXXXXXXXXXXXXXXXXXXXXXXXXXXXXXHXXXXXXXGXXXLWXGWXGFNXGSXXXXXXXXXXXXXXXXXXXXXXXXXXXXXXTXXXXXXXXXXXXXXXXXXXXXXXXXXXXXXXGXXXGLVXITXXXXXXXXXXXXXXGXXXXXXXXXXXXXXXXXXXXXXXXDDXLXXXXXHXXXGXXGXXXXGXXXXXXXXXXXXXXXXXXXXXXXXXXXXXXXXXXXXXXXXXXXXXXXXXXXQXXXXXXXXXXXXXXXXXXXXXXXXXXXXXXXXXXXXXDXXGXDXXXHXXXXY

SEQ ID NO: 18718 - DNA, 1332 bp, Saccharomyces cerevisiae
  CDS (1)..(1332)
atgaaatacaaggaaatcaatttcttcaagggccatccgagctcgaggttgctgcctcgagaagcagtaattcaagcgactgcggctatattggggcccgagaccagggagtacgataacgacccctataacaggcatccgctgacgtacggttcggacgaaggtgccctgtgggtgcgagagcagatttgtacgtttctgaatgatcagctgtttaagttcgaaaatggggctcggagcaggacacgggcagactatttgaatctgaatagcggcgcttcgtatggcatgctgaacatccttctgcaaacaaccttgccacataacgggtataccaggcaggcgttcatcatcacgccaacatatttcttgatcaacaattgcttcacagatgcgggattcaaggggaaaatgaccgccatcaacgagcagggccacgactcgattgatttcgagtcgttgatttctgcccttgagcagcacgaggcggagccgcagccccatagtaccacagagatgattcaggggccaaagttgaccaagaaggtctacaggtacgttatgtactgcatcccgacgtttgcaaacccatcgggaaacacatactcgcttgagaccagacgcagacttatcgacatcgctcggaagtacgacatgctgataatcactgatgacgtgtacgatattctagattacacgacgccctcagatgagctgccctctccgcccctaaggatggtgcacatagacagaagtacagcgccctccggtgaggactcgttcgggaatacagtgtccaacgcaactttctccaagctgatcgcccctgggctcagatttggataccatgagtcaatcaacgcgaatctcgccagacagctatctaaaggtggtgcaaacgtctctggcggaactccctcacaactgaactccatgatcgtgggtgagatgctgcgtagtggtgccgcccagagatgcattgcacatctgagatccgtatactccgagagggccactgtcttgacctcggcgcttaagaaatacatgcccctaggaaccgagattatgccattgaagggcggctattttacttggatcactctcccaccagcgtacaatgccatggagatatccactattcttgccaagaaatttaatgtcatccttgccgacggctccaatttcgaggtcatcggcgatgagaaaaactggggtcagtcatgctttaggctttctattagtttcttagaagttgatgatatcgacaggggcattgagctgtttggtgctgtttgcaaatctcatgcgatcaccaataacataactatgtag

SEQ ID NO: 18719 - protein, 443 aa, Saccharomyces cerevisiae
MKYKEINFFKGHPSSRLLPREAVIQATAAILGPETREYDNDPYNRHPLTYGSDEGALWVREQICTFLNDQLFKFENGARSRTRADYLNLNSGASYGMLNILLQTTLPHNGYTRQAFIITPTYFLINNCFTDAGFKGKMTAINEQGHDSIDFESLISALEQHEAEPQPHSTTEMIQGPKLTKKVYRYVMYCIPTFANPSGNTYSLETRRRLIDIARKYDMLIITDDVYDILDYTTPSDELPSPPLRMVHIDRSTAPSGEDSFGNTVSNATFSKLIAPGLRFGYHESINANLARQLSKGGANVSGGTPSQLNSMIVGEMLRSGAAQRCIAHLRSVYSERATVLTSALKKYMPLGTEIMPLKGGYFTWITLPPAYNAMEISTILAKKFNVILADGSNFEVIGDEKNWGQSCFRLSISFLEVDDIDRGIELFGAVCKSHAITNNITM

SEQ ID NO: 18720 - DNA, 1278 bp, Caulobacter crescentus
  CDS (1)..(1278)
atgtcatcttcagttcggactttgatcacccctatgacgacccagacttcagagcgcgcccaggactgggccggccgcttcagcgaacgcatgagccgcgtccgcgccagcgagatccgcgagcttctcaagctgctcgaccagcccgacattctgtcgttcgccggcggcattcccgatccgggcctcttccccgcgcaggagatccagaagggctacgacgccattctggccgatcccgtcctgtcgcgtcaggcgctgcagtactcggtcagcgaaggctacctgccgctgcgccagtggatcgccgaacgcatgacccgcgacggcatgccgtgcggtcccgataacatcatgctgaccgccgggtcgcagcaggcgctcgacctgatcggcaagctgttcctgaccaagggcgacacggtgatggtcgcgcgtccgacctatctgggcgcgctgcaggccttcaacggctatgagccggcctatctggacctgccggagacggcgctgagccagggcgtggacgaggcggccctgatggccggacgcgcgccgaggccgctgggctatttcgtgcccgacttcgccaatcccacgggcgtcagcctgaccctggccgagcgcgaggcgctgttggccatggccgatcgtctggatatgaccctcgtcgaagacgcggcctatcgcgagttgcggttcgccggcgaggcgacgccgacggtgctgggcctggacatcacgcgctcgggcgggatcgacaatgcccggacgctgttcctgggcaccttgtccaaaaccctctcgccggccttgcggatcggctgggtctgcgggcccaaggccgtgattgagaagctggtgctgctcaagcagggcgctgacctgcacgtctcgacgattaaccagatggtcgcccatcgcgcggtgaccgagggctatgaccaacacctgcaccgcctgcgcggcgcctatggggccaaggcgcgcgtgatgctggcggcgctggagcggaccatgcccaagggcgtgacctggtcgcatcccgaaggaggcatgttcgtctggatcgacctcccggaggggatcgacggcgcggctctgctggcgcgggctatcgaagaagagcgcgtggccttcgtgcccggcgcgccgttcttcgccgagaaccaaaccccgaacgcgatccgcctcagctactcgctaccgaccgacgcgcagatcgaggagggcgtgcagcgcctggcgcggctgatcgggaaggcgatcaacgcctag

SEQ ID NO: 18721 - protein, 425 aa, Caulobacter crescentus
MSSSVRTLITPMTTQTSERAQDWAGRFSERMSRVRASEIRELLKLLDQPDILSFAGGIPDPGLFPAQEIQKGYDAILADPVLSRQALQYSVSEGYLPLRQWIAERMTRDGMPCGPDNIMLTAGSQQALDLIGKLFLTKGDTVMVARPTYLGALQAFNGYEPAYLDLPETALSQGVDEAALMAGRAPRPLGYFVPDFANPTGVSLTLAEREALLAMADRLDMTLVEDAAYRELRFAGEATPTVLGLDITRSGGIDNARTLFLGTLSKTLSPALRIGWVCGPKAVIEKLVLLKQGADLHVSTINQMVAHRAVTEGYDQHLHRLRGAYGAKARVMLAALERTMPKGVTWSHPEGGMFVWIDLPEGIDGAALLARAIEEERVAFVPGAPFFAENQTPNAIRLSYSLPTDAQIEEGVQRLARLIGKAINA

SEQ ID NO: 18722 - DNA, 1449 bp, Bacillus subtilis
  CDS (1)..(1449)
atgagctttccagaagaaaaaaagatgaaaaagctccctaagtacagacaaatcgttcattttattaaagagaaaataggaaatggagagtggccgattggaagcaagattccaagccagcgcacgcttgcaaaagattttcaggtaaatcggagcacagtgattacagcgttagaggaattgatggccgatgggctaatagaaggcacaatggggaaaggcacagttgttatcaacaacacatggacactgatggctaagaattctgctcccgattgggatcaatatgtcacctctggcattcagatgccaagccgaaaaatcgttcaagagataaatcaatcagaatcaaatacagaccttatacagctcagtaaaggtgaactttcagctgagatttttcctttggctgttatgaaagagatgatggggaaggtatctcaacacatggaggcattcggatatgaagaaccaaaaggttacttacctttgagggaggcattaagcaactatttaaaaaccattggaatcaacgtctcatcttcttccattctgattgtctcaggagcgttgcaagccttgcagctgatatcaatggggctgttacaaagaggatcaaccgtttatcttgatcagccctcctacctttattcattacacgtatttcaatcagctggtatgaagctgactggacttcctatggataatgaaggacttttgcctgaaaatgttcatttaacaagaggagagcggggaagggctatcttatatacaaatccatgttttcacaatccgactggtattcttatgtctaaaaagcgacgggaagaaatcctagcagtaagtgagaatacacagcttcctattattgaagatgacatttatcgtgagttatggatcgatgaaattccgccatatcctattaaaacaattgataaaaatggacacgtactgtacataggaagtttatcgaaaacattaagcccaggtttgaggattggatggatcgtcggaccggaaccggtgattgaacgtttatctgacattaaaatgcaaacagattacggatccagttcgctatcccagagagtagcggcagagtggtttacttccggccactaccagcagcatgtagaaaaggttaggcagcaattaaaggtgagaagagaattggccttgagtgctttagaaactcatttgaaagaagtggcgacatggaatatcccaaaaggagggttttttgtctggataaaaatattgccttccatatcaatgaaattactttatactaaagccttatcaaaagggattctgatcaatctcggcagtatctatgctcaggaaaaagggaattatattcgcttatcatatgcttatgcatctcttgaagaccttcaaaaggggatttatgagttgggtttaatgattaaagaattggcaagcaggtaa

SEQ ID NO: 18723 - protein, 482 aa, Bacillus subtilis
MSFPEEKKMKKLPKYRQIVHFIKEKIGNGEWPIGSKIPSQRTLAKDFQVNRSTVITALEELMADGLIEGTMGKGTVVINNTWTLMAKNSAPDWDQYVTSGIQMPSRKIVQEINQSESNTDLIQLSKGELSAEIFPLAVMKEMMGKVSQHMEAFGYEEPKGYLPLREALSNYLKTIGINVSSSSILIVSGALQALQLISMGLLQRGSTVYLDQPSYLYSLHVFQSAGMKLTGLPMDNEGLLPENVHLTRGERGRAILYTNPCFHNPTGILMSKKRREEILAVSENTQLPIIEDDIYRELWIDEIPPYPIKTIDKNGHVLYIGSLSKTLSPGLRIGWIVGPEPVIERLSDIKMQTDYGSSSLSQRVAAEWFTSGHYQQHVEKVRQQLKVRRELALSALETHLKEVATWNIPKGGFFVWIKILPSISMKLLYTKALSKGILINLGSIYAQEKGNYIRLSYAYASLEDLQKGIYELGLMIKELASR

SEQ ID NO: 18724 - DNA, 1404 bp, Clostridium acetobutylicum
  CDS (1)..(1404)
atggaaaagtacaagatttgttttgaagaagaaattcctaagtatattcaaatagctaaaaatataaaaaaacttatcgataatggtgaagtttgtgatggagaaaagctgccatctataagaaagctatcggagtttttaggtgttaacaatgataccatagttaatgtatacaaaaagcttcagagtgaaggatacgcttttttaaaaatgggaagtggaacctatgcaaaaaaaagagatataaataaaagacttttaagagactattcaaatacatttaaaagaattagcaaggaagactatgatgactatgttgattttgcagaagagaacccttgcgcagagttttttccagtagataattttaaaaaggtaataaatgaagttcttgatagggatggagtggatgctttatcgtatgaggaaactttaggatatgaagggcttaggagtaatataagtaagtatttttggaatggagagatagattctgagagaatactaatagtttctggagcgcagcagggtatagatataatatcaaaagctattgtaaatgtaaatgacaatataatagtagaaaagccaacctacagtggagcgctttctatatttaaatggagaagagcaaacatatttgaagtagatatggaatgtggtggcattaatatagatgagtttgaaaaaattttaaagaaaaataatataaaatgcttttataccatgtcatattttcaaaatccaacaggtttatcatatagctatgaaaaaaagaaaaaaataatagagcttgctaataagtatgatttctatatcatagaagatgattatctttctgaaataagatatgatgagcgtattgattatacaagttttaaggctatagacgaaggagacagagttatatacataaagagtttttccaaaatatttctcccgggaattagaataggttatttggttatgccaagtaaaattaaggagcaaatagagaactcaaaaataaatactgacatatctacatctagtttgatgcagagagctttagatttatatattaaaaatggttattggaaaaagtatataaatgaaataaatattatatatgaaaaaagatataatttcatgataaataatttttcaagtgttcttaaagataaagtgcagtttataagtcctggaggagggtttagtttttatttgaaaataaatgatttaataaaaaagagttgcattgatttattttatgaatgtaaaagaaataaagtattaattacaccaggagtatttttttataaagatgcagctaacggtcttaattattttaaagttggtttttcaaagactaatgaggacaaaattcaaagaggaattgatgttataaacagcatattaaaataa

SEQ ID NO: 18725 - protein, 467 aa, Clostridium acetobutylicum
MEKYKICFEEEIPKYIQIAKNIKKLIDNGEVCDGEKLPSIRKLSEFLGVNNDTIVNVYKKLQSEGYAFLKMGSGTYAKKRDINKRLLRDYSNTFKRISKEDYDDYVDFAEENPCAEFFPVDNFKKVINEVLDRDGVDALSYEETLGYEGLRSNISKYFWNGEIDSERILIVSGAQQGIDIISKAIVNVNDNIIVEKPTYSGALSIFKWRRANIFEVDMECGGINIDEFEKILKKNNIKCFYTMSYFQNPTGLSYSYEKKKKIIELANKYDFYIIEDDYLSEIRYDERIDYTSFKAIDEGDRVIYIKSFSKIFLPGIRIGYLVMPSKIKEQIENSKINTDISTSSLMQRALDLYIKNGYWKKYINEINIIYEKRYNFMINNFSSVLKDKVQFISPGGGFSFYLKINDLIKKSCIDLFYECKRNKVLITPGVFFYKDAANGLNYFKVGFSKTNEDKIQRGIDVINSILK

SEQ ID NO: 18726 - DNA, 1287 bp, Pyrococcus horikoshii
  CDS (1)..(1287)
atgcatgaagatgttcagctgaacatatatgttcactctcaggagggaattgggatggaagagaacattaaaagcatgcttggggatgttgaaaggttcttctcgaaaaaagctctagaaatgagggcttcagaggttagagagctattaaaacttgtagaaactagtgatataataagcctagcaggagggctgcctaaccccaaaacattcccaaaggagattattagagatatcctagtggagatcatggagaaatacgctgacaaagctttacaatatggaactacaaaaggattcacgcctctaagggaaactctaatgaaatggctaggaaagaggtatggaatatcccaggataatgatataatgataacaagtggttctcagcaagcgttagacttgattggtagggtgtttttgaacccaggggacatagttgttgtagaagccccaacgtatttagcggcactccaagcttttaacttctatgagccccaatacatccaaattcccctagatgatgagggtatgaaggttgagatacttgaagaaaagctcaaggaacttaaatcccaaggaaagaaagtgaaagtagtatacacagttccaacgtttcagaatccagccggagttacaatgaacgaagataggaggaaatatctcctggagctcgcgagtgagtatgatttcatagtcgttgaagatgatccttacggagagctaagatactcaggaaatccagaaaagaagataaaggccttggataacgagggtagagtaatttatctaggaacgttctcaaaaatattagctccagggtttagaattggatggatggttggagatcctggaattataaggaagatggaaattgcaaagcaaagcaccgatttatgcacaaatgtcttcggtcaagtagttgcctggaggtatgttgatggtggatacctcgaaaagcatatcccagagataaggaaattctacaagccaagaagggatgcaatgctcgaggccttagaggagttcatgcctgaaggcgttaagtggacaaagcctgaaggaggaatgttcatctgggtaacgcttccagatggaatagactcaaagaaaatgcttgaaagggctataaagaagggagtagcctacgtccctggggaagcattttatgcgcatagggatgttaagaacacaatgagactcaactttacgtacgtggatgaagacaaaataatggagggaataaagagacttgcagaaactataaaagaggagctcaaggcttag

SEQ ID NO: 18727 - protein, 428 aa, Pyrococcus horikoshii
MHEDVQLNIYVHSQEGIGMEENIKSMLGDVERFFSKKALEMRASEVRELLKLVETSDIISLAGGLPNPKTFPKEIIRDILVEIMEKYADKALQYGTTKGFTPLRETLMKWLGKRYGISQDNDIMITSGSQQALDLIGRVFLNPGDIVVVEAPTYLAALQAFNFYEPQYIQIPLDDEGMKVEILEEKLKELKSQGKKVKVVYTVPTFQNPAGVTMNEDRRKYLLELASEYDFIVVEDDPYGELRYSGNPEKKIKALDNEGRVIYLGTFSKILAPGFRIGWMVGDPGIIRKMEIAKQSTDLCTNVFGQVVAWRYVDGGYLEKHIPEIRKFYKPRRDAMLEALEEFMPEGVKWTKPEGGMFIWVTLPDGIDSKKMLERAIKKGVAYVPGEAFYAHRDVKNTMRLNFTYVDEDKIMEGIKRLAETIKEELKA

SEQ ID NO: 18728 - DNA, 1233 bp, Pyrococcus abyssi
  CDS (1)..(1233)
atggaagaagaaattaagagcatgcttggaaatgttgagagattcttctcaaagaaggccatggaaatgaaggcctccgaggttagggaattactcaagctcgtcgagactagcgatataataagtctcgccgggggattgccaaatccaaaaacgttcccaaaagaaatcattaaggagattctcatcgaaattatggaggagcacgctgataaggccctgcaatatgggacaaccaaaggattcaccccactaagggagaccctacttgactggcttgaaaagagatacgggatatccaaggaaaacgatataatgataacgagcggttctcaacaggccctagatctaattggaagggtgtttattgatcctggggacatagttatagtggaggccccaacgtacctagcggcattacaagccttcaacttctatgagccaaagtacatccaagttccgctagatgataacggaatgaacgttgaagccctagaggatgagcttagaaagctaaaggctgaaggaaagaaggttaagatagtttacacagtcccaacttttcaaaacccggcaggagttacgatgagtgaagagagaagaaagcacctgatagagttagcaagcgaatatgacttaatagtcatagaagacgatccatatggagagctaaggtattcagggaagcctaaaaagaagataaaagctctagacaaagaaggcagggtgatatacttgggaaccttctccaagatccttgccccaggatttaggataggttggatcgttggagacccaggaatcataaggaagctcgagatagctaagcagagtactgacctctgtactaacgtctttggtcaagtagtagcctggaagtacgttagtgagggccacctggatagacacattccaaagattagggaattctacaagccaaggagagatgctatgcttgaagccctcgaggagtttatgccagaaaacgttaagtggacgaaaccagagggcggaatgttcgtctgggtaaccctaccggatggcatagattcaaagaagatgctagaaaaggctgttaagaaaggagtagcctatgtccctggggaagccttctacgcttacagggacgttaagaacacgatgagactcaacttcacgtacgttgatgaggataagataagggagggtgttaagaggctggctgaaacgatcaaggaagagacaggagtttga

SEQ ID NO: 18729 - protein, 410 aa, Pyrococcus abyssi
MEEEIKSMLGNVERFFSKKAMEMKASEVRELLKLVETSDIISLAGGLPNPKTFPKEIIKEILIEIMEEHADKALQYGTTKGFTPLRETLLDWLEKRYGISKENDIMITSGSQQALDLIGRVFIDPGDIVIVEAPTYLAALQAFNFYEPKYIQVPLDDNGMNVEALEDELRKLKAEGKKVKIVYTVPTFQNPAGVTMSEERRKHLIELASEYDLIVIEDDPYGELRYSGKPKKKIKALDKEGRVIYLGTFSKILAPGFRIGWIVGDPGIIRKLEIAKQSTDLCTNVFGQVVAWKYVSEGHLDRHIPKIREFYKPRRDAMLEALEEFMPENVKWTKPEGGMFVWVTLPDGIDSKKMLEKAVKKGVAYVPGEAFYAYRDVKNTMRLNFTYVDEDKIREGVKRLAETIKEETGV

SEQ ID NO: 18730 - DNA, 1263 bp, Deinococcus radiodurans
  CDS (1)..(1263)
atgcggtgcatgacccccgcttccaccggccccgtctccactggtcctgtccctattggccccgacctcttggcctgcatctcgcgccgcgcccagaccatgacggcgagcgccatccgcgaaatcctgaaaatcacccagcagcccgacgtgatttctttcgccgggggcctgcccgcaccggagctgtttccgctggacgccgtgcggcaggccgctgaaaccgcgctcagcaagtacggccccgccgcgctgcaatactcgaccaccgagggccacctgccgctgcgcgagtggattgctgggcgtcacggcatccccgccgcgaacgtgcagatcgtgaccggcagccagcaggggctcgacctgctcggcaaaattctgattgacgagggcgacctcgtgctcgtcgaggcgccgacctacctgggcgccctgcaatcgtttcagccgtacctgccgcgctacgccgagatgcccaccgacgagggcggcattgacgtggacgcgcttgccacgctgctcgccgggctggcggcgcagggagaaaagcccaaactgctctacgccatccccaacttccagaaccccaccgggcgcacgctgagtttggaacgccgccgccgtttggtcgagctgaccgcgcagtacggtgtgctggtcatcgaggatgacccctacggccagttgcgcttcagcggcgaggcgctgcccagcctctacgagattggtctggaactcgcgggcgacgtggaccgcaatcacgtcatctacagttcgagcttttccaagacgctggtgccggggctgcgcgacgcctgggtggaggccgccgcgccggtcatcaccaagctgattcaggccaaacagggcgccgacctgcacacgccgacgctcaaccagatgatgattaccgagctgctgccgctgctccccgcgcaaatcgagacggtcaaggccgcctaccgcgagcgcggcgcccacatgctcagccagatggacgaatttttcccggcgggcgtgacctacacccggccccagggcgggatgttcctctgggtgacgctgccggaaggcgtggatacggtcgcgctgctgccccgcgccgtggaaaacaaggtggcctacgtccccggtcagcccttttttgccctcggcggcggcgccaacaccatgcgcatgagctacagcagcgcgacccccgagcagattacccaggggatgcgcgcgctcggcgccactttccgcgaggccctcggttga

SEQ ID NO: 18731 - protein, 420 aa, Deinococcus radiodurans
MRCMTPASTGPVSTGPVPIGPDLLACISRRAQTMTASAIREILKITQQPDVISFAGGLPAPELFPLDAVRQAAETALSKYGPAALQYSTTEGHLPLREWIAGRHGIPAANVQIVTGSQQGLDLLGKILIDEGDLVLVEAPTYLGALQSFQPYLPRYAEMPTDEGGIDVDALATLLAGLAAQGEKPKLLYAIPNFQNPTGRTLSLERRRRLVELTAQYGVLVIEDDPYGQLRFSGEALPSLYEIGLELAGDVDRNHVIYSSSFSKTLVPGLRDAWVEAAAPVITKLIQAKQGADLHTPTLNQMMITELLPLLPAQIETVKAAYRERGAHMLSQMDEFFPAGVTYTRPQGGMFLWVTLPEGVDTVALLPRAVENKVAYVPGQPFFALGGGANTMRMSYSSATPEQITQGMRALGATFREALG

SEQ ID NO: 18732 - DNA, 1425 bp, Pseudomonas aeruginosa
  CDS (1)..(1425)
atgaccctttatctgcaactcgccgagaccctcggttcgcgcatcgaacagggcctctaccgtccgggcgaccggctgccctcggtgcgggccatgagcatcgagcacggcgtcagcctgagcaccgtgcaacaggcatacaggctgctggaagatcgcgggctggccgagccgcggccgaagtccggctatttcgtcccggccgcgcgacagatgccgccgctgccggcgatcgcccgcctggcccagcggccggtggaaatctcgcaatgggagcaggtgctggccctggtcagcacggtaccgcggccggacgtcgtccagctcggccgcggcatgccggacatctccagcccttcgctgaaaccgctgacccgcagcctggcccggctcaaccgccacgccgacgcccgtgcgctggcctacgacgggatccacggctcgccgttgctgcgcgaggaagtcgcccgcctgttggtggactccggctgtcgggccaccgccagcgacgtggtgatcaccaccggctgccacgaggccctgtcggtgagcatccgcgcggtgtgcgaaccgggcgatatcgtcgcggtggagtcgccgagcttccatggcgccatgcaatcgctgaaaggcctcggcatgaaggccctggagatccccaccgatccggtcaacggcatcagcctggaagccctcgaactggcgctggaacagtggccgatcaaggccatccaggtgaccccgaactgcaacaacccgctcggctacatcatgcccgagtcgcgcaagcgggcgctgctggccctggcccagcgctacgacgtggcgatcatcgaggacgatgtctatggcgacctggcctacacctatccgcgcccgcgcaccatcaagtcgtacgacgacgatggccgggtgctgctctgcgggtcgttctccaaggtcctggcgccgggcctgcggatcggctggatggtacccgggcgctacgccgaccgcgtgctgcacatgaagtacatcagtaccggcgccagcgccctgcaaccgcaactggcgatcgccgaattcatcggcaacggccactacgagccgcacttgcggcgcatgcgcgcccagtaccagcgcggacgcgacctgatgatcgactgggtggcgcgctatttcccggagggcacccgcgccagccggccccagggcggtttcctgctctgggtcgaactggacgaggcgttcgacaccctgcgcctggacaaggccttgcgcaaccgcggcgtacaagtcgcggtgggctgcatcttttccgcttccggcaagtatcggaactgcctgcggatgaactacgcggcgttgccgaccccggccatcgagcaggcggtcaggcgagtaggggagagcgcttgcgagctgctggagccttgcgaggcctga

SEQ ID NO: 18733 - protein, 474 aa, Pseudomonas aeruginosa
MTLYLQLAETLGSRIEQGLYRPGDRLPSVRAMSIEHGVSLSTVQQAYRLLEDRGLAEPRPKSGYFVPAARQMPPLPAIARLAQRPVEISQWEQVLALVSTVPRPDVVQLGRGMPDISSPSLKPLTRSLARLNRHADARALAYDGIHGSPLLREEVARLLVDSGCRATASDVVITTGCHEALSVSIRAVCEPGDIVAVESPSFHGAMQSLKGLGMKALEIPTDPVNGISLEALELALEQWPIKAIQVTPNCNNPLGYIMPESRKRALLALAQRYDVAIIEDDVYGDLAYTYPRPRTIKSYDDDGRVLLCGSFSKVLAPGLRIGWMVPGRYADRVLHMKYISTGASALQPQLAIAEFIGNGHYEPHLRRMRAQYQRGRDLMIDWVARYFPEGTRASRPQGGFLLWVELDEAFDTLRLDKALRNRGVQVAVGCIFSASGKYRNCLRMNYAALPTPAIEQAVRRVGESACELLEPCEA

SEQ ID NO: 18734 - DNA, 1224 bp, Aeropyrum pernix
  CDS (1)..(1224)
atgcgcagcgacatggtagattacgacaggcttttctcagagattacaaggcgtttcagagcgtctgacgtgagagagcttctcaagcttactgagggcaagagagtcataagcttcgcaggtggacttcccgaccccagggttttcccagctgaggagctggctgatatagctaggaatgttgtctccgagcttggcgataaggctctccagtacagccctacaccgggagtctccatctttagggagagggctctctcgtttcttgagcgtatgggcttgaagactagtgataggcagctactggttactactgggagccaggaggccctcttcctgacagccctgtccactctgtctccgggcgacgtggtcattatggaggagcccggctatctggccgctataaacgtgttcaaagcacttggagctaggatagttccagtaccagtagacgataagggcctcaacacgggcgtgctggctgaaactcttgacaggctagatgctgagggggttaagccgaagcttgtctacactaaccctacatgcaacaatcctaacggcactacaatgccgcttgataggaggcgggaactgcttcagctggcctcaaactatgacatgctggtgatagaggatgacccctatagccacatagccttcgagaagacgggcgaagaggtgcctctacaggcgctcgactctgaaggtagggttgtctatgtgacaaccttcagcaaaatactggcaccgggcctgaggcttggcctaacccttgccccgtctgaggtcacggctaggatagagcttctgaagcagatagtagatcttcacacgagcactctcgaccagtatatagcggcggaggctcttgagagggggattgtggataaggtgatctcgagggccgtatctatctaccgcaggaagagagatatcatgatcgagtctctcgaggagaacatgagcggagtggcgacgtggacgaagcctattggagggttcttcatattcctcaggataaacgggcctgtggacatgcgggctttaatgccaaaagccgtggagaggggtgtggcatacgtgcctggcgacgcgtttcacgtgacgcctggtgcgggcaggaatactgctaggctcagctacagcttcaacactgaggaggagataccggaggggatatctatactctcaaagctggttaaagaggtgttaagctag

SEQ ID NO: 18735 - protein, 407 aa, Aeropyrum pernix
MRSDMVDYDRLFSEITRRFRASDVRELLKLTEGKRVISFAGGLPDPRVFPAEELADIARNVVSELGDKALQYSPTPGVSIFRERALSFLERMGLKTSDRQLLVTTGSQEALFLTALSTLSPGDVVIMEEPGYLAAINVFKALGARIVPVPVDDKGLNTGVLAETLDRLDAEGVKPKLVYTNPTCNNPNGTTMPLDRRRELLQLASNYDMLVIEDDPYSHIAFEKTGEEVPLQALDSEGRVVYVTTFSKILAPGLRLGLTLAPSEVTARIELLKQIVDLHTSTLDQYIAAEALERGIVDKVISRAVSIYRRKRDIMIESLEENMSGVATWTKPIGGFFIFLRINGPVDMRALMPKAVERGVAYVPGDAFHVTPGAGRNTARLSYSFNTEEEIPEGISILSKLVKEVLS

SEQ ID NO: 18736 - DNA, 1137 bp, Deinococcus radiodurans
  CDS (1)..(1137)
atgctcaaaaccgcccagaccaccctgacagagggcgtcatcaacctcgcggtagggcacccctcgctgcacatgctgccgctgcgtgaaatggaacaggccgccgcgcaccgcttcgcgcagggcaatgccgaatttttgcagtacggctacgagtggggcgacgggttcctgcgcaccgaactcgccgcgtatctgactcgtgaatacggctttcccgtgtctgccgagcagaccttcatctcgggcggcacctcgcaggcgattgacctgtgctgcgcgatgcttactcgccccggcgacacggtcatcgtagaagaccctacttacttttttgccttcggcatgttccgcgaccacggactgaacatcgtgacggcgccggtagacgagcagggcctcgacgtggacgccctcgaaacactggtggcgcagcaccggcccaagctcgtttacaccatcccggtgcatcaaaaccccgccggcgtgacgctgccgcaggaacggcgcgaaaagctggtgcggctggcgcaggagcacggctttaccatcctggccgacgaggtgtaccagctcctcacctttgagggcaccccaccgcccagtttcgccgcctgggccgacaccgggcaggtcgtcagcctcggcagcttttccaagattctggcccccggcacccgcctcggctggatcaatgcccgcgaggacgtgctggagcggctcgcgcaaaacggtgcgctggtgagcggcggcggctacagcccgctggggggcggcatggtccgcagcatgctggagctggggctgctccccgagtacatcggcaagctgcgcgaaacctttcgccgccgctcgcgggcgctggcagacgcgctcgacgaactgcgcccgctggggctggattttcagcggcctaccggcggatatttcatctgggtgacgctgcccgctggcgtgtcggccaccgaactgttgccccgcgccctcgaccacggcgtgcgctttcagcccggtcctctcttttctccgaacggcacccagaccgacaaagcgcggctgtgcttcgccttctatgaggaagcagaattggtggaaggcgtgcggcggctgggcgaagtgttgcggcaagtcagataa

SEQ ID NO: 18737 - protein, 378 aa, Deinococcus radiodurans
MLKTAQTTLTEGVINLAVGHPSLHMLPLREMEQAAAHRFAQGNAEFLQYGYEWGDGFLRTELAAYLTREYGFPVSAEQTFISGGTSQAIDLCCAMLTRPGDTVIVEDPTYFFAFGMFRDHGLNIVTAPVDEQGLDVDALETLVAQHRPKLVYTIPVHQNPAGVTLPQERREKLVRLAQEHGFTILADEVYQLLTFEGTPPPSFAAWADTGQVVSLGSFSKILAPGTRLGWINAREDVLERLAQNGALVSGGGYSPLGGGMVRSMLELGLLPEYIGKLRETFRRRSRALADALDELRPLGLDFQRPTGGYFIWVTLPAGVSATELLPRALDHGVRFQPGPLFSPNGTQTDKARLCFAFYEEAELVEGVRRLGEVLRQVR

SEQ ID NO: 18738 - DNA, 1203 bp, Bacillus halodurans
  CDS (1)..(1203)
atgaaatatgcatttgcgaagcgggtccgccatctacattcatctgccgtacgagatattttaaaagtcgttaaccaacaaggggtgatttcctttgctggaggcttgcctgatgatgagttatttccgctcgaggcaatggaggatgccttttcgcgggtatttgccacaggaaaaaaatccatgcagtattctgaaacggaaggctttctcccattgagagagctcatactcgaacgaatgggtcgcaagggaatccgatcatacagtgaaagaaatgtcctgatcacgacaggttcccagcaagcgatcgatttattttctcgtgtcatgtttaatccaggggatgtcgtattgacggaagatccaacttatttagctgcgcttcaagtgtttgaatcctatgaagctgagattgttccagtggcttcggatgatgaagggatgatcccagaagatttggagcaaaaaatgaagcagcataagccgaaatgcgtctatgttgtaccgacgttttccaatcctgctggacgtgtttggtcgttagagcgtcgcaaacatttattgaatatggctcataagcatcatgttcttatttttgaagacgatccttatggggacattcaatttaatcaagaggagacatacgtcccgctcgcagccatggataccggttcacacgttctctatacgagtacgttctcgaaaacggcggttccagcgctgcgcacaggctggattactggaccatttcaagtcgtacgaatgatggcccaagcaaagcaagcgaatgaccttcattcaaactcattatcccagcaagctttataccaattgtttactcaccacgatatggacgggcatatccaacgtctcattgaggtatatcgttcgcgaaaagatgtcatgatcaaaaccttacagggtgccgatattccaggactccgttttgtggaaccaaaaggaggaatgtttctttgggcagaactagatgaggccatcaatacatcgttgctcattaaagaagctgtggcaaaaggaatggcgtatgtccctggggaaccgttctacgctggtgtgccaaaatacaatacgttaagattaaatttcacgcactcgactcctgagaaaatcgaaaaaggaatcggtatctttgccgacgtggttcacaaagagatggaatctgtggctatgtacacataa

SEQ ID NO: 18739 - protein, 400 aa, Bacillus halodurans
MKYAFAKRVRHLHSSAVRDILKVVNQQGVISFAGGLPDDELFPLEAMEDAFSRVFATGKKSMQYSETEGFLPLRELILERMGRKGIRSYSERNVLITTGSQQAIDLFSRVMFNPGDVVLTEDPTYLAALQVFESYEAEIVPVASDDEGMIPEDLEQKMKQHKPKCVYVVPTFSNPAGRVWSLERRKHLLNMAHKHHVLIFEDDPYGDIQFNQEETYVPLAAMDTGSHVLYTSTFSKTAVPALRTGWITGPFQVVRMMAQAKQANDLHSNSLSQQALYQLFTHHDMDGHIQRLIEVYRSRKDVMIKTLQGADIPGLRFVEPKGGMFLWAELDEAINTSLLIKEAVAKGMAYVPGEPFYAGVPKYNTLRLNFTHSTPEKIEKGIGIFADVVHKEMESVAMYT

SEQ ID NO: 18740 - DNA, 1242 bp, Thermotoga maritima
  CDS (1)..(1242)
atggtcgtgaatctagaaggcaagatctcaaagataggccaaaacatgaaatcctccatcatcagggaaattctcaaatttgccgcggacaaagacgccatttctttcggagggggagtacccgatcctgagactttcccgagaaaagaactcgcagaaatcgcaaaggaaatcatagaaaaagagtaccattacactcttcagtactccacaacagaaggagatcccgttcttaaacagcaaattttgaagcttctggagaggatgtacggcatcacaggactcgacgaagacaatctgatattcaccgttggatcccagcaggcgctggatctcattggaaagctcttcctcgacgatgagagttactgcgttctcgatgatcccgcgtacctcggagccataaacgcgttcaggcagtatcttgcgaacttcgttgtggtcccgctcgaagacgacggaatggatctcaacgttctggaaagaaagctttctgaattcgacaaaaacggaaagataaaacaggtgaagttcatctacgttgtttcaaatttccacaacccagcgggagtcacaacttctctggaaaagagaaaagcgctcgtcgagatcgcagagaagtacgacctcttcatagtggaagacgatccctacggtgctttgaggtacgaaggagaaactgtggatcccatcttcaagataggtggaccagaaagagtggttcttctcaacacgttcagcaaagtcctcgctccgggtctcagaataggaatggtggcgggaagcaaggagttcatcagaaagatcgttcaggcgaagcagtcagcggatctgtgcagtcccgctatcactcatcgtctcgctgcccgttatttggagaggtacgatcttctcgagcagttgaaacccaccatcgaactctacagaagaaagagaacggtgatgctcaacgctctcgaagagtacttctccgacataccaggcgtgaaatgggtgaaatcggaaggcggtctcttcatctggctcacccttcctgagggtttcgacacctgggagatgttcgagtacgcaaagagaaagaaggtgttttacgttcctggaagggttttcaaagtgtacgacgagccgagtccctctatgaggctttccttctgtctgccgccggatgaaaagatcgttgaagggatcaaaaggctcagggaagttgtcctcgagtacggcaaggaaaaacaccttctgtga

SEQ ID NO: 18741 - protein, 413 aa, Thermotoga maritima
MVVNLEGKISKIGQNMKSSIIREILKFAADKDAISFGGGVPDPETFPRKELAEIAKEIIEKEYHYTLQYSTTEGDPVLKQQILKLLERMYGITGLDEDNLIFTVGSQQALDLIGKLFLDDESYCVLDDPAYLGAINAFRQYLANFVVVPLEDDGMDLNVLERKLSEFDKNGKIKQVKFIYVVSNFHNPAGVTTSLEKRKALVEIAEKYDLFIVEDDPYGALRYEGETVDPIFKIGGPERVVLLNTFSKVLAPGLRIGMVAGSKEFIRKIVQAKQSADLCSPAITHRLAARYLERYDLLEQLKPTIELYRRKRTVMLNALEEYFSDIPGVKWVKSEGGLFIWLTLPEGFDTWEMFEYAKRKKVFYVPGRVFKVYDEPSPSMRLSFCLPPDEKIVEGIKRLREVVLEYGKEKHLL

SEQ ID NO: 18742 - DNA, 1440 bp, Pseudomonas aeruginosa
  CDS (1)..(1440)
atgaccaatctgctgctttaccaacgcatcgcccagcagttggccgaggacattcgccgtggcgtctaccagccgggcgagcgggtaccgtcggtgcgcaagctcagtacccagttgaacgtcagccacgccaccgtgctgcaggcctacgccaccctcgaggaccagggactgatccgcgcccgtccgcaatccggcttctacgtccaccgcaccccggcgctgaccgcgccgaccccggatatcgcgcgggtcgagcgtcccggcctggtcacccgcagcagcatcatcaaccaggtgctcgccgagtcccgccgcgaaggggtattcccgctcggcgcggcggtgccgcacgtggactacctgccggtgcgcgccttgcaccagcaactggccaaggtcacccgcttccagagcccacgggcgttcagctacatgttcagccccggtttcgagccgctgcggcggcaggtggcgatccgcatgcgcgacgccggcgtggtggtcgacccatcgcaggtgaccatcacccacggctgcgtggatgcgatccacatggccctgcgggtgctgacccgtcccggcgacctgatcgccaccgagtcgccgagctactacggcctgctgcaactggccgacgtgctgggcctgaaggtcatcgagatccccagcgacccgcgcaccgggatcagccttgaagcgctgcaactggcggccaaccagtggtcgatcaaggccttggtgctgaccgcgcggctgagcaatcccttcggcgggacgattcccgaggatcgccagaagcaactgctgaaactgaccgccgaacacaacatcggggtggtcgaggacgacatctacggcgaactgatgttcgaccagggccaggcgcgctcgctcaagtcccacgaccgcgacggccgggtgatctactgctcgagtttctccaagaccatctcgcccggcgtacgcatcggctggatcatcgccgagcgctaccaggaggagatccgtcgcttgcagaccttcaccacccattcggcctgcaccgtgacccagatgggcgtcgccgcctacctggagaacggcggctacgaccgccacctgcgctacatccgccaggagtaccggaagaacatgaccgcctaccagttggcggtgcagcagtacttcccggaaggtacgcagatgacccggcccaagggcggcttcatcctctgggtcagcctgccggccaaggtcaacaccaaggaactccacgtgcgggccctggagcagggcatcagcatcgccccggggctgatcttcagcaacaccgagcagttcaacaactgcctgcggctgacctgcgggattccctggaaccgcgaggcggagcgggcgatcatgaccctcggcatgcttgccgggcagctttgccaggaaggccttatcgccgcctga

SEQ ID NO: 18743 - protein, 479 aa, Pseudomonas aeruginosa
MTNLLLYQRIAQQLAEDIRRGVYQPGERVPSVRKLSTQLNVSHATVLQAYATLEDQGLIRARPQSGFYVHRTPALTAPTPDIARVERPGLVTRSSIINQVLAESRREGVFPLGAAVPHVDYLPVRALHQQLAKVTRFQSPRAFSYMFSPGFEPLRRQVAIRMRDAGVVVDPSQVTITHGCVDAIHMALRVLTRPGDLIATESPSYYGLLQLADVLGLKVIEIPSDPRTGISLEALQLAANQWSIKALVLTARLSNPFGGTIPEDRQKQLLKLTAEHNIGVVEDDIYGELMFDQGQARSLKSHDRDGRVIYCSSFSKTISPGVRIGWIIAERYQEEIRRLQTFTTHSACTVTQMGVAAYLENGGYDRHLRYIRQEYRKNMTAYQLAVQQYFPEGTQMTRPKGGFILWVSLPAKVNTKELHVRALEQGISIAPGLIFSNTEQFNNCLRLTCGIPWNREAERAIMTLGMLAGQLCQEGLIAA

SEQ ID NO: 18744 - DNA, 1245 bp, Agrobacterium tumefaciens
  CDS (1)..(1245)
atgcttgattgggaacaaattttcgccacgcgctcttcgcgcatgaaagcgtctgaaatccgcgagctgctgaagctgctcgaacagcccgatatcatctcctttgccggcggcattccggatccggctctcttccccgcagaggagttccagcaggcttatgcggaaattttttccggcgcgcaggtcaacgccgccctgcaatattctgtcagcgagggttacaagccgctgcgcgaatggctggcgggcgaaatggacaagatcggcatcgactgcaccgccgataacgtcttcatcgtttccggttcgcagcagggtctcgattatctcggcaagctgttcctgtcgccgaaggatacggcgctggtgacatggccgacctatctcggcgcgctttccgctttcaacgcctatgagccgaattacgaccagcttaatccgggtggcaaccgcacgcctgaagcttaccgcgaaacagcggccaagctcgggggcgcggtgaagttcgcctatctttcggctgatttctccaatccgaccggcgaaaccgtcgatcttgccggccgcgaaaaggttctggcgctggccgacgagcttgacatcgccgtcatcgaagacgctgcctatcagtcgctgcgttacgacggcgaagcggttccgcccatcatggcgctcgacattgcccgttcgggcggcatcgagaacacccgcaccatctactgcggcagcttttcgaagacgctcgcccccggcctccgcgtcgggtacatcgtcgcctccgcgcctgtcatccgcaagctggtgctgatgaagcaggccgccgacttgcattcctccaccatcaaccagatcgccatcgaacgcgtcgccgcgcgcggtttcgataagcaggtggccaagatcaaggcggcctacagcgcacggcgggatgcgatgctctccgcgctcgagaagtacatgccgaagaccaccagctggaccaagccggaaggtggcatgttcatctgggtgacattgcctgagggcatggatggtgccgcgctgctggcaaaatccatcgctacggaaaaggtggcctttgttcccggccgcgcgttctttgcggatggttcgggtacgaacacgctgcgcatcagcttctcctgcgccaacgaggcgatgatcgaggaaggcatgaagcggcttggccggttgattacgacggcgcaggcggagacgactgaggtgcttgcggcgatttga

SEQ ID NO: 18745 - protein, 414 aa, Agrobacterium tumefaciens
MLDWEQIFATRSSRMKASEIRELLKLLEQPDIISFAGGIPDPALFPAEEFQQAYAEIFSGAQVNAALQYSVSEGYKPLREWLAGEMDKIGIDCTADNVFIVSGSQQGLDYLGKLFLSPKDTALVTWPTYLGALSAFNAYEPNYDQLNPGGNRTPEAYRETAAKLGGAVKFAYLSADFSNPTGETVDLAGREKVLALADELDIAVIEDAAYQSLRYDGEAVPPIMALDIARSGGIENTRTIYCGSFSKTLAPGLRVGYIVASAPVIRKLVLMKQAADLHSSTINQIAIERVAARGFDKQVAKIKAAYSARRDAMLSALEKYMPKTTSWTKPEGGMFIWVTLPEGMDGAALLAKSIATEKVAFVPGRAFFADGSGTNTLRISFSCANEAMIEEGMKRLGRLITTAQAETTEVLAAI

SEQ ID NO: 18746 - DNA, 1413 bp, Escherichia coli
  CDS (1)..(1413)
atgacgcgttatcaacatctggcgactctgcttgccgaacggattgagcaagggctgtatcgtcacggggagaaattgccgtcggtgcgcagcttaagtcaggagcacggcgtcagtatcagcaccgtgcagcaggcgtatcagacgctggagacgatgaagctcatcactccgcagccgcgttcgggttattttgtcgcacaacgtaaagcccagccgccagtaccgccgatgacgcgtccggtgcagcgcccggtggaaattacccagtgggatcaggtgctggatatgctggaggcgcatagcgacagttccattgttccgttaagcaaaagcacaccggatgtcgaagcgcccagcctgaaaccgctgtggcgggagctaagccgggtggtgcagcataatctgcaaaccgttctcggttatgacttgttagccggtcagcgagtattgcgagagcagattgcccgcctgatgctcgacagcggctcggtggtcaccgccgatgacatcatcatcaccagcggctgccataactcgatgtcgctggcgttaatggcagtgtgtaaaccgggcgatattgtcgcggtcgaatccccctgttattacggttcgatgcagatgctgcgcggcatgggcgtgaaagtgattgaaatcccaaccgatccagaaactggcatcagcgttgaagcgctggaactggcgctggaacagtggccgattaaaggcatcattctggtgccaaactgtaataatccgctgggatttattatgccggacgcgcgcaaacgggccgttctctctctcgctcagcgtcatgatattgtgatttttgaagatgatgtctatggcgaactggcgacggagtatccgcgcccgcggaccattcattcctgggatatcgacgggcgagtgctgttgtgcagctcgttcagtaaaagtattgcaccaggcctgcgcgtgggttgggtcgcaccggggcgttatcacgataaactgatgcatatgaaatacgccatcagcagctttaatgtgccgtccacgcaaatggcggcggcaacgtttgtgctggaaggtcactatcatcgccatatccggcggatgcggcagatctatcagcgcaatttggcgctttatacctgctggatacgggaatattttccctgcgaaatctgtattacgcgcccgaaaggcggatttttactgtggatagaattgcctgaacaggtcgatatggtctgcgtcgcgcggcagctgtgccgcatgaaaatccaggtggcggcaggctcgattttctcagcttccggcaaataccgtaattgtctgcgcatcaactgcgctttgccgctcagcgaaacctatcgcgaagcactgaagcaaattggcgaggccgtgtatcgggcaatggaataa

SEQ ID NO: 18747 - protein, 470 aa, Escherichia coli
MTRYQHLATLLAERIEQGLYRHGEKLPSVRSLSQEHGVSISTVQQAYQTLETMKLITPQPRSGYFVAQRKAQPPVPPMTRPVQRPVEITQWDQVLDMLEAHSDSSIVPLSKSTPDVEAPSLKPLWRELSRVVQHNLQTVLGYDLLAGQRVLREQIARLMLDSGSVVTADDIIITSGCHNSMSLALMAVCKPGDIVAVESPCYYGSMQMLRGMGVKVIEIPTDPETGISVEALELALEQWPIKGIILVPNCNNPLGFIMPDARKRAVLSLAQRHDIVIFEDDVYGELATEYPRPRTIHSWDIDGRVLLCSSFSKSIAPGLRVGWVAPGRYHDKLMHMKYAISSFNVPSTQMAAATFVLEGHYHRHIRRMRQIYQRNLALYTCWIREYFPCEICITRPKGGFLLWIELPEQVDMVCVARQLCRMKIQVAAGSIFSASGKYRNCLRINCALPLSETYREALKQIGEAVYRAME

SEQ ID NO: 18748 - DNA, 1206 bp, Sulfolobus solfataricus
  CDS (1)..(1206)
atgtttgagagatttttatccaccgaaactaagtatttacgtacctcagaaataagagatctactaaaactaacggaaggtaagaatgtaattagccttgcgggaggtttacctgatcctcagacttttccagtagaagaaattaaaaaaatagcagatgacatcttattgaatagtgctgataaggcattacaatatactgcaactgctggtatatctgaatttagaagagaattggtgaacttatctagattaaggggaattagtggaatagatgaaagaaacgtctttgttacagtaggaagtcaagaagcacttttcatgatatttaatatattactagatccgggagacaatgtagtagtcgaggcgccaacttatttagcagctttaaatgccatgagaactagaaagccaaatttcatatcgataacagtaacggaaatgggcccagatctagatgaattggagagaaaaataaaagatgcccatagcaatgggaagaaggttaaactgatgtatgtgattccaacagcccagaatccggcgggtactacgatgaatacagaggataggaaaagacttttagagattgcatcgaaatatgatttcttaatttttgaggatgatgcttatgggttcttagtattcgagggagaaagtccaccaccaattaaagccttcgataaagaaggaagagtaatttatactagcacatttagtaaaatacttgcacccggtttaaggttaggatgggtaattgctcatgaagatttcataaaggaaatggaactatataaacaaaatgttgatttgcatacaccttcattatcacaatatattgcaatggaggctataaggaggggtataattcaaaataatttacctaagataaggagagtgtataaggaaaaaagagatgtaatgctagaggctattgaaacttatttccctaatgatgccagatggactaaaccagttggtggaatgtttgtttttgcttggttgccacaaaaaatagatactactaagatgttagaaaaagccttacaaaggggtgtagcttatgtaccaggttctagtttctatgctgactatagtggaaagaatactatgaggatcaactttagttttcctaagaaagaagaattaatagagggaattaagaggctaggagatacgataaagcatgagctctctacttaa

SEQ ID NO: 18749 - protein, 401 aa, Sulfolobus solfataricus
MFERFLSTETKYLRTSEIRDLLKLTEGKNVISLAGGLPDPQTFPVEEIKKIADDILLNSADKALQYTATAGISEFRRELVNLSRLRGISGIDERNVFVTVGSQEALFMIFNILLDPGDNVVVEAPTYLAALNAMRTRKPNFISITVTEMGPDLDELERKIKDAHSNGKKVKLMYVIPTAQNPAGTTMNTEDRKRLLEIASKYDFLIFEDDAYGFLVFEGESPPPIKAFDKEGRVIYTSTFSKILAPGLRLGWVIAHEDFIKEMELYKQNVDLHTPSLSQYIAMEAIRRGIIQNNLPKIRRVYKEKRDVMLEAIETYFPNDARWTKPVGGMFVFAWLPQKIDTTKMLEKALQRGVAYVPGSSFYADYSGKNTMRINFSFPKKEELIEGIKRLGDTIKHELST

SEQ ID NO: 18750 - DNA, 1215 bp, Streptomyces coelicolor
  CDS (1)..(1215)
atgaccgtgactgagaacgtgcccgccgccaccgcttccctgccgccgctcgccgcgcgggcccggtcgatcggcggttcgcccgtacgggacatcctcgccgtcaccgcccgccccgaggtgatcaacttcgcgggcgggctgccggcccccgaactcttcgacgcggagggcatcgccgccgcgtaccgggacgtcctcgccgagacgcccgcgcgggctttgcagtactccacgaccgagggcgaacccgccctgcgggccgccctcgccgcccgcacctcggcccgcgggctggccaccgacgccgacgacatcctcgtcaccaccggctcgcagcaggcactctcgctcctcgccaccgccctgctcgaacccggcgacaccgtcctcgtcgaacgcccctgctacctggccgcgctccaggccttcggcttcgcgggcgcccgggtggtggccgtgcccggggacgagcacgggatagaccccggggcgctggaggagctggtggtgcgcgagcggcccaagctgctctacacggtccccaccttctccaaccccaccggccgcaccgtgcccgccgcccgccgcgccgccgtcgccgaggtcgccgggcggtgcggcctgtggatcgtcgaggacgacccgtacggcgaactgcgcttcgagggcgagcgggtgccgtggatcgcctcctacgagggcgcccgggaccggaccgtgctgctgggctccttctccaaggtcatggcgcccggcctgcgcctgggctggctgcgggcacccgccgagctgcgccgggcctgcgcggtcgccaagcaggccgccgacctgcacaccccgaccgtcaaccagctcgccgccgcccgctacctggccgaccgtgacctggacgcccacgtcgcccgcgtcgccgccgtctacggcgagcgccgggacgccatgctcgcgggcctcgcggacgccctcccggccgggtcggtgtggacccgtcccgagggcggcatgttcctgtgggcgcggctgccgcaggggtacgacaccaccgccctgctccccgaggtggtccggcacgacgtggcgtacgtccccggagcccccttccacgccggcgagcccgaccgcgccacgctgcggctctgcttcgtcacccagacaccggacgagatcgcggaggggctgcggaggctgggggaggggctgcgggcagcctga

SEQ ID NO: 18751 - protein, 404 aa, Streptomyces coelicolor
MTVTENVPAATASLPPLAARARSIGGSPVRDILAVTARPEVINFAGGLPAPELFDAEGIAAAYRDVLAETPARALQYSTTEGEPALRAALAARTSARGLATDADDILVTTGSQQALSLLATALLEPGDTVLVERPCYLAALQAFGFAGARVVAVPGDEHGIDPGALEELVVRERPKLLYTVPTFSNPTGRTVPAARRAAVAEVAGRCGLWIVEDDPYGELRFEGERVPWIASYEGARDRTVLLGSFSKVMAPGLRLGWLRAPAELRRACAVAKQAADLHTPTVNQLAAARYLADRDLDAHVARVAAVYGERRDAMLAGLADALPAGSVWTRPEGGMFLWARLPQGYDTTALLPEVVRHDVAYVPGAPFHAGEPDRATLRLCFVTQTPDEIAEGLRRLGEGLRAA

SEQ ID NO: 18752 - DNA, 1425 bp, Schizosaccharomyces pombe
  CDS (1)..(1425)
atggctgctcaacctaaagacctttcacaccacttgtctgtggaaagtgcaagtcgtaaacaatctccacttaaagctgtcgctctttccaaaagcagccgcaatattaaaatcatttctttggctggcggtttgcctaaccctgaatactttcccattcgtgagatggatgcggagattcctgctataaactcttggaagaaggattcttcaaacagtggaaagctcgataccgtttctgttcctatgagctctagtgattctgatgtccttcctcttagtgtcgctttgcagtacggccagggttctggtgctgctttactttcccaatttttaaaggaacacactcgcatcattcataatcctccttatgaaggttggaacatcattatgactaccggtaatacttcatgcctagacatcgctcttcgtatgttgaccaatcgaggcgattccattttggtagagaaatactccttcccttccgcattacaaagcatgcgtcctcttggtttaagctgcattcctattgatatggaccagtttggttttttaccagagtctatggatgatattttgactaattgggatgctacttcctacggttctcctaaaccccacgtactttacactattcctactggtcaaaatcccactggtagtactctttctgtggagaggagaaagcaaatttacactctggcacaaaagcatgatattattatcctagaggatgaaccttactattacttacaaatggacgcttatgaaggaaaaccagaagctgctgataaagcttttaccaacgagcaatttgtaaaagaacttattccttcattcttaagtatggatgtcgacggtcgtgtcatccgtatggattctctgtcaaaggttgtagcccctggttctcgtgtaggttggttcactgctcaaccgttgttcattgaacgtggtttgcgtgctgctgaaactgcaactcaaagtgcttctggtatttcccaaggcatcctgtatgccatgttcaagcattggggtcaagacggatacctagagtggttgaagcatattcggtattcttatacgcttcgccgtaattatcttctttatgccatggacacatacttaccaaaatcggtctgctcttatatccctcctgtcgctggtatgtttatttggttcgaagttgacaaatcgcgctacatccatgccgataaaaatgaatctattcccgaaatcgaatctaaaatccatgctgaagctgttgaagaaggcgttaaccttgcttgcggtaactggttcgttgttgaccctagagtcaacgataagattttcttccgtgtgacatttgctcacgctgaattagaagaatttaatgttgccattgaacgttttgcgggcgttttgaagaataatttcaaatgctga

SEQ ID NO: 18753 - protein, 474 aa, Schizosaccharomyces pombe
MAAQPKDLSHHLSVESASRKQSPLKAVALSKSSRNIKIISLAGGLPNPEYFPIREMDAEIPAINSWKKDSSNSGKLDTVSVPMSSSDSDVLPLSVALQYGQGSGAALLSQFLKEHTRIIHNPPYEGWNIIMTTGNTSCLDIALRMLTNRGDSILVEKYSFPSALQSMRPLGLSCIPIDMDQFGFLPESMDDILTNWDATSYGSPKPHVLYTIPTGQNPTGSTLSVERRKQIYTLAQKHDIIILEDEPYYYLQMDAYEGKPEAADKAFTNEQFVKELIPSFLSMDVDGRVIRMDSLSKVVAPGSRVGWFTAQPLFIERGLRAAETATQSASGISQGILYAMFKHWGQDGYLEWLKHIRYSYTLRRNYLLYAMDTYLPKSVCSYIPPVAGMFIWFEVDKSRYIHADKNESIPEIESKIHAEAVEEGVNLACGNWFVVDPRVNDKIFFRVTFAHAELEEFNVAIERFAGVLKNNFKC

SEQ ID NO: 18754 - DNA, 1446 bp, Schizosaccharomyces pombe
  CDS (1)..(1446)
atgatccggaatagtgaggattttagccatcatttgtcgagagaaagcaaggctcgtgagaaaggcccttttcaaatgttaggaagaattaaaagtagtacagggattgacgctatatctttttcctcaggtttacctcatcctaacaagtttgctatccgtgagctttctatcaagtttcctcaacttggttgctttaaggaggaaaatgggacatacgccaaagaggttaatgtaacatttaacataaaagctgatccttctgagggtcttttaaatttctctcagtccttgcagtatggccaatgccaaggaatttctgaattggtgggatttataaaggaacacattcggcggattcatgctccccgatacgaaaactgggatattaagatgagtaatggtaatacaagtggtttggaatattgtttacgactgctagtcaattatggggatcatgtcttgacagaaaagtacacttatcctgctgccatcaccgcaatgcgagccctaggtgttcaatttgtatctgttgatatggattcggaaggtatgcttcctgaaagtcttgaagaaattatgagagactgggatatatctctgggacctagacctcatgtcttgtacacagttcctactggtcaaaatcctactggttctactttgtcattaagtcggcgcaaaaagcttttagcattagcaaggaaatacgatatcatcatcgttgaagatgagccatactattttctacaaatggaagattataacggaagtttaaaccctgcacagcaaaaatgtgatgggtcaacgtttttaaagagtttggtcccttcattgctaagtttagacacagaaggtcgagttttgcgacttgattcgttctctaaactgattgctccaggaacccgccttggctatattactggaaattcaatgtttattgatcatattacacggattgcagaagtatgcacggaaagcccgtctggtatttgccaatctgtattgtatgcaatgctgcataattggggtcaagagggcttttgtgcatggttacaggagctgcaatattcttatactgttcgtcgaaacgcattccttaatgtagcaaacaagtatctaccaaattctgtttgtatttatcacgtaccaagagctggattattcttgtgggttgagttaaacttaaatcattaccgcttttcggatacgaaaaagtcagtttcccaaattgaaatggaaatattcctagcgcttgtagaaaaaggtgtaaaaactgtttgtggtcagttttttatggcaaatccagaacgtagtactaagatctttttccgtttcgcatattcaattgctgactttgaggactttgaggagggaattaagcgatttacatcagtcataaatgagcattttaatgtcgaaagcagagtacgaatctgcccttga

SEQ ID NO: 18755 - protein, 481 aa, Schizosaccharomyces pombe
MIRNSEDFSHHLSRESKAREKGPFQMLGRIKSSTGIDAISFSSGLPHPNKFAIRELSIKFPQLGCFKEENGTYAKEVNVTFNIKADPSEGLLNFSQSLQYGQCQGISELVGFIKEHIRRIHAPRYENWDIKMSNGNTSGLEYCLRLLVNYGDHVLTEKYTYPAAITAMRALGVQFVSVDMDSEGMLPESLEEIMRDWDISLGPRPHVLYTVPTGQNPTGSTLSLSRRKKLLALARKYDIIIVEDEPYYFLQMEDYNGSLNPAQQKCDGSTFLKSLVPSLLSLDTEGRVLRLDSFSKLIAPGTRLGYITGNSMFIDHITRIAEVCTESPSGICQSVLYAMLHNWGQEGFCAWLQELQYSYTVRRNAFLNVANKYLPNSVCIYHVPRAGLFLWVELNLNHYRFSDTKKSVSQIEMEIFLALVEKGVKTVCGQFFMANPERSTKIFFRFAYSIADFEDFEEGIKRFTSVINEHFNVESRVRICP

SEQ ID NO: 18756 - DNA, 1413 bp, Schizosaccharomyces pombe
  CDS (1)..(1413)
atggataatttaaaaaaaaaatatcaacatcatttatccctagaaagcgcatcccgtgagtatggtccgtttcagatgttaggtcgtattcaaagtgactcggatatcaaaatgctttcctttgctggtggagaacccaatcccagtaaattcccgattcataaactttcggtctccttcccagaagtaaattcttgggaaaaagacacgaacaaggacgcaactgtgtcttatgaattaagtaataatgcaaatgagggttctctggatttactgggagctttacagtacggccagtgccaaggaattccagaattggtcaagtttataaaagatcacgttggacaaatccacatgccacaatataaggactgggatataaaaataacaaatggaaatacgatcggccttgagtattgcttgcgattgctcgtcaaccgtggtgattgtattctcatagaaaaatatacataccctgccgcaattaccgcaatgcgtccccttggtgtgaaatttattcccattgacatggatgaaaacggcatgctaccagaaagttttgagaaagttatggaaacatgggattcatcgttaggagcaaggccccatgttttgtatactataccgactgggcaaaacccaactggatccacgttaactttggaaagaagaaagaagtttctaaccttggcaaaaaaatacgatattatcattgtcgaagatgaaccatactattttttgcaaatggaaaaatatgatgcaaattggaaacctgacaagcaagctttcaatatttcgtcattcaaaaaaaagctaattccctctttactccatctagataccgacggtagggttttgcgagttgattccttttccaaattgattgtaccgggattacgtttgggatggataactggaaattctctattcatcgatcgcataacccgttacgcagaagtttgtactgagagcccatccggcgtctctcaagtggttctctatgctatattaaatcgttggggacaaaatggttttttggagtggctacaagatttgcaaaactcatatactatgcgtcgaaatgctcttcttttggcagctgacaaacatcttccaaaatctgtttgtaaatatcattctcctaaagctggattgtttctatgggttgaacttgacaaaaaccgtcttatttgctcaaatatggacaagtccatttcggaaattgagatggaaatttttgtagaacttgttaacaatggggtaaagcctgtttgtggacagctatttatgggagaaccaaattcggcggacaaaattttttttcgatttgcttattcccttgctgacctaagcacttttgaagctggtttagagcggtttactagtactatacaaaaatattttcaattgtga

SEQ ID NO: 18757 - protein, 470 aa, Schizosaccharomyces pombe
MDNLKKKYQHHLSLESASREYGPFQMLGRIQSDSDIKMLSFAGGEPNPSKFPIHKLSVSFPEVNSWEKDTNKDATVSYELSNNANEGSLDLLGALQYGQCQGIPELVKFIKDHVGQIHMPQYKDWDIKITNGNTIGLEYCLRLLVNRGDCILIEKYTYPAAITAMRPLGVKFIPIDMDENGMLPESFEKVMETWDSSLGARPHVLYTIPTGQNPTGSTLTLERRKKFLTLAKKYDIIIVEDEPYYFLQMEKYDANWKPDKQAFNISSFKKKLIPSLLHLDTDGRVLRVDSFSKLIVPGLRLGWITGNSLFIDRITRYAEVCTESPSGVSQVVLYAILNRWGQNGFLEWLQDLQNSYTMRRNALLLAADKHLPKSVCKYHSPKAGLFLWVELDKNRLICSNMDKSISEIEMEIFVELVNNGVKPVCGQLFMGEPNSADKIFFRFAYSLADLSTFEAGLERFTSTIQKYFQL

SEQ ID NO: 18758 - DNA, 1422 bp, Yersinia pestis
  CDS (1)..(1422)
atgacacgatatgaacagctagcgcagcaaatcagagcacaaatacaatcgaaggtctggcaagcgggcgataagctcccttcgctgcgagaaagttgtaaacaatcagggctaagcctgatgaccgtggtgcaatcgtatcagttgttggaaagccaggggtggatcgttgcccgcccacaatcgggctactatgtggcctcacggcccacgcagttaccgcaaccacagcggggtaataagctccatctggatgaacaggttgatatcaatacctttatttttaatgtgttacaggcagggaaagatccggcaatcatgccgttcggttcagcatttccagatccgagtttattgttacaaccgcgtttgtcgcgggcgttggccagcgtcgctcgcaagatctcgccacaaagttctgtaacgaatttgccaccgggtaatgaaagtttacggcgcaatattgcgcaacgttatgctgcctgcgggatgaatgtatcacccgaggaaattgtgattacggcgggggcgatggagtcactgagccttagcttacaagccgtgacacagcccggtgattgggtcgttattgaatcgcccgcgttttatggtgcattacaggcgattgaacgcctacgacttaaggctattgccattacgacggatccccagcaaggtgtggatttggaggcccttgagcaggttatcagccagtatccgataaaagcgtgctggttaatgccccattttcaaaacccaatgggggccaccatgccgtggtcacagaaacagcgactcgtcaccctgctacagcagaaggctatttcactgattgaagatgatgtatatggcgaactgtattttggtgctgaacgcttgctaccggcaaaagcgcttgaccagcatcggcagattttacattgctcctctttttctaaatgcctggcgccggggttccgtgtggggtgggtggcagcaggtgaacatgctcagcgtattcaacatttacagttgatgagcaccgtttcggccagcgtcccgacccaactggcgattgcggattatctgagccaagggggatacgatactcacctgcgccgcttgcgtcgggtaatggaacagcggatgagcacgttgcatcaggccgttgttgaacacttccccaaaaacatcaaaatcagccaccccgctggcggctatttcttatggttagaattggagccaccttttaatgccagtgaactgtaccgacgggcactggagcagggggttagcattgctcctgggagaatgttcaccacagggagtcagtttgatcattgctttcgccttaatgcctcctttgcctggtcagaacaaagcgcaaaagcgattcgtattttggcgaagttaatcggccaattgacgaacgaacgtcgatag

SEQ ID NO: 18759 - protein, 473 aa, Yersinia pestis
MTRYEQLAQQIRAQIQSKVWQAGDKLPSLRESCKQSGLSLMTVVQSYQLLESQGWIVARPQSGYYVASRPTQLPQPQRGNKLHLDEQVDINTFIFNVLQAGKDPAIMPFGSAFPDPSLLLQPRLSRALASVARKISPQSSVTNLPPGNESLRRNIAQRYAACGMNVSPEEIVITAGAMESLSLSLQAVTQPGDWVVIESPAFYGALQAIERLRLKAIAITTDPQQGVDLEALEQVISQYPIKACWLMPHFQNPMGATMPWSQKQRLVTLLQQKAISLIEDDVYGELYFGAERLLPAKALDQHRQILHCSSFSKCLAPGFRVGWVAAGEHAQRIQHLQLMSTVSASVPTQLAIADYLSQGGYDTHLRRLRRVMEQRMSTLHQAVVEHFPKNIKISHPAGGYFLWLELEPPFNASELYRRALEQGVSIAPGRMFTTGSQFDHCFRLNASFAWSEQSAKAIRILAKLIGQLTNERR

SEQ ID NO: 18760 - DNA, 1892 bp, Homo sapiens
  CDS (280)..(1557): n means a or g or c or t/u
aattcnactatagggnttcgacccacgcgtccgctttgccgggctcgccacacagccccagacccgtttaggaccgggagaccgaacgcagcgtccagccggggagtttcggcggcgttctccgggcaccgcgcgcgggaagccagacgcagcggggggacacatctcgcggtggcgttgccagagtgaggagttagcaggcaggacttgacgaggctctttggtttttctagtcctcaaccactgaagaagaagcttgatgcttggctgtcagaagacatgaattacgcacggttcatcacggcagcgagcgcagccagaaacccttctcccatccggaccatgactgacatattgagcagaggaccaaaatcgatgatctccttggctggtggcttaccaaatccaaacatgtttccttttaagactgccgtaatcactgtagaaaatggaaagaccatccaatttggagaagagatgatgaagagagcacttcagtattctccgagtgctggaattccagagcttttgtcctggctaaaacagttacaaataaaattgcataatcctcctaccatccattacccacccagtcaaggacaaatggatctatgtgtcacatctggcagccaacaaggtctttgtaaggtgtttgaaatgatcattaatcctggagataatgtcctcctagatgaacctgcttattcaggaactcttcaaagtctgcacccactgggctgcaacattattaatgttgccagtgatgaaagtgggattgttccagattccctaagagacatactttccagatggaaaccagaagatgcaaagaatccccagaaaaacacccccaaatttctttatactgttccaaatggcaacaaccctactggaaactcattaaccagtgaacgcaaaaaggaaatctatgagcttgcaagaaaatatgatttcctcataatagaagatgatctttactattttctccagtttaacaagttcagggtaccaacatttctttccatggatgttgatggacgtgtcatcagagctgactctttttcaaaaatcatttcctctgggttgagaataggatttttaactggtccaaaacccttaatagagagagttattttacacatacaagtttcaacattgcaccccagcacttttaaccagctcatgatatcacagcttctacacgaatggggagaagaaggtttcatggctcatgtagacagggttattgatttctatagtaaccagaaggatgcaatactggcagctgcagacaagtggttaactggtttggcagaatggcatgttcctgctgctggaatgtttttatggattaaagttaaaggcattaatgatgtaaaagaactgattgaagaaaaggccgttaagatgggggtattaatgctccctggaaatgctttctacgtcgatagctcagctcctagcccttacttgagagcatccttctcttcagcttctccagaacagatggatgtggccttccaggtattagcacaacttataaaagaatctttatgaagaaattaaactaggttgggcatggtggctcacacctataatcccagcactttgggaggcagaggagggaggatcacttgaacccaggaattcaaggctgcagtaagctacgatcacaccactgcactctggcctgcatgcactctggcctgcatggcagaacaagaccctgtctctaaaaaaagagaaagaaatcaaactaatcatgctgctcatggatttttccaataaatttcttgttttggcaggaagaaatgaacactggtattagacttaaagattaaatttcctcaaacatgtcctatctgnagtagttcaactagacaccttttaaa

SEQ ID NO: 18761 - protein, 425 aa, Homo sapiens
MNYARFITAASAARNPSPIRTMTDILSRGPKSMISLAGGLPNPNMFPFKTAVITVENGKTIQFGEEMMKRALQYSPSAGIPELLSWLKQLQIKLHNPPTIHYPPSQGQMDLCVTSGSQQGLCKVFEMIINPGDNVLLDEPAYSGTLQSLHPLGCNIINVASDESGIVPDSLRDILSRWKPEDAKNPQKNTPKFLYTVPNGNNPTGNSLTSERKKEIYELARKYDFLIIEDDLYYFLQFNKFRVPTFLSMDVDGRVIRADSFSKIISSGLRIGFLTGPKPLIERVILHIQVSTLHPSTFNQLMISQLLHEWGEEGFMAHVDRVIDFYSNQKDAILAAADKWLTGLAEWHVPAAGMFLWIKVKGINDVKELIEEKAVKMGVLMLPGNAFYVDSSAPSPYLRASFSSASPEQMDVAFQVLAQLIKESL

SEQ ID NO: 18762 - DNA, 1311 bp, Candida glabrata
  CDS (1)..(1311)
atgagtatggaccaacctgccagaatcaacttcttcaaaggacaccccagtttccggttgttgcctaatgaagagatagtagaagccaccagacaattgctcaccagcgaaactagagattatgacgatgacacaaggaataggcacccattgacatatggtcctgatgaaggcgctctatgggtgaggcaacagatatgtgatttcaacaacaggctgtttggtagtgactcaaaaccggagtttttaaacttgagcagtggttcctcatacggatgcctgagtgtcttattacatactacattacctcacacaaattttactagacaggcgttcattatatcaccaacttattttctgatcaatgattgttttattgatgctggatttggttcaaagctaactgcaattgatgaggaaggagaagactccattaactttgaacaattactaagcaaattgaggcactttgaagaattatatggtaatagcaatggcgatgtatcgattatccagaacccaaataaaccaacaaaaaaggtgtacaaatatgtaatgtactgtgtgccaacctttgcaaatccgagcggcaagagttactctttggaaacgagaactaaattgatagagatagcaagaagatatgatatgttaataatatgtgatgatgtctacgatctattagattactcgacagatgttcatgagtggccaagacctcaaaaaaggcttgtacatattgatagggctacggcacctgatgataatgaatttggcaacactatatctaatgcgacattttccaagatcattgcccctggtctaaggtttggttaccatgagactataaatgataaattagctgctcagctctctagaggtggtgccaatgtgtctggtggtacaccttcacaattaaattcaatgatagttggcaccatacttcaaaatgggagtatggaaagaatattaggtaaactaagagaaacttataaaactagatcagttgcaatgtgggattcattgcagaaacacatgccaaaggacacacatatctcgtctcccaaaggtggctatttcgtttgggtaaccttaccacccgggtatgatgccaagaaaataggaaaaaagctaaaagatgagcatggagtaatactggcaaatggatcagactttgaagttataggagatgaaagagggtggggtgacagatcagtgcgtctttccattagttttctcgagactcctgatatcattgaaggttgcgagttatgggggaaagtgtgcaaggagatggcacccagttcatag

SEQ ID NO: 18763 - protein, 436 aa, Candida glabrata
MSMDQPARINFFKGHPSFRLLPNEEIVEATRQLLTSETRDYDDDTRNRHPLTYGPDEGALWVRQQICDFNNRLFGSDSKPEFLNLSSGSSYGCLSVLLHTTLPHTNFTRQAFIISPTYFLINDCFIDAGFGSKLTAIDEEGEDSINFEQLLSKLRHFEELYGNSNGDVSIIQNPNKPTKKVYKYVMYCVPTFANPSGKSYSLETRTKLIEIARRYDMLIICDDVYDLLDYSTDVHEWPRPQKRLVHIDRATAPDDNEFGNTISNATFSKIIAPGLRFGYHETINDKLAAQLSRGGANVSGGTPSQLNSMIVGTILQNGSMERILGKLRETYKTRSVAMWDSLQKHMPKDTHISSPKGGYFVWVTLPPGYDAKKIGKKLKDEHGVILANGSDFEVIGDERGWGDRSVRLSISFLETPDIIEGCELWGKVCKEMAPSS

SEQ ID NO: 18764 - DNA, 1185 bp, Picrophilus torridus
  CDS (1)..(1185)
atgaaatacgaattctcggacaatttaaagtatatgaaatcatccgccataaggaatctgttaaaatacatacagcagcccggaatgatctcatttggcggcggaatgccaaacccggagacctttccaatagataagataatggagatcacaaatgatgttttaaaaaattatggaaagagtgcattgcagtacggtacaacagacggcctcaaacttttaagggatgagcttgttaaattcatattaaaggatgagaatataaaatgtggccctgagaacatatttataacaacaggatcacagcaggcactgtacgctctttcaaagatctttgcaaatccaggcgataaggtaatacttgaagcaccgacatacgttggtatgatatcatctttaaatgccaatgccgtggattcagaatcaataggaatggacgaaaacggaatgattgttgagaacctcgaggaaaagataaaatcaatgataaaagatggtaaaaagcccaggtttatatatacaataccaacatttcagaatcctgcaggttatacaatgccgctggacagaagaaaacatttaatagagatatcaaaaaaatacgagatacctgtaatagaggataatccatatggcgatttaagatactctggaagcaaggtaccaacactgaaaagccttgatgatgatgttatataccttggaacgttctcaaaggtcatggcgcccgggttgagaaccggatatgtaatagcaagtgaggacgttgcatcgaagttaaaccttttaaaacaggcacttgatcttgcaggcgattctttctcccagtacatagcctatgaataccttaaaaacggtataatatacgagcagataccaaaaaccatagaattatataaaagaaagagaaatgttatgcttgaggcactggacgagcatgttgacaatgccgagtggtcaaaaccagatggtggcatgttcctctggctaaggataaaaaagaacgtggattcagagaaactccttgaaaaggccatagagaaaaaggttgcttatgttccaggctctgcgttttatcataaaaacccggaattaaatacaatgaggctgaatttcacctacgcagatgatgatgatataaaggatggtataaagaggcttggccaggtgatagccgaggcataa

SEQ ID NO: 18765 - protein, 394 aa, Picrophilus torridus
MKYEFSDNLKYMKSSAIRNLLKYIQQPGMISFGGGMPNPETFPIDKIMEITNDVLKNYGKSALQYGTTDGLKLLRDELVKFILKDENIKCGPENIFITTGSQQALYALSKIFANPGDKVILEAPTYVGMISSLNANAVDSESIGMDENGMIVENLEEKIKSMIKDGKKPRFIYTIPTFQNPAGYTMPLDRRKHLIEISKKYEIPVIEDNPYGDLRYSGSKVPTLKSLDDDVIYLGTFSKVMAPGLRTGYVIASEDVASKLNLLKQALDLAGDSFSQYIAYEYLKNGIIYEQIPKTIELYKRKRNVMLEALDEHVDNAEWSKPDGGMFLWLRIKKNVDSEKLLEKAIEKKVAYVPGSAFYHKNPELNTMRLNFTYADDDDIKDGIKRLGQVIAEA

SEQ ID NO: 18766 - DNA, 1188 bp, Methanococcus maripaludis
  CDS (1)..(1188)
atggcattaagctactcaaaacggatggaaaacattaaatcttctgaaataagggagatattaaaagttactcaaaaacctgaaataatatcttttgcaggcggacttcctgcaccggaactctttcccgtaaaagaaataaaagaaatttccggaattgttctcgatgaaatgggtccggaatccttacagtacgatataacggaaggataccctccactcaggcagcagatttcagaacggatgaataaagtactaaaaacagagcttacagaaaataatatcttaatcgtctgtggatcccagcaaggattagatttctctggaaaagtattcttggatgaaaatgatgtggttttatgtgaaagtccaacataccttggagcaattaatgcatttaaatcatacgaaccgcagtttaaggaagttccaactgacgactttggaatgattccagaagaacttgaaaaaattttaaaaactaccaaaaatgtaaaactcatttatgcaattcctgattttcaaaatccaactggaaaaacgtggactcttgaaagaagggaaaaattcatgaaaataattgaaaaatatgaaattccagtagtcgaagataatccttacggggaattaagatttgatggagaaattttgccttcattaaaatcaatggataaaaagggcctcataattcatttaggaacattttcaaagactttttgtccaggtttgagggtaggatggattgcggcatcagaagatatccttgaaaaatacatctttataaaacagagcgcagatttgcacacctcgtcattttcccagagaattatttcaaaaatgcttgaaaattacgattttgatgaaagagtatcaagattaaaagaattatataagggcagacgggatttaatgattaaaacaattgcagaagaattcccagacgggcttaaatatacaaatccagaaggcgggctttttacatgggttgaacttcctgaaaaatataatgcgcgtgaatttttagatgaatgcattaaaaataacgttgcgatcgttccaggaggatctttcttcccaaacggaggtcatgaaaattctttcaggttaaattactcaaatatgcctgacgaaaaaatagttgaaggaattaaaaggctttcaaaagttttaaaagaatatttaaattaa

SEQ ID NO: 18767 - protein, 395 aa, Methanococcus maripaludis
MALSYSKRMENIKSSEIREILKVTQKPEIISFAGGLPAPELFPVKEIKEISGIVLDEMGPESLQYDITEGYPPLRQQISERMNKVLKTELTENNILIVCGSQQGLDFSGKVFLDENDVVLCESPTYLGAINAFKSYEPQFKEVPTDDFGMIPEELEKILKTTKNVKLIYAIPDFQNPTGKTWTLERREKFMKIIEKYEIPVVEDNPYGELRFDGEILPSLKSMDKKGLIIHLGTFSKTFCPGLRVGWIAASEDILEKYIFIKQSADLHTSSFSQRIISKMLENYDFDERVSRLKELYKGRRDLMIKTIAEEFPDGLKYTNPEGGLFTWVELPEKYNAREFLDECIKNNVAIVPGGSFFPNGGHENSFRLNYSNMPDEKIVEGIKRLSKVLKEYLN

SEQ ID NO: 18768 - DNA, 1341 bp, Aspergillus fumigatus
  CDS (1)..(1341)
atgggtgtaattccccccgaagagccaatcgatctcttcagaggctggccaaacccggccctgttgcccacctccgccttggcccaggcatccgccactgtcctgtccacgccgtccattcggaccccagccctgctgtatgggcctgatgatggctatctgcccttgcgaaagagtgttgctgaatggctgacccacttttacaaaccccgcgatccggttgggttcgatcggatctgcattactggcggtgccagccagaatctggcatgtattttccaagtcttcaccgatccaagttataccagacatgtctggatggtagcgcctgcatatcacctggcgtcccggatggtagacgatgccggcttcgcaggtcgtgtcagagccgttccgcaggatgacgcggggcttgatcttgactatctccgtcgggagatggaggcggccgagcggaaagctaatgaagagcagagattcgaaccgaaacataaacctccacggccatgggggaagatctacaaacacctcatctatgccacgccgacattctccaatcccaccacgcggaccatgtccctgtccgatcgggagcaactggtccagctcgcgcgcgagttcgatgccttgatcgtgaccgatgacgtctacgatttcctgcagtggtccgtggatccagactgccccctggctgctccagacgaggcacgcgtgcctcggctggtcgacatcgatcgctacatggatggagggccccaggatgaatggggaaacgtcatcagtaacgggagcttcagcaagttgatcggccctggcatgcggaccggatgggcagaaggcacggccaagcttgcctacggtctctctcaaacaggttcatcgcgctccggaggggccccgtcccaaatcgcctccacgataattgcccagttgctcatcaatgggaccttccagtctcatctaacaggggtcttgcagcccgcctacgcgcgcaggtaccatgtcatgatgtcctccatccgcaagcacctcctccctctgggcgtagggctgcccgactcttcggaagtcgtcggcggatactttatctgggtgcgtcttccaagtccgttacgcgctgctgatatcgtgcaactggctcagaagacgcagaatctcagagtggctgctggtgagattttccaaatccccggggactcggtggaccgaggcaacgactttcatgatttcctgcgcctttgttttgcctggtccgaggaggatcaactcgctgaaggagtgcggcgactcggatgcgttatccatgatgctttggttggaccagcagccaattctacgtag

SEQ ID NO: 18769 - protein, 446 aa, Aspergillus fumigatus
MGVIPPEEPIDLFRGWPNPALLPTSALAQASATVLSTPSIRTPALLYGPDDGYLPLRKSVAEWLTHFYKPRDPVGFDRICITGGASQNLACIFQVFTDPSYTRHVWMVAPAYHLASRMVDDAGFAGRVRAVPQDDAGLDLDYLRREMEAAERKANEEQRFEPKHKPPRPWGKIYKHLIYATPTFSNPTTRTMSLSDREQLVQLAREFDALIVTDDVYDFLQWSVDPDCPLAAPDEARVPRLVDIDRYMDGGPQDEWGNVISNGSFSKLIGPGMRTGWAEGTAKLAYGLSQTGSSRSGGAPSQIASTIIAQLLINGTFQSHLTGVLQPAYARRYHVMMSSIRKHLLPLGVGLPDSSEVVGGYFIWVRLPSPLRAADIVQLAQKTQNLRVAAGEIFQIPGDSVDRGNDFHDFLRLCFAWSEEDQLAEGVRRLGCVIHDALVGPAANST

SEQ ID NO: 18770 - DNA, 1431 bp, Synechocystis sp
  CDS (1)..(1431)
atgacaacctcgcctaatcagaccctctaccaaacggtagcggatcaaattcatggactgattagcgaagggactttccagccaggcgatcgcctaccatcggtgcgaaaattacatcagcagtggtcagtaagtatttcaacagtcttggaagcttatcgcctacttgaggatcgaggattaatcgaagctcgtccccagtcaggctactttgtcaaaaccatattgaatttcctacccgacgagcctagtcccagcacacctcagtctgccgataatcctgttgatacgtctttagccttccgtgtaaataattcaatgttgaaacctggaatcattggcttaggggcggcgatcgctggtagcaatcttttacctatagctaccctcaatcgtttgatggggcaagtgatacgggctaagcccgaagttacccatcgctatagttcaccacaaggctgtgaagaattacgtcatgaagtagcacgtcgtctcatagacactggttgctctattacaccagatcagatcgttattacgaatggaacgacggaagcactctatctttccttaaaggctgtcacaaaacccggtgataccgttgtcatcgaatctcctacttatcatcttttgttggaaacccttgaagctcttcacctccggattctagagttaccgactcatcctcaacatggtatctcgctaatacacctcgaagatgctttgaaaaacgatcaaatttcagcttgtgtcctaattgcaaattttagcaaccctttaggtagttgcatgagtgattctaaaaagaaacagcttataggtttaattaatcattataatgttccattaattgaagatgacatttatggtgatcttaactttactggaaatcgcccaaaatcaatcaaatcctttgatactcagggtttagtcctgtattgttcatctataagcaaaacattatcacctggattaagaattggctgggctgtaccgggacgttatcagacaaaagttgagcaactaaagatgacgactaattatatgacagcagttgctccacaactgacaatcgctgcatttttagcgaatggtggttatgatcgccatttgcggaagctaagacgcacctaccaggcgcaaatgatggatatgactcaggcgatttgtaattactttcctaaaatgaccagagtatctaggccaaaaggaggctatattctctggattgaaatgccagaaatagttgatactcttcagctatacgaggatgcattacgtcataatattgccattgctccaggtagtatgttttcttcatctggcggttatcgtaactgttttcgacttaattttggtttgccttttacagaagagattcagcaagcaatgattgtacttggacaacttttgcatgagcagacaaaataa

SEQ ID NO: 18771 - protein, 476 aa, Synechocystis sp
MTTSPNQTLYQTVADQIHGLISEGTFQPGDRLPSVRKLHQQWSVSISTVLEAYRLLEDRGLIEARPQSGYFVKTILNFLPDEPSPSTPQSADNPVDTSLAFRVNNSMLKPGIIGLGAAIAGSNLLPIATLNRLMGQVIRAKPEVTHRYSSPQGCEELRHEVARRLIDTGCSITPDQIVITNGTTEALYLSLKAVTKPGDTVVIESPTYHLLLETLEALHLRILELPTHPQHGISLIHLEDALKNDQISACVLIANFSNPLGSCMSDSKKKQLIGLINHYNVPLIEDDIYGDLNFTGNRPKSIKSFDTQGLVLYCSSISKTLSPGLRIGWAVPGRYQTKVEQLKMTTNYMTAVAPQLTIAAFLANGGYDRHLRKLRRTYQAQMMDMTQAICNYFPKMTRVSRPKGGYILWIEMPEIVDTLQLYEDALRHNIAIAPGSMFSSSGGYRNCFRLNFGLPFTEEIQQAMIVLGQLLHEQTK

SEQ ID NO: 18772 - DNA, 1347 bp, Actinoplanes teichomyceticus
  CDS (1)..(1347)
atggaatcgtctgcgctgcgcaagtcggaattgcatccgagcatttcggacccggttctggacacgatgaatttcctcaacgaggtgaccctgcgctatcccgaggcgatctcgttcgcgccgggccgcccgtacgacggcttcttccagaccgaggaggtcctcgcccacctgcgccgctttctcgaccacctggccgaccagggcgcctcgcccgcgcaggtgcgcacggcggtctaccagtacggcccgaccgccggccagatccgcgagatcatcgccgactcgctgcgccgggacgaggggatcgacgtgccggccgagtccatcgtggtcaccgtcggcgcgcaggaggcgatgatgctggtcgtccgcgcgctgatccgtgacccgcgggacgtgctgctggtgcccagcccctgctacgtgggcatcaccggggtggcccggctgctcgacgtgacgctcggcccggtgcccgagtcgccggacggcttctccctggagaacgtggcggcggcgatccgggcgcagcgggccgccgggcgccggccgcgagccttctacctggtgcccgaccacgccaacccgtccggcaccacgctgtccgagtcggaccgggccgggttgctgcacctggccgcgaaggaggatctgctgatcctggaggacaccccgtaccggctggtcagccccggcgagccggtgcgcacgctgaaggcgctggaccgccgccgctcggtggtgcacctggggtcgtactcaaaaacgatctttccgggcgcgcgggtgggcttcgccgtggccgaccagacggtggtcggcgacgacggccggaccggcctgctcgccgacgagctctcgaagatcaagagcatggtgacggtcaacacctcgtcgctgagccaggcggtggtggccggcgcgctgctcgcggccggcggccgggtctccgagctgaacgccaaggcggccgggcactacggcgacgccatgcgccgggtgctcgaccggctcgccgaccggttgcccgcggcgcggcgcgcggagctgggcgtgcggtggaacgaacccagcggcggcttcttcctgagcctgaccgtcgggttcgaggccgacgacgcggcgctcacccggtccgccgagcagttcggcgtcatctggacccccatgcggtacttccacccggacggcggtggccgccgggcgatccggctgtcggtcagctatctgtcgccggaggagatcgacgaggggatcacccggctggtcgcgttcatcgaggccgagacccgccggcaccgggcccgtcccggcaccctcccggcggggcacggcgcggtgtga

SEQ ID NO: 18773 - protein, 448 aa, Actinoplanes teichomyceticus
MESSALRKSELHPSISDPVLDTMNFLNEVTLRYPEAISFAPGRPYDGFFQTEEVLAHLRRFLDHLADQGASPAQVRTAVYQYGPTAGQIREIIADSLRRDEGIDVPAESIVVTVGAQEAMMLVVRALIRDPRDVLLVPSPCYVGITGVARLLDVTLGPVPESPDGFSLENVAAAIRAQRAAGRRPRAFYLVPDHANPSGTTLSESDRAGLLHLAAKEDLLILEDTPYRLVSPGEPVRTLKALDRRRSVVHLGSYSKTIFPGARVGFAVADQTVVGDDGRTGLLADELSKIKSMVTVNTSSLSQAVVAGALLAAGGRVSELNAKAAGHYGDAMRRVLDRLADRLPAARRAELGVRWNEPSGGFFLSLTVGFEADDAALTRSAEQFGVIWTPMRYFHPDGGGRRAIRLSVSYLSPEEIDEGITRLVAFIEAETRRHRARPGTLPAGHGAV

SEQ ID NO: 18774 - DNA, 1563 bp, Desulfovibrio vulgaris
  CDS (1)..(1563)
atgaacatcccgctggacagaagcctcagcctacctctctatgcacaggtcgccgccttcattcgcgcgcagatagaacgcggtgcgctcgaaccgggcatgaggctgccttccatacgccgcctctcacaagacctcggcgtaaaccgcgtgaccatcgagacggcctacggtgaacttgaggccgatggcctcgtgaccgcacgcgggggcagcggaacgttcgtgcttccgccctttcccgcatgtgccctgccctctctcgacggtagggcggtccccgccgccccccccgctgcgacaggcaggaaaaggggcacggcgtcttcggcttctgatgccgccaccgtcgaacttccgcgctggcagcaggccctttgcgacagacgacccgacctgtcctgcgacctgatgattcccttgcaggttcccggtcccgatgaaggccccatcgccctcgccagcggcaacagcgacgcacgcctcttccccctcgcctcgttcagacgcactctgcgcaccgttctcgcccgcgacggcatcaaggcccttgagtatgaagacccggcgggctacgcgcccttgcggcgcaccatcgcgcgcatcctcgccgaccagggtgttccggcgacacccgacacggtgctcgtcacagcaggctcacagcaggcactccatcttgtggcgcaggtcgtcctgaaaccgggagaccccgtgtatgtcgaaacgccatcctacgccgacggcatggcgctcttccgcacactggggttacgcatcgtacccgtcttcacagacagcgaaggcatgtccgccgagggactgcgcgaagccatcgcccgccacggacacgggctcgtcttcaccatgcccaatttccagaaccccacgggcatctgcatgagcggccagcgcagacgacggattgcggccatcgccgtggcgcacggtgttccaatcctcgaagacgactatgtgggtgacatcagatacgaagggtattcacagccttcgctacacagcctcactccgcccggacacaccttttacgcagggacgttctccaagatgctggtccccggccttcgcatggggtacctcgtggccgaagggccggtgctgcggatgctggcacgggtgaaacgcatgtacgacctctccacctccagcgtcgtacagcgcacactggaacgcttcgtcgacctcggcagctaccgtgcccacctcacccgcgcgtgccgtatctacaaggtgcgtcgtgatgcccttctcgacagcgcagtgcgccacctgccggacgatgtgaccatcgcccccgtgcggggcgggttgttcgcatggatgacgctgccggagggggtcggtgccactgtgctggcccacgaagcggcgcggcatggcgtgaccgtgactccgggtacccccttcttcgcagaagggctggaaggtgaacgacacctgcgcatcaacttcacccagcacgaccccgagattctcgaagagggaatgcgccgccttgcacgcgccatcgcccgctgccgcaagggaaagcactgtgcctga

SEQ ID NO: 18775 - protein, 520 aa, Desulfovibrio vulgaris
MNIPLDRSLSLPLYAQVAAFIRAQIERGALEPGMRLPSIRRLSQDLGVNRVTIETAYGELEADGLVTARGGSGTFVLPPFPACALPSLDGRAVPAAPPAATGRKRGTASSASDAATVELPRWQQALCDRRPDLSCDLMIPLQVPGPDEGPIALASGNSDARLFPLASFRRTLRTVLARDGIKALEYEDPAGYAPLRRTIARILADQGVPATPDTVLVTAGSQQALHLVAQVVLKPGDPVYVETPSYADGMALFRTLGLRIVPVFTDSEGMSAEGLREAIARHGHGLVFTMPNFQNPTGICMSGQRRRRIAAIAVAHGVPILEDDYVGDIRYEGYSQPSLHSLTPPGHTFYAGTFSKMLVPGLRMGYLVAEGPVLRMLARVKRMYDLSTSSVVQRTLERFVDLGSYRAHLTRACRIYKVRRDALLDSAVRHLPDDVTIAPVRGGLFAWMTLPEGVGATVLAHEAARHGVTVTPGTPFFAEGLEGERHLRINFTQHDPEILEEGMRRLARAIARCRKGKHCA

SEQ ID NO: 18776 - DNA, 1167 bp, Desulfovibrio vulgaris
  CDS (1)..(1167)
atgcagatagcgaaacgcatggataacgtgcagcggtcctatatccgcgagattctcaaggtcacggcgcgtcccgacatcatctcgttcgcgggcgggttgccgcatcccgattcgttcccggtgcagggcgtggcagaggccgcagccgcggtactggccgaaagcggaagcgaggccctgcagtacagcaccaccgagggctacctgcccctgcgcgagtggatttccgcccgttatgcacggcagggcatcgaagtgtcccccgatgagattctgatcaccaccggttcgcagcaggcgctcgacctcgtggccaagaccaccatcgaccgcggcgcgcccgtggtcatcgaacgtccgggctatctcggtgccatccagtgtttttcgttctacggcgcgcaattccgtaccgtagacctcacgcccctcggcgtcgatgtcgaggccctgcgccgtgaggccaagggtgcccggctgttctatgccgtgccaagcttccagaacccttccggcatcacctacgatgagccgacccgccgcgaagtggccgccatcatggccgagacgggctgtatgctcgtcgaggacaatccctatggcgaactgcgcttcatgggtacgccggtggcgcccatccgcaagtgggccgagtcgccttcggtgctgctcggttcgttctccaaggtggtctcgccggggctgcgcatcgggtgggcctgtgcccctgccgaactcatgcggcacatggtcaccgccaagcaggcaagcgacctgcatacccccatgttcacgcagcgtctgctgcatcgcttcctcgtggacaacgacgtggacgagcacatcgcctcgattcgcaaacgctacggggcgcagcgccagtgcatgatggacgccatccgcaagcatttccccgaatgcgtcaccgtgacggaacccgagggcggcatgttcctgtggtgcggtctgcccgaaggcgtgacctctgagcatctgttccacaaggccatcgagcgcaaggtggccttcgtgcccggttgtccgttctatgtggacggcaccgacaccggcttccgcctcaacttctccaacgccagtcaggacgacatcgtcgagggcatcgcgcgcctcggcgcgtgcctcaccgaagagcttgcgcgttag

SEQ ID NO: 18777 - protein, 388 aa, Desulfovibrio vulgaris
MQIAKRMDNVQRSYIREILKVTARPDIISFAGGLPHPDSFPVQGVAEAAAAVLAESGSEALQYSTTEGYLPLREWISARYARQGIEVSPDEILITTGSQQALDLVAKTTIDRGAPVVIERPGYLGAIQCFSFYGAQFRTVDLTPLGVDVEALRREAKGARLFYAVPSFQNPSGITYDEPTRREVAAIMAETGCMLVEDNPYGELRFMGTPVAPIRKWAESPSVLLGSFSKVVSPGLRIGWACAPAELMRHMVTAKQASDLHTPMFTQRLLHRFLVDNDVDEHIASIRKRYGAQRQCMMDAIRKHFPECVTVTEPEGGMFLWCGLPEGVTSEHLFHKAIERKVAFVPGCPFYVDGTDTGFRLNFSNASQDDIVEGIARLGACLTEELAR

SEQ ID NO: 18778 - DNA, 1434 bp, Bacillus cereus
  CDS (1)..(1434)
atgacaaatagtaaaaaactgcctaagtatcggcagatagtagattatatgaaagaaaaaattgaaaatggagagtggccaattggaagtaagatccctagtcaaaggcagttagcaaaatcatttcaagtaaatcgtagcactgtaataactgcactagatgaacttatggctgatggactgattcaagggaaaattggagcaggaacaattgtaacgaataatacatggtcattattagcaacgaatccaccacctgattggagtgaatatgtaaaggccggtattcataaaccaagcaagttaatggtacgagaaataaatgaggcagaagcaaataacaaacttatccatcttagtaaaggcgaacttgctcctcatctttttccgttagaaacgatgcagtccattatgaaaaaagtaagtgaggaattagattattttggatacgaagaacaaaaagggttttatccgttacgtaaagcaataagtaaatacgtaaaatcattcggaatacatacgtcaccgagttctatattaatcgtctctggtgcattacaagcattgcaattaatatcaattggtcttttgcatagagaatcaactgttttacttgaacaaccttcttacttatattcacttcatgtatttcaatcagcaaatataaatttatctggtatagctatggatcatcacggtgttttacctaacgaattattaaaacgcattaaatatagtaaaaagaaaaacattttatattctatccctagttttcaaaacccaacagggatattaatgtctaaagagcgaagaaaagaaataataaaaatatgtgaaaaggaacagttacctattattgaagatgatatttatcgcgagttatggattgatgaaccacctccagtccctttaaagtcgatagataaacatggacatgtattatatgttggtagcctatctaaaacacttagcccaggacttagaattggatggattattggacctgaaccagttattgatagattgtcagatataaaaatgcaaacagactatggatcgagttcattatctcaaagggttgctgccgaatggataaataaaggtttttatgaggaacatgttgcaaacgtaagaattcaactaaaagaacgaagacaaatcatgatacgggctttaaataagtattgtgcagatgttgcaacgtgggatattcctagtggtggattttttatatggctaaaggtagtacctagcattccgatgaagaaattattttcagaggctctatcaaaaggggttctattaaacccaggacgtatctatgaagaagaatcagatcagtacatacgtttatcgtatggatatgcttcccctgaacaaatcactaacgggattaaattgttgagtgaattaattcgtaagctaatggcataa

SEQ ID NO: 18779 - protein, 477 aa, Bacillus cereus
MTNSKKLPKYRQIVDYMKEKIENGEWPIGSKIPSQRQLAKSFQVNRSTVITALDELMADGLIQGKIGAGTIVTNNTWSLLATNPPPDWSEYVKAGIHKPSKLMVREINEAEANNKLIHLSKGELAPHLFPLETMQSIMKKVSEELDYFGYEEQKGFYPLRKAISKYVKSFGIHTSPSSILIVSGALQALQLISIGLLHRESTVLLEQPSYLYSLHVFQSANINLSGIAMDHHGVLPNELLKRIKYSKKKNILYSIPSFQNPTGILMSKERRKEIIKICEKEQLPIIEDDIYRELWIDEPPPVPLKSIDKHGHVLYVGSLSKTLSPGLRIGWIIGPEPVIDRLSDIKMQTDYGSSSLSQRVAAEWINKGFYEEHVANVRIQLKERRQIMIRALNKYCADVATWDIPSGGFFIWLKVVPSIPMKKLFSEALSKGVLLNPGRIYEEESDQYIRLSYGYASPEQITNGIKLLSELIRKLMA

SEQ ID NO: 18780 - DNA, 1437 bp, Geobacter sulfurreducens
  CDS (1)..(1437)
atgaacacggtgaaaagcggaggcaaaatccctctctacgaatcggtggccggccgcgtggcccaactcatcggcgagggaacattccgggcaggggaccggattccgtcggtcagggcactggggcggcaattccaggtgagcctcaccacggtgatggaggcctacaccctcctcgaggatcgaggactcatcgaggcgcgcccccaatcagggtactacgtgagagcccgcttccccggctcgacagccgagccggaaatgacggcgccgcccctgaaacctacaaccgtcggcacggcggaactctccatgatggtaatgcgggatacccgcaacccggacctcgtcccgctgggcgccgccattcccaatcccgagctgctgccggtggaccggttgaaccggatgctcgccaccgagagccggaaacatgccgtggccagcgtctcctacgatatgccacccggctgcgagcggctgcgggtccagatcgcccggcggatgctggccgtggggtgcgccttggcgccggaccagatcgtgaccacctccggctgtatcgaggcggtagtcctgtcgctgcgggccatctgccgtcccggggatacggtggcagtggaatcgccggtgtactacaacttcctgcaggcgatcgacctgatggggctcaaggccctggagatccccacccatccgcgcacggggatcagcctcgacgccctgcgctacgcccttgatcacaccccgatccgggcctgcctggtggtcgccaacttcaacaatcccctgggaagcctcatgcccgacgaccacaagcgcgaactggtggcaatgctggcggcccgccggattcccctcatcgaggacgatatctacggcgatctgagtttctccccggaacgcccccgggcggccaaggccttcgacgaggcagggctcgtcctgtactgcacatcggtcaccaaaaccgttgcaccgggctaccgggtcggctgggtggctccggggatcttccaaaaggagatcgagcggctcaaagcggtgaccaccatcgcctgctctacgcccacggagcttgccgtggcggagtttcttgccaacggcgggtatgaccaccacctgcggcgcatccgcaggatctacgcccgccagatgtccctcatggccgaggcggtggggcaggcattcccggtcggtacccgtgtcacccgacccgaaggggggtttgtcctctgggtcgaatgccccgagcgggtggactccctggttctctacgagcaggcgctcaccagggggatcaccattgcgccgggtccaattttttcggccaccggcaagtaccgcaactgcatccgcctgaacgccgcatggtgggacgatcgggtggaacgggccatccatacccttggagaactggccgccgccatgatgtga

SEQ ID NO: 18781 - protein, 478 aa, Geobacter sulfurreducens
MNTVKSGGKIPLYESVAGRVAQLIGEGTFRAGDRIPSVRALGRQFQVSLTTVMEAYTLLEDRGLIEARPQSGYYVRARFPGSTAEPEMTAPPLKPTTVGTAELSMMVMRDTRNPDLVPLGAAIPNPELLPVDRLNRMLATESRKHAVASVSYDMPPGCERLRVQIARRMLAVGCALAPDQIVTTSGCIEAVVLSLRAICRPGDTVAVESPVYYNFLQAIDLMGLKALEIPTHPRTGISLDALRYALDHTPIRACLVVANFNNPLGSLMPDDHKRELVAMLAARRIPLIEDDIYGDLSFSPERPRAAKAFDEAGLVLYCTSVTKTVAPGYRVGWVAPGIFQKEIERLKAVTTIACSTPTELAVAEFLANGGYDHHLRRIRRIYARQMSLMAEAVGQAFPVGTRVTRPEGGFVLWVECPERVDSLVLYEQALTRGITIAPGPIFSATGKYRNCIRLNAAWWDDRVERAIHTLGELAAAMM

SEQ ID NO: 18782 - DNA, 1317 bp, Ashbya gossypii
  CDS (1)..(1317)
atgggagatggatcgcagatcaacttcttcaagggccatccttctgtgcgcctacttccccgagagagcatcatcaaaagtaccaaggagttgttggagcctgaacatcgcgggtatgaccagaatccagaggattgccacccactcacgtatggctccgagcagggctcgctatgggtccgctcggccattgctacgctgatcaacgactgctaccgccccgagaaggccactcgtgccgaacatgttaatctcactggcggtgcttcctatggaattatgaacatcctgatgcagacgacgctggctcacgccggctatacccggcgagcgttccttgtctcgcccacgtactttcttatcaaccagatattcctcgacgctggctttggcggccgcatgaccgctgtccgggaaacccaggatggccagcttgaccttgagtatcttgcagagaagctttcggagtttgacgcagagcatccatccactgaggcactcacggaaccgcggcgcacaccgcctaaacgcacctaccgatacgtcatgtatctgataccgacatattcgaatcctagcgggtccacatactccctagagacacgcacgcgcttagtcgagctggcgcgccgctatgatatgctgctcatctcagatgacatctacgatttgctcgcttacgaccaaccgtccgatcaattgcctcgcgcattgcctagccttgtgcacgtggaccgcgccaccctgaacgaagaacaggatagctggggccataccgtggcaaacgccagtttctcgaagattgttgcgccgggtctgcgctgtggttaccaggaatccgtgacctctcgcctggtcggacagctggccaatgggggcgccaacgtgtccggcggctcgcccgcccagctcaacagcatgataattggcaccctcatctccacaggcgaactggcacatctgctccagttgctacgcagtgtttaccaagaccgcgcagaggttttgcaccgagctgtgcgtgaatatctgcccgctgcaaccgattacaaagcacaaaacggcggctatttctcctggtgcacgctgcccgagggctacaactcagaagcgatctgccgcacgctgcagcatgactacggtgttgtattagccaatgggtcacactttgaggtcagcgacgatgagctcgggtggggccgccgctccgtgcgcctctcagtcagctttttagaaccagcggagatcgaagaaggcatgcgcaggtttggagcggtatgccaagagcacgccactgccctgggcctgcctttctag

SEQ ID NO: 18783 - protein, 438 aa, Ashbya gossypii
MGDGSQINFFKGHPSVRLLPRESIIKSTKELLEPEHRGYDQNPEDCHPLTYGSEQGSLWVRSAIATLINDCYRPEKATRAEHVNLTGGASYGIMNILMQTTLAHAGYTRRAFLVSPTYFLINQIFLDAGFGGRMTAVRETQDGQLDLEYLAEKLSEFDAEHPSTEALTEPRRTPPKRTYRYVMYLIPTYSNPSGSTYSLETRTRLVELARRYDMLLISDDIYDLLAYDQPSDQLPRALPSLVHVDRATLNEEQDSWGHTVANASFSKIVAPGLRCGYQESVTSRLVGQLANGGANVSGGSPAQLNSMIIGTLISTGELAHLLQLLRSVYQDRAEVLHRAVREYLPAATDYKAQNGGYFSWCTLPEGYNSEAICRTLQHDYGVVLANGSHFEVSDDELGWGRRSVRLSVSFLEPAEIEEGMRRFGAVCQEHATALGLPF

SEQ ID NO: 18784 - DNA, 1455 bp, Bacillus subtilis
  CDS (1)..(1455)
atgaccttgtcgcaatggcagccaagccgaaagtcggatgttccgctgcatcggcagatcgaacaatatatgaaagacaagattcttcacggagagtgggctgtagggacgaaaatcccctcacagagaacgctggccgacatgtttcaagtcaaccgcagcacagtcacagcagccatagatgaactcacgtctcaaggcttgttagagggaagaaaaggcggcggtacgaaggttgtaaacagtacttggagcgtgctgacggctgagcctccgcttgattggagcgattacgtccgttcgggcattcatcgcgccaattcttccatcattcaagctattaatcagaacgaaccaagagcggatatcatcagattaggaactggagaactttcaccggatcttgtgcctgctgacacaattggacggatgtttcagcaaatcaatccgggcgtcctgtctttaggatatgagcagccgaaaggaaaccgtcagctgcgggaggcagtggccgaccatttaaaaggaaagaagatccatgtgtcaccgtctgcaattttaattgtgtccggtgcacttcaggcacttcagctcatctcaattggacttttaaaacgagattctgtcattttgacggagaagccgtcctaccttcaatccttgcatgtatttcaatcagctgggatgcggcttcgcggcttgccgatggatgatgaaggggtcaaagcggggcttgtttcttctaatcgaaaacaatatggaggacagctgctttacacgattccgtcgtttcataatccgacaggcacagtcatgtcagagcagcgaaggaaagagatcatcagcctgtcaaaaaaagagcagatgcccatcattgaggatgatgcgtacggtgatttatggtttgaagaaaaaccgccgcagccgttgaaagcaatggatcatgagggcaatattctgtatctgggcgcgttttcaaaaacggttagccccggtctgcgaatcggctggcttgccggtccggagccggttattgaaaggctggcggacattaaaatgcagacagactacggatcaagcggcctgtcccagtgggcggctgccgagtggctgtcacagggatattatgaagagcatctgacttgggtacgcaggaagcttaaagaaaggagagacgccgccgttcattttctcgagcggtatgccggggacattgccacgtggcggattcccgcaggcggcttttatatttgggtgacatttcacaaaaacctgcctgtcagccgtttcttttatgaattgctgaaacggcaggtgcttgtgaatcccggctatatttatgacggtgaagaccgaaacagcatcaggctgtcatattcctatgcatctcttggagatttggaaactggcattaaagcggcagctgaaacagcacgccgcctgatgatgtcctag

SEQ ID NO: 18785 - protein, 484 aa, Bacillus subtilis
MTLSQWQPSRKSDVPLHRQIEQYMKDKILHGEWAVGTKIPSQRTLADMFQVNRSTVTAAIDELTSQGLLEGRKGGGTKVVNSTWSVLTAEPPLDWSDYVRSGIHRANSSIIQAINQNEPRADIIRLGTGELSPDLVPADTIGRMFQQINPGVLSLGYEQPKGNRQLREAVADHLKGKKIHVSPSAILIVSGALQALQLISIGLLKRDSVILTEKPSYLQSLHVFQSAGMRLRGLPMDDEGVKAGLVSSNRKQYGGQLLYTIPSFHNPTGTVMSEQRRKEIISLSKKEQMPIIEDDAYGDLWFEEKPPQPLKAMDHEGNILYLGAFSKTVSPGLRIGWLAGPEPVIERLADIKMQTDYGSSGLSQWAAAEWLSQGYYEEHLTWVRRKLKERRDAAVHFLERYAGDIATWRIPAGGFYIWVTFHKNLPVSRFFYELLKRQVLVNPGYIYDGEDRNSIRLSYSYASLGDLETGIKAAAETARRLMMS

SEQ ID NO: 18786 - DNA, 1407 bp, Vibrio vulnificus
  CDS (1)..(1407)
atgaatcgttatcgccaactggcacagtcgtttagacagcagatcgaaagtaaaacttggagagcgggagaaaaactgccttcagtgcgaatggcttgcaagcatcatggtgtcagtgcgggtaccgtgttacaggcgtatcaattgcttgaagcgcaagggtgggttattgcaaagccgcaatcgggttattttgtcacctctgatttgcaacgactcacggaaccacgagaaccgtccgtgagtgcgctaccgtcatttagtgacgagttgtatgactttctgaaagatcaaagtgagagtcaggcggtgaaactgggttcggctttccccgatgttcatcttttccccttagaagccctcaatcgcaatttagccagtgcggggcgtaagatgtctgcgaatgatctgctcaacaacttaccgccaggcaatgaagcgttgagacgcttgatcgcacagcgatatatccagcaagggatggatttgacccatcacgacatcgttatgacctcgggcgcaatggaagcgctaaatctgagtttgcaagtggtcacaaagccaggagataccatcgtcgtcgaatctccgtgtttttatggcgcactgcaagcggctcagcggcttgggctcaacgtcattgaagttgatgttgatgagcgtgatggcctgaatcttgagcagttcgagcacgtgcttgctaacaatgaagtcaaagcgtgttggttgatgagtaacttccaaaatccaacaggcgtgacattgagcgagcaaaagaagcaagcggtggtcgagctcgttcatcgttatcagctttacttaattgaggacgatgtttactccgagctctactattcacaagataagcccagctcgtttaaaacctatgatcgggaagatcgtgtattgcattgtggttcactgtcgaaaagcttgtgccccggttatcggcttggttgggtcgtgacaaggcgttttaaccatgcaatccaaaagttgcagctgacttctacgttatcgggcagtgcaccgatacaacaaggcgttgcgtattacttgcaaaacgatggctatgataaacatctgcgcaagttgcgtagcacgctaaaacaacgacagcaatggatgatgaacgaactcaggcgacaattgcctgatacggtgcaattttcatcgccgacgggtggctattttttatggcttaaactacctgaacctattcaagcgcgtctggtgtacacacgactgaagcagcagggtgtgctatcggcttatggtggcttatttagccaaacaaagcggtttgaccattatttacgtatcaattgctcattgccggaaagtgatgaacttgtgcaagcaatccgatgtttggcggtgacgattaaccgtctcgcaactgattag

SEQ ID NO: 18787 - protein, 468 aa, Vibrio vulnificus
MNRYRQLAQSFRQQIESKTWRAGEKLPSVRMACKHHGVSAGTVLQAYQLLEAQGWVIAKPQSGYFVTSDLQRLTEPREPSVSALPSFSDELYDFLKDQSESQAVKLGSAFPDVHLFPLEALNRNLASAGRKMSANDLLNNLPPGNEALRRLIAQRYIQQGMDLTHHDIVMTSGAMEALNLSLQVVTKPGDTIVVESPCFYGALQAAQRLGLNVIEVDVDERDGLNLEQFEHVLANNEVKACWLMSNFQNPTGVTLSEQKKQAVVELVHRYQLYLIEDDVYSELYYSQDKPSSFKTYDREDRVLHCGSLSKSLCPGYRLGWVVTRRFNHAIQKLQLTSTLSGSAPIQQGVAYYLQNDGYDKHLRKLRSTLKQRQQWMMNELRRQLPDTVQFSSPTGGYFLWLKLPEPIQARLVYTRLKQQGVLSAYGGLFSQTKRFDHYLRINCSLPESDELVQAIRCLAVTINRLATD

SEQ ID NO: 18788 - DNA, 1425 bp, Photorhabdus luminescens
  CDS (1)..(1425)
atgatgaagcgttatgaacaatttgccaggcaaattcttcaacatattgaagatggtacctggctggtgggagatagattaccttcattgagggaatcagtgaagttatcaggtttgagtttgatgaccgttgttcaatcgtatcaattactagaaagtcagggatggatcatttcccggcctcaatcgggttattacgtcgctaaacgtttgcagccctttgccgcagcaaaagggggaaagcgattacatttaagtgaaagcgtggaaataagcgcttctatttttgatgtattacaggcgtgcaaagatcctgcgattattccgtttggtttagcatttccagatccatccttattgattcaacctaaactttccaaagcgttagcggctgctgccagacgaatagcaccacatagcgctttagctaatttaccgccgggtaatgataagttacgccgtaacatatcgcgccgttatgcaatgcatggtattcatgtccctcctgatgaaattgtcatcactgcgggtgcgatggaatcactgagtttcagtttacagtcggtgacagaaccgggggattgggtggtgattgaatcaccggctttttacggtgctttacaggccattgaacgtttacgtctgaaagcggtagccatcaaaactgatccacaaaacggtattgatttggatgcgttggaggaggtgatccagaaatacccaataaaagcttgttggttaatgactcactttcagaacccgctagggggaacgatgtccgctgaaagtaaattacggctggtgaatatcctgaacagtaatcaggtggtgctgattgaagatgatgtttatggtgaactctacttcgatcagcaacggcctgtaccggcgaaagggttagacagtgaaaacaactttatgcactgctcctcgttttctaaatgtctggccccgggattccgtgtgggttgggtggcagcaggaaaacatgccaagaaaatccaacagttacaaatgatgagtaccgtttctgccagcatgccgacgcaattggcaattgctgattatcttgcggaggggggatatgacaaccacttacgtcgccttcgtcgcatattggagcaacgtcagcaactgatgttacgagcaattggtgactatatgcctgcttcagtcaaagtgaatcgccctaaaggtggctattttctctggttggaatttgagcctctgttcagtgcacagcggctttatcaactggcattggcagaagggatcagtattgcaccgggcagtatgttttgcaccagcgaacagtttaaccatgcctttcgtctgaatgcctcttttgattggaatcagcaaatggaacgtgcgatgcagactttgggcaatatttgtcatacattattggttgaaatagcctga

SEQ ID NO: 18789 - protein, 474 aa, Photorhabdus luminescens
MMKRYEQFARQILQHIEDGTWLVGDRLPSLRESVKLSGLSLMTVVQSYQLLESQGWIISRPQSGYYVAKRLQPFAAAKGGKRLHLSESVEISASIFDVLQACKDPAIIPFGLAFPDPSLLIQPKLSKALAAAARRIAPHSALANLPPGNDKLRRNISRRYAMHGIHVPPDEIVITAGAMESLSFSLQSVTEPGDWVVIESPAFYGALQAIERLRLKAVAIKTDPQNGIDLDALEEVIQKYPIKACWLMTHFQNPLGGTMSAESKLRLVNILNSNQVVLIEDDVYGELYFDQQRPVPAKGLDSENNFMHCSSFSKCLAPGFRVGWVAAGKHAKKIQQLQMMSTVSASMPTQLAIADYLAEGGYDNHLRRLRRILEQRQQLMLRAIGDYMPASVKVNRPKGGYFLWLEFEPLFSAQRLYQLALAEGISIAPGSMFCTSEQFNHAFRLNASFDWNQQMERAMQTLGNICHTLLVEIA

SEQ ID NO: 18790 - DNA, 1296 bp, Anopheles gambiae str
  CDS (1)..(1296)
atggaaggttctactgctgccgtgctgcggcgggaagtgccaatgagccatcttttcgatggcggtgcactgaacgtgtacgatcagcaggtggccaacctgtcggccggtgcaccggggccggatttgcttggcaagagtgcgcaattctttcagcaagctaccgaagagcggatcaaatatgagctaaaaaattcatccttcctcttccaatacggtccatcgattggtacgacggaatttcgcaaatcgctcgcctccttccttgccgacggctatcggagcgaggtaaacatgtccgatctggttcaaaccagtggtgcgacgaacgggctgcacctgatactctccaccctggtcgatctggcgggcgtaatattcgtcgacgagtacacgtacatgatagcgctcgaaaccatcgcccagtttaataccatgaaaatagtaccagtgccccttgacgaggacggccctaacatcgccactctgcaggcgttgatcgatcagcaccggttcgagccgacgaaagggaaactattttggggcgtttattacacgatgccgacgttccacaacccgaccggtatcgtcttctccgaggcaaagtgtcaacagctgataaaactcgctcgcgcaaccgacatcttgattgcgtgtgacgacgtgtacaatttattgcactacgctgatccggacgcgccaccgccaaagcgcctgttcgcgcgcgacatcgccgacctgggccgggtggagggatggcgcggcaacgtgatctcgaacggatccttctccaagatcctgtcgcccggcatacggctcggctggatggagtgtcctccgcgctgtgtcgaagcattccgcaacagtggagtgctcatgagtggaggtgcggccaacaactacaccggcggtgtagtggccaccctcatccagatgggcttggcacggcgacagctggaccactaccgcaccaactacgccgcacggctggacgcgatggcggaaacgctacaggcgcaccttcccgccggctgcagcttccgcaaaccgaacggcgggtacttcgtgtggatccgcttcccatcgcacatcgactgtgccgagtttaatcggtactgtttggagaagtatcgcgtttccgccattcccggcgtacggttctctttcgcgaaggaggcgcgccactttctgcgcctcacgtttgcgttccacgagccggattatctgcgccgcagcgtgcggacactgtgcgaggcggccagggagtatctggagatagctgccagcacagtgtag

SEQ ID NO: 18791 - protein, 431 aa, Anopheles gambiae str
MEGSTAAVLRREVPMSHLFDGGALNVYDQQVANLSAGAPGPDLLGKSAQFFQQATEERIKYELKNSSFLFQYGPSIGTTEFRKSLASFLADGYRSEVNMSDLVQTSGATNGLHLILSTLVDLAGVIFVDEYTYMIALETIAQFNTMKIVPVPLDEDGPNIATLQALIDQHRFEPTKGKLFWGVYYTMPTFHNPTGIVFSEAKCQQLIKLARATDILIACDDVYNLLHYADPDAPPPKRLFARDIADLGRVEGWRGNVISNGSFSKILSPGIRLGWMECPPRCVEAFRNSGVLMSGGAANNYTGGVVATLIQMGLARRQLDHYRTNYAARLDAMAETLQAHLPAGCSFRKPNGGYFVWIRFPSHIDCAEFNRYCLEKYRVSAIPGVRFSFAKEARHFLRLTFAFHEPDYLRRSVRTLCEAAREYLEIAASTV

SEQ ID NO: 18792 - DNA, 1683 bp, Neurospora crassa
  CDS (1)..(1683)
atgggggaagcactcatcaacggctccggcgccgtctccaacgtcagtgccttggaaacgcttggtcccgcagccaagctaacggacgccgacccttctgagatcccacctgcatcaggccccggccgggagaatgcagtcaccatcagcgacatcctcgagaggcgtgccaaagctggcagactcattgcaccgaccgcttcgtacgcggatagcgacatgtttaagggtccgcaagtaggaaaacccaaatccaagtctatgaaccatcacctctccgccgaatccctttcccgccacccctgtgcccttaaacaagccgcccgccacctcaaaaaccccaacatcatctccctcggcggcggccttccctgcgccgagtacttccccatcgaatccatcaccctcaaggtacccacaccgcctgacttctccgaagccgccacgtcccagtccggggccgaagtccgcatcggcaagtacgacgccaccgacccttccatccagggcacctacgacctggccgttgcgctcaactacgcacaagcctccggctccgcccagctgttgaggttcgtcactgagcacactgaattggtccacaacccgccttacagtgactggcggtcctgcctgacgataggcagcacgggtgctctggagcagactcttcgcatgctctgtgacgggccggggaggcgtgacagtcttttgacggaggagtattcgttctccacggctctggagacggcggggccgttggacctaaaggtggtgggtgtcaagatggatgggcaggggttattgccggaagcgatggatgagcttttgtcgaactggaatccggaagagagagagggcaggaggaagccgcatgtgctgtacacggtgccgagcggacagaatcccacgggcaccacgcaggggttggagaggaggaagcaggtgtatgaggtggcgaggaagcacgatttgtttgtgattgaggacgagccgtattattatcttcagatgccgttggaggagtccaaggagacggaatcggaggaggagacagtggaatccttcatgtcctcactcatcccctccctcttgtccctggatgtcgacggccgcgtcctgcgcatggattccttctccaaggtggtcgttccgggatcgcgtgtcggatgggtgacggcctcggagaatatcatcgagcagtacctccggcacgccgaggtgtgcaaccaaggcgccaacggcatctcgcaggtgatcctgtacaagctgctggacgagcaatggggacatgaggggtacttcaagtggttgatgaatctgaggcaggagtataccaagcggagggataccatggtgacggcggctgagaagttcttgcccaaggaggtggtgagctggactgtgcctgttgctggcatgttttactggctcaagatcgaccactcccagcaccccggtattcaggctggaaaaggcattttggaagttgaagaggagatcttcaactcttgcatcgccaggggcgttttggtcgctcgaggatcttggttccgcgctgaacaagatacagagccgaacgagcttttcttccgcgcgacgtttgcggcagcaacggccgagaacatgacagaggcaattagaaggtttggagaggccatcagagagagcttcaagttgtga

SEQ ID NO: 18793 - protein, 560 aa, Neurospora crassa
MGEALINGSGAVSNVSALETLGPAAKLTDADPSEIPPASGPGRENAVTISDILERRAKAGRLIAPTASYADSDMFKGPQVGKPKSKSMNHHLSAESLSRHPCALKQAARHLKNPNIISLGGGLPCAEYFPIESITLKVPTPPDFSEAATSQSGAEVRIGKYDATDPSIQGTYDLAVALNYAQASGSAQLLRFVTEHTELVHNPPYSDWRSCLTIGSTGALEQTLRMLCDGPGRRDSLLTEEYSFSTALETAGPLDLKVVGVKMDGQGLLPEAMDELLSNWNPEEREGRRKPHVLYTVPSGQNPTGTTQGLERRKQVYEVARKHDLFVIEDEPYYYLQMPLEESKETESEEETVESFMSSLIPSLLSLDVDGRVLRMDSFSKVVVPGSRVGWVTASENIIEQYLRHAEVCNQGANGISQVILYKLLDEQWGHEGYFKWLMNLRQEYTKRRDTMVTAAEKFLPKEVVSWTVPVAGMFYWLKIDHSQHPGIQAGKGILEVEEEIFNSCIARGVLVARGSWFRAEQDTEPNELFFRATFAAATAENMTEAIRRFGEAIRESFKL

SEQ ID NO: 18794 - DNA, 1422 bp, Bordetella bronchiseptica
  CDS (1)..(1422)
atgaagctgaagcgctatgaagtgcttgccgacgaaatcaccgcatcgatccaggccggcacgcgccgcgccggcgaccgcctgccgtcggtgcgccagaccagcgccagccgcggcctgagcgccaccacggtcttcaaggcctattacctgctggaggcgcgcggcctgatccgcgcgcgcgaccgttcgggctactacgtggtgggcaagcccaaggcgttgccgcccgaactggaggccggcgcgccggccgagtcgcggcgcgtggacgtggatgtcagcgaccgggtgctgcacgtgctgcagctgaccatgcggcgcgacgtggtgccgttcggctcggcgtttccgcatccctcgctgtttccgcacgcgcggctggcgcgcgccatggcttccagcgtcgcggcgctggacccctggagctcggtcgacgacctgagcgcgggcaacacgcggctgcgccgcgccatcgcgctgcgctacctggccgacggcgtgcaggtgcgcaccgaggacatcgtgatcaccaacggcgcgctggaggccctgaacctgtgcctgggcgcggtgacgcggccgggcgattcggtgctcatcgaatcgcccacgttctactcggccctgcaatcgctggagcggctgggcttgcgcgccatcgaggtgccggcccatccgcgcgagggcatcgagctcgatgcgctggcgcgcgccatcgacacgcaccggccggccgcctgctggctgatgaccaatttccagaatccgctgggcagcctgatgcccgagggcaagaagcgcgccctggtcgaactgctggccgcgcgcgacgtgccgctgatcgaggacgacgtctacagcgagctgtacttcggcgcgcagcggccgctgccggccaaggcctatgacgagagcggcatcgtgatgagctgttcgtcgttctccaagagcctggcgccgggctggcgcatcggctgggtgctgggcgggcgttatgccgaccggatcctgcgcggcaagctgtcgctgtcgctgtcgacgtcggcgccgtcgcaggcggcgctggccacctacctggagcatggcggctacgaccgccacctgcggcaactgcgccagacgctggagcagcagcgcaaccaggtcatggaggcgatcgcccggcattttccgccgggcacgcgcaccacccaccccgacggcgggtacttcctgtgggtggcgctgccgccgcaggtcgatgcgctggcggtgcaccgcgccgcgctgtcgctgggcgtgagcaccgcgcccgggccgatcttctcggtgcaggaccgctttcgccattgcctgcggctgaactacggccaccccttcgacgcgcgcgcgcaggacggcctggccacgctgggcaagctgatcgcgcggcagtgctga

SEQ ID NO: 18795 - protein, 473 aa, Bordetella bronchiseptica
MKLKRYEVLADEITASIQAGTRRAGDRLPSVRQTSASRGLSATTVFKAYYLLEARGLIRARDRSGYYVVGKPKALPPELEAGAPAESRRVDVDVSDRVLHVLQLTMRRDVVPFGSAFPHPSLFPHARLARAMASSVAALDPWSSVDDLSAGNTRLRRAIALRYLADGVQVRTEDIVITNGALEALNLCLGAVTRPGDSVLIESPTFYSALQSLERLGLRAIEVPAHPREGIELDALARAIDTHRPAACWLMTNFQNPLGSLMPEGKKRALVELLAARDVPLIEDDVYSELYFGAQRPLPAKAYDESGIVMSCSSFSKSLAPGWRIGWVLGGRYADRILRGKLSLSLSTSAPSQAALATYLEHGGYDRHLRQLRQTLEQQRNQVMEAIARHFPPGTRTTHPDGGYFLWVALPPQVDALAVHRAALSLGVSTAPGPIFSVQDRFRHCLRLNYGHPFDARAQDGLATLGKLIARQC

SEQ ID NO: 18796 - DNA, 1200 bp, Bordetella bronchiseptica
  CDS (1)..(1200)
atggacaagcctttcgaacccgagtgttccttttcggaacgcgccaagcagctcaccagctccgcgatccgtgaaatcctcaaggtcacggaacgacccgaagtcatttcgttcgccggcggcctgccggcgcccggcggctttccggtagaagtggtacaggctgcgttcgacaaggtcttggccaccaatggccgcgccgccctgcaatacggccccaccgaaggttatgcgcccctgcgccaatgggtggccgacgacctgaatgccgcgggcgccaacgtcacggccgaccagatcctcatcgtgtcgggctcgcagcaggcgctcgacctgctgggcaaggtgctgatcgacaaggacagccccatcctggtcgaggatcccagctacctgggcgcgctgcagtcgttcagcctgtaccagccgaagtacgtgccgatccccaccgacgacggcggcctggtccccgaggcgatcacggccgaactggccgagggcgcgcgcttcctgtacgcgctgccgaacttccagaatcccaccggccgcacgctcaacctggagcgccgcaaggccctggtgcgacaggccgcacagttcggcgtacccatcatcgaggacgatccctacggcgaactacgctacgccggggaaccgcaacccggcctgctggccctggccggcgaatgcggcgccaccgtcatccggctgggcacgttctccaaggtgctggcgcccggcctgcgcctgggctacatcgccgcgccgcgcaacatcatcaacaagctggtgcaggccaagcaggccaccgacctgcacacgcccacgctcacgcagatggcggtctacgaagtcgtcaagaccggcttcctggccgagcacctgccgcgcgtgcgcgagatctaccgcgtgcagggccgctgcatgctcgaagccatcgagcgcgaattccctgcatcggtcagctggaccaagcccgagggcggcatgttcatctgggtcacgctgcccgagcacatcgacagcaccaagctgctggcgcaggcggtcgagcagaacgtggccttcgtgccgggcggccccttctacgcgggcacgccgcggcagaatacgctgcgcctgagcttcgccacggtgccggaagccaagatccgcgaaggcatcgccatcctgggcaaactgctcaaggcagcgatctga

SEQ ID NO: 18797 - protein, 399 aa, Bordetella bronchiseptica
MDKPFEPECSFSERAKQLTSSAIREILKVTERPEVISFAGGLPAPGGFPVEVVQAAFDKVLATNGRAALQYGPTEGYAPLRQWVADDLNAAGANVTADQILIVSGSQQALDLLGKVLIDKDSPILVEDPSYLGALQSFSLYQPKYVPIPTDDGGLVPEAITAELAEGARFLYALPNFQNPTGRTLNLERRKALVRQAAQFGVPIIEDDPYGELRYAGEPQPGLLALAGECGATVIRLGTFSKVLAPGLRLGYIAAPRNIINKLVQAKQATDLHTPTLTQMAVYEVVKTGFLAEHLPRVREIYRVQGRCMLEAIEREFPASVSWTKPEGGMFIWVTLPEHIDSTKLLAQAVEQNVAFVPGGPFYAGTPRQNTLRLSFATVPEAKIREGIAILGKLLKAAI

SEQ ID NO: 18798 - DNA, 1194 bp, Thermus thermophilus
  CDS (1)..(1194)
atgaaaccgctaagctggtccgaggcgttcggtaaaggcgcgggaaggatccaggcctccaccatccgggagcttctcaagctcacccagcgccccggcatcctgagcttcgccggggggctcccggcccccgagctcttccccaaggaggaggcggcggaagccgcggcgcggatcctgcgggagaagggcgaggtcgccctccagtacagccccaccgagggctacgcccccctaagggccttcgtggcggagtggatcggcgtgcgccccgaggaggtcctcatcaccaccgggagccagcaggccttggacctcgtgggcaaggtcttcctggacgagggaagccccgtgctgctggaggccccaagctacatgggggccatccaggccttccgtctccaaggcccccgcttcctcacggtgcccgccggggaggagggcccggacctggacgccctggaagaggtcctcaagagggagcgcccccgcttcctctacctcatcccctctttccagaaccccacggggggcctcacgccccttcccgcccggaagcggctcttgcagatggtgatggagcggggcctcgtggtggtggaggacgacgcctaccgggagctctacttcggggaggcgcgcctcccgagcctctttgagctcgcccgggaggcgggctaccccggggtcatctacctgggaagcttctccaaggttctctcccccgggcttcgcgtggccttcgccgtggcccacccggaggccctgcagaagctcgtccaggccaagcagggggccgacctccacacccccatgctcaaccagatgctggtccacgagctcttaaaggagggcttctccgagcgcttggaacgggtccgcagggtctaccgggaaaaggcccaggccatgctccatgccctggaccgggaggtgcccaaggaggtgcgctacacaaggcccaagggcgggatgttcgtctggatggagctccccaagggcctctccgccgagggcctcttccggagggccctcgaggagaacgtggccttcgtgccgggaggtcctttcttcgccaacgggggcggggagaacaccctgaggctctcctacgccaccctggaccgggaggggatcgcggagggcgtgcggcggctggggcgggcgctaaaggggcttttggccttggtctag

SEQ ID NO: 18799 - protein, 397 aa, Thermus thermophilus
MKPLSWSEAFGKGAGRIQASTIRELLKLTQRPGILSFAGGLPAPELFPKEEAAEAAARILREKGEVALQYSPTEGYAPLRAFVAEWIGVRPEEVLITTGSQQALDLVGKVFLDEGSPVLLEAPSYMGAIQAFRLQGPRFLTVPAGEEGPDLDALEEVLKRERPRFLYLIPSFQNPTGGLTPLPARKRLLQMVMERGLVVVEDDAYRELYFGEARLPSLFELAREAGYPGVIYLGSFSKVLSPGLRVAFAVAHPEALQKLVQAKQGADLHTPMLNQMLVHELLKEGFSERLERVRRVYREKAQAMLHALDREVPKEVRYTRPKGGMFVWMELPKGLSAEGLFRRALEENVAFVPGGPFFANGGGENTLRLSYATLDREGIAEGVRRLGRALKGLLALV

SEQ ID NO: 18800 - DNA, 1434 bp, Bacillus cereus
  CDS (1)..(1434)
atgacgaccgataaaaaagtgcccaaatatcagcagataatagactatatgaaagaaaaaattgaaaacggagaatggccaattggaagtaaaatccctagtcagcggcagttagcaaaattatttcatgtaaatcgaagtactgtaattactgcgctagatgaacttatagcagatggtttaattcaaggacaaatcggagcaggaacaattgtaacaaataatacatggtcattattagcaactaatcctccgcccgattggagtgaatatgtaaaagccggtattcataaaccaagtaagttaatggtgcgagaaataaatgaagcagaagcaaataaaacgcttatccatcttagtaaaggtgaacttgcacctcatcttttcccgctcgaaactatgcaatctataataaaaaacgtcagtgaggaattagattatttcggatacgaagaacaaaaaggtatttatccgttacgtgaagcaataagcaaatatgtaagatcatttggaatacatgcatcaccggattctatattaatagtctctggtgcactccaagcattacaattaatatcgattggtcttttacatagaaaatcaactgttttacttgaacaaccttcttacttatattcacttcatatttttcaatcagcaaatataaatttatccggtatatcaatggatcatcacggtattttacctaacgacttattaaaacgaattaaatatagtcaaaagaataatattttatattcaattccttgttttcaaaatccaacggggatattgatgtccaaagagcgaagaaaagaaatattaaaaatatgtgaaaaagagcaattgcctatcatcgaggatgatatataccgagagttatggcttgatgaatcacctccagctcctttaaagtcgatggataaacatggacatgtattatatattggtagtctctctaaaacacttagcccaggactgagaattggatggataatcggaccagaacctgttattgatagattgtcagatataaaaatgcaaacagactatggatccagctctttatctcaaagagtagctgctgaatggataaatgaaggtttttatgaagaacatgtagcaaatgtaagaatgcacctgaaagaacgaagacaaataatgatacgagctttaaataaatattgtgcagatattgcatcatgggatattcctagtggtggattttttatatggctaaaggttatacataacattccgatgaaaaaactattttcagaggcactatcaaaaggaattcttttaaatccgggacgtatttatgaagaagaatcagatcagtacattcgtttatcatatggatatgctactccagaacaaatgactaacggaattagattgctcagtgaattaattcggaagttaacggcataa

SEQ ID NO: 18801 - protein, 477 aa, Bacillus cereus
MTTDKKVPKYQQIIDYMKEKIENGEWPIGSKIPSQRQLAKLFHVNRSTVITALDELIADGLIQGQIGAGTIVTNNTWSLLATNPPPDWSEYVKAGIHKPSKLMVREINEAEANKTLIHLSKGELAPHLFPLETMQSIIKNVSEELDYFGYEEQKGIYPLREAISKYVRSFGIHASPDSILIVSGALQALQLISIGLLHRKSTVLLEQPSYLYSLHIFQSANINLSGISMDHHGILPNDLLKRIKYSQKNNILYSIPCFQNPTGILMSKERRKEILKICEKEQLPIIEDDIYRELWLDESPPAPLKSMDKHGHVLYIGSLSKTLSPGLRIGWIIGPEPVIDRLSDIKMQTDYGSSSLSQRVAAEWINEGFYEEHVANVRMHLKERRQIMIRALNKYCADIASWDIPSGGFFIWLKVIHNIPMKKLFSEALSKGILLNPGRIYEEESDQYIRLSYGYATPEQMTNGIRLLSELIRKLTA

SEQ ID NO: 18802 - DNA, 1449 bp, Bacillus cereus
  CDS (1)..(1449)
atgtttaaggattttaaagttgttaaagaacgtcccgtttatattcaattgaaagattatttgaagaaaatgattatgaaagggcatttgctcggggatcaaaaaatcccatcaacaagggaactaagtgaattactaagtgtgagtagaaacactgtactcgctgcttatgcagatttagagcaagaaggactcatttatgcagttaaaggaaaagggaactttgttgccaaggtggatatatctaacacttcgtctgttaaaatagattggaaaaataaacttaatacagtgaccgcattagcggacgaattagatttaatgaaacatggtgttcgttgggaaaagggaatgattgtttttaatagtatagccccggatgagaagctatttgatgttgaaaatttcaaaagagcttttcttactcgtatgtccattgaaggggacatcgtattgaactacggatatgcaaagggatatagaccgttaatgaattatttacttcattacatggaaatgaaaggtgtagacatttcgaataaagatattctaattacaaatggatttacagaaggattggatattgtactctcttctttatcaaaaaaatccggtcgtgtcatttgtgagaatccaactcaccatgctgcacttaagcttttccgtttacatggacttgaagttcatgggattgatatgcatgaggatggtattgatacgaatgcagttgaaaaaagtttgcgtgaaaaagattttgagtttgcttatttaattccttcttatcataatccaaccggtattgttacgagttcagagaaaagaacggaattgatgaggttattctcaaaatacaacgttcctattatagaggacggatttaatgaagaattacgttattcaggttcacatttagctccattattaacttttgcgggagctggcaataatgtgatttatattagtagcttttcaaaggtacttttccctggtttacgtgtaggctggattattgcagataaagagctgattcattatttagaaagcgtaaaaagagcaagaacgattcacacatctacgctagatcaagctgttctgtttcaatatttacatgagggatattttgaaaaatatttaaaaaaggcaagatctgtttataagaaaaaatatgagttagctgtcggggcatgtaaccagtacattccttttaaaagaatgactggagatggtgggctgcatttatttatagagctagaagagcatatgaatgcccgcacacttttacaaaagtgttatgagaaaggcgttacgttttcacctggagatgttttttactctgatggagaaggagcaaacactttccgattagggttttcgcgcttgaaagaagaagaaatagttcgtggaattaaaataattggtgatacattaaaaaatgaaatttggagttga

SEQ ID NO: 18803 - protein, 482 aa, Bacillus cereus
MFKDFKVVKERPVYIQLKDYLKKMIMKGHLLGDQKIPSTRELSELLSVSRNTVLAAYADLEQEGLIYAVKGKGNFVAKVDISNTSSVKIDWKNKLNTVTALADELDLMKHGVRWEKGMIVFNSIAPDEKLFDVENFKRAFLTRMSIEGDIVLNYGYAKGYRPLMNYLLHYMEMKGVDISNKDILITNGFTEGLDIVLSSLSKKSGRVICENPTHHAALKLFRLHGLEVHGIDMHEDGIDTNAVEKSLREKDFEFAYLIPSYHNPTGIVTSSEKRTELMRLFSKYNVPIIEDGFNEELRYSGSHLAPLLTFAGAGNNVIYISSFSKVLFPGLRVGWIIADKELIHYLESVKRARTIHTSTLDQAVLFQYLHEGYFEKYLKKARSVYKKKYELAVGACNQYIPFKRMTGDGGLHLFIELEEHMNARTLLQKCYEKGVTFSPGDVFYSDGEGANTFRLGFSRLKEEEIVRGIKIIGDTLKNEIWS

SEQ ID NO: 18804 - DNA, 1416 bp, Vibrio parahaemolyticus
  CDS (1)..(1416)
atggcgaagtatcaagagttagtggaacagcttaaaaggcagataaaatcggggatatggcacccgggtgacaaactgccttctctgcgtcgccaatctgaacactcgggtttgagcttgatgacggtattgcacgcttatcaaattctggaatctcaaggctgggtcacctcacagccgcgctctggttatcgagtcgctcccaatattaagagttcaaatgaaccccaagcgccagccgcggtttcgtggacagagcaggtagacatcaatgagtttatctttgatgtgctgcaggcgagtaaaaatccatccatgatcaattttggctttgcctatccagatccaagtttgtacccacgatatcacgtgaatcgggcgatgagcgcagccgctcgcaatatgccgatttccaccacctttgataacttaccgccgggaaacgagcaattacgcaccatcatcgcgaagcgttatgctgcgaaaggcattgaaatttcacccgatgaaattgtcattacggcaggcgcgctggaggcgttaacgctcagtttgcaagcctgcacaagaccgggagattgggtggttgtggagtcgcctgcattctacggtgcattgcaatccttagagcggttaggtttgaaagcgctctcagtaagaacagacccggtcacgggcattgacctagattcattggaacgagcgctgcaaacacacgatgtgaaagcatgttggctgatgtcgaacttccaaaatcctctgggttttacgctctccaacgagaaaaaacaaaagctgattgagctgacacagcgatataacgtgccagtgattgaagatgatgtgtacagcgaactgcatgccgagaatgactcggtttacccactaagaatgtttgatgacacgggcaataccatgttgtgctcgtcgttttcaaaatcattaatcgcagggctacgtattggttgggttgcggcgggaaagcgggcgctagaggtacaaaagttacagctaatgagtacattagcgacgagtgcaccagtgcaaatgacattggtgcactatttaacaagccgcaattatgaatcgcatttgaagcagttacggaaaaagctgtttgaacgtaaaagtaagatgacgaatctgcttaatgagctgttacctgaagaagtcaaagtgttaagccaaagcggcgggtactttatttggttagagcttcccaagcatatcgacgccttgcagatatatcgagaagcgctaaaagataatatcagcatcgcaccgggaaagatgttcagcctgacagaacaatacgatcactgtattcgtcttaacgcttcttttgagcttaatgacaaatacgtccatgctctcaatctgcttgccaacattattcgcgatcatttggcaaaatag

SEQ ID NO: 18805 - protein, 471 aa, Vibrio parahaemolyticus
MAKYQELVEQLKRQIKSGIWHPGDKLPSLRRQSEHSGLSLMTVLHAYQILESQGWVTSQPRSGYRVAPNIKSSNEPQAPAAVSWTEQVDINEFIFDVLQASKNPSMINFGFAYPDPSLYPRYHVNRAMSAAARNMPISTTFDNLPPGNEQLRTIIAKRYAAKGIEISPDEIVITAGALEALTLSLQACTRPGDWVVVESPAFYGALQSLERLGLKALSVRTDPVTGIDLDSLERALQTHDVKACWLMSNFQNPLGFTLSNEKKQKLIELTQRYNVPVIEDDVYSELHAENDSVYPLRMFDDTGNTMLCSSFSKSLIAGLRIGWVAAGKRALEVQKLQLMSTLATSAPVQMTLVHYLTSRNYESHLKQLRKKLFERKSKMTNLLNELLPEEVKVLSQSGGYFIWLELPKHIDALQIYREALKDNISIAPGKMFSLTEQYDHCIRLNASFELNDKYVHALNLLANIIRDHLAK

SEQ ID NO: 18806 - DNA, 1149 bp, Vibrio parahaemolyticus
  CDS (1)..(1149)
atggaaatcgcacagtcattacaacaaactaagtcatcctacatccgagagatcctcgcagcagcgagcgataagaacgtcatttctcttgcgggtggcttaccggacgaaaaaaccttcccgatcgacttaatgaaaccgacgctcgaaaacctcgcgaacatgccagaggtgtttcaatacggcgcaacagcaggctacgcaccgctacttaactttttgaccgattattaccaactgccagaatctcatttggcgatgatcacaacgggttctcagcaagggctagatttgattgcgcgtgcgtacgtgaatccgggcgataaagtggtgatggaagcaccaagctaccttggtgctatgcaagtattcggtttagtgcaagccaacatcgtgaccgtttcgcaaaccgagtgtggcccaaaccttgaagaactcgagcaatgctttgccacgcagcaaccaaaaatgttctacgccgtgcccgattttcacaacccaacgggcgtatgctgggcgctagagactcgccaaaaagttgccgagctttgtatccaatacgacgttgcattcattgaagacgcaccataccgcgagctgcgtttttctggtgaagcactaccgctggtctcgggtttctgcccacaacactccatcgtgttgcgttcattctccaaaatcgcctcaccaggcttgcgtattggtgtggttaccggcaaacgcagttaccttgagccactcatcaaaatcaaacaaggtgcagatctgcactctagtattcctatgcaggcgttgctgcatggtctacttcagcatgacaatttcgaaacacacatttcaaccatctgtgcgctttacaaatcgcgttacgatgtcatgtttgctgagctgcaaaagcagctgccagaaagttgcttactaaaacctgtcgatggtggcatgtttgtctgggtcgaaattccagaatgcgacacgttcgaactggcgaaaactctactcgcaaactgggttgctgtggtaccaagcccggtattctatccggaaggttccaaggtaaaagccgctctgcgtcttaactttaccaatgccacaccagaagagctgacgacggctgtcactcgacttgcggatgtacttaacgctttgtaa

SEQ ID NO: 18807 - protein, 382 aa, Vibrio parahaemolyticus
MEIAQSLQQTKSSYIREILAAASDKNVISLAGGLPDEKTFPIDLMKPTLENLANMPEVFQYGATAGYAPLLNFLTDYYQLPESHLAMITTGSQQGLDLIARAYVNPGDKVVMEAPSYLGAMQVFGLVQANIVTVSQTECGPNLEELEQCFATQQPKMFYAVPDFHNPTGVCWALETRQKVAELCIQYDVAFIEDAPYRELRFSGEALPLVSGFCPQHSIVLRSFSKIASPGLRIGVVTGKRSYLEPLIKIKQGADLHSSIPMQALLHGLLQHDNFETHISTICALYKSRYDVMFAELQKQLPESCLLKPVDGGMFVWVEIPECDTFELAKTLLANWVAVVPSPVFYPEGSKVKAALRLNFTNATPEELTTAVTRLADVLNAL

SEQ ID NO: 18808 - DNA, 1392 bp, Vibrio parahaemolyticus
  CDS (1)..(1392)
atgaaccgataccgccaactggctgaactgttcaaaacgcagattcagcaaaacacatggagagcaggagaaaagctgccgtcagtgcgtgttaccagccgaaatcattccgtcagtgccggaacggtgttgcaagcttatcagctgctcgaagcgcaaggctgggtcgcggcaaaacctcagtctggctactttgttaccgcagagctggaccgtttggagccgagtcctcctgcgacctctgtttatcgctctaacatcaatgatgagctttacgactatctcaaaaatcaagcgtcaccggatgcgatgaagttcggatctgcctttcccgatcctgcgttgtttccattggatgcgttgaatcgtaatctagccagctctggtaggaagatggggccagagacgttattggataacttaccgccaggctctgaatcattgcgtcgtttgattgctcaacgttacattcaacaaggtatggtgttaacccatgatgacattgtcattacttcaggggcgttagaagcgttgaatttgagccttcaggccgtgacacaaccgggagatactatcgtggttgaatcgccaacattttacggagcgcttcaagcgatagaacgtttgggtttaaaggcgatagaaatttcagtagacccgcgtatcgggcactctttgcaacaaattgaagcggcttttactgaccatgatgttcgcgcgtgttggttgatgacgaactttcacaacccaaccggaatgtcattaaacgatgagcagaagcagcgcatcgttgagcttgctgataaacacgatgtgtatttgattgaagacgatgtgtattcagagctctatttttctaacaagaaaccaagttcgctgagaacttttgatacacaagatcgtgtgttgcattgcggatcattttcaaaaagtctttgcccgggttatcggctggggtgggtggtcaacaagcgctttaatgagcatctgcaaaaactgcaacttatctcgactttgtcaggtagtgcgcctatccaacaaggtatcgcgcattatttgcaaaatgacagctatgataatcaccttagaaaacttcgaaagaatcttgagcagcgacaatccacgttcattgaactgatcggtaagtactttcctaaatcgattcattacacacagccagaaggcggctattttttatgggttgaactgccggaatcaaaatgcggaaaagctatttatcagaagttattggaagacaacatcaccgttgcattcggtaagttgttttctgtcggcacagattatgagaactacctaaggcttaatacatcgttaccctgcaacgatgaactagaagaagccgtgaagacgatcggagaattacttcactag

SEQ ID NO: 18809 - protein, 463 aa, Vibrio parahaemolyticus
MNRYRQLAELFKTQIQQNTWRAGEKLPSVRVTSRNHSVSAGTVLQAYQLLEAQGWVAAKPQSGYFVTAELDRLEPSPPATSVYRSNINDELYDYLKNQASPDAMKFGSAFPDPALFPLDALNRNLASSGRKMGPETLLDNLPPGSESLRRLIAQRYIQQGMVLTHDDIVITSGALEALNLSLQAVTQPGDTIVVESPTFYGALQAIERLGLKAIEISVDPRIGHSLQQIEAAFTDHDVRACWLMTNFHNPTGMSLNDEQKQRIVELADKHDVYLIEDDVYSELYFSNKKPSSLRTFDTQDRVLHCGSFSKSLCPGYRLGWVVNKRFNEHLQKLQLISTLSGSAPIQQGIAHYLQNDSYDNHLRKLRKNLEQRQSTFIELIGKYFPKSIHYTQPEGGYFLWVELPESKCGKAIYQKLLEDNITVAFGKLFSVGTDYENYLRLNTSLPCNDELEEAVKTIGELLH

SEQ ID NO: 18810 - DNA, 1440 bp, Pseudomonas syringae
  CDS (1)..(1440)
atgaccaaccttttgctctatcaacgtatcgctcaacaacttgctgaagacatccgtcgtggtgtgtaccagcccggtgagcgtgtgccttctgttcgcaaaatgagctcgcagctcaatgtcagccatgcaacggtgttgcaggcctacgcgaaccttgaggatcagggcttgatcagggcgcgtccgcagtcgggttactacgttcaccagacccctgcgttgacggcttcgacgccggacatcgcgcgggtcgagcggccagggctggtcacgcgcagcagcattatccagcaggtgcttgaagagtcgcgacgcgaaggcgtgttcgccctgggcgcagcggtgcctcatgtggattacctgccggtacgcgccctgcatcagcagcttgcgaaagtgacgcgctttcacagtccgcgtgcgttcagttacatgttcagtccgggcttcgagccactgcgcaggcaggttgccatccgtatgcgcgacgcgggcgtagtggttgatccatccgaagtggtgattactcacggctgtgtggatgcgttgcaaatgaccctgcgtgtgctgacccggcctggcgatctgatcgctgccgagtcgccggcctattacggcttgctgcaactcgccgatctgctgggcctgaaagtcatcgagatccccagcgacccggccaccggcatcagcctggaagccctgcaattggcggccaatcagtggtcgatcaaggctctggtgctgacctcgcggctgagcaacccgctgggcggcaccatgcctgaggagcgccagaagaacttgctgcggctggcctcggattttgatattcaggtggttgaagacgatgtctacggcgagctgatgttcgaggtcggacgaaccaaggcactcaaggcgtttgatcggctgggcagggtgatttattgctcgagcttctccaaaacgctatcgcccggtgtacgtatcggctggacaatcgcgggcaaataccaggctgaaattcagcgtctgcagactttcagcactcactcggcttgcagcgtcacgcaaatggccgtagctgcctaccttgaaaacggcggctatgaccggcatctgcgcttcattcgcctggaataccgcaagaacatgagcgcctaccaactggcggtgcagcagttctttcctgagggcacgcagatgagtcgtccggcgggcgggtttatcttgtgggtcagtctgccggggcgcgtcaatacccaggagctgcatgtgcgtgcgctggagcagggcatcagcatcgcgccggggctgatcttcagtaacaccgagcagttcaaccactgcattcgcctcaattgcggcatgccgtggaacaaagaggctgagcgcgcgctgatgacgctgggtatgttggccaagcagttgtgtcaggaagcgatacaggtgtactga

SEQ ID NO: 18811 - protein, 479 aa, Pseudomonas syringae
MTNLLLYQRIAQQLAEDIRRGVYQPGERVPSVRKMSSQLNVSHATVLQAYANLEDQGLIRARPQSGYYVHQTPALTASTPDIARVERPGLVTRSSIIQQVLEESRREGVFALGAAVPHVDYLPVRALHQQLAKVTRFHSPRAFSYMFSPGFEPLRRQVAIRMRDAGVVVDPSEVVITHGCVDALQMTLRVLTRPGDLIAAESPAYYGLLQLADLLGLKVIEIPSDPATGISLEALQLAANQWSIKALVLTSRLSNPLGGTMPEERQKNLLRLASDFDIQVVEDDVYGELMFEVGRTKALKAFDRLGRVIYCSSFSKTLSPGVRIGWTIAGKYQAEIQRLQTFSTHSACSVTQMAVAAYLENGGYDRHLRFIRLEYRKNMSAYQLAVQQFFPEGTQMSRPAGGFILWVSLPGRVNTQELHVRALEQGISIAPGLIFSNTEQFNHCIRLNCGMPWNKEAERALMTLGMLAKQLCQEAIQVY

SEQ ID NO: 18812 - DNA, 1422 bp, Pseudomonas syringae
  CDS (1)..(1422)
atgacgctctacgtcaaccttgccgaactgctcggctcgcgcatcgaaaacggcttttaccggcccggcgaccgtctgccgtcggtacgcgccttgagcgtcgaacacggtgtcagtttgagcaccgtgcagcaggcgtaccgggttctggaagacagcgggctggccgcgccgaaacccaaatccggctattttgtctcggtcagcaggcatgcacccgcgctcccggcggtgggtcggccagcgcaacggcctgtggatatctctcaatgggatcaggtgctggacctgattcgggtagcgccccgcgaggcggtcacccaactggggcgcggcatgcccgacgtcaccagcccgactctgaaaccgctgatgcgcgccttgggccagttgagccgccatcaggacatgccgggcctgtattatgacaatatttacggcgtgctcaggctgcgtgagcaggttgcccggttgatgctcgactccggctgcaacctgaccgccaatgacgtgatcatcaccaatggctgtcatgaggcactgtctgcaagcgtgcgggcgatctgctcgcccggtgacatcgtggcggtggactcgccaagcttcttcggtgccatgcagaccctcaagggtgtgggcatgaaggcgctggaaatccccaccgatccgttgactggcatcagccttgaagcgctggaactggcccttgagcagtggccgatcaaggtcatccagctgacgcccaactgcaacaacccgctgggttacgtcatgccggaagcccgaaagcgcgccttgctgaccctggcgcaacgctttgacgtggcgatcattgaggatgatgtgtatggcgatctggcctacaactaccctcgcccgcgcaccatcaagtcgttcgatgaggatggccgcgtgctgctctgcagttcgttttccaaaaccctggcacctgggctgcggattggctgggtcgcgccgggccgctatctggagcgggtgctgcacatgaaatacatcggcaccggttccactgccccgcagccgcaactggccatcgccgattttcttgaaggcgggcattacgagccgcacgtgcgccgcatgcgtacgcagtatcagcgcagccgtgaccagatgatcgactgggtgatgcgctatttcccggaaggcacccgcgccagtcgtccacagggcagtttcatgttgtgggtggagctggccgaggattttgacacgttgcgcttgaatcgcgccttgctggacaagggtgtgcagattgccgtgggcagtattttttcggcctcgggcaaataccgcaactgcatgcgcttgaactacgcagccaaatcgagccgcgaaatcgagagcgccgtgcgtatcgtgggcgagacgattgcgcaactgattgcgcaaagtgactga

SEQ ID NO: 18813 - protein, 473 aa, Pseudomonas syringae
MTLYVNLAELLGSRIENGFYRPGDRLPSVRALSVEHGVSLSTVQQAYRVLEDSGLAAPKPKSGYFVSVSRHAPALPAVGRPAQRPVDISQWDQVLDLIRVAPREAVTQLGRGMPDVTSPTLKPLMRALGQLSRHQDMPGLYYDNIYGVLRLREQVARLMLDSGCNLTANDVIITNGCHEALSASVRAICSPGDIVAVDSPSFFGAMQTLKGVGMKALEIPTDPLTGISLEALELALEQWPIKVIQLTPNCNNPLGYVMPEARKRALLTLAQRFDVAIIEDDVYGDLAYNYPRPRTIKSFDEDGRVLLCSSFSKTLAPGLRIGWVAPGRYLERVLHMKYIGTGSTAPQPQLAIADFLEGGHYEPHVRRMRTQYQRSRDQMIDWVMRYFPEGTRASRPQGSFMLWVELAEDFDTLRLNRALLDKGVQIAVGSIFSASGKYRNCMRLNYAAKSSREIESAVRIVGETIAQLIAQSD

SEQ ID NO: 18814 - DNA, 1491 bp, Pseudomonas putida
  CDS (1)..(1491)
atgctgtattttcagcccaactgtaccggtcgctatgccaatgcagcgcaggagtatgccgtgaccctctacctgaatctcgccgaaatactcggcgcccgaatcaagcagggcctctatcgccctggccagcgcctgccgtccgtgcgcgcactgagtgaggagcatggggtcagcctgagcaccgtgcagcaggcctatcgcatgctcgaagacagcggtatggtctcgccgcggcccaagtccggctacttcgtcagcgaccaacggcagttgccggcactgcccgcagtcagccgcccggcccagcgcccggtggacatctcgcagtgggaacaggtgctggagctggtgcgcagtacgccgcgccaggatgtggtgcaactcggccgcggcatgcccgacatcgacagccctaccctgaagccgctgctgcgcagccttgcccagttgagccggcgccaggacatgcctggcctgtactacgacaacatccacggtaacctggccctgcgcgaacaggtggcccggctgatgctcgactccggctgccgcctggggccggccgacctggtgattaccaccggctgccatgaggcgctgtcatgcagcatccgcgcagtctgcgagccaggcgacatcgtcgcggtcgactcgcccagcttccacggcgccatgcaaaccctcaagggcttgggcatgaaagcgctggaaatccccaccgacccggtcaccggcatcagcctggaggcgctggagctggccctggagcagtggccgatcaagctcattcagatcacccccagctgcaacaacccgctgggctacatcatgcccgaggcacgcaagaaggccctgctgagcctcgcccaacgctatgacgtggcgattctggaagacgatgtgtacggcgacctggcctatacctacccacgcccacgcaccctgaagtcgttcgacgacgatggccgcgtgctgctctgcagttcgttctccaaaaccctcgcgcccggcctgcggatcggctgggtggcgcccgggcgctacctggagcgcgtgctgcacatgaaatacatcagcaccggcagcaccgccagccagcctcagctggccatcgctgacttcatcgcagccgggcactaccagccccatgtacggcgcatgcgcagccagtaccagcgtggccgcgacctgatgggcgactgggtgacccgctacttcccggcgggcacccgggtcagccggccccagggcggcttcatgctgtgggtggaattacccgaacatctcgatacgcttcggctgaaccgcgctttactggagcagggcgtgcaggttgccgtgggcagcatcttttcggcctcgggcaagtttcgccactgcctgcgcatgaatttcgccgccaggccaacgccgcaaatcgaagcctccgtgcgcaaggttggtgaaaccgcccttcgtctactggatgacgaaagcgccgacgcgtaa

SEQ ID NO: 18815 - protein, 496 aa, Pseudomonas putida
MLYFQPNCTGRYANAAQEYAVTLYLNLAEILGARIKQGLYRPGQRLPSVRALSEEHGVSLSTVQQAYRMLEDSGMVSPRPKSGYFVSDQRQLPALPAVSRPAQRPVDISQWEQVLELVRSTPRQDVVQLGRGMPDIDSPTLKPLLRSLAQLSRRQDMPGLYYDNIHGNLALREQVARLMLDSGCRLGPADLVITTGCHEALSCSIRAVCEPGDIVAVDSPSFHGAMQTLKGLGMKALEIPTDPVTGISLEALELALEQWPIKLIQITPSCNNPLGYIMPEARKKALLSLAQRYDVAILEDDVYGDLAYTYPRPRTLKSFDDDGRVLLCSSFSKTLAPGLRIGWVAPGRYLERVLHMKYISTGSTASQPQLAIADFIAAGHYQPHVRRMRSQYQRGRDLMGDWVTRYFPAGTRVSRPQGGFMLWVELPEHLDTLRLNRALLEQGVQVAVGSIFSASGKFRHCLRMNFAARPTPQIEASVRKVGETALRLLDDESADA

SEQ ID NO: 18816 - DNA, 1593 bp, Pseudomonas putida
  CDS (1)..(1593)
atgcggcctgttttatgtcggtttaatcgtttcgatagctgtcacgctgttgtattgtcgactacgttgcaatctgtcccagtacactttgcaactgttacggtatcctctaccgtcagtgacccgtacaagaacaacgagcatgtcgacatgaccaacctgctgctgtaccagcgtatcgcccagcaactggccgatgatatccgtcgcggtgtctaccagccaggcgagcgggtaccctccgtgcgcaagatgagcgcccagctcaatgtcagccatgccacggtgttgcaggcctatgccaatctcgaggaccaagggcttatccgggcgcggccgcagtctggctattacgtgcaccagacccctgccttgaccgcgcaaacccccgacatcgctcgggtggagcgcccgggcctggtcacgcgcgccagcatcatccagcaggtgctgactgaggcgcgccgcgatggtgtgttcccgtttggtgctgctgtgccgcatgtcgactacctgccagtgcgcgccctgcatcagcaaatcgccaaggtgacgcgctttcatagcccgcgcgccttcagttacatgttcagccccggtttcgagccgctgcgccgacagatcgccatacgcatgcgcgatgccggcgtgctggtcgacccgcgcgaagtgatcgtgacccatgggtgtgtcgatgccctgcagatgtcgctgcgggtgctgacccgcccaggtgacctgatcgccgccgagtcaccgacctactacggcttgctgcagctggctgacctgctgggtttgaaagtgatcgaaatccccagtgacccgtccaccggtatcagcctcgaagccttgcaactggcggctaaccaatggtcgatcaaggcgctggtgctcactgcccgcttgagcaatccgctgggcggcaccgttcccgaagagcggcaaaagcaattgctgcgcctggcctcggacttcgatatccagatcatcgaggatgacatctacggtgagctgatgttcgagcaaggcaagaccaaggcgctgaaggcgttcgaccggctggaccgggtgatctactgttcgagcttctccaagaccctgtcccctggcgtgcgggtgggctggatgatcgcagggcgttaccaggacgagattcagcgcctgcagacttttaccacccactcggcctgtagcgtgacgcagatgggcgtggcagcctacctggaaaatggcggctacgaccggcatctgcgctacatacgccaggaatatcgcaagaacctcagtgcctaccagctggcagtgcagcagcacttccccgagggtacccagatgacccggccgacaggcggcttcatcctctgggtgagcctgcccggtcgggtcaatacccaggagctgcatgtgcgcgcgctggagcagggcatcagcattgcaccaggactgatattcagtaacacagagcagttcaaccactgtgtccgactcaattgcggcataccttggaataaagaggccgagcgggctgtgattacgctcggtttgctggcgcagcagttgtgcagggagactgcggtcacgctgttgtaa

SEQ ID NO: 18817 - protein, 530 aa, Pseudomonas putida
MRPVLCRFNRFDSCHAVVLSTTLQSVPVHFATVTVSSTVSDPYKNNEHVDMTNLLLYQRIAQQLADDIRRGVYQPGERVPSVRKMSAQLNVSHATVLQAYANLEDQGLIRARPQSGYYVHQTPALTAQTPDIARVERPGLVTRASIIQQVLTEARRDGVFPFGAAVPHVDYLPVRALHQQIAKVTRFHSPRAFSYMFSPGFEPLRRQIAIRMRDAGVLVDPREVIVTHGCVDALQMSLRVLTRPGDLIAAESPTYYGLLQLADLLGLKVIEIPSDPSTGISLEALQLAANQWSIKALVLTARLSNPLGGTVPEERQKQLLRLASDFDIQIIEDDIYGELMFEQGKTKALKAFDRLDRVIYCSSFSKTLSPGVRVGWMIAGRYQDEIQRLQTFTTHSACSVTQMGVAAYLENGGYDRHLRYIRQEYRKNLSAYQLAVQQHFPEGTQMTRPTGGFILWVSLPGRVNTQELHVRALEQGISIAPGLIFSNTEQFNHCVRLNCGIPWNKEAERAVITLGLLAQQLCRETAVTLL

SEQ ID NO: 18818 - DNA, 1410 bp, Pseudomonas putida
  CDS (1)..(1410)
atgaaacgctacgaacgcttcgccgatgacattgccgaactgatccgctccggggtgctgggccccggccagcgcgtgccgtccgtgcgctacgccagccagacccacggggtcagcccgtctaccgtgttccaggcctattacctgctggaacggcgcgggctgatccgcgcccggccgcgctccgggtatttcgtcaacgcccacgttccgcgtcagttcagcgagccgcaggcgctgcagccggtgagcgagtctaccgatgtcgacgtcagcgccttggtattttcgatcctcgactcgatcaaggaccccaacaccattgccttcggctcagcctttcccagccctgaactgttcccgctgcaacgcctgtcccgctcactggccagtgccagccgcagcatggacccgcgcatggtggtgaccgatctgtcccccggtaacccgcagttgcgccggcagatagccctgcgctacatggtcggtgggctgatgctgccgatggaagagctgctgatcaccaacggcgcactggaggccctgaacctgtgcctgcaggcagtgacccagccgggcgatctggtcgccatcgaggccccggccttctatgcctgcctgcaggtgctggagcggctcaagctcaaggctgtggaaatccccgtgcacccgcgcgagggcatggacctgggggtgctggcgcagaccctggaaatgcacccggtaaaggccgtgtggtgcatgaccaatttccagaacccggtgggtgcaagcatgccggaggccaagaaacaggccatggtggagttgctggcgcgccatcaggtgccgttgatcgaagacgacgtgtacgccgagctgtactactcgcaacaggcgcccaaacccgccaaggccttcgacactcagggcctggtcatgcactgcggctcgttcgccaaaagcctggcaccgggctatcgcattggctgggtggccgccgggcgctttgcgcaaaagatcgagcggttgaaactgatgacctccctttgtgcttccatgccggcccaggcggccatcgccgactacctgcaacacggcggctacgaccgccacctgcgcaagctgcgctacgcgctggagggccagcaggccaacatgctggcagccatcgcccgccacttcccggcgcagacacgggtcagccagccttccggcggctacttcctgtggctggaactgcccgagcagatggacgccctcaagctgttccacatggccctggcccaaggcatcagcatcgcgcccgggccgatcttttcgcccacccgacgcttcggcaattgcatccgcctgaactacggcagcccctggcatgacggcgccgaacaggccatggaaaccctcgggcggatcattcgctcgttctga

SEQ ID NO: 18819 - protein, 469 aa, Pseudomonas putida
MKRYERFADDIAELIRSGVLGPGQRVPSVRYASQTHGVSPSTVFQAYYLLERRGLIRARPRSGYFVNAHVPRQFSEPQALQPVSESTDVDVSALVFSILDSIKDPNTIAFGSAFPSPELFPLQRLSRSLASASRSMDPRMVVTDLSPGNPQLRRQIALRYMVGGLMLPMEELLITNGALEALNLCLQAVTQPGDLVAIEAPAFYACLQVLERLKLKAVEIPVHPREGMDLGVLAQTLEMHPVKAVWCMTNFQNPVGASMPEAKKQAMVELLARHQVPLIEDDVYAELYYSQQAPKPAKAFDTQGLVMHCGSFAKSLAPGYRIGWVAAGRFAQKIERLKLMTSLCASMPAQAAIADYLQHGGYDRHLRKLRYALEGQQANMLAAIARHFPAQTRVSQPSGGYFLWLELPEQMDALKLFHMALAQGISIAPGPIFSPTRRFGNCIRLNYGSPWHDGAEQAMETLGRIIRSF

SEQ ID NO: 18820 - DNA, 1227 bp, Lactobacillus plantarum
  CDS (1)..(1227)
atgaaaaaattatttgcaaatcgcgtgttaaacaatgacacttccgacctagatgaggtcttcaagaatagtgcaaacccggaaaacatttccttcgctggtggttttccagatcagcacttattccctgacaacgacttaaagcaagcctatcgtgatgctattgaacacgatggtcaaggcattttccaatactcatcaactcaagggttgccggcattacgccaaaaaattgcagatcgaatggcgactcatgctgacgttcaagttagtgccgacaatgtcatgatgacccaaggtggtcagcaagccatcgacctcgtggcgaagctcatgttgaaccatggagatgccatggtcgtcgaaggcccgacttacatgggggctttagccgccttcgacacttacgaaccgacttactacgaaattccagttgatgataatgggatgaatattcgtcaacttcgtaaaaccttgaaagctcatcctgagatcaaattgatttacacgattcctgacttccacaatccaacgggtacgacgatgagtgccaaacgtcgtcaagcactcgttgcccttgccaatcagtacgacgtcattattttggaagacagcccgtaccgggacctccgttatagtggtcaaaatattccggctatcaaacactacgatactgaaggccgcgtcatctttatctcaagtttctcaaagattctctccccggccttgcgaacaggctggattgttgctgacgacgcaatcatgcacgaattggtcggactgaaatccgcaatcgatgttcaatcgccaaatgtaacactggctgctatcaacagctacctagatcaacacgacatcgacgatcacgttgcaactattagtacttcataccggattaaacgtgacgcgatgttagccgcactcgatcaatacttcccgcaaaatgtccactacacccgtcctaatgggggcttcttcatctgggtaaccttgccagaaggaattgatgctaaaaccttgctcaatgacgttgttttaccgcaagcacacgttgcctatgtgccatccgcttgccaattcgcaagtcgcaaggttaaaaacgggttccggttgaatttcaccagtctcgacgtcgaaacgattacgctgggaattaaacgccttggccacatcttacaaccggcaccagtaattgttccagcagcatcgttcgcaccccaattctaa

SEQ ID NO: 18821 - protein, 408 aa, Lactobacillus plantarum
MKKLFANRVLNNDTSDLDEVFKNSANPENISFAGGFPDQHLFPDNDLKQAYRDAIEHDGQGIFQYSSTQGLPALRQKIADRMATHADVQVSADNVMMTQGGQQAIDLVAKLMLNHGDAMVVEGPTYMGALAAFDTYEPTYYEIPVDDNGMNIRQLRKTLKAHPEIKLIYTIPDFHNPTGTTMSAKRRQALVALANQYDVIILEDSPYRDLRYSGQNIPAIKHYDTEGRVIFISSFSKILSPALRTGWIVADDAIMHELVGLKSAIDVQSPNVTLAAINSYLDQHDIDDHVATISTSYRIKRDAMLAALDQYFPQNVHYTRPNGGFFIWVTLPEGIDAKTLLNDVVLPQAHVAYVPSACQFASRKVKNGFRLNFTSLDVETITLGIKRLGHILQPAPVIVPAASFAPQF

SEQ ID NO: 18822 - DNA, 1452 bp, Lactobacillus plantarum
  CDS (1)..(1452)
atggcaattttaacgatcaactggcaaccaaataaacaggtcagcacaccaatttaccaacaaattactaactattttcaagaacaaatcgcgaaaggcaattgggccgttggggctaagcttcctgcgcagcgtaaactggccgaacaattcggcgtgaatcgtagcaccctaattacggcacttgatgaactaatggcagtcggcttaattacgagcaatccaggctctgggatggttatttcaggtaaccattggtccagcttattggcggaacacgtcaactggtcgcaatatgttaaagcaggccaattcaagcccaattcccacgcgctccaaaaaatcaaccaatttgaaaccgatgcggttattcgtttaagtacaggtgaacccgcaccagaacaatttccccgtccactttttcaacgggcctttgcacatctaggcgaacagttaacgagtttgaactataccgagcctgcgggcattttggctttgcgacaacaaattgcacgtcacttggaaaaagttgggattcatacccatccggaaaacattctgattacttccggatcattacaagcgctccaactggtctcaatgtcactatttcccaaagatgccaccatctacacggaagcacctacttatgtcaaatctttacacgtctttcaatcggcccacacccatctcgctggcatcccgatggacagtcagggcttggcgtactggcagatgaacgcccccattcagggacaccatgccattctttacacgattccgacattcaataacccgactggaatcgtcatgagtgccgagcgacgtcaacaggtcttacaaaccgcacaagaacaccgcttaccaatcttagaagacgccgcttatcaagatgtctggttcgatcagcagccgccacagccactgaaggcactcgataagactggcaacgttatttattttggtagcatctcaaagtcccttgcaccgggattacgcatcggctggacggtggccgccaaaccggtcatcgatcgcttgactgacgtgcgcatgcaaaccgattacggcgctagctcactgtcacaacttgtactggcagaaatcttagctgatcctgaatatgaaacgtatcaagctgatttccggtccgtacttgtcaagaaggccgcggcggcagaacaaattctgcatcattactgggacgattttgcgacttggcagacgcccacgggtggcttttatctgtgggtccgcttagccgacaacattaatattcccaaattattcgaccttgccactgcgcacaacgttctcttcaaccctggtagtatctacgatttccagccgaatcagtacattcgtctgagcttttcttatgaatccagcgaccgctttgaacaggggattaaaattctaactgatttaattcacgccaattttaacgtttaa

SEQ ID NO: 18823 - protein, 483 aa, Lactobacillus plantarum
MAILTINWQPNKQVSTPIYQQITNYFQEQIAKGNWAVGAKLPAQRKLAEQFGVNRSTLITALDELMAVGLITSNPGSGMVISGNHWSSLLAEHVNWSQYVKAGQFKPNSHALQKINQFETDAVIRLSTGEPAPEQFPRPLFQRAFAHLGEQLTSLNYTEPAGILALRQQIARHLEKVGIHTHPENILITSGSLQALQLVSMSLFPKDATIYTEAPTYVKSLHVFQSAHTHLAGIPMDSQGLAYWQMNAPIQGHHAILYTIPTFNNPTGIVMSAERRQQVLQTAQEHRLPILEDAAYQDVWFDQQPPQPLKALDKTGNVIYFGSISKSLAPGLRIGWTVAAKPVIDRLTDVRMQTDYGASSLSQLVLAEILADPEYETYQADFRSVLVKKAAAAEQILHHYWDDFATWQTPTGGFYLWVRLADNINIPKLFDLATAHNVLFNPGSIYDFQPNQYIRLSFSYESSDRFEQGIKILTDLIHANFNV

SEQ ID NO: 18824 - DNA, 990 bp, Clostridium tetani
  CDS (1)..(990)
atgtatcaagaggctttagggtacgaaggacttagaaattcaataaataaatatttttggaataataaaatagatgttgacaatattttaatagtttcaggagctcaacagggtatagatatagtatctaaatctattattaatgttaatgacaatataatcatagaaagacctacctatggtggagctatagctgtatttaaatggagaagagcaaatatattcgaagtgcctatggaaaaagacggtatggacttagattatttagagtctttagtgaagaaaaataaagttaaagttgtttatgtaatgagttatttccaaaaccctacaggaatcacctatagcttacaaaagaaacaaagacttttaaatatggcaaagatttatgatttctatataatagaagatgattatctttcagaactaatatataataatgatgaatatgtaagttttaaaagtatggatagaaatgatagagttatatatattaaaagtttttctaaaatatttttaccaggaataagacttggatacatgattactccaaataagtttagggaagtaatacagagttcaaaaataaatacggatatagcaacttctagtttgatgcaaagagttttagacatatatataagaaaagatgtctggaaaggatatatagaaaaactaaatagcatgtataaaaatagatatttattcataagggataatataaaatatttagaaaaatatttagatatatacataccaactggtggactgcatatatatgctaaaattaaaaattctaatataaattgtctagaactttttaaaatgttaaaagaacaaggtatactaataacaccaggagtcatattttataaaaaacctgaagaaggtatgagatattttagaataagtttttcacaaacagatgtagaagatatagaaaaaggttttagaactatagaaaagatattaaaggaatggaataggtga

SEQ ID NO: 18825 - protein, 329 aa, Clostridium tetani
MYQEALGYEGLRNSINKYFWNNKIDVDNILIVSGAQQGIDIVSKSIINVNDNIIIERPTYGGAIAVFKWRRANIFEVPMEKDGMDLDYLESLVKKNKVKVVYVMSYFQNPTGITYSLQKKQRLLNMAKIYDFYIIEDDYLSELIYNNDEYVSFKSMDRNDRVIYIKSFSKIFLPGIRLGYMITPNKFREVIQSSKINTDIATSSLMQRVLDIYIRKDVWKGYIEKLNSMYKNRYLFIRDNIKYLEKYLDIYIPTGGLHIYAKIKNSNINCLELFKMLKEQGILITPGVIFYKKPEEGMRYFRISFSQTDVEDIEKGFRTIEKILKEWNR

SEQ ID NO: 18826 - DNA, 1446 bp, Clostridium tetani
  CDS (1)..(1446)
atgtttcctatttttaatataaaggatggtcagatagcctatgaagaaatatataaatacttaaaagaaattataaaaaatggaatgatgccatcaggaagtaaattaccttcttcaagagagatggcaaccatgactacattaagtagaaatactataataagagcttatgagcttttagaggaagaaaatttagtttatacaaaaagaggaaaaggaacatttgtaagtgacataaagataagtgagaataatgattggaaaatagattggtatagtaagataaatgaatatggaaagatgtcagaagacttagatataatgaaaactgaagcattatataaaaaaggtatgatttcttttaaaagtatagctccagatgaaaaattatttgatgtagaagaattaaaaagagcttttttaaatagggtatccttagaaggggaaaaaatattaaattatggttatgctaaaggatataagcctcttatagattaccttttagaatacatgaaagaaaaaggtgtaaatataaaaaataaggatatattaattaccaatggttttacagaagggtttgatatagtactttcatcccttttaaatgaaggagataaaataatatgtgaaaatcctacccataatacagcaattaaacttatgagacttcataagttggatatagtaggtgttaccatagatgataagggtgtagacttaaatcagttagaaaataagctaaagaataaccaagtaaagctttcctatgtaattccatcgtatcataatcctacaggtagggttatgtcttttaagagaagaaaaaagttttatgaaatattaaaaaaatataatgtacccatagtagaagatggatttaatgaagaacttcaacactcgggaactcatatagcaccaattgcagctatagcgggagaagaaaactccattatatatataggtagtctttcaaaaatactttttccaggtatgagaataggatggattttagcagacaaaagattaatagatatcttagaaagtgttaaaagaagtagaaatatacacacgtcttttttagatcaaggaatactttatgaatatatgaatagtggggcttttgagaagtatgtaaaaaaagtaaagacaatatataaagagaaatatgaatatataatgaaactttgtaaagaagaaattcctaataaatatattctaggcgatggaggactttatatatttataaaattaaaaaatataaagtcacgagaacttttaaaagcctgtcttaaaagaaaagttatatttactccaggagatatgtttttcatagataatgaaggtgaggacacactgcggttaggtttttctagaaattctttagaagaaatagaaaagggaataaagataattggggaagaagcacgtagtatacttaacaagtaa

SEQ ID NO: 18827 - protein, 481 aa, Clostridium tetani
MFPIFNIKDGQIAYEEIYKYLKEIIKNGMMPSGSKLPSSREMATMTTLSRNTIIRAYELLEEENLVYTKRGKGTFVSDIKISENNDWKIDWYSKINEYGKMSEDLDIMKTEALYKKGMISFKSIAPDEKLFDVEELKRAFLNRVSLEGEKILNYGYAKGYKPLIDYLLEYMKEKGVNIKNKDILITNGFTEGFDIVLSSLLNEGDKIICENPTHNTAIKLMRLHKLDIVGVTIDDKGVDLNQLENKLKNNQVKLSYVIPSYHNPTGRVMSFKRRKKFYEILKKYNVPIVEDGFNEELQHSGTHIAPIAAIAGEENSIIYIGSLSKILFPGMRIGWILADKRLIDILESVKRSRNIHTSFLDQGILYEYMNSGAFEKYVKKVKTIYKEKYEYIMKLCKEEIPNKYILGDGGLYIFIKLKNIKSRELLKACLKRKVIFTPGDMFFIDNEGEDTLRLGFSRNSLEEIEKGIKIIGEEARSILNK

SEQ ID NO: 18828 - DNA, 1407 bp, Vibrio vulnificus
  CDS (1)..(1407)
atgaatcgttatcgccaactggcacagtcgtttagacagcagatcgaaagtaaaacttggagagcgggagaaaaactgccttcagtgcgaatggcttgcaagcatcatggtgtcagtgcgggtaccgtgttacaggcgtatcaattgcttgaagcgcaagggtgggttattgcaaagccgcaatcgggttattttgtcacctctgattttcaacgactcacggcaccacgagaaccgtccgtgagtgcgctaccgtcatttagtgacgagttgtatgactttctgaaagatcaaagtgagcgtcaggcggtgaaactgggttcggctttccccgatgttcatcttttccccttagaagccctcaatcgcaatttagccagtgcggggcgtaagatgtctgcgaatgatctgctcaacaacttaccgccaggcaatgaagcattgagacgcttgattgcacagcgatatatccagcaagggatggatttgacccatcacgacatcgttatgacctcgggcgcaatggaagcgctaaatctgagtttgcaagtggttacaaaaccaggagataccatcatcgtcgaatctccgtgtttttatggcgcactgcaagcggctcagcggcttgggctcaacatcattgaagttgatgttgatgagtgtgatggtctgaatcttgagcagttcgagcacgtgcttgctaacaatgaagtcaaagcgtgttggttgatgagtaacttccaaaatccaacaggcgtgacattgagcgagcaaaagaagcaagcggtggtcgagctcgttcatcgttatcagctttacttaattgaggacgatgtttactccgagctctactattcacaagataagcccagctcgtttaaaacctatgatcgggaagattgtgtattgcattgtggttcactgtcgaaaagcttgtgccccggttatcggcttggttgggtcgtgacaaggcgttttaaccatgcaatccaaaagttgcagctgacttctacgttatcgggcagtgcaccgatacaacaaggcgttgcgtattacttgcaaaacgatggctatgataaacatctgcgcaagttgcgtagcacgctaaaacaacgacagcaatggatgatgaacgaactcaggcgacaattgcctgatacggtgcaattttcatcgccgacgggtggctattttttatggcttaaactgcctgaatctattcaagcgcatcaggtgtacacacatctgaagcagcagggtgtgctatcggcttatggcggtttatttagccaaacaaagcgatttgagcattatttacgtatcaattgctcattgccggaaagtgatgaccttgtgcaagcaatccgatgtttggcggtgacgattaaccgtctcgcaactgattag

SEQ ID NO: 18829 - protein, 468 aa, Vibrio vulnificus
MNRYRQLAQSFRQQIESKTWRAGEKLPSVRMACKHHGVSAGTVLQAYQLLEAQGWVIAKPQSGYFVTSDFQRLTAPREPSVSALPSFSDELYDFLKDQSERQAVKLGSAFPDVHLFPLEALNRNLASAGRKMSANDLLNNLPPGNEALRRLIAQRYIQQGMDLTHHDIVMTSGAMEALNLSLQVVTKPGDTIIVESPCFYGALQAAQRLGLNIIEVDVDECDGLNLEQFEHVLANNEVKACWLMSNFQNPTGVTLSEQKKQAVVELVHRYQLYLIEDDVYSELYYSQDKPSSFKTYDREDCVLHCGSLSKSLCPGYRLGWVVTRRFNHAIQKLQLTSTLSGSAPIQQGVAYYLQNDGYDKHLRKLRSTLKQRQQWMMNELRRQLPDTVQFSSPTGGYFLWLKLPESIQAHQVYTHLKQQGVLSAYGGLFSQTKRFEHYLRINCSLPESDDLVQAIRCLAVTINRLATD

SEQ ID NO: 18830 - DNA, 1233 bp, Brucella suis
  CDS (1)..(1233)
atgttggactgggaaaatgtatttgcaacgcgctcgaaacgtatgcgcgcatcggaaatccgtgaactgctgaagcttctggaacggccagatatcatttccttcgcaggcggcattcctgatcccgctcttttcccgcatgatgaattccaggcagcctacaaggatattttgggtggcccggaagccaatgctgcgctgcaatattccatttcggaaggctacaagccgctgcgcacatggctggttggcgaactcgccaagatcggcattccctgcaccgaagataatgtgttcatcacgtctggctcgcagcaggcgctcgattatctgggcaagctgtttctgtcgccgggcgatactgcgctcgtaactgcgccgacatatcttggcgcgctgcaagccttcaacgcctatgaaccgaactatgacacgctggcgcttaagggcaatcgcacgccgcaatcctatgcgcagactgcgcagaaggctggcggacaggtcaagttcgcttatctttcggctgatttcagcaatccgactggcgagacggtcgatcgtgcgggtcgcgaaaagctgctggcacatgccgacgaactggatatcccagtgatcgaagatgccgcctatcagtatcttcgctataatggcgatgcgatcccgccgatcctggcgctcgacattgcccgcaatggcggcgatatcgagaagacccgcaccatctattgcggctcgttctccaagacgctggcaccgggcttgcgcgtcggctatgtggttgcctccaagaccgtcatccgcaagctcgtcctgatgaagcaggcggcggaccttcattcttccaccatcaaccagattgcgatccagcacgttgcggtgcatggcttcgatgcacaggtggcaaagctgcacggcgtttacaaacatcgccgtgacaggatgctggaggctctggcgaaatatatgccggaaggcgttcactggacaaagccggaaggcgggatgttcgtctgggtcacactgccggaaggcatggacggcgcttcgctgctggccgtttccatcgacagtgaaaaggtggcattcgttccgggcaaggcgttctttgccgacggaaccggtgcgaatacgctgcgccttagctattcctgcgccaatgacgagatgatcgatgaaggcatcaagcggcttggccgcctgatccgcgcgcatacgaaatccgctgcggcgtaa

SEQ ID NO: 18831 - protein, 410 aa, Brucella suis
MLDWENVFATRSKRMRASEIRELLKLLERPDIISFAGGIPDPALFPHDEFQAAYKDILGGPEANAALQYSISEGYKPLRTWLVGELAKIGIPCTEDNVFITSGSQQALDYLGKLFLSPGDTALVTAPTYLGALQAFNAYEPNYDTLALKGNRTPQSYAQTAQKAGGQVKFAYLSADFSNPTGETVDRAGREKLLAHADELDIPVIEDAAYQYLRYNGDAIPPILALDIARNGGDIEKTRTIYCGSFSKTLAPGLRVGYVVASKTVIRKLVLMKQAADLHSSTINQIAIQHVAVHGFDAQVAKLHGVYKHRRDRMLEALAKYMPEGVHWTKPEGGMFVWVTLPEGMDGASLLAVSIDSEKVAFVPGKAFFADGTGANTLRLSYSCANDEMIDEGIKRLGRLIRAHTKSAAA

SEQ ID NO: 18832 - DNA, 1665 bp, Bifidobacterium longum
  CDS (1)..(1665)
atgcagcttgagctgaatcgacgcagcaaggtgccgatgtaccggcagctggccgccgagctgcgtgaacagatcgtctccggcgcgatggccgagggctaccgcctgcctcccgaacgcgagctgtcctcacgtctcgaagtcaatcgcaccacggtgttgcaggcgtatcagcagctcaaggacgaaggtcttatcgcctccaaagtcggcaaaggcacgttcgtgctgccggctgcctccgcaagccgaacatcgcacacgtcaaacagtgacttcgggaatgcaataacgcgaacaacacgatcgtcggcagaaatgggaacatcgcaagcctcctcttccggcgacgtagaacgtgctacctccactgatttcttgacgacagaccagggcagcagctctgcggcggtccatacgattcgtgaaagccgttcggttcagggcccggaaccaaccgtcgtgcgtccgccatggtcggtgttgttctctgattattccaaccggtttacctaccatgacatcgcctcggccgagcgggcgcagcgcggcgacaccattattgacttcgccaccggttcgccgaacccggcggatatcccggacgatctgctgcgcaaggtgagcatcgaggcgttcgaatcgcgggaattcgacggccaaccggaatcacctatcgagggattcgaagagttgcgtgcgctgcttgccgaacatatgcgcgcacgaggcgtacaatgcggcgtccgcaacgtgatggtgctctccggctccgagcagggcattgacctcatcgtgcgcgcgttcatcaaccccggcgactgcgtgctggtcgaacaatccacgttcttcccggcattgcagaccttccgttcggcggatgcgcgcatcatcggcgttccagtggacgagcacggtatgcgtacagacctgttggatgggtattgcgcgcgattccggcccaagctcatttacaccgtcccgacgttccaaaaccctaccggtaccacgctgtcgcccgaacgacgcagcgaactcattgacgtggcgcggcgctatcagtgtctgatcgtggaagacgatgcttacggcgatttgtggtacggcggggaatcgtccgacgcgcatcgccccataccgcttaaaggcatggagaatgcgggatacgtgatgtatttgtcgacgttctcgaaaaccgtcacttcgggcctgcgcacgggatgggttgtggccgatccgcatgtgatcaaccggctggcggctctgcggcgcatggtcgaccagcatacgagcacgtcatcgcagcgcatctgcctggaactgcttaaagaaggccgcatcgccgaacatttgcgcggtttgattaaggcttaccgcattcgacgagatgcagcaatcgcagcattggagcagtatgcgccggatgaagtgtattggaccatgcctgcaggtggctactatatttgggtttctttgccggacggcgtgcgctctctggatgtattggaatcctgccgttcccaaggcgttacgttcatgccgggcagcgtgttcgacgttgacgaaatggatgattcccatattcgtctcaactttgtgcgcccggatgctgctgacattgataccggcattcgaatcattggcgagacgatagcacagatgtag

SEQ ID NO: 18833 - protein, 554 aa, Bifidobacterium longum
MQLELNRRSKVPMYRQLAAELREQIVSGAMAEGYRLPPERELSSRLEVNRTTVLQAYQQLKDEGLIASKVGKGTFVLPAASASRTSHTSNSDFGNAITRTTRSSAEMGTSQASSSGDVERATSTDFLTTDQGSSSAAVHTIRESRSVQGPEPTVVRPPWSVLFSDYSNRFTYHDIASAERAQRGDTIIDFATGSPNPADIPDDLLRKVSIEAFESREFDGQPESPIEGFEELRALLAEHMRARGVQCGVRNVMVLSGSEQGIDLIVRAFINPGDCVLVEQSTFFPALQTFRSADARIIGVPVDEHGMRTDLLDGYCARFRPKLIYTVPTFQNPTGTTLSPERRSELIDVARRYQCLIVEDDAYGDLWYGGESSDAHRPIPLKGMENAGYVMYLSTFSKTVTSGLRTGWVVADPHVINRLAALRRMVDQHTSTSSQRICLELLKEGRIAEHLRGLIKAYRIRRDAAIAALEQYAPDEVYWTMPAGGYYIWVSLPDGVRSLDVLESCRSQGVTFMPGSVFDVDEMDDSHIRLNFVRPDAADIDTGIRIIGETIAQM

SEQ ID NO: 18834 - DNA, 1194 bp, Chlorobium tepidum
  CDS (1)..(1194)
atgccacgattttcgaaatccgtttctgcattgcgctcctcagcgatcagggagctaatgagcctcgcttctcgccctgatattctctcgtttgcgggaggaatgccgggtaacgagctgtttccgatcgatgaggtcgaggagctgttccggaacctcgacaccaaaaccaaacaggccgcgttccagtacggcccgacacccggcctgccctcactgctcgaatcgcttggcggttttctggaacgcaaaggcctgccagtcaagaagaaccgcctcatgatcaccaccggatcacagcaggctctgagtatttttgcccgcgctttcgtcgatccgggcgaccgggtgctgaccgagtacccctgcttcatcggagccatcgcggcgttccgcgcctgcggagccgagatcgtctcgctgccggtcgatgaagcgggcatcgacatcgccatgctccgtcaggaggtggagaatcccgacccggcgaagtttctctacatcacaccgtacttccacaacccggcgggaatgctctacagcaccaaccgcaagaggaagctgatcaaagcgttacaggggcgcgacattccgctgctcgaagacgacgcttacggcgacctctggttcagcgacgaacaccgcgaagccctgcaacccatcaaggcgatcgatccggaggacatcgacgtctgctacatgggctccttctccaagattctcggcccgggcctgcgccttggctggatgctggcgccagaggcaatctacgaaaagtgcgagctgatcaagcagtccgccgacgcctgttcgtcaagcttcacccaggtcatcgccgacgcattcatccgctcgggcaggatcgatacatacgtcgcttcggtgcgcgaagagtacaagcgccgcgccgcctccatggtcaaagccctgcgaagcaacctgcccgcctacgtccgctggaacgaaccgaaaggcgggttctacatctggctgaccctgccggagggagccgacgccactgaaatactcaagcgcgccatcgaaggcggcgcggtcttcgtcaccggcagcaccttcgacccgcaaggaacacgcaacaacaccatgcgcctctcctactgcaacaacaccccggaagagatcgaacgcggcattcccatcatcacccgcgccatccgcgaggtgtgcgggtaa

SEQ ID NO: 18835 - protein, 397 aa, Chlorobium tepidum
MPRFSKSVSALRSSAIRELMSLASRPDILSFAGGMPGNELFPIDEVEELFRNLDTKTKQAAFQYGPTPGLPSLLESLGGFLERKGLPVKKNRLMITTGSQQALSIFARAFVDPGDRVLTEYPCFIGAIAAFRACGAEIVSLPVDEAGIDIAMLRQEVENPDPAKFLYITPYFHNPAGMLYSTNRKRKLIKALQGRDIPLLEDDAYGDLWFSDEHREALQPIKAIDPEDIDVCYMGSFSKILGPGLRLGWMLAPEAIYEKCELIKQSADACSSSFTQVIADAFIRSGRIDTYVASVREEYKRRAASMVKALRSNLPAYVRWNEPKGGFYIWLTLPEGADATEILKRAIEGGAVFVTGSTFDPQGTRNNTMRLSYCNNTPEEIERGIPIITRAIREVCG

SEQ ID NO: 18836 - DNA, 1359 bp, Streptomyces toyocaensis
  CDS (1)..(1359)
atgctgtcgggtttcctcacgccacaggcgaattcccccgcggccctcaccgcgaccgaaccggtgaccttacggaagacggacctgcacggcagcgtctccgatccggtcctggacacgatgaacttcctcaacgaggttacgcttcgctatcccgacgcgatctccttcgctcccggccgtccttatgacgggttcttcgacaacgagcagatcttctcccacatccgccggtacctggagcacctccaggaacaggggagttcaccgcagcagatccgcaccgccatgtaccagtacgggccgacggccggtcagatccgcgagatcatcgccgactcgctgcgcgccgacgaggacatcgacgcccccgccgagtccgtcgtggtgaccgtcggcgcccaggaggccatgctgctggtgctgcgtgccctgatcagcggccccgacgacgtcctgctcgtctccagtccctgctatgtggggatcaccggcgcggcccgcctgctggacatcgcactgactccggtcgtggaacgggaggacgggttctcctgtgccgacctggaggcggccatccagcacgagaaggcccgcgggcgccgtccccgtgccttctacctggtgcccgaccacgccaatccgtcggggaacacactggggctgcgggcccgcgccgaactcctggaactcgccgcgcgccacggcatcctcatcctggaggacagcccctaccggatggtcagtcccggccgcccgctgccgaccctgaagtccctggaccgcgcccgcacggtcgtccacctgggttcctactccaagacgatctttcccggcgcccgggtcggcttcgtcgtcgccgaccaggtcgtcgtggaccaggacggccggagcagcctcctcgcggacgaactcgtcaagatcaagagcatggtgacggtgaacacctcgtcgctgagccaggccgccgtggcgggcgcgctgcttgccgcccagggccgggtctcggagctgaacgccagagcaggcgcctattacggcgacgccatgcagtgcacgctccggcatctggacgcacgccttccggcggaccggcgagcatctctgggggtgcgctggaacgaaccgaccggcggattcttcctgaccgtgcaggtcccgttccgggcggacgaggccgcactcacccggtccgcacaggacttcggcgtgatctggaccccgatggagcacttccacccggaaaagggcggccaccacgccatgcggctctccatcagctatctgactcccaccgagatcgacgaggggaccgctcgcctcgcccgcttcatcgaggcggagagcgcgaaggcctga

SEQ ID NO: 18837 - protein, 452 aa, Streptomyces toyocaensis
MLSGFLTPQANSPAALTATEPVTLRKTDLHGSVSDPVLDTMNFLNEVTLRYPDAISFAPGRPYDGFFDNEQIFSHIRRYLEHLQEQGSSPQQIRTAMYQYGPTAGQIREIIADSLRADEDIDAPAESVVVTVGAQEAMLLVLRALISGPDDVLLVSSPCYVGITGAARLLDIALTPVVEREDGFSCADLEAAIQHEKARGRRPRAFYLVPDHANPSGNTLGLRARAELLELAARHGILILEDSPYRMVSPGRPLPTLKSLDRARTVVHLGSYSKTIFPGARVGFVVADQVVVDQDGRSSLLADELVKIKSMVTVNTSSLSQAAVAGALLAAQGRVSELNARAGAYYGDAMQCTLRHLDARLPADRRASLGVRWNEPTGGFFLTVQVPFRADEAALTRSAQDFGVIWTPMEHFHPEKGGHHAMRLSISYLTPTEIDEGTARLARFIEAESAKA

SEQ ID NO: 18838 - DNA, 2241 bp, Myxococcus xanthus
  CDS (895)..(2115)
cagccgaggcgccccgagccgcgcaccgagctggttcgtgcacctcacggatgcgccgctcgatcgcaacaacccagcccacttgggcgtgctgcttcgaaccgatgagcgctttccggaaatcggtgggcgcgctgcgccgtgaacagtcaggcgccagccctccgttcatccggacacaatgcgcggcgtcaacgagccccgggcaggtgccaccgcacctggctcgccccaggttcccgccgccgtccggccgaggcggcatccggcggacggacacacctttccactgtcagcatcgacacagttcacggtgcgaatggacgtcgcgttcgaggttgcacccttggagcatcaaatataaattatctgccgtcccgcaaaagtgcctataaattcaaggcaaacgcccccatgttcctggacgaactagaccaccgcatcatcgacatgttgcagcgcgatggccgcgccacgcagctggagctgtcgcgtgcggtgaagctgtcccagccggcggtggcggagcggatccgcaaattggaggagcgcggcgtcatcacgggctactcggcccgcgtggacgcggcgaagctcggcaaggacatcacggccttcatcggcgtgagcatcgagcacccgaagtacttcgacgagttcttgcagaaggtgctgttgctgccggatgtcctggagtgccaccgcgtggcgggccaggactcataccttctcaaggtgaagacggcgaacacccgttcgctcgactccctcctggtgggaacgctgcgcaccatcgcgggagtcacccgcacgcagaccaccatcgtcctgacgtccatgaaggaggacacgcatgtccgcgtgcctccagacaccccaaaaggagcgtgacgtatgagcgccgacgcgatgagcgccccccttcccccgccgcccgtatggcggttggcccagcggatgtcccgcatcaagacgtccgcggtgcgcgaaatcctgaaggtcgccgagcggcccgacatcctctccttcgcgggaggcctgccagccccggagctcttcccgctggaggccatcgccgaggcgcacgccgaggccctggcgaccgagggccgcgccgcgctccagtacagcaccaccgagggcttcggcccgctgcgtgagtggatttgcggccacctccagaagcgcggccgccagtccaacgcggaccaggtgctcatcaccaacggctcgcagcagggcatcgacctggtggccaaggtgatgctggaccccggtgacctcgtcatcgtggagaaccccagctacctggcggcgctgcagacgttcggcgcctatgaggcgcgcttcgccacggtgggcagcgacgaccagggcatgcgcaccgacgaccttgagcgcctgctggccacacacaagcccaagctggtgtacgtggtcgccaacttccagaaccccaagggcaccaccctgtcgctggagcggcggcgcgaactggtccgcctggcccagcagtaccgcttcctcatcctggaggacgacccgtacggcgagctgcgcttccgcggcgagcacgtgccgtccctgtccgccttctacgacgagggcgtcgtcgtgtcgctgggcaccttctccaagacgctggccccgggcatgcgcctgggctgggtggtgggcccgcgcgacttcgtgcgcagcctggccatcgccaagcagtccaccgacctgcacacggccacgctggctcagcgcgcggtggtgaagctgctggcgcgcttcgattacgcggcccacctggagtcgctgcgccccgtctacggcgagcgcgcccaggccatgctggacgccctccaggcgcacatgcccgcgggcacccagtggacgcaccccgaaggcggcatgttcctgtgggtggagctgcccggcgggctggacgcccaggcgctgctgcccaaggcggtggagcagaaggtggccttcgtgccgggcgcgcccttctacgccaacaacccgcgcccggagttcatgcgcctcaactactccaaccgcccgccggacctgattgccgagggcatgcgccgcctgggcgccgtgattgccgccgagctgggttgagcccctgacggagcctctttgccgcgccgcgtcggaaacgacgcggcgcttttcatttcaagaagttgaagattgattcaggtttcaactcgctcgccgctggccagcgcggtcggggtttcgtac

SEQ ID NO: 18839 - protein, 406 aa, Myxococcus xanthus
MSADAMSAPLPPPPVWRLAQRMSRIKTSAVREILKVAERPDILSFAGGLPAPELFPLEAIAEAHAEALATEGRAALQYSTTEGFGPLREWICGHLQKRGRQSNADQVLITNGSQQGIDLVAKVMLDPGDLVIVENPSYLAALQTFGAYEARFATVGSDDQGMRTDDLERLLATHKPKLVYVVANFQNPKGTTLSLERRRELVRLAQQYRFLILEDDPYGELRFRGEHVPSLSAFYDEGVVVSLGTFSKTLAPGMRLGWVVGPRDFVRSLAIAKQSTDLHTATLAQRAVVKLLARFDYAAHLESLRPVYGERAQAMLDALQAHMPAGTQWTHPEGGMFLWVELPGGLDAQALLPKAVEQKVAFVPGAPFYANNPRPEFMRLNYSNRPPDLIAEGMRRLGAVIAAELG

SEQ ID NO: 18840 - DNA, 1233 bp, Xanthomonas campestris
  CDS (1)..(1233)
atggcggcgggcagtcgctatgcttggttgatgacgacctctttccagatctcccgacgtgcgcaggcgctgaccagttcggcgattcgcgaaatcctcaagatcaccgaacggccggaggtgatttcctttgccggcggcctgccgtcgccggccacgttcccggtggagcgcatgcgtgcggccagcgaccaggtgctgcgcgatgcgccgcaggcggcgctgcaatacggccccaccgaagggtatctgccgctgcgcgagtgggtcgccgcgcggctgagccgtgacggtgccagcatccgcccgacccaggtgctgatcaccaccggatcgcagcaggggctggatctgctgggcaagatattcatcgacgaaggcagcaaggtgctggtggagacgccgagctatctcggtgcattgcaggcgttttcgctgttccagcccaactttgccggcatgccgtccgatgccgatggcgtggtggtggatgcactggacccctcgctgttggccgatgcgcgctttctgtattgcctgcccaatttccagaaccccaccgggcgccggctgccgctgtcgcgccgccaggcgctggtggcgcgggctgcggaggcgggcgtgccgatcgtcgaagacgacccgtacggcgagctgtactacagcggcgagccgctgccgagcctgttgtcgatgcacccggacggggtgatctacatgggctcgttctccaaggtgctggcgcctggtctgcgcctgggctacgtggtggcaccggaggcagtgctgggcaagttgatccaggccaagcaggcggccgatctgcatacgccgtcgtttacccagcgcgtggtgcactccacgttgcaggacgatttcctggatacgcatattccgcagatccgcgcgctgtatgcgcggcaatgcagcctgatgctggaggcgctggagcggcactttccgccgcaggtgcagtggaatcgtcccgacggcggcatgttcctgtgggtgacgctgccgcagggcctggatgccagcgtgctgctggcgcgtgcgatcgcgcgcaatgtcgcgtttgtgcccggcgcgccgttcttcgccaccttgccgcagaccaatacgctgcggctgtcgttcgttaccgtgccgggcgaacgcatcgatgccggcatccaggtgctcggcgaattgctgcgtgaggcattggcggagctgccggggcagggcgcgtga

SEQ ID NO: 18841 - protein, 410 aa, Xanthomonas campestris
MAAGSRYAWLMTTSFQISRRAQALTSSAIREILKITERPEVISFAGGLPSPATFPVERMRAASDQVLRDAPQAALQYGPTEGYLPLREWVAARLSRDGASIRPTQVLITTGSQQGLDLLGKIFIDEGSKVLVETPSYLGALQAFSLFQPNFAGMPSDADGVVVDALDPSLLADARFLYCLPNFQNPTGRRLPLSRRQALVARAAEAGVPIVEDDPYGELYYSGEPLPSLLSMHPDGVIYMGSFSKVLAPGLRLGYVVAPEAVLGKLIQAKQAADLHTPSFTQRVVHSTLQDDFLDTHIPQIRALYARQCSLMLEALERHFPPQVQWNRPDGGMFLWVTLPQGLDASVLLARAIARNVAFVPGAPFFATLPQTNTLRLSFVTVPGERIDAGIQVLGELLREALAELPGQGA

SEQ ID NO: 18842 - DNA, 1284 bp, Xanthomonas axonopodis
  CDS (1)..(1284)
atgccgggcgaggcaagcggtcagcgatccgtcgctgcactgcacagcgccgcagccacttgcgttcgctatgcttgcgccatgacaacttccttccagatctcccgacgtgcgcaggcgctgaccagttcggcgattcgcgaaatcctcaaggtgaccgaacggccggaggtcatttccttcgccggcggcctgccgtcgccggccacctttcccgtggagcgcatgcgcgcagccagcgaccaggtgctgcgcgacgccccgcaggcggcactgcaatacggcccaaccgaaggttatgcgccgctgcgcgaatgggtggccgcgcggctgagtcgcgatggcgccagcatccggcccagccaggtgctgatcaccaccggctcgcaacaaggcctggacctgctcggcaaggtcttcatcgacgaaggcagcaaggtgttggtggaaacgccgagctacctgggcgcattgcaggcgttttcgttgttccagccggcattcgtcggcatgccttcggacgagggcggcgtggtggtggatgcgctggatccgtcgctgctggccgatgcgcgctttctgtattgcctgccgaatttccagaatcccactggccggcgcttgccgttggcgcgtcgccaggccttggtggcacgcgcggccgaggcaggcgtgccgatcgtcgaagacgacccgtatggcgagctgtactacagcgggcaaccgttgccgagtctgttgtcgatgaacccggaaggcgtcatctacatgggctccttttccaaggtgctcgcgcccggcctgcggctgggctatgtggtggcgcccgaaacggtgctgggaaaactgatccaggccaagcaggcggccgatctgcacactccatcgttcacgcagcgcgtggtgtaccagacgctgcaggacgattttctccagacccatattccgcagatccgtgcgctgtatgcgcgtcagtgcagcctgatgctggaggcgctggaccggcacttcccgccgcaggtgcagtggaatcgcccggagggcggcatgttcttgtgggtgaccttgccgccgggtctggacgggaccgcgttgctggcgcgggccatcgcgcgcaatgtcgcgttcgttcccggcgcgccgttcttcgccaccttgccgcagaccaatacgctgcgcctgtcgttcgtcaccgtgcccggcgagaagatcgatgccggcatccaggtgctgggggagctgttgcgcgaggcgctggccgagtcgccagggttgggcgggtga

SEQ ID NO: 18843 - protein, 427 aa, Xanthomonas axonopodis
MPGEASGQRSVAALHSAAATCVRYACAMTTSFQISRRAQALTSSAIREILKVTERPEVISFAGGLPSPATFPVERMRAASDQVLRDAPQAALQYGPTEGYAPLREWVAARLSRDGASIRPSQVLITTGSQQGLDLLGKVFIDEGSKVLVETPSYLGALQAFSLFQPAFVGMPSDEGGVVVDALDPSLLADARFLYCLPNFQNPTGRRLPLARRQALVARAAEAGVPIVEDDPYGELYYSGQPLPSLLSMNPEGVIYMGSFSKVLAPGLRLGYVVAPETVLGKLIQAKQAADLHTPSFTQRVVYQTLQDDFLQTHIPQIRALYARQCSLMLEALDRHFPPQVQWNRPEGGMFLWVTLPPGLDGTALLARAIARNVAFVPGAPFFATLPQTNTLRLSFVTVPGEKIDAGIQVLGELLREALAESPGLGG

SEQ ID NO: 18844 - DNA, 1401 bp, Xanthomonas axonopodis
  CDS (1)..(1401)
atgctcttgtacgaatcgctcgccatgcggctgcgcgagcagatcgagcgtggcacgttgcgtgccggcgagcgcctgccctcgatccggcagctggccgccaatcacggcatcagcgcggccacggcggtgcaggcgtgtctgcaactcgagcgcgaaggacgcgtccaggcgcgaccgcgcgcgggctacttcgtgcgcgccacggccgttgcatcgcctgccgcgccacctgcgccgcgtcgacgcacgcctggtatggtcgatcatccggcattgcagcgcgtgctcgacaccgtggcgcgcaccgacctgttgccgctgcacaccgccactcctgcgccggccctgttacccgccgcgcacctggccgccgcattgtcgcgtcaggtgcggcgccagcgcactgccgcactggattacgcgccaccgcaaggtcacgccgcgctgcggcggcaaatcgcacaacgctacgcgcattgcgccaccagcgtgactacggacgaagtggtaatcaccgccggcgcgatggaggccatcagcctggcattgcgcacactcaccatgcccggcgatgtcgttctggtggaaactcccacgtatcacggcattttgcaggcgatggccgcattgcgtctcaaggtgctggaggtgcccaaccgcagcggccaggggatcgatatcgcgcgcctggagtcgctactgcaacgcacgaaggtgcgcgccgccgtgctggtgcccaatttcaataatcccattggaagcctcactcccgacagcgccaagcgcgccctgctcgacagctgcgcgcgacatggcacggtggtgatcgaagacgatatctacggcgagctcgattggtcgggccagcgcccacgtccgctgcgccacttcgatacgcatgccaacgtgatcacctgcggctcgttctccaaggtactggccccgggcctgcgcgtgggctggttgctcggaggcgactggaccgacgcactggtgcgcgccaaatatttttccacagttggcagtgccagcctgccgcaactggcgctggccgattacctggcgcatcacgatctggaacgccacctgcgcaagctgcggcgcacactggccaacaacgggcaacgcctgcgcgatgcgatcgtgcggtactggccacacggcacgcgcgtcggcgaccccgctggcggattgtcgctctggctgcaattgcccgcaggcggcagcggccaggcgttgttcgaagcggcactgaccgaacgcatcggcacctcgcccgggcatttgtattccagccgtggcgactacgccgaccacctgcgtctgagctgcggccagccgtggagcgacatcctggaagcggcaatgcgccggctgggcaaactggctgcacgatga

SEQ ID NO: 18845 - protein, 466 aa, Xanthomonas axonopodis
MLLYESLAMRLREQIERGTLRAGERLPSIRQLAANHGISAATAVQACLQLEREGRVQARPRAGYFVRATAVASPAAPPAPRRRTPGMVDHPALQRVLDTVARTDLLPLHTATPAPALLPAAHLAAALSRQVRRQRTAALDYAPPQGHAALRRQIAQRYAHCATSVTTDEVVITAGAMEAISLALRTLTMPGDVVLVETPTYHGILQAMAALRLKVLEVPNRSGQGIDIARLESLLQRTKVRAAVLVPNFNNPIGSLTPDSAKRALLDSCARHGTVVIEDDIYGELDWSGQRPRPLRHFDTHANVITCGSFSKVLAPGLRVGWLLGGDWTDALVRAKYFSTVGSASLPQLALADYLAHHDLERHLRKLRRTLANNGQRLRDAIVRYWPHGTRVGDPAGGLSLWLQLPAGGSGQALFEAALTERIGTSPGHLYSSRGDYADHLRLSCGQPWSDILEAAMRRLGKLAAR

SEQ ID NO: 18846 - DNA, 1375 bp, Pyrococcus furiosus
  CDS (75)..(1316)
ggtaccgtcggaaaatacctagtgagcaaatatgttcagatgatcatacatgagcatgaaaagaggtgaaaaatatggaagaaattttggaaaagaaacttgaaagtggtcctcttaattttgagtcttatttttctgagaaagctctaaagatgaaagcctcagaagttagagaattacttaagcttgtagagacaagtgatgttataagcctagctggcgggttgcctaacccaaaaacatttcccaaagatattataaaaggcattttggaagaaatcatggaagagcacgctgataaagcccttcaatatggaaccacaaaaggctttacccctcttagacttgccattgctgagtggttgagaaaaaggtacaacattccaacttcaaaagttgacataatgattacaagtggatcccaacaagctctcgacttaattggtagagttttccttaacccaggggacttagtagttgttgaagccccaacttatttagcagcgcttcaagccttcaatttctatgagccccagtacattcaagttcctctagatgatgaaggaatgagaatagatattttggaagagaagctcagaaagctaaaagcagaaggaaagagagttaagctcgtatataccgttccaaccttccaaaacccagcaggtgttacaatgacggaagaaagaagaaagcatctcctagagcttgcaagtgaatatgactttataattgtagaagatgacccctacggtgagctcaggtattcgggcaagcccgtaccaaagataaaagccctagacacagaaggaagagttctctacctgggaactttctcaaagatacttgccccaggatttagacttggatggatagcaggagagcctcactttataagaaaattagagattgcaaagcagagtgttgacttgtgtaccaattcgtttgggcaagttgtagcgtggagatacctggaaggaggtcaccttgagaaacacattccaaggataatcgaattctataagcccaggagaaatgctatgcttgaagctttagaacagtacatgcccgaaggtgtcaaatggactaggccagaaggaggtatgttcatctgggtaatactcccagaaaaaattaatgccacgacaatgttagagaaagccgttaagaaaggagttgcatacgtcccaggagaggcattctttgcttacagagatgtaaaaaacacaatgaggctcaactttacctacgtagatgaggacaagatccaagagggagtaaagaggttagcagagactattaaggaggaattataatatagccttctcaactgttcccattttttggagtgtttgtgagttttagtgagctgcag

SEQ ID NO: 18847 - protein, 413 aa, Pyrococcus furiosus
MEEILEKKLESGPLNFESYFSEKALKMKASEVRELLKLVETSDVISLAGGLPNPKTFPKDIIKGILEEIMEEHADKALQYGTTKGFTPLRLAIAEWLRKRYNIPTSKVDIMITSGSQQALDLIGRVFLNPGDLVVVEAPTYLAALQAFNFYEPQYIQVPLDDEGMRIDILEEKLRKLKAEGKRVKLVYTVPTFQNPAGVTMTEERRKHLLELASEYDFIIVEDDPYGELRYSGKPVPKIKALDTEGRVLYLGTFSKILAPGFRLGWIAGEPHFIRKLEIAKQSVDLCTNSFGQVVAWRYLEGGHLEKHIPRIIEFYKPRRNAMLEALEQYMPEGVKWTRPEGGMFIWVILPEKINATTMLEKAVKKGVAYVPGEAFFAYRDVKNTMRLNFTYVDEDKIQEGVKRLAETIKEEL

SEQ ID NO: 18848 - DNA, 1221 bp, Ralstonia solanacearum
  CDS (1)..(1221)
atgggcgtctccacactgaaggaccataccatggaccaccccgcctgcaccttctcccgccgcgcgcaacagctgaccagctcggcgatccgggaaatcctcaagatcaccgagcgccccgaggtgatctcgttcgccggcggcctgccttcgccggtgaccttcccggtcgaggcgatccaggcggcgtgcgcccgcatgttcgcggacaatccgcaggcgtcgctgcagtacaccccgaccgaaggcctgtcgatgctgcgcgagtggatcgcccagcgccacggcaccaccgcgtcgcgcgtgctgatcaccaccggctcgcaacagggcctggacctgctgggcaagatcttcatcgacccgcagagcaaagtgctggtcgaaacgccgacctacctcggcgcgctgcaggcgttctcgctgttcgagccgagctacgcctcggtgccgaccgatgagcgcggcctgctgcccgaagcgctcacgcccgaactcaccgccggcgcgcgcttcttctacaccatcccgaacttccagaacccgaccggccgccgcctgccgctcgagcgccgccaggccctggtggcccgcgcgaaagaactcggcgtgctgctggtcgaagacgatccgtacggcgagctgagctataccggcgatgccctgccgtcgctgcgctcgctcaatccggacggcgtggtctacatgggctcgttctcgaagatcctggcgccgggcatgcgcctgggctacatcatcgcccccgagccgatccacttcaaactcgtgcaggccaagcaggcatccgacctgcacacgcccagcttcacgcagcgcgtggcctacgaagtgctgaagaccggcctgctcgacacccacatcccgagcatccgcaccctgtacggcaagcagtgcgagacgatgctggatgcgctcacgcgccacatgccggccggcgtgcactggaaccgtccggaaggcggcatgttcatctgggtggaagtgccggaaggcatcgacaccatggcgctgctggaaaaggcggtcgcgcgcaacgtggccttcgtgccgggcgcgccgttctacgccaacgcaccgcgccgcaacaccatgcgcctggccttcgtgacggtgtcgccggagcgcatcgaacagggcatcacggtgctgggcgagctgatccgcgccgagatcgccgcgctcacgcccaaggccgcgtaa

SEQ ID NO: 18849 - protein, 406 aa, Ralstonia solanacearum
MGVSTLKDHTMDHPACTFSRRAQQLTSSAIREILKITERPEVISFAGGLPSPVTFPVEAIQAACARMFADNPQASLQYTPTEGLSMLREWIAQRHGTTASRVLITTGSQQGLDLLGKIFIDPQSKVLVETPTYLGALQAFSLFEPSYASVPTDERGLLPEALTPELTAGARFFYTIPNFQNPTGRRLPLERRQALVARAKELGVLLVEDDPYGELSYTGDALPSLRSLNPDGVVYMGSFSKILAPGMRLGYIIAPEPIHFKLVQAKQASDLHTPSFTQRVAYEVLKTGLLDTHIPSIRTLYGKQCETMLDALTRHMPAGVHWNRPEGGMFIWVEVPEGIDTMALLEKAVARNVAFVPGAPFYANAPRRNTMRLAFVTVSPERIEQGITVLGELIRAEIAALTPKAA

SEQ ID NO: 18850 - DNA, 1209 bp, Ralstonia solanacearum
  CDS (1)..(1209)
atggatttcctgcaatcgttgctcgccccccgcctgcaaaacgtcgagacttcggccatccgcgaactcttcaaggtgctcggcaagccgggcctgatttcgtttgccggcggctttccggatgcggcgctgttcgacgtcgagggcctgaaggccgccgccgacagcgcgctcgccaccgacgcggcgcgcgcgctgcaatacggcgccaccgaggggttcgagccgctgcgcgaagccatcgtcacgctgatgcaggcgcgcggcgccacggtggccaacaccgacatcctcgtcaccaccggctcgcagcaggggctggacctgctgggcaaggtgctgatcggcgaaggcgacacggtgctgaccgaggccccgaccttcctcgccgccatccaggccttcaagctgtatggcgccaaggtggccggcgtgccgaccgatgaagacggcctggacctcgatgcgctggagcgcgcgctcgccgccggccgccccaagttcctctacgtgatccccaacttcggcaacccgagcggcgcgctgatgagcctggagcgccgccggcgcctgctggcgctggccgtgcgccatgacctgctgatcgtcgaggacgacccgtatggcgagctgtacttcgacgcgccgccgccgccttcgctgttcgcgctcagccagcagaccgacggcgcgcagggccgcgtggtctacctgggcagcctgtccaaggtggtggcgccgggcctgcgggtgggctggatgatcgcgccgtcgctggtgctgtccaacgcggtgatggtcaagcagtttgccgacgcgcacacctccaccttcgcgcaggccaccgccgccgcctacctgcgcagccagcgcatggagaccgtgctgccgcgcacgcgcgccgcctatgccgagcgcgcccacgccatggccgacggcctgcgcgcgctgctgcccgaggccgaactgaccttcaaccgtccgcgcggcggcatgttcctgtggggtcgcctgcccggccgcaacgcggcggacgtcgcccggatcgccatcgagcgcggcgtggccttcgtgccgggggcggcgttctatccggtcgatccggaccgctcgacgctgcgcctgtcgtatgccacctcgtcgcttgcccaggtggaggagggggtacgcaagctggcgggggcgatcggcgagctggcggccgcctga

SEQ ID NO: 18851 - protein, 402 aa, Ralstonia solanacearum
MDFLQSLLAPRLQNVETSAIRELFKVLGKPGLISFAGGFPDAALFDVEGLKAAADSALATDAARALQYGATEGFEPLREAIVTLMQARGATVANTDILVTTGSQQGLDLLGKVLIGEGDTVLTEAPTFLAAIQAFKLYGAKVAGVPTDEDGLDLDALERALAAGRPKFLYVIPNFGNPSGALMSLERRRRLLALAVRHDLLIVEDDPYGELYFDAPPPPSLFALSQQTDGAQGRVVYLGSLSKVVAPGLRVGWMIAPSLVLSNAVMVKQFADAHTSTFAQATAAAYLRSQRMETVLPRTRAAYAERAHAMADGLRALLPEAELTFNRPRGGMFLWGRLPGRNAADVARIAIERGVAFVPGAAFYPVDPDRSTLRLSYATSSLAQVEEGVRKLAGAIGELAAA

SEQ ID NO: 18852 - DNA, 1200 bp, Pyrobaculum aerophilum
  CDS (1)..(1200)
atgaacattggagatctcgtctcgtcccgcacacagtatatgaccgcgagcgagataagggagttgctgaggtgggccacggccgatgtaatatccttcggcggcgggatgccggatccctccacgtttccagtagaggacattgcgaaaatcgtcgcgtatgtcctggaggcctatccccacagggcgttgcaatacggatccactgagggagtaatggagctgagacaggaaatcgctaagttcagcgagttttttaggggaattaaggccaagcctgagaacgtaattataaccgttggcagtcaggaggcgcttgaattactgggccgcgtgtttatagatcctggcgacgtggtgatcactgaaaacccaacgtacctagcggctttacaagcgtggagggtgtaccaaccccgcctggtgggcataccaatggacgaacacggcatgatggtagatgtgctggaggagaaagtcaagcagttaaaggcagagggcgctcgtattaaattcatatacacaatacccacagcacaaaacccctccggcctcacaatgacgcaagacagaaggaagtatctgctggaaattgcggagaaatacgatctgttagtagtggaggacgacccgtactcttatttcctctttgagcaaatcgaagtgtcgcctataaaagcgcttgataaaagcgacagagttatatatttgtccacagcctctaaaatcttcgcgccgggcttccgcctcggctgggttatagcaaatgaagaggtgataaaatggtttaacttagcaaaacagtcattaaacttaaatacatctaattttgtacaatatatatttctagagggccttaggagaaatgttgtgcttaaaaacctgcctcacgtaagggatttgtacaagaggaaaagagacgccatgctggcggctttagaaacttacatgcccccaggcgtcagttggacgaagcccagcggcgggatgttcatatgggtcacaacgctccagcatatagatacaagagaattattgaaaattgcagtcacgcagtataaagtggcctttgtgccagggcatgggttctttgtggatcagtctgtaagaaacgcaatgcggctcaatttcacctacccctcttttgagcagataaatgagggcattcgccggctcgccttggcgataaaaggcgcatga

SEQ ID NO: 18853 - protein, 399 aa, Pyrobaculum aerophilum
MNIGDLVSSRTQYMTASEIRELLRWATADVISFGGGMPDPSTFPVEDIAKIVAYVLEAYPHRALQYGSTEGVMELRQEIAKFSEFFRGIKAKPENVIITVGSQEALELLGRVFIDPGDVVITENPTYLAALQAWRVYQPRLVGIPMDEHGMMVDVLEEKVKQLKAEGARIKFIYTIPTAQNPSGLTMTQDRRKYLLEIAEKYDLLVVEDDPYSYFLFEQIEVSPIKALDKSDRVIYLSTASKIFAPGFRLGWVIANEEVIKWFNLAKQSLNLNTSNFVQYIFLEGLRRNVVLKNLPHVRDLYKRKRDAMLAALETYMPPGVSWTKPSGGMFIWVTTLQHIDTRELLKIAVTQYKVAFVPGHGFFVDQSVRNAMRLNFTYPSFEQINEGIRRLALAIKGA

SEQ ID NO: 18854 - DNA, 1419 bp, Rhizobium meliloti
  CDS (1)..(1419)
atggccgtggatcgcgtggacgtttcctgggtgccggccctcggcagggcgggaggcccgctgtatctcgcaattgccgacgagatcgccgcggacatcgcggcgggccggctggaggatggagtgcgcctgccgccgcagcgcgctctggcggccgcgctcggcatcgactttacaaccgtcagccgagcctacaacgaagcgcgccggcgcggcctggtcgaaggtcgcgtggggcagggtacctatgtcacggctcggcggaggagcgcggtacgtccctcctcgggcggtctggcgggcggcctgttgggcagtctcgtcgacatgagcatgaacctgccgccgctcttcgacgacccggccctgtcggagaagatgtgggcggatgttgcggctctcgatcagcgtggtcccgaactgctgatgcgctatcagcctgtcggcggcgcggagcgggacagggctgcgggtgcggcctggctcaagccgcggctcggcgatcttcaagccgatcggttggtcgtctgtacaggagcgcaaggggctctgcttgcgagcgtcgggatgctggcgacgaagggcgacaggatctgcgccgaggcgcttacctatcccggcctccgctcactggcggcgcatatgggtatcgaactcgtgagcgtcgggatcgaccgcaacgggatattgcctgacgccttcgaggaggcgtgcgcccggtacaagccgaaggctctttactgcaatccgacccttcacaatccgacgaccgcgacgcttccgctcgaacgccgcgaggcgatcgtggcgatcgcacgccgccatggcgtggtcgtaatcgaggacgacgcctacggcgcattgcccgcgaaccccgttcccccactggccgcgctcgcgccggacctcgtctttcacatagcaggccttgccaagtgcctctcgccggcgctccgcatcgcctacctggtcgcgcctgaccgatcggcggccgtccgcctcgaaggggcgattcgagcgacagtcggcatgacgtctccgctttcggcggccatcgccacgcgctggctggaggagggaacggcgcaggcggttctggcagcgatccgcacggaagccggcgcgcgccagcggatcgcgatcaagggcctcgatggtgccgatcttctcgccgatcgcgagggttttcatctttggctgaagctgccttcccggtggagccgcggcgagttcacggcgcaactgcgaatggccgggatcggcgtcgtcgccagcgatgccttcgcgatctccgacccaccggaagccgtccggctcggtctcggcgctgcgcggacacgcgatgaactgcggcatagcctggacgtcatcgccggtctgctcgctcagtttccagcggcccataacctcatcgtttaa

SEQ ID NO: 18855 - protein, 472 aa, Rhizobium meliloti
MAVDRVDVSWVPALGRAGGPLYLAIADEIAADIAAGRLEDGVRLPPQRALAAALGIDFTTVSRAYNEARRRGLVEGRVGQGTYVTARRRSAVRPSSGGLAGGLLGSLVDMSMNLPPLFDDPALSEKMWADVAALDQRGPELLMRYQPVGGAERDRAAGAAWLKPRLGDLQADRLVVCTGAQGALLASVGMLATKGDRICAEALTYPGLRSLAAHMGIELVSVGIDRNGILPDAFEEACARYKPKALYCNPTLHNPTTATLPLERREAIVAIARRHGVVVIEDDAYGALPANPVPPLAALAPDLVFHIAGLAKCLSPALRIAYLVAPDRSAAVRLEGAIRATVGMTSPLSAAIATRWLEEGTAQAVLAAIRTEAGARQRIAIKGLDGADLLADREGFHLWLKLPSRWSRGEFTAQLRMAGIGVVASDAFAISDPPEAVRLGLGAARTRDELRHSLDVIAGLLAQFPAAHNLIV

SEQ ID NO: 18856 - DNA, 1227 bp, Rhizobium meliloti
  CDS (1)..(1227)
atgctggattgggaaagcattttcgccacgcgctcgagccggatgaaggcttcggagatccgcgaattgctgaagctgctcgatcgccccgacatcatttcctttgcgggcggaattcccgatccggagctttttccgaatgatgcgttcagagaggcttacgccgagattttcggtgggccgtcggtcggtgccgcgctgcaatattcgataagcgagggctatcgcccgcttcgcgagtggctcgccgggcagatggcggcacttggcattccggcgagcgtcgacaacatcttcatcacctccgggtcgcagcaggggctcgactatctcggcaagctgtttctgtcgccgaaagacacggcgctcgtcacctggccgacctatctcggtgcgctgcaggccttcaacgcctatgaacctagctacgatcagctgaaccccgccggtaaccggacgccggcagcctatgcccaggccgcagcggaagcgggcgggcgcgtcaagttcgcctatctctcggccgacttcgccaacccgaccggcgagacggtgggccgcgccgggcgcgagcgcgtcctcgaacttgccgaggagctcgacatcgccatcatcgaggatgcggcctaccagtcgctgcgttatgacggcgaggcgatcccgccgatccttgcacttgagatcgcccgcaaaggcgacataaacagcacccgcacgatctattgcggcagcttctcgaagacactggcgcctggccttcgcgtcggctggatctgcgccgccgaaccggtgatccgcaagctggtgctgatgaagcaggccgccgaccttcactcctccacgatcaaccagatggcgatcgcgaccgttgccgagcgcggcttcgaggagcaggtggccaagatccacaaggcctaccggcagcggcgtgacgcgatgctgtcggcgctcgaaaaatacatgcccgccggcgtcacctggacgaagcccgaaggcggcatgttcatctgggtgacgctgccgaaggggagcgacggcgctgagctgctcgccaagtcgatccagacggccaaggtggctttcgtccccggccgcgccttcttcgccgacggctccggcgaaaacaccctgcggctcagcttctcctgcgccaacgacaggatgatcgacgagggcatccgccggctgggcgatctcgttcgcggcgaggtcgcgcaggcggcctag

SEQ ID NO: 18857 - protein, 408 aa, Rhizobium meliloti
MLDWESIFATRSSRMKASEIRELLKLLDRPDIISFAGGIPDPELFPNDAFREAYAEIFGGPSVGAALQYSISEGYRPLREWLAGQMAALGIPASVDNIFITSGSQQGLDYLGKLFLSPKDTALVTWPTYLGALQAFNAYEPSYDQLNPAGNRTPAAYAQAAAEAGGRVKFAYLSADFANPTGETVGRAGRERVLELAEELDIAIIEDAAYQSLRYDGEAIPPILALEIARKGDINSTRTIYCGSFSKTLAPGLRVGWICAAEPVIRKLVLMKQAADLHSSTINQMAIATVAERGFEEQVAKIHKAYRQRRDAMLSALEKYMPAGVTWTKPEGGMFIWVTLPKGSDGAELLAKSIQTAKVAFVPGRAFFADGSGENTLRLSFSCANDRMIDEGIRRLGDLVRGEVAQAA

SEQ ID NO: 18858 - DNA, 1137 bp, Sulfolobus tokodaii
  CDS (1)..(1137)
atggtctctcggataggtagggaaatagaaatttctccagtagaattagcctcgcaaattgcaaaaaaggtcgaaataaatcttgccagtggtactccagatcctaaagttatgcctattgcagaaataaaagagacttataatgaggttattgaagaatatggtagcaaagtatttttttatcctggtgcaggagggcaagaggaacttataaaggaaatagagaactatatacctaatcttaatctgtctttaaatggaaacagaattgtagttacaagtggtgctcagcacgctattgagcttttatctaaatattttctagaaaatgatactatagctgttgaaaatcctacattcatagaaacttttacaccattaaagttaagaagtaatgttgttcttcctataggtcttgattcaaaaggaattattgttgatgaattggagacagtgctgaaaattgtaaaaattaaattactttatgtaatacctaattgtcataatccagctggagttaacttatgtgaagatagaaggaaaaggttagttgaacttgcagatagttatgatttctatatactagaagatgatccgtataaacctatagctggagagacccctaaacctataaaatattttgataaaagtggaagagtaatttacataagttcttttagcaaaattattgcacctggattaagaataggctttatactagcaaatgaagaaattgcagaaaaaatatctcttatcgaacaaatggatttctctacttcaactataaatcaatacgtagtggctagattgttgaaaaaaggaatagtaaaaaatagaatgaattatctatatgagcattatgctaataagatgaaaattttaacagattctctattagataccgggtttactgattttaatagaccatcttgtggatttttcttacttcttgacctaaagaaagatagttggaaagtcttcaatgaggctataaaaatgggactaagttttgtcccagctaagcctttctttttaaggggaggtgatactatggctaggctaagtatatctgttgctactgaggatgaaattaaaaaaggggttaaaatattaaaatcagcgtgggatagggtttaa

SEQ ID NO: 18859 - protein, 378 aa, Sulfolobus tokodaii
MVSRIGREIEISPVELASQIAKKVEINLASGTPDPKVMPIAEIKETYNEVIEEYGSKVFFYPGAGGQEELIKEIENYIPNLNLSLNGNRIVVTSGAQHAIELLSKYFLENDTIAVENPTFIETFTPLKLRSNVVLPIGLDSKGIIVDELETVLKIVKIKLLYVIPNCHNPAGVNLCEDRRKRLVELADSYDFYILEDDPYKPIAGETPKPIKYFDKSGRVIYISSFSKIIAPGLRIGFILANEEIAEKISLIEQMDFSTSTINQYVVARLLKKGIVKNRMNYLYEHYANKMKILTDSLLDTGFTDFNRPSCGFFLLLDLKKDSWKVFNEAIKMGLSFVPAKPFFLRGGDTMARLSISVATEDEIKKGVKILKSAWDRV

SEQ ID NO: 18860 - DNA, 1203 bp, Sulfolobus tokodaii
  CDS (1)..(1203)
atgttcgaaagatttctttcaaaagacgtatcaaatttaaggtcgtcagaaattagagatttattaaaactgactgaaggaaaaaaagttattagtttagctggcggtttaccagatcctactacttttcccgttgaagagattagaaaaataactgacgatgtactcagagaaaaatctgatagagccctacaatattcaacaacgtctgggataactgagttcaaaaaagagcttgttaacctatcaagatacagaggaataagcggtataaatgaaaataatacattcgtaactgtaggaagccaagaagccttatttatgatatttaatctcctagtagatccaggagatactgtaatcgtggaaatgcccacatatcttgctgcacttaatattcttagagcaagaaaacccaatttcattggcgtccatcttacacaaaatggtccagaccttgatgaattagagagaaaagtaaaagagagcataagtaatggcaaaaaaccgaagctaatgtatgttatacctacagctcaaaaccctggaggaacaacaatgagtttagatgataggaaaagacttcttgaaatagctcaaaaatacgactttttacttatagaagatgatgcttatggctttttagtttttgacggagaagcaccaccaccacttataagtttagataaagaaggaagagtaatatatacatctacattcagtaaaattttagctccaggtttaagattaggatgggttatagcacaagaagagtttattagagaaatggagttatacaagcagaatatagatttgcatactcctacacttactcaaatgatagcaatggaggcaataaagagaggagttatacaaaatcagttaccattgattagaagagtatatagagaaaaaagagatgtaatgctagcagcaatagagaaatacttcccgaaagaagctacgtggagcagaccagttggaggaatgtttgtttttgcctggttaccagaaaaaatagatacagtaaagatgttagaggaaagcatgagaagaggagtagcctatgttcctggatctagtttctaccatgattattctgggagaaatactatgagattaaacttcagctatcctactaagcaagaactagaagaaggtattaaaatcctaggaaatactatattagattttcttaaataa

SEQ ID NO: 18861 - protein, 400 aa, Sulfolobus tokodaii
MFERFLSKDVSNLRSSEIRDLLKLTEGKKVISLAGGLPDPTTFPVEEIRKITDDVLREKSDRALQYSTTSGITEFKKELVNLSRYRGISGINENNTFVTVGSQEALFMIFNLLVDPGDTVIVEMPTYLAALNILRARKPNFIGVHLTQNGPDLDELERKVKESISNGKKPKLMYVIPTAQNPGGTTMSLDDRKRLLEIAQKYDFLLIEDDAYGFLVFDGEAPPPLISLDKEGRVIYTSTFSKILAPGLRLGWVIAQEEFIREMELYKQNIDLHTPTLTQMIAMEAIKRGVIQNQLPLIRRVYREKRDVMLAAIEKYFPKEATWSRPVGGMFVFAWLPEKIDTVKMLEESMRRGVAYVPGSSFYHDYSGRNTMRLNFSYPTKQELEEGIKILGNTILDFLK

SEQ ID NO: 18862 - DNA, 1209 bp, Thermoplasma volcanium
  CDS (1)..(1209)
atgaactacaaattctctgaaatttttagatacataaagccctctgagatccgatctctcttaaagtatacttcagatcccgagttaatctcatttggcggtgggatgcctaatcctgaaagtttcccagtagaggaaatgaaggaaatactcgctgacataatggacaattatggcaaaaaagcccttcagtatggaacaactgaaggactagacgttttgagagatgaactggcaaagtatgtgcttaagacagaaggcattaatgcaaaaagagaggaaataatactaactactggatcacagcaggctttgtatgcaatagctaagatatttgtaaatcctaacgatcctgtaattacagaaggcccaacgtacgttggtgccatatcggcctttaatgcaaacactgccaatatgatggctatagacatagatgagaatgggatgaatgttgatgaacttgaggcaaagataaaagaattatcacagaacggactaaaacccaagttcatatacgttatacctacttttcagaatccagctggaactacgatgtctcttgacaggagaaagagactcctagagatctcggagagatatgaaatacccatagttgaagacaacccatatgggcagcttcgctacgatggagaacctgtacagtctataaagagtatggacaagaatgggaatgtgatataccttggaacattctcaaaggttatggctccaggtctaaggcttggatacgtaatagctccaagggaagttattgataaaattaatttgcttaaacaaggtcttgatcttgcatcggattcattatcagagtatatagcctacgaatatctaaagagaggtgcgatttacaggcagataccgaaaacagtagatctataccgtaagaagagggatttgatgatcaaatcacttgaagaatacttccctgaagctgcaacatggacaaagcctcacggtgggatgttcctctgggtatcactggatgaacgcatagatactaccaagatgttggatcgtgctttgaaggcaaaagtggcttatgtaagcggatctgcattctatccgcacggagaaaaacacaacagcatgaggttgaacttcacctactctgatgatgataagatagtcgaaggtataaagaggcttgcttacgtcataaatgaagaaatggaagtagttgaataa

SEQ ID NO: 18863 - protein, 402 aa, Thermoplasma volcanium
MNYKFSEIFRYIKPSEIRSLLKYTSDPELISFGGGMPNPESFPVEEMKEILADIMDNYGKKALQYGTTEGLDVLRDELAKYVLKTEGINAKREEIILTTGSQQALYAIAKIFVNPNDPVITEGPTYVGAISAFNANTANMMAIDIDENGMNVDELEAKIKELSQNGLKPKFIYVIPTFQNPAGTTMSLDRRKRLLEISERYEIPIVEDNPYGQLRYDGEPVQSIKSMDKNGNVIYLGTFSKVMAPGLRLGYVIAPREVIDKINLLKQGLDLASDSLSEYIAYEYLKRGAIYRQIPKTVDLYRKKRDLMIKSLEEYFPEAATWTKPHGGMFLWVSLDERIDTTKMLDRALKAKVAYVSGSAFYPHGEKHNSMRLNFTYSDDDKIVEGIKRLAYVINEEMEVVE

SEQ ID NO: 18864 - DNA, 1227 bp, Rhizobium loti
  CDS (1)..(1227)
atgacccttttgaacctgctggcttcgcgctcgtcgcgcatgaaggcctccgaaatccgcgaactgttgaagctgctcgaccagcccgacatcatctccttcgccggcggcattcccgatccggcgctgtttccggccgacgccatccgcgatgcctatgccgaggtgctgggcggtgcggaggccggtgcggcactgcagtaccaggtgtcggaaggttatctgccgttgaggcgctggatcgccgggcagatgggcaagctcggtgtcgcctgcgacgaggccaacatcttcatcacctccggctcgcagcaggcgctggattatctcggcaaactgttcctgtcgccgggcgacaccgcgctggtgacatggccgacctatctcggcgcgctgcaggcgttcaacgcctatgagccgcgctatgaccggctgcggccggaaggcggcaacatgacgccggacgcctatcgcgcggcggcggccgcccccaccagttcttcaagggggggcggcaaggtcaagttcgcctatctggtgcccgacttcgccaacccgaccggcaacacgctggaccggaagcagcgcgaagcggtgctcgatcttgccggcgaactcgacatcgccgtcatcgaggacgccgcctatcgcgcgctgcgctatgacggcgagggcgtgccgccgatcctggcgctcgattgcgcgaggtcgggcggtatcgacaaggcgcgcacgctctattgcggctcgttctcgaaaatcctgtcgccgggcatgcgcgtcggctgggtgtgcgcgccgcgccatgtggtggaaaaactggtgctgatgaagcaggcgtccgacctgcacagcccgtcgatcaaccagttggtcatgcaccgcgtcgccgaatccgtgttcgacggccaggtcgacaaactgatcggcgcctatcgcgagcgccgcgacggcctgctgggcgcactggaagcccacatgccggagggcgtgacctggagccgcccggaaggtggcatgttcgtctgggcgacgctgccggaagggtccgacgccaccgagcttttggcgcggtcggtgaaggaggcgcgcgtcgccttcgtgcccggcaacgctttttacgccgacggcaccgggcgcaacacgctgcggctgtccttcacgctggccgaccgccgcgcggtgaccgagggcattccacggctggcggcgctgctgaaagggtag

SEQ ID NO: 18865 - protein, 408 aa, Rhizobium loti
MTLLNLLASRSSRMKASEIRELLKLLDQPDIISFAGGIPDPALFPADAIRDAYAEVLGGAEAGAALQYQVSEGYLPLRRWIAGQMGKLGVACDEANIFITSGSQQALDYLGKLFLSPGDTALVTWPTYLGALQAFNAYEPRYDRLRPEGGNMTPDAYRAAAAAPTSSSRGGGKVKFAYLVPDFANPTGNTLDRKQREAVLDLAGELDIAVIEDAAYRALRYDGEGVPPILALDCARSGGIDKARTLYCGSFSKILSPGMRVGWVCAPRHVVEKLVLMKQASDLHSPSINQLVMHRVAESVFDGQVDKLIGAYRERRDGLLGALEAHMPEGVTWSRPEGGMFVWATLPEGSDATELLARSVKEARVAFVPGNAFYADGTGRNTLRLSFTLADRRAVTEGIPRLAALLKG

SEQ ID NO: 18866 - DNA, 2406 bp, Thermococcus litoralis
  CDS (196)..(1419)
tctagaagcactccccgtggaggtgccttcggatctttccagagttctatttcatagaatttctcaatcatcttaattccattttccggaatttgtcgtgttataaacaccttgggcttcatggtatttccccttctaagataatggtcaaaacgtataaatatctttatgaagattagttaatggtgatgttgaatggattacacaaaatacctagccggaagggcgaattggattaagggctcagctttggctgatgtgatgaaaaaggcttcagaactccaaaagaaaggggtaaagctaatttctctcgcagctggagatccagatccggagttaattccaagagctgttcttggggaaatagcaaaagaagttcttgaaaaggaaccaaaatccgttatgtatactccggcaaatggaatcccggagcttagggaagagctggcagcattcttgaaaaaatacgaccatttagaagtttctccagaaaacattgttattacaataggaggaacgggagcattggatcttcttggaagggttttgatagaccctggagatgtcgtgataacagagaacccatcgtacataaacacattattggcatttgaacagttgggagccaaaattgagggggttccagttgataacgatgggatgagggttgatctgttggaggagaaaataaaggagcttaaagctaaaggacagaaagttaagctgatctacaccatcccgactggtcagaatccaatgggcgtcactatgagcatggaacggagaaaggcactacttgagattgcctctaaatacgacctcctaataattgaggacactgcttataatttcatgagatatgaaggaggggatatagtccccttaaaggctttggacaatgaaggaagagttatcgtggcgggaacgctcagcaaagtccttggaacaggattcagaattggatggataatagcagagggagaaatcctcaaaaaagttctcatgcagaaacagccaattgacttctgtgctccagctatttcccaatacattgccctagaatacttaaagaggggctattttgagaagtatcacttggaaggagcactgctcggttataaagagaagagggacatcatgctgaaggctcttgaaaatcacttgccaaatgcagaatttacaaagccaatagcgggaatgtttgttatgtttttccttccagagggagcagatggcatctcatttgccaacgagctcatggaaagggagggagttgtggtagttccaggaaagcctttctacacagacgagtctggaaagaatgctataaggcttaacttctcaaggccaagcaaggaagaaattccaataggaatcaagaaacttgctaagctttataaggaaaagtttggcgagtgaattctttgtttttacattttcttctgggccatcacattctcgatggagagaaggttagtttgtttttaatgcactcagaaaagttctttttggtgcgggggcggggatttgaaccccggaacccctacgggacgggaccctcaatcccgcgcctttgaccaggctcggcaacccccgcaagagcgccgtttatttgtcttcttagtttgtttataaatttttctgtcccctttaaccggggcgtgtttatagtaacctttattagggtttttgctgaattctttcaggtggttgtcgtgatccccagatgggatcacaaactcaaagaccctgaaagcgtggcattcataatcctcgacgttttagcagacttcgaatcagaaggaaagctgaagaacctgccaaaaatccaaaaaatttccagtaaaaacaatactggcaatactcctctttaaacaatactacaacctacccctcagagacgcccagcactacggcagaaaattcttcggagcaaacattcactactcaaccctccacaactgggagaaaaagctgaacctcgaagaactgacaaaccacctcctgaaaaaactccagaaattaccctacgccagcactcaagcagactcaaccattatcacaaataaaaaaaggacagaatagaagttcaggcaataacgagaatcctgccgggtttactgtatccggttgctgtgaagatcacaacttctgagaacgagctgattgaactcctgccggagggttctgggaatttttatgctgatggggcttatgattcaaagaaagttctgaacactgtggtggaaaagggttatcggccgattgttaagaaaactaagaaccctccaggtggttttggtagtaagaagagagatagagtgttttctgaagaagagtacaggcataggaatcctcatgaggggttctggggtgcgtttacaacgtggtttggcagtaggatcc

SEQ ID NO: 18867 - protein, 407 aa, Thermococcus litoralis
MDYTKYLAGRANWIKGSALADVMKKASELQKKGVKLISLAAGDPDPELIPRAVLGEIAKEVLEKEPKSVMYTPANGIPELREELAAFLKKYDHLEVSPENIVITIGGTGALDLLGRVLIDPGDVVITENPSYINTLLAFEQLGAKIEGVPVDNDGMRVDLLEEKIKELKAKGQKVKLIYTIPTGQNPMGVTMSMERRKALLEIASKYDLLIIEDTAYNFMRYEGGDIVPLKALDNEGRVIVAGTLSKVLGTGFRIGWIIAEGEILKKVLMQKQPIDFCAPAISQYIALEYLKRGYFEKYHLEGALLGYKEKRDIMLKALENHLPNAEFTKPIAGMFVMFFLPEGADGISFANELMEREGVVVVPGKPFYTDESGKNAIRLNFSRPSKEEIPIGIKKLAKLYKEKFGE

SEQ ID NO: 18868 - DNA, 1209 bp, Thermoplasma acidophilum
  CDS (1)..(1209)
atggaatacagattttctgacatatttcggtacataaagccctccgagattagatcgttattgaaatacacctccgatccggaactcatttctttcggcggcggaatgccaaatccggaatcatttccgatcaaagaaatgaaggagatactgaacgatgtgatagataattacggtaaaaaggccctccagtacgggacgaccgagggcctagatccgctcagggacgaactggccaaatacgtggagaagaccgagggaatcagggcaaagagggaggagatcatactcaccaccggatcgcagcaggccctttacgcgattggaaagatattcacgaatccaggagaaacagtcataacggaggggccaacctatgtcggcgccatatcggccttcaattccaacaaggctgagatgatcgcgatagatctcgatgacaagggaatggacgtggatgctctggaggaaaggataaggaattttatggccaacggaacgaaaccaaagttcatctacgtcataccgacattccagaaccctgctggcaccacgatggtgcttgacaggagaaagcagctgctcgaaatttcaaaaaggtatgagataccaattgtggaagataatccgtacggacagttgagatacgatggggatcctgttccatccatcaagagcatggacgatgacggaaatgtgatctacctggggacattctcaaaggtcatggctccgggcctgaggcttggatacgtcatagcggacaggcagatagtggagaagataaatctggtgaagcagggcctggatcttgcatcggactccctgtctgagtacatcgcatatgaatacctgaagcgcggagacatatacaggcagatacccaagacggtcagcctgtacaggaagaagcgcgacctgatgctgaaatcgatagctgagtatttccctgaaggggttaaatacacaaagccaaacggcggcatgttcctctgggtctctctcgatgagaagatcgacacaaccaggatgctggagagggctttgaaggcaaaggtcgcgtacgttagcggagctgccttctatccgcatggcgaaaagcacaacagcatgagactgaacttcacgtattctgacgatgacaagatcgtcgagggaataaaacgcctagcatacgtgataaatgaggagatggaggtcgtcgagtaa

SEQ ID NO: 18869 - protein, 402 aa, Thermoplasma acidophilum
MEYRFSDIFRYIKPSEIRSLLKYTSDPELISFGGGMPNPESFPIKEMKEILNDVIDNYGKKALQYGTTEGLDPLRDELAKYVEKTEGIRAKREEIILTTGSQQALYAIGKIFTNPGETVITEGPTYVGAISAFNSNKAEMIAIDLDDKGMDVDALEERIRNFMANGTKPKFIYVIPTFQNPAGTTMVLDRRKQLLEISKRYEIPIVEDNPYGQLRYDGDPVPSIKSMDDDGNVIYLGTFSKVMAPGLRLGYVIADRQIVEKINLVKQGLDLASDSLSEYIAYEYLKRGDIYRQIPKTVSLYRKKRDLMLKSIAEYFPEGVKYTKPNGGMFLWVSLDEKIDTTRMLERALKAKVAYVSGAAFYPHGEKHNSMRLNFTYSDDDKIVEGIKRLAYVINEEMEVVE

SEQ ID NO: 18870 - DNA, 1440 bp, Thermococcus profundus
  CDS (112)..(1365)
tcggtccggttttaaagaaaagtttataaccactgcccccaatctactcatgtacagttcagtactgatgaattgaaatgatcatcgggagggaggaacgtggagaaaaaaatgaaaaaacttgagaagaagctctccgccgagcccataaacttcgactcgttcttctcggagaaggcaatgctgatgaaggcctccgaagtgagggaactcctcaagcttgtcgagacgagcgatgttataagtttagccgggggtctgcccgcccctgagacctttcccgtggagaccataaagaagatcgccgtggaagttcttgaggaacatgccgacaaggcccttcagtacgggacaaccaagggcttcacacccctgcgccttgccctcgcaaggtggatggagaagagatacgatatcccaatgagcaaagtcgaaataatgaccgttgccggctcccagcaggcgctcgacctcataggaagggtcttcctcaaccccggcgaccccatagtcgtcgaggccccaacttacctggccgcgatccaggccttcaagtactacgaccccgagttcatatcgatccctctcgacgacaagggcatgcgggttgacctgctggaggagaagcttgaagagctaaggaagcagggaaagagggttaagattgtctacaccgtctcgaccttccagaaccccgcgggagtaacgatgagcgttgaccggaggaaaaagctccttgagcttgccaacgagtacgacttcctgatcgttgaggacgggccctacagcgaactccgctactccggggagccaaccccgccgataaagcacttcgacgactacgggcgcgtcatctacctcggcacgttctccaagatactggcccccggcttcaggatcggctgggtggcggcccacccgcacctcataaggaagatggagatagccaagcagagcatcgacctctgcactaacacctttgggcaggcaatagcctggaagtacgtcgagaacggctacctcgatgagcacataccgaagataatcgagttctacaagccgcgcagggacgccatgcttgaggccctcgaggagtacatgcccgagggagtcgaatggacgaagcccgagggcggaatgttcgtctgggtgacactgccagagggaatcgacaccaagctcatgatggagagggccgtcgcaaagggagtggcctacgtcccgggagaggcgttcttcgtccacagggacaagaagaacaccatgaggctcaacttcacctatgttcccgaggagacgataagggaaggcgtcagaaggctcgcggagacgatcaaggaagagatgaagagggtcaagggctgagcccttttaaaccttccagaacctttttataattttccggggacttcctctggtggtgattgtgaagcccctgat

SEQ ID NO: 18871 - protein, 417 aa, Thermococcus profundus
MKKLEKKLSAEPINFDSFFSEKAMLMKASEVRELLKLVETSDVISLAGGLPAPETFPVETIKKIAVEVLEEHADKALQYGTTKGFTPLRLALARWMEKRYDIPMSKVEIMTVAGSQQALDLIGRVFLNPGDPIVVEAPTYLAAIQAFKYYDPEFISIPLDDKGMRVDLLEEKLEELRKQGKRVKIVYTVSTFQNPAGVTMSVDRRKKLLELANEYDFLIVEDGPYSELRYSGEPTPPIKHFDDYGRVIYLGTFSKILAPGFRIGWVAAHPHLIRKMEIAKQSIDLCTNTFGQAIAWKYVENGYLDEHIPKIIEFYKPRRDAMLEALEEYMPEGVEWTKPEGGMFVWVTLPEGIDTKLMMERAVAKGVAYVPGEAFFVHRDKKNTMRLNFTYVPEETIREGVRRLAETIKEEMKRVKG

SEQ ID NO: 18872 - DNA, 1263 bp, Drosophila melanogaster
  CDS (7)..(1263)
ttaaacatgttgaaatccagtcaagatcgcaagctaaagcaccttttcgatggcggtgattggaatgtatacgctccgaacatcctaaatctcggagtgggtgctccaggaccagatatcctgaccgccaactgtgatagcttccggacggccacagatcattgtctggaacgcgaaaagcgggaaaaccagtcgctaattttccaatatggaccaacaagtggaacattcgaggtgcgacgcgagatctccacctatttcaccgaaatgttcaaaagtcccgtcaattgtgaggatttgataataaccacaggagcatcccatggccttcacatacttttgtccacaatgttggactttgagggtttcgtattcgtcgatgagtacacctatatgattgctttagatagtataaaacactttagcactgtgaccatagttcccgtaaagctcaacgatgatggcgtggatctgaaggatcttgaagagaaggtatcaaaacgacgatttcaatcgaagaagaaagagttctggggaatctactatacgataccaacgtatcataatcccacggggattctattctcgccggaggtctgtcgtggaattgtgcaacttgctaggaattatgatttccttgtcgtctgcgatgatgtttataatattctcaactatggcgaaacgcccacacacagccgtctgttgtcctatgatgacagaaatgatgccaacttcgcaggacatgttatctccaatggaagtttctccaagattctgggaccgggagttcgcctgggttggcttgaggttcctccgcgcctgaaaccaattttagatggaagtggttttgccactagtggtggatgcttcaacaactacacatcagggattgtgggcagtctatttgagcttaagctagcccagaagcaaatttctgagtcctatgaagcttataaggagcgcatgctggccaccacgcaagtgcttcgagatgagttgcccgactgctgcaagttggtcagccccacgggcggatacttcatttgggtgcggataccggatcgattggactgccgggagtttctcaagtactgcatggagaatcacaagatctactttatagtaggaacacgcttctctgcggatggtcaaagtggcaaacagttcttccgcctgtccatcgccttctatccgaagtcgaagttggtggatggtgctagaagactttgcaacgcacttaaggattacatagccgagcaatag

SEQ ID NO: 18873 - protein, 418 aa, Drosophila melanogaster
MLKSSQDRKLKHLFDGGDWNVYAPNILNLGVGAPGPDILTANCDSFRTATDHCLEREKRENQSLIFQYGPTSGTFEVRREISTYFTEMFKSPVNCEDLIITTGASHGLHILLSTMLDFEGFVFVDEYTYMIALDSIKHFSTVTIVPVKLNDDGVDLKDLEEKVSKRRFQSKKKEFWGIYYTIPTYHNPTGILFSPEVCRGIVQLARNYDFLVVCDDVYNILNYGETPTHSRLLSYDDRNDANFAGHVISNGSFSKILGPGVRLGWLEVPPRLKPILDGSGFATSGGCFNNYTSGIVGSLFELKLAQKQISESYEAYKERMLATTQVLRDELPDCCKLVSPTGGYFIWVRIPDRLDCREFLKYCMENHKIYFIVGTRFSADGQSGKQFFRLSIAFYPKSKLVDGARRLCNALKDYIAEQ

SEQ ID NO: 18874 - DNA, 27 bp, Primer
atgaaatacaaggaaatcaatttcttc

SEQ ID NO: 18875 - DNA, 26 bp, Primer
ctacatagttatgttattggtgatcg

SEQ ID NO: 18876 - DNA, 741 bp, Saccharomyces cerevisiae
  CDS (1)..(741)
atggcatctaatcaacctggcaagtgttgctttgaaggagtttgtcacgatggaacacccaagggtcgtcgtgaagaaatcttcggtttagatacttatgcagcaggctctacatctcccaaggaaaaagttatagttatcttgacagatgtgtatggcaataaattcaacaatgttttattaacggccgacaaatttgctagtgctgggtacatggtctttgttcccgatattttattcggcgatgctatctcatcggacaaaccaattgatcgtgatgcctggtttcaaagacattctcctgaagtcaccaagaaaattgttgatggattcatgaagttgttaaaacttgaatatgacccaaagtttattggcgttgtgggttactgttttggtgcaaagtttgccgtccaacacattagtggcgacgggggtcttgccaatgctgcagccattgcacatccatctttcgtcagcatcgaggaaattgaagcaattgatagcaagaaaccaatattgatttcagcagcggaagaggatcacatctttccggcaaacttaagacacttaacggaggaaaaattaaaggataatcacgctacttaccagttagacctcttcagtggtgtggctcacgggtttgcagcaagaggcgatatatccatacctgccgtaaaatatgcgaaggagaaagtcttgctcgaccaaatatactggttcaatcatttttcgaatgtttaa

SEQ ID NO: 18877 - protein, 246 aa, Saccharomyces cerevisiae
MASNQPGKCCFEGVCHDGTPKGRREEIFGLDTYAAGSTSPKEKVIVILTDVYGNKFNNVLLTADKFASAGYMVFVPDILFGDAISSDKPIDRDAWFQRHSPEVTKKIVDGFMKLLKLEYDPKFIGVVGYCFGAKFAVQHISGDGGLANAAAIAHPSFVSIEEIEAIDSKKPILISAAEEDHIFPANLRHLTEEKLKDNHATYQLDLFSGVAHGFAARGDISIPAVKYAKEKVLLDQIYWFNHFSNV

SEQ ID NO: 18878 - DNA, 744 bp, Candida glabrata
  CDS (1)..(744)
atggcttctaacccaccaggaaaatgttgttttgaaggcttttaccatgaaggtcaagccaagggtactcataaggatgtctgcggcgttgacacctatgttaccggtgctgagaactcttccgatagagttattgttattttgacagatatttacggtaacagattgaacaatgtccttttgactgctgatcaaatggcaactgattgttaccaagtctacattccagacatattgttcaatgaccctgttgtcgctcttgatggctctaccgacttcaacgcttggttggctgctcaccctgctgagaaagttcaagagctagttaccaaatacttgactgacttgagagctcaattgaagcctaagttcttggctgtcgtgggctactgttacggtgccaaatttgctattcagcaaattggtgctaacccattggctgattgttgtgccattgctcatccatctttcgtttcaattgaagaagtcgatgctatctcgaagccagttttgatttccgctgccgaagaagatcctatcttcccagaagaattgagacatcaaactgaagccaagctaaaggaaaataaggctagataccagttggatttgttcagcggtgtttctcatgggtttgctgctagaggtgatacttctaatccggttgtgaagtacgctaaggagaaggtattagtagaccaattgtactggtttaactatttctccggttgctgtcaaaaataa

SEQ ID NO: 18879 - protein, 247 aa, Candida glabrata
MASNPPGKCCFEGFYHEGQAKGTHKDVCGVDTYVTGAENSSDRVIVILTDIYGNRLNNVLLTADQMATDCYQVYIPDILFNDPVVALDGSTDFNAWLAAHPAEKVQELVTKYLTDLRAQLKPKFLAVVGYCYGAKFAIQQIGANPLADCCAIAHPSFVSIEEVDAISKPVLISAAEEDPIFPEELRHQTEAKLKENKARYQLDLFSGVSHGFAARGDTSNPVVKYAKEKVLVDQLYWFNYFSGCCQK

SEQ ID NO: 18880 - DNA, 744 bp, Candida glabrata
  CDS (1)..(744)
atggcttcaaaaatgcttggtcaatgctgctttaaaggattctacagaaaaggtgaaaccaaaggtctgcataaggatatttttggtgttgatagctatgttgttggattggaaaatcccagtgataaagtagttgtcatcatgaccgatgtttatggtaatagactaaacaatgtacttttaaccgcagatcaaatcgcagaaagtggctaccaggtgtacgttcctgatattttatttaataaccccgcactagatctcaatgtcccactggatatacctgcttggatggcatctcatcctgttgacagggcgcacaatttagtgacaaaatacttatctgacctaagaaaacacgtgaaccccaagtttgttggtattattggctattgctacggagctaagttcgccattaagcaaattgattcagcttcaggtattgtcgacgcttgcgccatagcccacccatcactagtgactattgaggatgttgcggccatcgggaaaccattgctgatttcggccgccgaggaggatgccatttttccagaggagatgagacacatgacggaagccaaattgaaggaaattggtgctagatatgaaattgatctctttagcggtgttgaacatggatttgcatctaggggtgatgtttccaacccagttgtcaagtttgctatgaacaaggcgttggctgatcagctatactggtttgatcattttgcctcggggggtcagtaa

SEQ ID NO: 18881 - protein, 247 aa, Candida glabrata
MASKMLGQCCFKGFYRKGETKGLHKDIFGVDSYVVGLENPSDKVVVIMTDVYGNRLNNVLLTADQIAESGYQVYVPDILFNNPALDLNVPLDIPAWMASHPVDRAHNLVTKYLSDLRKHVNPKFVGIIGYCYGAKFAIKQIDSASGIVDACAIAHPSLVTIEDVAAIGKPLLISAAEEDAIFPEEMRHMTEAKLKEIGARYEIDLFSGVEHGFASRGDVSNPVVKFAMNKALADQLYWFDHFASGGQ

SEQ ID NO: 18882 - DNA, 919 bp, Chaetomium globosum
  CDS (25)..(786)
ttccctcaatacccccaaatcgctatggcttcgaacccgcccggaaaatgttgcactgttggcgttaagcatgaaggtgacaccgtcggcaagacgattcaagtcgctagcaagcacgacgcctacctcgcaactccgccccccgacaaggcgcaccaaggcgtcggcattctactcatcccggacgtcatcggcatctggcagaatagcaagctgattgccgaccaatttgctgccaacggctacctgacactcatgctcgatgtgtacaacggtgacgcgctctccctcaccagccgccccgccgggttcaacctctttgactggatcgccaagggctccgacggcaagaacccgcacacaactgaggctattgacccaatggtggttgatgggatcaaggcgctgaaggaggaatacgggatccagaagatgggcggcgtgggctatggtttgggggctaagtacgtgatccggcactacaagaacggcatctccgccggctacgtcgcccacccgtccttggtagacgaggaggagctcgcggccatcgggggcccgctggccatctcggccgctgagaccgacagcatcttccccgccgagaagcgccaccggtccgaggtaatcctcaaggacgctggcaagccataccagatcaacctcttctcccaggtcgagcacgggttcgccgtccgctggcgacacgtccgtcaaggtccagaagtttccaaggagcaggctttcctgcaagccattaactggtttgacgagtatcttctgtgagagccagtgtacaattagcggctaatgcctgggtttctgtgtttcgttatgcggcaactgcgacgactgttcaacacgcgtgagcaatggcatcctggttcttcgggaaaaaaaaaaaaaaaaaaaaaaaaaa

SEQ ID NO: 18883 - protein, 253 aa, Chaetomium globosum
MASNPPGKCCTVGVKHEGDTVGKTIQVASKHDAYLATPPPDKAHQGVGILLIPDVIGIWQNSKLIADQFAANGYLTLMLDVYNGDALSLTSRPAGFNLFDWIAKGSDGKNPHTTEAIDPMVVDGIKALKEEYGIQKMGGVGYGLGAKYVIRHYKNGISAGYVAHPSLVDEEELAAIGGPLAISAAETDSIFPAEKRHRSEVILKDAGKPYQINLFSQVEHGFAVRWRHVRQGPEVSKEQAFLQAINWFDEYLL

SEQ ID NO: 18884 - DNA, 705 bp, Ashbya gossypii
  CDS (1)..(705)
atgtcgagctgctgtgtacaaggagcgcgccacgaaggcgacagcgcaggtagactgcgcgaagtgtacggattagagacatacgaggtgggtgcagggacacgggtgatcgtggtgctaacggatatatacgggcaccgctttaaaaacgtgcagttaatcgcggaccagctagccgaggcaggttaccgcgttcttgtaccggatatcctacagggcgatgcagtcgagcggttggatgggagcgtgaacttcggagagtggctggagaggcacggcccggcggtaacggggaagttagtagccgagtacatgcagcgggtgcgcgagggaggtgccagtttcgtcggcgtgacgggatactgtttcggtgcgaagtacgccgtgcaacaaattgggccggatgggcatgcggacgcatgtgcggtcgcgcacccgtcgtttcttgaactggaagaggtagcacgggtgcggaagccgatactgatctcggctgcggagaccgatcagcattttcctgcggagacgcggtgggcggcggagaaggagttggccgggatttgcgccacctatcagatcgacttgttcagcggcgttgtgcacggcttcgctgtgcgtggcgatctggctgacgaggccgtgcgttacgcgatgggcaaggttgtgggcgaccagatttgctggatggggcgcttcgctaagtga

SEQ ID NO: 18885 - protein, 234 aa, Ashbya gossypii
MSSCCVQGARHEGDSAGRLREVYGLETYEVGAGTRVIVVLTDIYGHRFKNVQLIADQLAEAGYRVLVPDILQGDAVERLDGSVNFGEWLERHGPAVTGKLVAEYMQRVREGGASFVGVTGYCFGAKYAVQQIGPDGHADACAVAHPSFLELEEVARVRKPILISAAETDQHFPAETRWAAEKELAGICATYQIDLFSGVVHGFAVRGDLADEAVRYAMGKVVGDQICWMGRFAK

SEQ ID NO: 18886 - DNA, 771 bp, Neurospora crassa
  CDS (1)..(771)
atggcctctaaccctccctccaagtgctgcgtcatgggcttccgccatgagggcgagccaaccggcaccatgaccaaggtcgccgacaagtgggacgcctacatcgcccagcccactggctcccagaagaccggcaaagccctcctcttccttcccgacatcatcggcatctggcaaaactccaagctgatggccgaccagctggccgcccagggctaccttaccatggttctcgacatcctcaacggcgacccgctcccgctcaaccgccccgacgacttcgacatcatgggctggctgaccaagggcagcaccggcgataacccgcataccaaggacttcgttgatcccattgtgcaggccggaatcaaggctttgaaggagcagtatggagcgaccaagatcggagcgttgggatactgctttggtgccaagtcccttgtccgcaacatgacggccaccgccccctacaccggcatcgacgtcggctttgtcgcccatccctccttcgtcgaggaggaagagctcgccgccatctccggccctttggccattgccgccgccgagactgactccatcttccctgccgagctgcgccacaagtccgaggagatcctcaaggagacgggtctgccctaccaggtcaccctgtactctggcgtctcccacggcttcgccatgcgcgccgatctcagcaagaagccggagaagtttgcgagggagcaggcgtttgcgcaggctgtcgcttggtttggagagtatttggagtaa

SEQ ID NO: 18887 - protein, 256 aa, Neurospora crassa
MASNPPSKCCVMGFRHEGEPTGTMTKVADKWDAYIAQPTGSQKTGKALLFLPDIIGIWQNSKLMADQLAAQGYLTMVLDILNGDPLPLNRPDDFDIMGWLTKGSTGDNPHTKDFVDPIVQAGIKALKEQYGATKIGALGYCFGAKSLVRNMTATAPYTGIDVGFVAHPSFVEEEELAAISGPLAIAAAETDSIFPAELRHKSEEILKETGLPYQVTLYSGVSHGFAMRADLSKKPEKFAREQAFAQAVAWFGEYLE

SEQ ID NO: 18888 - DNA, 24 bp, Primer
atggcatctaatcaacctggcaag

SEQ ID NO: 18889 - DNA, 27 bp, Primer
ttaaacattcgaaaaatgattgaacca

SEQ ID NO: 18890 - DNA, 1188 bp, Escherichia coli K12
  CDS (1)..(1188)
atggcggacaaaaagcttgatactcaactggtgaatgcaggacgcagcaaaaaatacactctcggcgcggtaaatagcgtgattcagcgcgcttcttcgctggtctttgacagtgtagaagccaaaaaacacgcgacacgtaatcgcgccaatggagagttgttctatggacggcgcggaacgttaacccatttctccttacaacaagcgatgtgtgaactggaaggtggcgcaggctgcgtgctatttccctgcggggcggcagcggttgctaattccattcttgcttttatcgaacagggcgatcatgtgttgatgaccaacaccgcctatgaaccgagtcaggatttctgtagcaaaatcctcagcaaactgggcgtaacgacatcatggtttgatccgctgattggtgccgatatcgttaagcatctgcagccaaacactaaaatcgtgtttctggaatcgccaggctccatcaccatggaagtccacgacgttccggcgattgttgccgccgtacgcagtgtggtgccggatgccatcattatgatcgacaacacctgggcagccggtgtgctgtttaaggcgctggattttggcatcgatgtttctattcaagccgccaccaaatatctggttgggcattcagatgcgatgattggcactgccgtgtgcaatgcccgttgctgggagcagctacgggaaaatgcctatctgatgggccagatggtcgatgccgataccgcctatataaccagccgtggcctgcgcacattaggtgtgcgtttgcgtcaacatcatgaaagcagtctgaaagtggctgaatggctggcagaacatccgcaagttgcgcgagttaaccaccctgctctgcctggcagtaaaggtcacgaattctggaaacgagactttacaggcagcagcgggctattttcctttgtgcttaagaaaaaactcaataatgaagagctggcgaactatctggataacttcagtttattcagcatggcctactcgtggggcgggtatgaatcgttgatcctggcaaatcaaccagaacatatcgccgccattcgcccacaaggcgagatcgattttagcgggaccttgattcgcctgcatattggtctggaagatgtcgacgatctgattgccgatctggacgccggttttgcgcgaattgtataa

SEQ ID NO: 18891 - protein, 395 aa, Escherichia coli K12
MADKKLDTQLVNAGRSKKYTLGAVNSVIQRASSLVFDSVEAKKHATRNRANGELFYGRRGTLTHFSLQQAMCELEGGAGCVLFPCGAAAVANSILAFIEQGDHVLMTNTAYEPSQDFCSKILSKLGVTTSWFDPLIGADIVKHLQPNTKIVFLESPGSITMEVHDVPAIVAAVRSVVPDAIIMIDNTWAAGVLFKALDFGIDVSIQAATKYLVGHSDAMIGTAVCNARCWEQLRENAYLMGQMVDADTAYITSRGLRTLGVRLRQHHESSLKVAEWLAEHPQVARVNHPALPGSKGHEFWKRDFTGSSGLFSFVLKKKLNNEELANYLDNFSLFSMAYSWGGYESLILANQPEHIAAIRPQGEIDFSGTLIRLHIGLEDVDDLIADLDAGFARIV

SEQ ID NO: 18892 - DNA, 1522 bp, Bordetella avium
  CDS (154)..(1344)
caggggtagcatgggagcggggtcagagagtgatcaaaaccagcgctgccatcatagggcaaagccatattcctagcgccaggtaatatcgattcaactttgtgtaggcctgctgcctgttacgctttcattctttcgtctgccgcctctgccatgtctgacacctccgctaaacacatcgacaccctgttgcagcatctgggtagcgcgcccttcaatcccgacactggcgccgcgccggtcaatctgccatccgtgcgcgccagcactgtgcgttttcaaagtctggccaagctcgaggacgctcagcgccgcaaggcggcgggcgaacgcgcgtctacctatgggcgcatgggcatggatacccacgccgccctggagcaggtgtttgcagagctggagggtggcacgcattgctatctggcttcgtccgggctggcgggcatctcgatggtgtttctgtcgctgttgtcggccggcgaacatgccctggtggcggattgcgcctatgggcccgtgcatgagctccatgaggccgtgctgtcgcgcctgggcatcgacgtcaccttcttcgacgcaaaggccgatctggcaagcctcgtgcgtcccactacgcggctgatctttgccgaagcgcccggctccctgctgttcgagatgctggacatgccggcgctggcccgcttcgccaaacaacatgacctgattctcgccaccgacaatacctggggctcgggctatatctaccgcccgctcacgctgggcgcgcaggtctctgtcatcgccggcaccaagtatgtgggcggacactccgacctgatgttgggcgcggtggtcaccaatgatgaggccatcgccaagcgcttgaaccgcacgcaatatgcgctgggttattcggtcagcgccgatgatgcctggctcgccctgcgcggggtgcgcaccatgcctgtgcgcatggcccaacatgcgcgccatgccctcgaagtctgcgagttcctgcaaaaccgtcccgaggtcgtacgcctctatcacccggcatggccggccgatccaggccatgccctatggcagcgtgactgcagcggctcgaatggcatgttggcggtgcagttaggcctgtcgccgcaggccgcgcgggacttcgttaatgcgctgacgctgtttggcatcggtttttcctgggggggcttcgagtccctggtgcaattggtcacgccgggcgagttggcgcgccatcagtattggcaaggcggctcggacgcgctggtgcgtctgcatatcggtctggaatcgccggccgatcttattgccgacctggcccaggcgctggaccgcgccgcctgagcgctcagctgcggccttgccgcttgcgccgccacgtcgcgaactcggcaggcgtgagcggcggcgagtatagatagccttggccccattgcacgccgttgcgcgtcaggtgctcggcctgcgcggcggtttctatgccttctgccgtgagctccagcttaaggcgttgacctagcgc

SEQ ID NO: 18893 - protein, 396 aa, Bordetella avium
MSDTSAKHIDTLLQHLGSAPFNPDTGAAPVNLPSVRASTVRFQSLAKLEDAQRRKAAGERASTYGRMGMDTHAALEQVFAELEGGTHCYLASSGLAGISMVFLSLLSAGEHALVADCAYGPVHELHEAVLSRLGIDVTFFDAKADLASLVRPTTRLIFAEAPGSLLFEMLDMPALARFAKQHDLILATDNTWGSGYIYRPLTLGAQVSVIAGTKYVGGHSDLMLGAVVTNDEAIAKRLNRTQYALGYSVSADDAWLALRGVRTMPVRMAQHARHALEVCEFLQNRPEVVRLYHPAWPADPGHALWQRDCSGSNGMLAVQLGLSPQAARDFVNALTLFGIGFSWGGFESLVQLVTPGELARHQYWQGGSDALVRLHIGLESPADLIADLAQALDRAA

SEQ ID NO: 18894 - DNA, 1743 bp, Rattus norvegicus (Norway rat)
  CDS (11)..(1207)
ccgtcccagcatgcagaaggacgcctcctccagcggcttcctgcccagcttccagcactttgccactcaggccatccacgtgggaccagagccggagcaatggagttcgcgtgctgtggtgctgcccatttcgctggccaccacgttcaaacaggactctccaggccagtcctcgggttttgtatacagccgctctggaaatccgacgaggaattgcttggaaaaagcagtggctgcactggatggggcaaagcactgtttgaccttcgctcggggccttgccgccaccacaacgattacccatcttttaaaagcaggagatgaagtcatttgcatggatgaagtgtatggaggcaccaacaggtacttcaggagggtggcatccgagtttggactgaagatttcttttgtggattgttccaaaaccaaattgctggaggcagcgatcacaccacagaccaagcttgtttggattgaaacacccacaaacccaaccttgaagttggccgacatcaaagcctgcgcacaaattgtccacaaacacaaagacatcattctggttgtagataacactttcatgtctgcatatttccagagacctttggctctgggtgctgatatttgtatgtgttctgccacaaaatacatgaacggccacagtgatgttgtcatgggcttagtgtctgttacttccgatgacctcaacgaacggcttcgtttcctgcagaattctctcggggcagttccttctcctttcgattgttacctctgctgccgaggcctgaagacactgcagatccggatggagaaacacttcaggaatgggatggcagtggcccgtttcctggagtctaatccccgggtagaaaaggttatttatcctgggctaccgtctcaccctcagcatgagctcgccaaacgtcagtgcacgggctgccccgggatggtcagtttctatatcaagggtactctgcagcatgctcaggtcttcctcaaaaatataaagctgtttgctctggctgagagcctgggaggatatgagagtctggctgagcttccagcaatcatgacccatgcctccgtgcctgagaaggacagagctaccctcgggatcagtgacacactgatccgactttctgtgggcctagaggatgaaaaggaccttctcgaagacctgggtcaagctttaaaggcagcgcacccttaaagttcgagtcaaagccggcattccagtgctgccatcagcagcagcagccaaggggccagaccttctgaataactggacagaccattaaggagcatctgcagaacttcgcagtgaacattttaagaccctagtgattttacagctgtaaccttacagggatcttcccttaaggactgtcttctgctaacaggttgttctgttagtatcattctgatagttttgctgtatttgtgttcaaggaagagagttgtattattttggggatcatgttgcttcttttttcctttttctttcttcggtagcctaagatatgttttaatcatgtttacaaaatttagtattgatgttttatgaagttaaattattcaatgaacggtcttaaatcaactgtaggggttttttttttgaaaaattattgaaagtggggggtctttatttaattaccataagccaaaaaaatcaaatatttggaatatctactgtgaaattctagtgattaaaggttgtacttgatacttgttgtttttcttaaatgg

SEQ ID NO: 18895 - protein, 398 aa, Rattus norvegicus (Norway rat)
MQKDASSSGFLPSFQHFATQAIHVGPEPEQWSSRAVVLPISLATTFKQDSPGQSSGFVYSRSGNPTRNCLEKAVAALDGAKHCLTFARGLAATTTITHLLKAGDEVICMDEVYGGTNRYFRRVASEFGLKISFVDCSKTKLLEAAITPQTKLVWIETPTNPTLKLADIKACAQIVHKHKDIILVVDNTFMSAYFQRPLALGADICMCSATKYMNGHSDVVMGLVSVTSDDLNERLRFLQNSLGAVPSPFDCYLCCRGLKTLQIRMEKHFRNGMAVARFLESNPRVEKVIYPGLPSHPQHELAKRQCTGCPGMVSFYIKGTLQHAQVFLKNIKLFALAESLGGYESLAELPAIMTHASVPEKDRATLGISDTLIRLSVGLEDEKDLLEDLGQALKAAHP

SEQ ID NO: 18896 - DNA, 1140 bp, Bacillus subtilis
  CDS (1)..(1140)
atgaagaaaaaaacattgatgatacatggcggaatcacaggtgatgagaaaacaggcgcagtttccgtgccgatttatcaagtaagcacgtacaagcagccgaaagcagggcagcatacaggctacgagtattcaagaacggccaatccgactcgaaccgctctcgaagcacttgtgacagaactggaaagcggggaagcaggctatgcgttcagctcaggaatggctgccattacagcggttatgatgctgtttaacagcggagatcatgtcgtgttgactgatgatgtgtacggcggaacatatcgcgtgatgacaaaggtgcttaaccgtcttggcattgaatcaacatttgttgatacgagcagcagggaagaagttgaaaaagcgattcgccctaatacaaaagcaatttatattgaaacaccgacaaacccgttgctcaaaatcaccgacctgacgctcatggctgatatcgcaaaaaaagcgggtgttctgcttatcgtagacaatacctttaatactccttattttcaacagccgcttactttaggcgctgatatcgtactgcacagtgcgacaaaatatcttggcggacacagtgatgtcgtcggaggtttagttgtgacagcttcgaaagagcttggagaagagctgcattttgtgcaaaactccacaggcggcgtgctcggccctcaagattcctggctgttaatgagaggaatcaaaacgttgggactcagaatggaagcgatcgatcaaaatgcgcggaaaatcgcaagctttcttgagaatcaccctgctgtccaaacgttatattaccctggttcttcaaatcatcccggacatgagcttgcaaaaacgcaaggagcgggcttcggcggcatgatctcctttgatattggcagtgaagaacgggttgatgcgtttttaggaaatctgaaactgtttaccattgctgaaagcctgggggcggttgaaagcttaatttctgttcctgcaagaatgacacatgcctctattccgagagaacgccggcttgagctcggcattacggacggcttgatcagaatttctgtaggaattgaagatgcggaagacttgttggaagatatcggccaagcgcttgaaaatatataa

SEQ ID NO: 18897 - protein, 379 aa, Bacillus subtilis
MKKKTLMIHGGITGDEKTGAVSVPIYQVSTYKQPKAGQHTGYEYSRTANPTRTALEALVTELESGEAGYAFSSGMAAITAVMMLFNSGDHVVLTDDVYGGTYRVMTKVLNRLGIESTFVDTSSREEVEKAIRPNTKAIYIETPTNPLLKITDLTLMADIAKKAGVLLIVDNTFNTPYFQQPLTLGADIVLHSATKYLGGHSDVVGGLVVTASKELGEELHFVQNSTGGVLGPQDSWLLMRGIKTLGLRMEAIDQNARKIASFLENHPAVQTLYYPGSSNHPGHELAKTQGAGFGGMISFDIGSEERVDAFLGNLKLFTIAESLGAVESLISVPARMTHASIPRERRLELGITDGLIRISVGIEDAEDLLEDIGQALENI

SEQ ID NO: 18898 - DNA, 1155 bp, Aeropyrum pernix
  CDS (1)..(1155)
atgaggggcttcaccaccaaggccgtccacgcgggggaggacccccgggagaccctccacggcgacgtcgtccaccctatacacctctccgtcacgtattggaagaggagtgtggctgaggccgaggagggctacgtgtactcgaggacctccaaccccaccagggacgcccttgagaagaagctggccgccctcgagaacgccaggtacgccctggccttctcctccggcctggcggccgaggccaccgtcatactcgccctgctgagggagggagaccatatagtggcgttcgacgacctctacggcggcaccaagaggctcttccagagggtgatggcccggttcgggattaaggtcacctacgtggacgcccgcgaccccgggaacatcgagaaggccctgacacccgccaccaggatgatatggctcgagacccccaccaacccgctgctgaagctgaccgacatcagggccgcggcggagatagcgtcccgggcgggggcttacctggtggtagacaacaccttcgccaccccatacttccagaggcccctggagctgggggcggatatagtggtgcacagcgccactaaatacctctcaggccactcagacctcctcgcgggggccgtgatggtcaacagcagcgaggtctacgagaagctcaagtaccaccagaacgccgtcggcgccgtcccaccacccctcgactcctacctcctcatgagatccctcaaaaccctagccctcaggatggagtggcaccagcacaacgccatgaagatagccgaacacctagagagccacccgaaggtggaccgggtaatctaccccggcctctcaacacacccccagcacagcctggcgaagaggcagatgacaggctacagcggcatgctctccttcgagctcaaggggggcgccggggcggcggtcaggttcgtagagagcctcaggatcatagccctcgccgagagcctaggaggggtagaatccctagtggagataccctcgctcatgacacacgcctcaatacctagggaggagaggctcaagaaagggataacagacggcctagtaagactctcagtaggcatagaggacctcgaagacctcatagaagacatagaacaagccctcaagaaaacatag

SEQ ID NO: 18899 - protein, 384 aa, Aeropyrum pernix
MRGFTTKAVHAGEDPRETLHGDVVHPIHLSVTYWKRSVAEAEEGYVYSRTSNPTRDALEKKLAALENARYALAFSSGLAAEATVILALLREGDHIVAFDDLYGGTKRLFQRVMARFGIKVTYVDARDPGNIEKALTPATRMIWLETPTNPLLKLTDIRAAAEIASRAGAYLVVDNTFATPYFQRPLELGADIVVHSATKYLSGHSDLLAGAVMVNSSEVYEKLKYHQNAVGAVPPPLDSYLLMRSLKTLALRMEWHQHNAMKIAEHLESHPKVDRVIYPGLSTHPQHSLAKRQMTGYSGMLSFELKGGAGAAVRFVESLRIIALAESLGGVESLVEIPSLMTHASIPREERLKKGITDGLVRLSVGIEDLEDLIEDIEQALKKT

SEQ ID NO: 18900 - DNA, 1257 bp, Deinococcus radiodurans
  CDS (1)..(1257)
atgaccaacaccccttcttcccccaatgacgcgtcctggagctacgacacggcggcggtgcagagcgggattccgcgcggcctgggcgaaaccatcggctttccgattcacgcggcggcggcctttcagttcgacacgctggagcaggcgcaagacgagtttcaatacaacggaggcctgagctacgcccgcattcagaaccccaccgtgcgggcgctggaggagcgtctcacggtgctcgaaggcggcgcggcgacggtggccctcgccagcgggcaggccgccagcctcaccgccattctgagcgtgtgccgggccggggaccacgtggtgtcgagtgccagcctgtttggcggcagcaccgggatgctgaccaatattttgccgctgatgggcatcacggcgacgctggtggagggccaccccgagcagattcgcgctgctatgcaggacaatacccggctggtgtgggccgagatgatttccaacccctcgggcgcggtggccgatgtcgaggcgctggctggggttgcccacgagcgcggcgccctgctcgccatcgacaacacctgcggcggcgtggggtacctgtgtcggcccctcgaccacggcgccgacatcgtgagccagtcgctcaccaagtgggcgggcgggcacggcagcgtcatgggcggcagcgtgacggtgggcacgcagcacgacctgagccgcaacccgatttatgcgggcggcgaaaacagcctgctcgagcagcgcggcgcggacgccctcgcgtggcggcagcggtggtttggggcgcatcagctcggcatgacgctcgcgccgcacagcgcgttcctgatcgcgcagggcctggaaaccctggggctgcggctgcaacgcgaatccgactcggcgctggcgctggcgcgctggctggggcagcatccccgcgtcggcggcgtgagctacgcgggcctgccggggcacccgagcttcccactggttcagaagtacctgccgcgcggcgcgggcgcggtcctcaccttcgaggtggacgacccctcgcgcttcctctcgcggttgcgggtgctgcgcatggcccccaacctcggcgacgtgcggaccctcgtcgtccacccctggaccaccacccacgggcgggtgcccgaggcggcccggcacgcggcgggcgtgacccccggcaccattcgcatgagcgtgggcgtggaagacgtgatggacttgcaggccgacatcgagcaagcgctgaattga

SEQ ID NO: 18901 - protein, 418 aa, Deinococcus radiodurans
MTNTPSSPNDASWSYDTAAVQSGIPRGLGETIGFPIHAAAAFQFDTLEQAQDEFQYNGGLSYARIQNPTVRALEERLTVLEGGAATVALASGQAASLTAILSVCRAGDHVVSSASLFGGSTGMLTNILPLMGITATLVEGHPEQIRAAMQDNTRLVWAEMISNPSGAVADVEALAGVAHERGALLAIDNTCGGVGYLCRPLDHGADIVSQSLTKWAGGHGSVMGGSVTVGTQHDLSRNPIYAGGENSLLEQRGADALAWRQRWFGAHQLGMTLAPHSAFLIAQGLETLGLRLQRESDSALALARWLGQHPRVGGVSYAGLPGHPSFPLVQKYLPRGAGAVLTFEVDDPSRFLSRLRVLRMAPNLGDVRTLVVHPWTTTHGRVPEAARHAAGVTPGTIRMSVGVEDVMDLQADIEQALN

SEQ ID NO: 18902 - DNA, 1158 bp, Neisseria meningitidis
  CDS (1)..(1158)
atgaaattcgccacgaaagccattcattccagctacgattgcgacgaacacaaccgcgcgctgatgccgccgatttatcaaaacagtatgtttgcgttgcacgagattggcgaaaatgtgccttaccgttattcgcgcctgagcaacccgacccgtcagattttagaagacaccgttgccgatttggaacacggtgcggcaggttttgcgttttccagcggtatggcgggaattgatgccgtatggcgcactttcctgcgcccgggcgataccattgtcgccgtcgccgatatttacggcggcgcttatgatttattggtcgatgtttatcaaaaatggggggtgaacgttgtttttgccgatttaggcaatccggataatttggacgaactgcttaaagcgcacaaggtcaaactggtttggctggaaacgccgtccaatccacttttacgcttggtagacatcaaagtccttgccgcaaaagccaaagcagccggtgcgctggtcggtatcgacaacacttttgccacgccgtatctgcaacagccgttggatatgggttgcgattttgtattccattccgctaccaaatatttgtgcggccattccgacgtgttgatgggcatcgtcgttgccaaaaccaaagaactggcgcagcctttgcacgatatgatggtgcataccggcgcggttgccggcccgctggactgctggctggtgttgcgcggcatcaaaacactggctctgcgcatgaacgcccattgccaaaacgcactcgaaatcgcgcgccgtttggaagcccatcctgccattgaaaaagtgttccatcccggcctgccgtctcacgaacattacgaactggcgaaaacacaaatgcccaaaggcatcggcggcgtggttacggtttatctcaaaaacgacacgcgtgaagcggcaaacagcgtgattaaaaacatgaaactggtcaaaatggcttccagcctcggcggtgtggaaagtttggtcaaccattgctattcccagtcccacagcggcgtaccgcatgatgtgaaaatggaaatgggcatcaaagtcggtctgctgcgtttctccatcggcatcgaagacgcggacgatatttggaacgatatttccgccgcactcgatacaactttgtaa

SEQ ID NO: 18903 - protein, 385 aa, Neisseria meningitidis
MKFATKAIHSSYDCDEHNRALMPPIYQNSMFALHEIGENVPYRYSRLSNPTRQILEDTVADLEHGAAGFAFSSGMAGIDAVWRTFLRPGDTIVAVADIYGGAYDLLVDVYQKWGVNVVFADLGNPDNLDELLKAHKVKLVWLETPSNPLLRLVDIKVLAAKAKAAGALVGIDNTFATPYLQQPLDMGCDFVFHSATKYLCGHSDVLMGIVVAKTKELAQPLHDMMVHTGAVAGPLDCWLVLRGIKTLALRMNAHCQNALEIARRLEAHPAIEKVFHPGLPSHEHYELAKTQMPKGIGGVVTVYLKNDTREAANSVIKNMKLVKMASSLGGVESLVNHCYSQSHSGVPHDVKMEMGIKVGLLRFSIGIEDADDIWNDISAALDTTL

SEQ ID NO: 18904 - DNA, 1167 bp, Vibrio cholerae
  CDS (1)..(1167)
atgaccacacgcaagccagccaccattgcggttcgtaccggtattgaatcggacactcaataccatgccgttgtgccccccatttatctttcgaccaactatggttttcccgcgtttggcgaagtacctaaatacgattacacccgttcaggcaacccaaaccgaggacttttagaacaaaccttatatgagcttgaatgtggagaaggtgccgtagtgaccaactgtggcacttctgccatcaatttatgggtcacagccttgttaggccctgatgatctgattgtcgcgccgcatgactgctatggcggcacttatcgcttgctcaacactcgcgctaaaaaaggcgatttcaaagtgcagtttgtggatcaatccaacgcagccgcactcacccaagctttagcccgcaagcccaaactgttgctgattgaaaccccctccaaccctttagtgcgtgtggtggatattgctcatctttgccagttagcgaaagcgcaaggcactttggtggcagtcgataacaccttcttaaccccggtattccaaaaaccgctcaccttaggcgcggattttgtgctgcactccaccaccaaatacattaatggtcactcggatgtgattggcggcgtgttgatctgtaaacacaagcaacatgccgaagagttggcttggtggggcaactgtttagggtcaaccggcactccatttgatagctacatgaccttgcgtggcattcgcacgctgggcgcgcggatgcgcgtgcatgaagagagtgcgcaacagattttggcttatctgcagactcaatctttggttagcaaaatttatcatccaagtctgcccgaccatccggggcatgagattgccaaaaaacagcaatctggctttggcgctatgctcagtttcgagtttgccggcagttttgagcagctgaaattctttgtgggtaagttggcgctgttttcactggcggagtcacttggcggggtagaaagtcttatttgccatcctgcgtctatgactcatcgtgcaatgggcgaagaagccttagctgaagcgggaatttcccagcagttgctgcgtctttccgtcggtcttgaagatgcctctgatctgattgccgatcttgaccaagcctttttgcacactcttgccgcgaattaa

SEQ ID NO: 18905 - protein, 388 aa, Vibrio cholerae
MTTRKPATIAVRTGIESDTQYHAVVPPIYLSTNYGFPAFGEVPKYDYTRSGNPNRGLLEQTLYELECGEGAVVTNCGTSAINLWVTALLGPDDLIVAPHDCYGGTYRLLNTRAKKGDFKVQFVDQSNAAALTQALARKPKLLLIETPSNPLVRVVDIAHLCQLAKAQGTLVAVDNTFLTPVFQKPLTLGADFVLHSTTKYINGHSDVIGGVLICKHKQHAEELAWWGNCLGSTGTPFDSYMTLRGIRTLGARMRVHEESAQQILAYLQTQSLVSKIYHPSLPDHPGHEIAKKQQSGFGAMLSFEFAGSFEQLKFFVGKLALFSLAESLGGVESLICHPASMTHRAMGEEALAEAGISQQLLRLSVGLEDASDLIADLDQAFLHTLAAN

SEQ ID NO: 18906 - DNA, 1173 bp, Agrobacterium tumefaciens
  CDS (1)..(1173)
atgaaccaaggcaacgatctctttgatcccgcctccctgattgtcgcgcatgacgagacccacgctttcgaagccgtggtgccgcctctcgtgcagacctcgcttttcaccttttccagctacgatgaaatggtctccacctatcgcggtgaaaaggtgcgaccggtctatacgcgcgggcttaacccgacggtgcgcatgttcgaagaaatgctggccagactcgaaggcgctgaagacgcgctcggttttgccagcggcatgtctgctatctcttccaccgtgctgtccttcgtgtcgccgggcgaccgcattgtcgcggtgcgccatgtctatcccgatgccttccgcctgttcggcaccttcatgcagcgcatgaatgttgaggtcgtctatgtcgatggtcgtgatgaggcggcggttgaaaaggcgatgccgggcgcaaagctgttctacatggaaagcccgacgagctgggtgatggaagcccatgatgtcggtgcgctggccgccatcggcaaacggcatggcgcggtcaccgtcatcgacaattcctgggcaagcccggtcttccagcagccgatctcgcttggcgtcgatctcgtcgtgcattcggcctcgaaatatctcggcggccatagcgatgtggtctccggcgtggtggccggttcgaaggcgatgatcgaccgcatccgggaggaaacctatccctatctcggtggcaagatgtcgcctttcgatgcgtggctgctcattcgcggacttcgcaccctgccgctgcgcatgaaggcgcatcaggcttcggcgctcgacatcgcaacccgcctgcaggcgctggatgtggtggagaaggtctgccatccggggctggcgaaccgcctgccgcccggccttcacggcacgtcgggcctgttttcattcatcttcaaggaaggcgtggatgtgcgggcttttgccgaccgcctccagcttttcaaactgggcgtttcctggggcgggcatgaaagcctgatcgttccgggcgaagtggtgctcgaacagaaggcgcagccaaactccgcccacacgttcggcatcagcgcgcgttcggtgcgcctgcatgtcggactggagggcacggaagcgctctggaacgatctcgaacccgcgatcaaggcggcctcagccgtctga

SEQ ID NO: 18907 - protein, 390 aa, Agrobacterium tumefaciens
MNQGNDLFDPASLIVAHDETHAFEAVVPPLVQTSLFTFSSYDEMVSTYRGEKVRPVYTRGLNPTVRMFEEMLARLEGAEDALGFASGMSAISSTVLSFVSPGDRIVAVRHVYPDAFRLFGTFMQRMNVEVVYVDGRDEAAVEKAMPGAKLFYMESPTSWVMEAHDVGALAAIGKRHGAVTVIDNSWASPVFQQPISLGVDLVVHSASKYLGGHSDVVSGVVAGSKAMIDRIREETYPYLGGKMSPFDAWLLIRGLRTLPLRMKAHQASALDIATRLQALDVVEKVCHPGLANRLPPGLHGTSGLFSFIFKEGVDVRAFADRLQLFKLGVSWGGHESLIVPGEVVLEQKAQPNSAHTFGISARSVRLHVGLEGTEALWNDLEPAIKAASAV

SEQ ID NO: 18908 - DNA, 1182 bp, Yersinia pestis
  CDS (1)..(1182)
atgaataaaaaagatatttctagttttggtattagtactcaaataacacaactgggtagaaatccacaagagcagacgggttttgttaatacaccgatctatcgggggtccacggttatttttaatacggtcgatgacattgtcaataatcgtgctgtttttaactatgggacagcaggtactcccactattgctaatctagagagtgcgtggaccgcactggctggggctgcaggaaccgtgatttccccttctggcttgggggtgatcgcgttagcattgttaacaacgctaaaagcgggtgatcacttgttgatgccagatagtgtgtataaaccgacaaggttactctgtgcgggtttgatcgctcggatgggggttgaaacaacatattatgacccattgatcggtgctgaaattgaaacattaatgaagccgaatacatcgacgttatttttggagtctcctggctcacaaagcttcgaaattcaggatattccgatgatgacggcaatcactaaaaggcgagggattgcgacaattattgataatacttgggcttcaccgctattttttgccgcccataaacatggctgtgatttatcacttgaggcgggtaccaaatatttgggcgggcactctgacctattaatggggctggtgtcggcgaacgaacaatggtggcctaaattaagggagacttatgactctatggccatgctaccgggggctgaggactgtttcttagcattacgtggcttaaggaccctacatctacgaataaaagaggcagaaaagcgcggacttgaaatggcgcaatggctgaaagagcggccagaagtgttgcgtgttttacatccggcctttcctgattgccctggacatgagttttggaaacgtgattttaccgggtcatcaggtctattctctattgtattaaagcccgaatttactcaaaaagggttggcggagatgttggacaatatgtctatctttgctatgggtttctcttgggggggatatgagagcctggtgatcccttttgattgctcggaataccgcacggtgacgaaatggaacccaggtggattaaccatccgcttacaaatcggtcttgaggatatggaggatctcaaggaggacttggcgcaaggttttattcggttagcatcaaatagttaa

SEQ ID NO: 18909 - protein, 393 aa, Yersinia pestis
MNKKDISSFGISTQITQLGRNPQEQTGFVNTPIYRGSTVIFNTVDDIVNNRAVFNYGTAGTPTIANLESAWTALAGAAGTVISPSGLGVIALALLTTLKAGDHLLMPDSVYKPTRLLCAGLIARMGVETTYYDPLIGAEIETLMKPNTSTLFLESPGSQSFEIQDIPMMTAITKRRGIATIIDNTWASPLFFAAHKHGCDLSLEAGTKYLGGHSDLLMGLVSANEQWWPKLRETYDSMAMLPGAEDCFLALRGLRTLHLRIKEAEKRGLEMAQWLKERPEVLRVLHPAFPDCPGHEFWKRDFTGSSGLFSIVLKPEFTQKGLAEMLDNMSIFAMGFSWGGYESLVIPFDCSEYRTVTKWNPGGLTIRLQIGLEDMEDLKEDLAQGFIRLASNS

SEQ ID NO: 18910 - DNA, 1173 bp, Listeria innocua
  CDS (1)..(1173)
atggctaaggattatgggcaagatacagctgtaattaaagctagtttaggaatcgataaagaaacaggtgcacttaatacgcccattcatttatcgtctacatttcatcaacatgattttgataattaccatacttatgattatgcaagaagtggcaatccgacgagagaaaaagtggagcaagcgattgccgagttagaaagtggcacgaacggttttgcttttgcaagtggtatggctgctgtttctgcggcacttttcacactatctaaaggggatcattttattatttcaaaagatgtgtatggtggaacttttcgtttggttgagcaagtgttgccgaggtttgggattacgcatacttttgttgatacgacaaatattgatgaagttgcgaaggcatttcaagcgaatactaagttggtttacttggaaacaccatccaatccgctattacatgtgacggacattcggactgtttctaaacttgcgagagcgaatggctgccatacgtttgttgacaatacttttttaacaccacttattcaaaaaccgttagagctaggggcagatttggttatccacagtgcgacgaaatttcttggcggtcatagtgatattttggcggggcttattgttactaataacccggatttggctgaagctatttactttttgcaaaattcaactggtggggttcttggggtgcaagattcttggctgttgcttcgtggacttaaaacgctatctgttcggatgaaagctgggacggaaactgcggaaaaaattgctttgtttttaaatgcggaaccagatgtagtcgcggtgcattatcctgggttaccatcccatgcaggctatgaaattcaagtagaacaagcgacgagtggtggagctgttttgtcttttgatcttggtagcgaagaagcagtgcgcgagctcgtgaatcatttggagttaccggtattttccgtgagtttaggtgcggttgagagtattttatcttatcctgctaaaatgtctcatgctgctgttccggaagaggagcgattaaaacaaggaattactccaggattattacgtttttcagcggggcttgaggatgcagatgatttgattgctgatttaaaacaagcactttcgttcattaagaaaggaagtgtcgcgaaatga

SEQ ID NO: 18911 - protein, 390 aa, Listeria innocua
MAKDYGQDTAVIKASLGIDKETGALNTPIHLSSTFHQHDFDNYHTYDYARSGNPTREKVEQAIAELESGTNGFAFASGMAAVSAALFTLSKGDHFIISKDVYGGTFRLVEQVLPRFGITHTFVDTTNIDEVAKAFQANTKLVYLETPSNPLLHVTDIRTVSKLARANGCHTFVDNTFLTPLIQKPLELGADLVIHSATKFLGGHSDILAGLIVTNNPDLAEAIYFLQNSTGGVLGVQDSWLLLRGLKTLSVRMKAGTETAEKIALFLNAEPDVVAVHYPGLPSHAGYEIQVEQATSGGAVLSFDLGSEEAVRELVNHLELPVFSVSLGAVESILSYPAKMSHAAVPEEERLKQGITPGLLRFSAGLEDADDLIADLKQALSFIKKGSVAK

SEQ ID NO: 18912 - DNA, 1284 bp, Agrobacterium tumefaciens
  CDS (1)..(1284)
atgaccgcgccgcatccgtccaaaacccatatcggcaaccacgccctccatcctgaaacccagatgctcaattacgggtatgatccggaattgtcggagggtgccgtcaagcccccggtattcctgacgtcgaccttcgtcttcaaatcggcagaggatgggcgtgacttcttcgactacgtttccggccgcaaggagccgccggcgggcaagggtgcgggtctcgtttactcccgttttaaccaccccaacagcgagattgtcgaggatcgccttgccgtttacgaacgtacggagagttgtgcgcttttctcgtccggcatgtccgccatttccacgacgcttttcgccttcgtccggcccggcgacaccgtgctccattcccagccgctgtatggtggcactgagacgctgctggcaaagaccttccataattttggcgtctcggcggtgggttttgccgacggtgtcagcgaggcatcggtgatggccgccgcagagaccgcgatggcgaagggcagggtgtcggtcattctgatcgaaacgccggccaacccgacaaatagcattgtcgatgttgcgatgatgaggcgtgtcgctgacgtgatcggcgaaaaacaaggccacagaccgatcatcgcctgcgacaacacccttctcggcccagttttccagcagcccatcgagcacggcgccgatatttcgctctattcgctcacgaaatacgtcggcgggcattccgacctcatcgccggggcggcgctcgggcggaaggatgtcatgaagcaggtgaaggccctgcgcggagcgatcggcacgcagctcgatccgcactcctgctggatgctcggacgttcgctcgagacgctgcaaatccgaatggagcgggcaaacagcaacgcgaaaatcgttgcggaattcctgaaagcgcatccgaaggtcgagaaaattcattatttgccgttcagcgatccggcatctgcagtcggcaaggtgtttgccgctcaatgctccggtgcgggatcgaccttctcgttcgacattgttggcgggcagccggcgtctttcaaattcctcaatgcgctgaccatattcaaacttgccgtgagcctcggcggtacggaatccctcgcgtctcaccccgcaacgatgacgcattcaggcgttcccgccgatgtccgccagcgcattggtgtactggattccacgattcgcctgtcgatcggcatcgaacatcccgatgatcttatcgccgatctgacccttgctttggacatgtcctga

SEQ ID NO: 18913 - protein, 427 aa, Agrobacterium tumefaciens
MTAPHPSKTHIGNHALHPETQMLNYGYDPELSEGAVKPPVFLTSTFVFKSAEDGRDFFDYVSGRKEPPAGKGAGLVYSRFNHPNSEIVEDRLAVYERTESCALFSSGMSAISTTLFAFVRPGDTVLHSQPLYGGTETLLAKTFHNFGVSAVGFADGVSEASVMAAAETAMAKGRVSVILIETPANPTNSIVDVAMMRRVADVIGEKQGHRPIIACDNTLLGPVFQQPIEHGADISLYSLTKYVGGHSDLIAGAALGRKDVMKQVKALRGAIGTQLDPHSCWMLGRSLETLQIRMERANSNAKIVAEFLKAHPKVEKIHYLPFSDPASAVGKVFAAQCSGAGSTFSFDIVGGQPASFKFLNALTIFKLAVSLGGTESLASHPATMTHSGVPADVRQRIGVLDSTIRLSIGIEHPDDLIADLTLALDMS

SEQ ID NO: 18914 - DNA, 1212 bp, Yersinia pestis
  CDS (1)..(1212)
atggcagtgaataaagcaatcccagaaaaactggaaacagccttagtcagcgcagggcgaagtaaaaaatttactcaaggctcagtgaataccgtgatccaacgagcatcatctctggttttcgaatctgtaaaagcgaaaaaacatgccacgatcaatcggggcaatggtgagttgttctatggccgcagggggacattaacccacttctctttgcaagaggcaatgacggagctggagggcggcgcaggttgcgtgctttatccttgtggcgctgccgccatcagtaatgcgattttatcgtttgtcgccacgggcgatcatgtgctgatgaccggctcagcttatgagcccgcccaaagtttctgcgataagattttatcgcgcatgaatatcacgacgacctattttgatcccatgataggtgctgggattgcttcactgattaccccgaaaaccaaggtgatatttcttgagtcacccggctccatcaccatggaagtgcaggatattcctgcgatggtggcggccatccgggcggtggctccggatgtcgttatcatgatggacaacacctgggccgcaggtgtgttatttaaagcactggattttgatatcgatatctctattcaatccggcactaaatacattattggtcactctgatgccatgctgggcattgcggttgccaatgcccgctgctgggaacaactgcgtgaagactcttatttgatgggccagatggtcgatgctgatactgcctatcttgccagccggggcttacgcacgttaagcgtccggttaaaacaacatgagaaaaacagcattgaaatcgctaactggttggcagagcgcccggaagtggcggtggtttatcatcccgcactgccaggctgcaagggccatgaattctacaagcgggattttaatggctgcaatggtttgttttctttcgaattaaaagaagaattaacccagcaacaactggagaattacctggatcactttacccatttcagcatggcgttttcatggggtggttttgaatcgctgatattaggttatcagccgaaggatattcgtgcgatccgcaaatatgacgcggaaggcatcaaaggaacattattccgtctgcatattggccttgagaatgtgcaagatttgcaagacgatctggccgcaggatttgagcgaattcaagccgtaaaatag

SEQ ID NO: 18915 - protein, 403 aa, Yersinia pestis
MAVNKAIPEKLETALVSAGRSKKFTQGSVNTVIQRASSLVFESVKAKKHATINRGNGELFYGRRGTLTHFSLQEAMTELEGGAGCVLYPCGAAAISNAILSFVATGDHVLMTGSAYEPAQSFCDKILSRMNITTTYFDPMIGAGIASLITPKTKVIFLESPGSITMEVQDIPAMVAAIRAVAPDVVIMMDNTWAAGVLFKALDFDIDISIQSGTKYIIGHSDAMLGIAVANARCWEQLREDSYLMGQMVDADTAYLASRGLRTLSVRLKQHEKNSIEIANWLAERPEVAVVYHPALPGCKGHEFYKRDFNGCNGLFSFELKEELTQQQLENYLDHFTHFSMAFSWGGFESLILGYQPKDIRAIRKYDAEGIKGTLFRLHIGLENVQDLQDDLAAGFERIQAVK

SEQ ID NO: 18916 - DNA, 1125 bp, Listeria innocua
  CDS (1)..(1125)
atggcaaagctgaaacaagagacgatagcagcgcaaattggaaatagaaagtgtgaaagaacgggtgctgtcaatatgccagtctacttctctacagcttaccagcatgccgatcttggggtatcaacgggatatgattatactagaacgggaaatccaacgcgagatgctttacaagaagcacttgcggaactagagaatggcacgcatgcatttgcgacgagttctgggatgagtgcgattcaattagtctttcagctatttaaaacgggtgaacatattataagctcgcaggatttgtacggtgggacttttagatattttgaacagtttggagcgcaatatcagattggtttttcttattgggacggggcgaatgtgaatgatttggaaaaattggttcgcccggaaacaaaagcaattttcatcgaaacgccgactaatccattgatgcaagaaacagacattgctagtgtgtctcggtgggcacatgcgaatgatttacttgttattgtagataatacattttatacacctgttttgcagcaaccattaactttaggcgcagatattgttgttcatagtgcgacgaagtatcttggtggacataacgatgtgctggcaggcgcggttattgttaaagaggaatggcttggaaaattcttttttgatcagctaaatgcaacgggtactgtgttatcaccatttgatagttggcttttgattcgtggtctgaagacgcttgttttacgagtgagacagcatcaggcaaatgcggagaaaatcgctgcgtttttggaagagcatgagttagtggaggaagtgcgctatccgggccgcgggggaatgattagtttctttattaaggatgcagcgctcgtatcgccacttttaaaagagcttgagttgtttacttttgcggaaagtttaggtggggtagagagtttgattacttatccaacaacacaaactcatgcggatattccattggaacttagaaattcttatgggctcacagataaattattacgaatttcggttggaattgaagctagtgaagatttaattgctgatttatctaaagcgcttgatgcggttttgaaaggggtgaccgctcgtggctaa

SEQ ID NO: 18917 - protein, 374 aa, Listeria innocua
MAKLKQETIAAQIGNRKCERTGAVNMPVYFSTAYQHADLGVSTGYDYTRTGNPTRDALQEALAELENGTHAFATSSGMSAIQLVFQLFKTGEHIISSQDLYGGTFRYFEQFGAQYQIGFSYWDGANVNDLEKLVRPETKAIFIETPTNPLMQETDIASVSRWAHANDLLVIVDNTFYTPVLQQPLTLGADIVVHSATKYLGGHNDVLAGAVIVKEEWLGKFFFDQLNATGTVLSPFDSWLLIRGLKTLVLRVRQHQANAEKIAAFLEEHELVEEVRYPGRGGMISFFIKDAALVSPLLKELELFTFAESLGGVESLITYPTTQTHADIPLELRNSYGLTDKLLRISVGIEASEDLIADLSKALDAVLKGVTARG

SEQ ID NO: 18918 - DNA, 1206 bp, Brucella melitensis
  CDS (1)..(1206)
atggaaaaaatgacgactgagaatgcccgcaaatttcgccctgcaaccgaactcgtccatgccggatcgttgcgctccggtttcgccgaaatgtcggaagccctgtttttgacgcaaggcttcctttaccccacggcggaagctgccgaagcgcgtttcaagggtgaagatccgggtttcatctattcgcgctacgccaacccgaccaccgacatgtttgaaaagcgcatgtgtgcgctggaaggcgcggaagacgcccgcgccaccgcctccggcatggccgccgttgccgccgccattctctgccaggtacaggcgggcgatcatgtcatctcggcccgcgccgtcttcggctcgtgtcgttatatcgtcgaaaccgtcctgccgcgctatggcgtggaagtctcgatcatcgacggctcggatgtggccaactggaaagcggccgtgcgccccaataccaaggtcatgtttcttgaaagcccgtcgaacccgacactcgaaatcatcgacattgccgccgttgcacagattgccaacgaagcgggcgcaaagctgatcgtggacaatgttttcgccacgccgcttttccagaagccgctggagcttggcgcacatatcgtcgtctattcagccacgaaacatattgacggccagggccgctgcctcggcggcgtggtgctttccgaccgcgaatggatcgaaaccacattgcaggattatttccgccatacgggaccgggcctcagccccttcaatgcatggatcatgctgaagggcctggaaacgctttcggtgcgcgtgcgccagcagacgcaatcggctgccgcaatcgccgacttccttgcaggcaagccgggcgtcaagcgtgtgatctatccgggccgcgccgaccatccgcagaccgacatcattgctaagcagatgacaggcggatccacgctcatcgcgctggagctggagggcggcaaggaagcagctttcaagtttgaaaatgcattgcaaattttcagcatcaccaacaatctgggcgacaccaagagcctgattacccatccggccaccacgacgcacaagaacctctccaacgaggcgaaggcagaactcggcatttcggatggcctgctgcgcgtttcggtcggcctcgaagacaccgacgatcttctggaagatgttgaagtggcgctgaaagtagcgcgcggctga

SEQ ID NO: 18919 - protein, 401 aa, Brucella melitensis
MEKMTTENARKFRPATELVHAGSLRSGFAEMSEALFLTQGFLYPTAEAAEARFKGEDPGFIYSRYANPTTDMFEKRMCALEGAEDARATASGMAAVAAAILCQVQAGDHVISARAVFGSCRYIVETVLPRYGVEVSIIDGSDVANWKAAVRPNTKVMFLESPSNPTLEIIDIAAVAQIANEAGAKLIVDNVFATPLFQKPLELGAHIVVYSATKHIDGQGRCLGGVVLSDREWIETTLQDYFRHTGPGLSPFNAWIMLKGLETLSVRVRQQTQSAAAIADFLAGKPGVKRVIYPGRADHPQTDIIAKQMTGGSTLIALELEGGKEAAFKFENALQIFSITNNLGDTKSLITHPATTTHKNLSNEAKAELGISDGLLRVSVGLEDTDDLLEDVEVALKVARG

SEQ ID NO: 18920 - DNA, 1188 bp, Agrobacterium tumefaciens
  CDS (1)..(1188)
atgaccaagaccaatgacctgcgttccgccgcaggtgtgaatacgcgcctgacccatggcggcaacgatcccgcggactgtttcggtttcgtcaatcctcccatcgtgcgtggctcgaccgtgctttttcccgatgcggagacgctttcgaccgaagaccagaaatacacctatggcacccatggtacgccgacgacggacgcgctctgcaatctggtcaacgagctggaaggttctttcggaaccattctcgtcccgtcgggccttgcggcgattaccgtgccgttccttgcctatctcggtgctggcgatcatgcgctgatcgttgattccgtctatttccccacccgccgtttctgcaacaccatgctgaagaagctgggcgtggaggtggagtattacgatcccgcgatcggggctggcatcgaggcgcttatccgaccaaatacgaagctcgtgcatctggaagcgccgggttccaacaccttcgagattcaggatgtccggctgatcactgacatcgctcaccggcatgattgcgtggtgaccatggacaatacctgggcgacgccgctttatttcaagccgctcgatttcggcgtcgatgtctccattcacgccgccaccaaatatccctcgggccattccgacgtgctgatgggcttcgtttcggccaatgaaaagtactggaaagcgctttatcaggccaacaccaatctcggcatctgcgtcacccccgacgatgcctatcagatcctgcgcggcatgcgcaccatggggatcaggctggaacaccatcagaagagcgcgctggatatcgcgcaatggctcgagggtcgcgacgacgttgtgcgcgtgctgcatccggccttgccgagctttgccgggcatgaactctggaagcgtgatttcaagggcgcgagcggtgtcttctccttcgtattgaaggcggaagagggcaaatacaaacagacggcatctgccttccttgatgcgctgacgttcttcgggctcggctattcctggggcggctacgaatcgcttgccgtatcggtatcgctcgtcgacagaacgattgcgaagggcccgtcggaaggaccggtcatccgtctgcagatcgggctcgaggatgtcgccgatctcaagaaagacctcgaggccggtttttcagccgcggccggggtctga

SEQ ID NO: 18921 - protein, 395 aa, Agrobacterium tumefaciens
MTKTNDLRSAAGVNTRLTHGGNDPADCFGFVNPPIVRGSTVLFPDAETLSTEDQKYTYGTHGTPTTDALCNLVNELEGSFGTILVPSGLAAITVPFLAYLGAGDHALIVDSVYFPTRRFCNTMLKKLGVEVEYYDPAIGAGIEALIRPNTKLVHLEAPGSNTFEIQDVRLITDIAHRHDCVVTMDNTWATPLYFKPLDFGVDVSIHAATKYPSGHSDVLMGFVSANEKYWKALYQANTNLGICVTPDDAYQILRGMRTMGIRLEHHQKSALDIAQWLEGRDDVVRVLHPALPSFAGHELWKRDFKGASGVFSFVLKAEEGKYKQTASAFLDALTFFGLGYSWGGYESLAVSVSLVDRTIAKGPSEGPVIRLQIGLEDVADLKKDLEAGFSAAAGV

SEQ ID NO: 18922 - DNA, 1185 bp, Agrobacterium tumefaciens
  CDS (1)..(1185)
atgagcaataaatggcgcccggcaacccagctcgttcacggcggtacgctacgctcaccctatggtgaaacgtcggaagcgatctatctgacccagggtttcgtttacgaaaactccgaagccgccgaagcccgcttcaagggcgaaacggatggcttcatctacgcccgctacgccagcccgaccaatgacatgttcgaaaagcgcatgtgcctgctggaaggcgcggaagacgcgcgcgcgcttgcctccggcatggccgccgtcaccgccgccatcatgtgccagctgcgcgccggcgatcacatcgttgccgcacgagcccttttcggctcctgccgctgggtggtggaaacgctcgcaccgaaatacggcatcgaatgcacgctgatcgacggacgtgatctcgacaattgggaaaaggcgatccagccgaacaccaagctgttcttccttgaaagcccgaccaacccgacgctcgaagtggttgatattgccggtgtggcgaagctcgccaaccagatcggcgcgaaagtggtggtcgataacgtctttgcgacgccgcttttccagaagccgctcgaactcggcgcccatatcgtggtttattcggccaccaaacatattgacggccagggccgctgcctgggtggcgtgatcctctccgacaagaagtggatcgaagaagagctgcaggactatttccgccatacgggcccggccatgtcgccgttcaacgcctggacgcttctgaagggcatcgagaccctgccgcttcgcgtcaagcagcagacggagaatgccgcgaagatcgccgatttcctcgccgatagcggcaaggtcgccaaggtcatctatcccggccgcgccgatcatccgcaggcggatatcatcgcacggcagatgtccggaggctccactttggtggccttcgaactgaagggcggcaaggacgcagccttcaagttgcagaacgcgcttgagatcgtgaagatttccaacaatctcggcgatgccaagagcctcatcacccatcccggtacgacgacacacaagaacctctccgacgaggcgcgtgccgaactcggcatttccggaggcaccctgcgcctttcctgcggcatcgaggataccgacgatctgctggaagatctcgcaaagggtcttgcggccgtttccgcctga

SEQ ID NO: 18923 - protein, 394 aa, Agrobacterium tumefaciens
MSNKWRPATQLVHGGTLRSPYGETSEAIYLTQGFVYENSEAAEARFKGETDGFIYARYASPTNDMFEKRMCLLEGAEDARALASGMAAVTAAIMCQLRAGDHIVAARALFGSCRWVVETLAPKYGIECTLIDGRDLDNWEKAIQPNTKLFFLESPTNPTLEVVDIAGVAKLANQIGAKVVVDNVFATPLFQKPLELGAHIVVYSATKHIDGQGRCLGGVILSDKKWIEEELQDYFRHTGPAMSPFNAWTLLKGIETLPLRVKQQTENAAKIADFLADSGKVAKVIYPGRADHPQADIIARQMSGGSTLVAFELKGGKDAAFKLQNALEIVKISNNLGDAKSLITHPGTTTHKNLSDEARAELGISGGTLRLSCGIEDTDDLLEDLAKGLAAVSA

SEQ ID NO: 18924 - DNA, 1329 bp, Brucella melitensis
  CDS (1)..(1329)
atgcatccggcttgcgcgcgtcttatccaagaagttagagttcccacaaagaacgcgatcgaagctctttttgccgaagccaatcttgtacccagccggcagaatcacgtctttcgagaatctgtggaacagcacgcaacatggtctggaggcattttcgtggctaagcagcagttgaagacagagaagttgggcataaacacgcggcttgctcatgacggttattgccccggcgactatcacggctttgtcaacccgcccgtcgtgcgcgcatcgaccgtgctttttcccgatgcagaaaccatggcaagcaacggccagaaatatacctatggcacacgcggcacgcccacaagcgaagcgctttgcaaagccatcgacgcgctggagggctctgcgggaacggtttgcgttccatcggggctagcggccataaccgttccgctgctgggatttctttcacccggcgatcatgcgcttcttgtcgattcgatttattacccgacccgccacttcgccaatacgatcctgaaacgcatgggtgtggacgtcgaatattacgatccggaaatcggtgcggacattgcaaagctgatgcgcccgaacaccaaggtcgtgtttacggaatcacccgcctccaacacattcgagatacaggatattcctgccatcgctgaagccgcccacaagggcaatgccatcgtcatgatggacaatacctgggcgacaccgctttatttccgggcgctcgatttcggcgtggacatcagcattcacgccgcaaccaaatatccctccggccattccgacattcttttcggcaccatttcgaccaatgagaaatgctggccgcaattgctggaaacacacggcacgatgggcctttgtgccgggcctgacgacacctaccagatcttgcgcagactgcgcaccatgggcatccggctggaacatcatcgcaaaagcgcactggagattgcccgctggctggaaaatcatccaatggtggaacgcgttctgcatccagccctcgaaagccatcccggccatgaaatctggaaacgcgatttttccggttcgtccggcattttctcctttgttctggcaaagggcgaacatgcgcaagcgagcgccttcctcaacgcgctggagattttcggcctcggctattcgtggggtggctatcaaagccttgcgcttgaagtgaagcttggcgaccgcaccgtttcgaagaacgattatgccggggcggtcatccgccttcagatcggtctggaagacgtgcccgacctcatcgccgatctcgaaagaggttttgctgcaatctga

SEQ ID NO: 18925 - protein, 442 aa, Brucella melitensis
MHPACARLIQEVRVPTKNAIEALFAEANLVPSRQNHVFRESVEQHATWSGGIFVAKQQLKTEKLGINTRLAHDGYCPGDYHGFVNPPVVRASTVLFPDAETMASNGQKYTYGTRGTPTSEALCKAIDALEGSAGTVCVPSGLAAITVPLLGFLSPGDHALLVDSIYYPTRHFANTILKRMGVDVEYYDPEIGADIAKLMRPNTKVVFTESPASNTFEIQDIPAIAEAAHKGNAIVMMDNTWATPLYFRALDFGVDISIHAATKYPSGHSDILFGTISTNEKCWPQLLETHGTMGLCAGPDDTYQILRRLRTMGIRLEHHRKSALEIARWLENHPMVERVLHPALESHPGHEIWKRDFSGSSGIFSFVLAKGEHAQASAFLNALEIFGLGYSWGGYQSLALEVKLGDRTVSKNDYAGAVIRLQIGLEDVPDLIADLERGFAAI

SEQ ID NO: 18926 - DNA, 1125 bp, Listeria monocytogenes
  CDS (1)..(1125)
atggcaaagctgaaacaagagacgatagcagcgcaaattggaaatagaaaatgtgaaagaacgggtgctgtcaatatgccagtctacttctctacagcttaccagcatgccgatcttggagtatcaacggggtatgattatactagaactggaaatccgacgcgagatgctttacaggaagcactcgcggaactagaaaatgggacgcatgcttttgcaacgagttcagggatgagtgcgattcaacttgttttccaactttttaaaactggtgaacatattattagttcgcaggatttgtacggggggacttttagatattttgaacagtttggtgcgcaatatcagattggattttcttattgggacggggcggagattgctgatttggaaaaattgattcgtccagaaacgaaggcgatttttattgaaacgccaacgaatccattgatgcaggaaacggatattgcgactgtcgcaaaatgggcccatgcgcatgatttacttgtgattgtggataatactttttatacacctgttttacagcagccgctatctttgggagcggatattgtgattcatagtgcgacgaagtatctcggtggtcataatgatgtgctagctggtgcggttatagtaaaagaggaaaaactcggaaaattcttctttgatcaattgaatgcgacggggacggtcctatcaccatttgatagttggttattgattcgcgggcttaagacactggttttacgagtgagacaacatcaagctaatgctcaaaaaatcgcggcgtttttggaagagcacaagctagtggaggaagtgcgctatccaggacgtggtgggatgattagtttctttattcgagatgcggcgctcgtatcgccacttttgaaagaactagaattgtttacttttgcggaaagtttaggcggtgtggagagtttgattacttatccaacgactcaaacacatgcggatattccggtggagttgcggaattcttacgggctgacagataaattgttgcgcatctcagttgggattgaagcgagtgaggatttgattgctgacttgtctaaggcgctcgatgcggttttggaagaggtgagtgctcgtggctaa

SEQ ID NO: 18927 - protein, 374 aa, Listeria monocytogenes
MAKLKQETIAAQIGNRKCERTGAVNMPVYFSTAYQHADLGVSTGYDYTRTGNPTRDALQEALAELENGTHAFATSSGMSAIQLVFQLFKTGEHIISSQDLYGGTFRYFEQFGAQYQIGFSYWDGAEIADLEKLIRPETKAIFIETPTNPLMQETDIATVAKWAHAHDLLVIVDNTFYTPVLQQPLSLGADIVIHSATKYLGGHNDVLAGAVIVKEEKLGKFFFDQLNATGTVLSPFDSWLLIRGLKTLVLRVRQHQANAQKIAAFLEEHKLVEEVRYPGRGGMISFFIRDAALVSPLLKELELFTFAESLGGVESLITYPTTQTHADIPVELRNSYGLTDKLLRISVGIEASEDLIADLSKALDAVLEEVSARG

SEQ ID NO: 18928 - DNA, 1161 bp, Salmonella enterica subsp. enterica serovar Typhi
  CDS (1)..(1161)
atgacgcgtaaacaggccactatcgcagtgcgtagcggattaaacgatgacgaacaatacggctgcgttgtgccgccaatccatctctccagtacctataactttaccggtttcaatgagccgcgcgcgcatgattattcccgccgcggtaatcccacgcgtgatgtggttcagcgcgcattagcggaactggaaggcggcgcgggcgcagtattgacgaataccggcatgtcggcgattcatctggtcaccaccgttttcctcaagccgggcgatctgctggtcgcgccgcatgattgctacggcggcagttatcgtctgtttgacagtctggcgacgcgcggctgttatcgtgtgcggtttgtcgatcagggcgatgaacgcgccttacaggcggcgctggaagaaaaaccgaagctggtactggtagaaagtccaagtaatccattgttacgcgtggtggatattgcgaaaatctgtcggctggcgcgcgaggcgggcgcagtgagcgtcgttgataacacatttttaagcccggcgctgcaaaatccgctggcgttgggtgccgatctggtgttgcattcatgcacgaaatatctcaatggtcattcggatgtcgtggccggcgtgatgattgctaaggatccggaaatggtcactgaactggcgtggtgggcgaataatattggcgtgaccggcggggcgtttgatagctatctgctgctgcgcggtttgcgaactctggtgccgcgtatggagctggcgcagcgcaacgcgcaggcgattgtgaaatatctgcaaacccagccgttggtgaaaaaactgtatcacccgtcgctgccgaataatcagggacatgagattgccgcgcgtcagcaaaaaggctttggcgcaatgttgagttttgaactggatggggatgaggagacgctacgtcgttttctgggcgggctgtcgctgtttacgctggcggaatctttagggggagtggaaagtttgatctctcacgccgccaccatgacgcatgccggtatgtcgccgcaggcgcgtgccgccgccgggatctccgaaacgctactgcgtatctccaccggtattgaagatggcgaagatttaattgccgacctggaaaatggcttccgggctgcaaacaaggggtaa

SEQ ID NO: 18929 - protein, 386 aa, Salmonella enterica subsp. enterica serovar Typhi
MTRKQATIAVRSGLNDDEQYGCVVPPIHLSSTYNFTGFNEPRAHDYSRRGNPTRDVVQRALAELEGGAGAVLTNTGMSAIHLVTTVFLKPGDLLVAPHDCYGGSYRLFDSLATRGCYRVRFVDQGDERALQAALEEKPKLVLVESPSNPLLRVVDIAKICRLAREAGAVSVVDNTFLSPALQNPLALGADLVLHSCTKYLNGHSDVVAGVMIAKDPEMVTELAWWANNIGVTGGAFDSYLLLRGLRTLVPRMELAQRNAQAIVKYLQTQPLVKKLYHPSLPNNQGHEIAARQQKGFGAMLSFELDGDEETLRRFLGGLSLFTLAESLGGVESLISHAATMTHAGMSPQARAAAGISETLLRISTGIEDGEDLIADLENGFRAANKG

SEQ ID NO: 18930 - DNA, 1143 bp, Helicobacter pylori
  CDS (1)..(1143)
atgcgcatgcaaaccaaattaatccatgggggcattagtgaggacgcaacaacgggggcggtgagcgtgcctatttatcaaacttccacctaccgccaagacgccataggccgccataagggctatgaatactctcgctcaggcaaccccacgcgctttgctttagaagaactcatcgctgatttagaagggggggttaaggggtttgcttttgcctctggattagctggaatccacgccgttttttccctcttgcaatcaggcgatcatgtgttattgggcgatgatgtttatggggggactttccgcttgtttaatcaagtgcttgtcaaaaacgggctttcttgcaccattatagacactagcgatatatcccaaattaaaaaggctatcaagcccaacaccaaagccctttatttagaaacccctagtaaccccttgcttaaaatcacggatttagcgcaatgcgctagtgtcgctaaagatcatggtttgctcactatcgtggataacacctttgccaccccctattatcaaaacccgcttcttttgggagcggacattgtggcacatagcggcaccaaatacttaggcgggcatagcgatgtggtcgccgggcttgtaaccactaataatgaagcgctagcccaagagatcgcttttttccaaaacgctatcggtggggttttaggccctcaagacagctggctgttgcaaagagggattaaaacgctgggattgcgcatggaagcccatcaaaaaaacgctctttgtgtggctgagtttttagaaaaacaccctaaagtggaaagggtttattacccgggccttcccactcaccctaattacgaactagctaaaaaacagatgcgtggctttagcgggatgctctctttcactctcaaaaatgatagcgaggcggttgcttttgtagaaagccttaaactattcattttaggcgagagtttgggcggggtggaaagtttggtggggattccggcatttatgacccatgcgtgcatccctaaaacgcaacgagaagctgctgggattagagatggcctggtgcgcttgtctgtagggattgagcatgaacaggatttgttagaagatttagagcaagcgttcgctaaaataggctaa

SEQ ID NO: 18931 - protein, 380 aa, Helicobacter pylori
MRMQTKLIHGGISEDATTGAVSVPIYQTSTYRQDAIGRHKGYEYSRSGNPTRFALEELIADLEGGVKGFAFASGLAGIHAVFSLLQSGDHVLLGDDVYGGTFRLFNQVLVKNGLSCTIIDTSDISQIKKAIKPNTKALYLETPSNPLLKITDLAQCASVAKDHGLLTIVDNTFATPYYQNPLLLGADIVAHSGTKYLGGHSDVVAGLVTTNNEALAQEIAFFQNAIGGVLGPQDSWLLQRGIKTLGLRMEAHQKNALCVAEFLEKHPKVERVYYPGLPTHPNYELAKKQMRGFSGMLSFTLKNDSEAVAFVESLKLFILGESLGGVESLVGIPAFMTHACIPKTQREAAGIRDGLVRLSVGIEHEQDLLEDLEQAFAKIG

SEQ ID NO: 18932 - DNA, 1173 bp, Bacillus subtilis
  CDS (1)..(1173)
atgagtaaacacaattggacgctggaaacccagctcgtgcacaatccatttaaaacagacggcggaaccggggcagtcagtgtaccgattcagcacgcctcgacttttcaccaatcttcatttgaagagttcggggcatatgattacagccgctctggcacgccgacaagaacagctctcgaagaaacaattgccgcactggaaggcggaacaagaggatttgctttcagttcaggcatggctgccatctcaacagcatttttactgctgtcacagggtgatcacgttcttgtgacagaagatgtatacggcggaaccttccgtatggtgacagaggtgctgacccggtttggcattgagcatacgtttgtcgacatgacggatcgtaatgaagtggcgcggagcatcaagccgaacacaaaggtcatttatatggagacgccatcaaatccgacacttgggattacggatattaaagcagttgttcagcttgcaaaagaaaacggctgcctgacctttctggacaatacattcatgacgccggcactgcagcgtccgcttgatctcggcgtggatattgtacttcacagcgcgacaaaattcttaagcggacacagcgatgtgctctcaggtttggctgctgtcaaagatgaagagcttgggaagcagctgtataagctacaaaacgcgttcggcgccgtccttggcgtgcaagattgctggcttgtcctgcgcggattaaaaacattgcaggtccgtttagagaaagcgagtcaaacagctcagcggcttgcggaatttttccagaagcacccggcggtcaagcgcgtgtattatccgggactggctgatcatcccggcgctgaaacccataaaagccagtcaacgggagcgggcgccgtgctatcttttgagcttgaaagcaaagaggccgttaagaagttagtcgagaatgtgtcactcccagtcttcgctgtcagccttggcgccgtggaatcgattttgtcctatccggcaacgatgtctcatgcggcaatgcctaaggaagagcgtgaaaaacgcggtatcactgatggcctgctccgtctgagtgtcggcgtcgaacatgcagacgatttagaacacgatttcgaacaagcgctgaaagaaattgctccagtttcggttcgttaa

SEQ ID NO: 18933 - protein, 390 aa, Bacillus subtilis
MSKHNWTLETQLVHNPFKTDGGTGAVSVPIQHASTFHQSSFEEFGAYDYSRSGTPTRTALEETIAALEGGTRGFAFSSGMAAISTAFLLLSQGDHVLVTEDVYGGTFRMVTEVLTRFGIEHTFVDMTDRNEVARSIKPNTKVIYMETPSNPTLGITDIKAVVQLAKENGCLTFLDNTFMTPALQRPLDLGVDIVLHSATKFLSGHSDVLSGLAAVKDEELGKQLYKLQNAFGAVLGVQDCWLVLRGLKTLQVRLEKASQTAQRLAEFFQKHPAVKRVYYPGLADHPGAETHKSQSTGAGAVLSFELESKEAVKKLVENVSLPVFAVSLGAVESILSYPATMSHAAMPKEEREKRGITDGLLRLSVGVEHADDLEHDFEQALKEIAPVSVR

SEQ ID NO: 18934 - DNA, 1158 bp, Neisseria meningitidis
  CDS (1)..(1158)
atgaaattcgccacgaaagccattcattccagctacgattgcgacgaacacaaccgcgcgctgatgccgccgatttatcaaaacagtatgttcgcgttgcacgagattggcgaaaatgtgccttaccgctactcgcgcctgagcaacccgacccgtcagattttagaagacaccgttgccgatttggaacacggtgcggcaggttttgcgttttccagcggtatggcggggattgatgccgtgtggcgtaccttcctacaaccgggcgataccatcgtcgcggtcgccgatatttacggcggcgcgtatgatttattggtcgatgtttatcaaaaatggggggtgaacgttgtttttgccgatttgggcaatccggataatttggacgaattgctcaaagcgcacaaggtcaaactggtttggctggaaacgccgtccaatccgcttttgcgcttggtagacatcaaagcgcttgccgcgaaagccaaagcggccggcgcactggtcggtatcgacaacacctttgccacgccgtatctgcaacagcccttggatatgggttgcgattttgtgttccattccgctaccaaatatttgtgcggccattccgacgtgttgatgggcatcgtcgttgccaaaaccaaagagctggcgcagcctttgcacgatatgatggtgcataccggcgcggttgccggcccgatggactgctggctggtgttgcgcggcatcaaaacactggctctgcgcatgaacgcccattaccaaaacgcactcgaaatcgcgcgccgtttggaagcccatcctgccattgaaaaagtgttccatcccggcctgccgtctcacgaacattacgaactggcgaaaacacaaatgcccaaaggcataggcggcgtggttacggtttatctcaaaaacgacacgcgtgaagcggcaaacagcgtgattaaaaacatgaaactggtcaaaatggcttccagcctcggcggcgtggaaagtttggtcaaccattgctattcccagtcccacagcggcgtgccgcataatgtgaaaatggaaatgggcatcagggtcggcctgctgcgtttctctgtcggtatcgaagatgtagatgatatttggaatgatatttccgccgcactcgatacaactttgtaa

SEQ ID NO: 18935 - protein, 385 aa, Neisseria meningitidis
MKFATKAIHSSYDCDEHNRALMPPIYQNSMFALHEIGENVPYRYSRLSNPTRQILEDTVADLEHGAAGFAFSSGMAGIDAVWRTFLQPGDTIVAVADIYGGAYDLLVDVYQKWGVNVVFADLGNPDNLDELLKAHKVKLVWLETPSNPLLRLVDIKALAAKAKAAGALVGIDNTFATPYLQQPLDMGCDFVFHSATKYLCGHSDVLMGIVVAKTKELAQPLHDMMVHTGAVAGPMDCWLVLRGIKTLALRMNAHYQNALEIARRLEAHPAIEKVFHPGLPSHEHYELAKTQMPKGIGGVVTVYLKNDTREAANSVIKNMKLVKMASSLGGVESLVNHCYSQSHSGVPHNVKMEMGIRVGLLRFSVGIEDVDDIWNDISAALDTTL

SEQ ID NO: 18936 - DNA, 1047 bp, Campylobacter jejuni
  CDS (1)..(1047)
atggaaaaatacagagaattaagaaaaacagatcgtgttttaagctatggagctagaggaacaacaaccaattttgaacttgaaaaacttatttgcactctagagggtggttatagagcacaactttttccaacaggacttgcagcattagccatggtacttttaaactatgcaagcaaagatgcacattttttaatcactgatgcaatttatgggcctgtaagaacgatttgcgaattatttttagacaaaataggcgttgaaattgattttttaaaagctgatgcaagtgatatagaagaaaaaatcaaacctaataccaagcttatcctatgcgaaagtccaggttctatactttatgaaatcatagatttaccaaaactttgcaaaattgctcatgcatataatatccctgtagctattgacaatacttattctagtggatattttctaaatcctttagaacttggagtagacatttcagttatcgccgctacaaaatatcttagtggacactctgatgtaaccatgggtatagtagtaatcaacgaaaaagaatggaaaaattttgacaaacttccagaagctttaggctttacaacaagtcctgatgatgcttacttagtacttcgtggtatgagaacactagatgtaagaatgaaagctcatgaaaaaagtgctgatgaaattgtagagtttttacaaagcagaaaagaaattaaaacaattttctatccaaaactcaaatcccacccaaatcatgaaattttcatgcgtgatcataaaggtgcaaatggtatgattaccatagaatttgcagaaggttataacaaagatgatgctattaaatttgtagataaactagaatacttttcaattggtgctagctggggtggatatgaaagcttagccaccgtaactactccgcctagaactgcaacagacctaagtgcaagagggctatttgtaagatttcatataggtcttgaagatactaaagatttaattgctgatttaacacaagcttttgatagtattaaaaaataa

SEQ ID NO: 18937 - protein, 348 aa, Campylobacter jejuni
MEKYRELRKTDRVLSYGARGTTTNFELEKLICTLEGGYRAQLFPTGLAALAMVLLNYASKDAHFLITDAIYGPVRTICELFLDKIGVEIDFLKADASDIEEKIKPNTKLILCESPGSILYEIIDLPKLCKIAHAYNIPVAIDNTYSSGYFLNPLELGVDISVIAATKYLSGHSDVTMGIVVINEKEWKNFDKLPEALGFTTSPDDAYLVLRGMRTLDVRMKAHEKSADEIVEFLQSRKEIKTIFYPKLKSHPNHEIFMRDHKGANGMITIEFAEGYNKDDAIKFVDKLEYFSIGASWGGYESLATVTTPPRTATDLSARGLFVRFHIGLEDTKDLIADLTQAFDSIKK

SEQ ID NO: 18938 - DNA, 1137 bp, Bacillus halodurans
  CDS (1)..(1137)
atgaatcgtaaagaattagaaacagctttagtacaaatcggaaatcgaatggatgatcgaacaggtgcgatcaacacgcctgtttacttttcgaccgcctatcgtcactccggaattggcgaatccactggctatgactatgcacggacagggaatcccacgagagaagtgcttgaaaaggcgattgctacgttagaaaacggagatcaagggtttgcctgtagttccggtatggcagctatccaaacggtgttttctctttttcaatcaggggatgaaattattgcttcccaagatttgtatggaggaacgtaccgcttgtttgaaggtggctggaaaaagtgggggctttctttctcctatgctgatccgcgaaatcttgcagcgttagaacagcaaataacagaaaaaacgagggcgctgtttattgaaacccctacgaatccactcatgcaagaagcaaatattcgtgagcttgccgcccttgctaataaacatgggttgctgctgatcgtcgataatacgttctatacgccacttttacaacaaccattaaacgaagggacccatatcgtcatccatagtgcgtcaaaatacttaggcggacacaatgatgtcatcgctggattgattgttgccaaaggacaagagctatgtgagcagatcgcctattaccataacggaattggcggaacgctctcagcctttgattcatggttgctcattcgtgggatgaaaactcttgctctacgaatggagcagcatcaaaacaatgcgagggctatagcgtcttacttagaaaagcatgaaggagtaacggatgttctttatcctggacggggtgggatgctttccttccgcatccaatcggagagctgggttaacccgtttttacaatcgttgaagctcatttcatttgcagagagcctagggggagtcgagagcttaatgacctatccggcgacgcaaacccatgccgatattccagaggatgtgcggatcgctaacggtgtatgtaatcgcttgttgcgattctcagttgggatcgaacatgtgggtgatttgattgccgacctcgatcaagcgttcaaccgtgtcatcgagcagtcagcggtgaaaggaagtgaagcacagtga

SEQ ID NO: 18939 - protein, 378 aa, Bacillus halodurans
MNRKELETALVQIGNRMDDRTGAINTPVYFSTAYRHSGIGESTGYDYARTGNPTREVLEKAIATLENGDQGFACSSGMAAIQTVFSLFQSGDEIIASQDLYGGTYRLFEGGWKKWGLSFSYADPRNLAALEQQITEKTRALFIETPTNPLMQEANIRELAALANKHGLLLIVDNTFYTPLLQQPLNEGTHIVIHSASKYLGGHNDVIAGLIVAKGQELCEQIAYYHNGIGGTLSAFDSWLLIRGMKTLALRMEQHQNNARAIASYLEKHEGVTDVLYPGRGGMLSFRIQSESWVNPFLQSLKLISFAESLGGVESLMTYPATQTHADIPEDVRIANGVCNRLLRFSVGIEHVGDLIADLDQAFNRVIEQSAVKGSEAQ

SEQ ID NO: 18940 - DNA, 1179 bp, Caenorhabditis elegans
  CDS (1)..(1179)
atggctactttcccacacttcggaactgctgctatccacgttggacaagaaccagagcaatgggatatgaatcaggtggtcccgccaatcagcttgtcctcgacctacaaacaggataatccaggagagccaaagggacacgattattctcgtgctggaaacccaactcgtgatgttcttcaaaagaatctggctgctctcgaagacgcaaaacactgccaagtgttctcttcaggacttgccgcaacttccgcaatcatcaatcttctcaagtacggagatcatattgtgtgctctgatgatgtctacggaggtactcaaagatatatccgccgtgttgctgttcctaatcacggattggaagtcgattcggttgatttgacggatgttcagaatctcgagaaagcaatcaaaccaaataccaagatggtttggtttgaatctccatctaacccacttttgaaggttgttgatattgccgcagtggtccaaactgcaaagaaagccaatccagaaattgttgtagttgttgataataccttcatgtctccatacttccaacgcccaatttctcttggagcggatgttgtcgttcattcaattaccaagtatattaatggacattctgatgttgttatgggtgctgttatcactgataatgacgagttccaacaacatcttttcttcatgcaacttgccgtcggagcagtcccatctccatttgattgcttccttgttaatcgtggactcaaaactcttcacatcagaatgagagctcactatgaaaatgctcttgctgttgccaaataccttgaagccaatgatcgtatcgaatcagttctctatccagctcttccatctcatccacaacatgaagttcatgagaaacaaacaaagggaatgtctggaatgatctcattctatcttaaaggagaacttcaagagagtcgtgctttcctttctgctctcaaagtattcactttggctgaatctcttggaggatatgaatcacttgccgagcttccatctatcatgactcatgcttcagtgcctgctgaaactcgaattgttcttggaatcactgataaccttatccgtatctctgttggaattgaagatctcgatgatttggttgctgatttggatcaagctttgaagattgccattccaaaagtataa

SEQ ID NO: 18941 - protein, 392 aa, Caenorhabditis elegans
MATFPHFGTAAIHVGQEPEQWDMNQVVPPISLSSTYKQDNPGEPKGHDYSRAGNPTRDVLQKNLAALEDAKHCQVFSSGLAATSAIINLLKYGDHIVCSDDVYGGTQRYIRRVAVPNHGLEVDSVDLTDVQNLEKAIKPNTKMVWFESPSNPLLKVVDIAAVVQTAKKANPEIVVVVDNTFMSPYFQRPISLGADVVVHSITKYINGHSDVVMGAVITDNDEFQQHLFFMQLAVGAVPSPFDCFLVNRGLKTLHIRMRAHYENALAVAKYLEANDRIESVLYPALPSHPQHEVHEKQTKGMSGMISFYLKGELQESRAFLSALKVFTLAESLGGYESLAELPSIMTHASVPAETRIVLGITDNLIRISVGIEDLDDLVADLDQALKIAIPKV

SEQ ID NO: 18942 - DNA, 1143 bp, Helicobacter pylori
  CDS (1)..(1143)
atgcgcatgcaaaccaaattaatccatgggggcattaatgaggacgcgacaacgggggcggtgagcgtgcctatttatcaaacttccacctaccgccaagacgccataggtcgccacaaaggctatgaatactctcgctcaggcaaccccacacgctttgctttagaagaactcatcgccgatttagaagggggggttaaggggttcgctttcgcttctggtttagccggaatccacgccgttttttccctcttgcaatcaggcgatcatgtgttattgggcgatgatgtttatggggggaatttccgcttgtttaataaggtgcttgtcaaaaacgggctttcttgcaccattatagacactagcgatctatcccaaattaaaaaggctatcaagcccaacaccaaagccctttatttagaaacccctagtaaccccttgcttaaaatcacggatttagcgcaatgcgctagtgtcgctaaagaacataatttgctcactatcgtggataacacctttgccaccccctattgccaaaacccgcttcttttgggaacggacattgtggcgcataacggcacaaaatacttaggcgggcatagcgatgtggttgctgggcttgtaaccaccaataatgaagcgctagcccaagagttcgattttttccaaaacgctatcggtggggtgttaggccttcaagacagctggctgttgcaaagagggattaaaacgctgggattgcgcatggaggcccatcaaaaaaacgccctttgcgtggctgagtttttagaaaaacaccctaaagtggaaagggtttattacccaggcctacccacccaccctaaccacgaactggccaaagcccaaatgcgtggctttagcgggatgttttctttcaccctcaaaaatgacagcgaagcggttgcttttgtagaaagccttaaattattcattttaggcgagagtttgggcggagtggaaagcttggtagggattccagcgctaatgacccatgcgtgtatccctaaagcgcaacgagaagccgccggaatcagagatggtttggtgcgcttgtctgtggggattgagcatgaacaggatctgttagaagatttagatcaagcgttcgctaaaataagctaa

SEQ ID NO: 18943 - protein, 380 aa, Helicobacter pylori
MRMQTKLIHGGINEDATTGAVSVPIYQTSTYRQDAIGRHKGYEYSRSGNPTRFALEELIADLEGGVKGFAFASGLAGIHAVFSLLQSGDHVLLGDDVYGGNFRLFNKVLVKNGLSCTIIDTSDLSQIKKAIKPNTKALYLETPSNPLLKITDLAQCASVAKEHNLLTIVDNTFATPYCQNPLLLGTDIVAHNGTKYLGGHSDVVAGLVTTNNEALAQEFDFFQNAIGGVLGLQDSWLLQRGIKTLGLRMEAHQKNALCVAEFLEKHPKVERVYYPGLPTHPNHELAKAQMRGFSGMFSFTLKNDSEAVAFVESLKLFILGESLGGVESLVGIPALMTHACIPKAQREAAGIRDGLVRLSVGIEHEQDLLEDLDQAFAKIS

SEQ ID NO: 18944 - DNA, 1191 bp, Vibrio cholerae
  CDS (1)..(1191)
atgtcagaaggtaaaaagacccgcctcgttaccgcgggacgcaacaaaaaatggacacttggcgtggttaaccccccagtacaacgcgcttctactgtggtgtttgatacggtcgcacaaaaaaaccaagcggcgatcaatcgcgccaacaaaaccctgttttacggacgtcgtggcaccacaactcacttcgcgtttcaagaagcaatggttgagattgaaggcggcgcgggttgcgtgctctacccttgtggcgcagcggccatcaccaacgcgattctctcttttgttgcgcaaggtgaccatatcttgatggtcgatacctgttacgaacccacccgtgacttttgtgagaaagtcctgaaaaaacttggtgtatcaaccacctattatgatcctatgcttggcgaaggtattcgcgagttgattcaacctaataccaaggttctgtttaccgaatcaccgggctcactgaccatggaagtgcaggatattccgacactctctcgcatcgctcacgagcacgacatcgttgtcatgttggataacacttgggcggctggggtactgttctcacccttcgaacatggcgtcgatatttccattcaagcagcgaccaaatacattgtcggtcattctgatgtgatgctcggtactgcggtcgccaatgagaagtgttgggcacaactgcgtgaacacagctatttgatgggacaatatgcctcacctgacgatgtgtacatggcaatgcgtggattgcgcaccctcgatgtacgtttacgccagcatgaacaaaacagtttacagattgcccagtggttgcaaactcgcccagaagtcgatcatgttcgccaccctgcgttagcgacctgtccggggcacgagtttttcgaacgtgattttactggcggcaatggcttgttctcttttgtgttgaaaacgacgcatccagaagccacaaccgctctactcgatggcatgcaacacttcagcatgggcttttcttggggtggatttgaaagtttgatcttagcccacgaacccaaagcctttacctctcttcgctcagtcgcaaaccctcacttctgcggcactctactccgggttcatatcgggttagaagatgtcgaagatttaatcgccgatctggaagcgggttttgcgcgctacaaccaaatcctgcatgcatag

SEQ ID NO: 18945 - protein, 396 aa, Vibrio cholerae
MSEGKKTRLVTAGRNKKWTLGVVNPPVQRASTVVFDTVAQKNQAAINRANKTLFYGRRGTTTHFAFQEAMVEIEGGAGCVLYPCGAAAITNAILSFVAQGDHILMVDTCYEPTRDFCEKVLKKLGVSTTYYDPMLGEGIRELIQPNTKVLFTESPGSLTMEVQDIPTLSRIAHEHDIVVMLDNTWAAGVLFSPFEHGVDISIQAATKYIVGHSDVMLGTAVANEKCWAQLREHSYLMGQYASPDDVYMAMRGLRTLDVRLRQHEQNSLQIAQWLQTRPEVDHVRHPALATCPGHEFFERDFTGGNGLFSFVLKTTHPEATTALLDGMQHFSMGFSWGGFESLILAHEPKAFTSLRSVANPHFCGTLLRVHIGLEDVEDLIADLEAGFARYNQILHA

SEQ ID NO: 18946 - DNA, 1173 bp, Bacillus halodurans
  CDS (1)..(1173)
atgagcgaacagtacagcttgcaaacaaaactacttcataatgagcataaggttgaccaggcaactggtgcggtaagcgtaccaatccaacacgcttctacgtttcatcagtttgactttgatacgtttggaacgtatgactatagccgttcgggtaatccgacacgggatgctctcgaagcggcgattgctgagcttgagggaggcaatcatggatttgcgtttgcttctgggatggctgccatctccacagcgtttatgcttctatcaaagggcgatcatgttgttttaacgaaagatgtgtacggtgggacatttcgccttgtaacggaagttttaacccgacttggaattgaacatacatttgttgatatgacaaacttggcagaagtggcggcggccatcagaccaaatacccgtgtcctttatatggagacgccatccaatccaacgttgaacattaccgacattcgcggggtcgtttcgctggcaaaagaacacgaatgtctcacatttcttgacaacacctttttaacaccagctttgcagcgaccgctagaacttggtgtcgatgttgtcctccatagtgcgacgaagtttattggaggtcacagtgatgttgtcgcagggctggcggtgacgaagaatgaagaactcggaaaaaagctcgcctttttacaaaactcgttcggcgctattttaggagttcaagacgtatggctcgttctccgaggtctgaaaacacttcatgtgcggatggagcacggagagaaaggagctcagcagatcgccgaatggcttcaaggcgttccggaagtgaagcgggtctactaccctggtttaaaagatcacccaggacacgaattgcaaaaaaggcaggcggaagggtttggcgctgtgctatcgtttgagctagaaaatgaagaggcggttcgaaggttcgtggaacatgtaaagctccctgtttttgctgtcagtttaggagcggtagaatcgatcttgtcttaccccgccaaaatgtcccatgccgcgatgccgaaagaggagcgggaggcaagaggcattcgtgatggattgcttagactttcagtcgggttagaaaaaccggaagaactaatggctgactttaaagcggcatttgctcacgttcgaggaaaggtggaacatctatga

SEQ ID NO: 18947 - protein, 390 aa, Bacillus halodurans
MSEQYSLQTKLLHNEHKVDQATGAVSVPIQHASTFHQFDFDTFGTYDYSRSGNPTRDALEAAIAELEGGNHGFAFASGMAAISTAFMLLSKGDHVVLTKDVYGGTFRLVTEVLTRLGIEHTFVDMTNLAEVAAAIRPNTRVLYMETPSNPTLNITDIRGVVSLAKEHECLTFLDNTFLTPALQRPLELGVDVVLHSATKFIGGHSDVVAGLAVTKNEELGKKLAFLQNSFGAILGVQDVWLVLRGLKTLHVRMEHGEKGAQQIAEWLQGVPEVKRVYYPGLKDHPGHELQKRQAEGFGAVLSFELENEEAVRRFVEHVKLPVFAVSLGAVESILSYPAKMSHAAMPKEEREARGIRDGLLRLSVGLEKPEELMADFKAAFAHVRGKVEHL

SEQ ID NO: 18948 - DNA, 1188 bp, Escherichia coli
  CDS (1)..(1188): s means g or c
atggcggacaaaaagcttgatactcaactggtgaatgcaggacgcascaaaaaatacactctcggcgcggtaaatagcgtgattcagcgcgcttcttcgctggtatttgagagtatggaagccaaaaagcacgcgacgcgcaatcgcgccaatggcgagttgttctatggacggcgcggaacgttaacccatttttccttacaacaagcgatgtgtgaactggaaggtggcgcaggctgcgcgctatttccctgcggggcggcagcggttgctaattcgattcttgcttttgtcgaacagggcgatcatgtgttgatgaccaacaccgcctatgaaccgagtcaggatttctgtagcaaaatcctcagcaaactgggcgtaacgacatcgtggtttgatccgctgattggtgccgatatcgttaagcatctgcagccaaacactaaaatcgtgtttctggaatcgccgggttccatcactatggaagtccacgacgttccggcgattgttgccgccgtgcgcagtgtggtgccggatgccatcattatgatcgacaacacctgggcagccggtgtgctgtttaaggcgctggattttggcatcgatgtttctattcaagccgccaccaaatatctggttgggcattcagatgcgatgattggcactgccgtgtgcaatgcccgttgctgggagcagctacgggaaaatgcctatctgatgggccagatggtcgatgccgataccgcctatataaccagccgtggcctgcgcacattaggtgtgcgtttgcgtcaacatcatgaaagcagtctgaaagtggccgaatggctggcagaacatccgcaagttgcgcgagttaaccaccctgccctgcctggcagtaaaggacacgaattctggaaacgagactttacaggcagcagcgggctattttcctttgtgcttaagaaaaaactcaatgatgaagagctggcgaactatctggataacttcagtttattcagcatggcctactcgtggggcgggtatgaatcgttgatcctggcaaatcaaccagaacatatcgcagccattcgcccacaaggcgagatcgattttagcgggaccttgattcgcctgcatattggtctggaagatgtcgacgatctgattgccgatctggacgccggttttgcgcggattgtataa

SEQ ID NO: 18949 - protein, 395 aa, Escherichia coli
  misc_feature (16)..(16): Xaa can be Ser or Thr
MADKKLDTQLVNAGRXKKYTLGAVNSVIQRASSLVFESMEAKKHATRNRANGELFYGRRGTLTHFSLQQAMCELEGGAGCALFPCGAAAVANSILAFVEQGDHVLMTNTAYEPSQDFCSKILSKLGVTTSWFDPLIGADIVKHLQPNTKIVFLESPGSITMEVHDVPAIVAAVRSVVPDAIIMIDNTWAAGVLFKALDFGIDVSIQAATKYLVGHSDAMIGTAVCNARCWEQLRENAYLMGQMVDADTAYITSRGLRTLGVRLRQHHESSLKVAEWLAEHPQVARVNHPALPGSKGHEFWKRDFTGSSGLFSFVLKKKLNDEELANYLDNFSLFSMAYSWGGYESLILANQPEHIAAIRPQGEIDFSGTLIRLHIGLEDVDDLIADLDAGFARIV

SEQ ID NO: 18950 - DNA, 1191 bp, Haemophilus influenzae
  CDS (1)..(1191)
atgcaaacaaaatatgatctttcaacaatgtttattcattctggtcgtcaaaaacgtttttcacaaggatcggtaaaccctgttttacagcgagcttcttcattactatttgacagtattgaagataaaaaacacgctactcaacgtagagcaaaaggcgaattattttatggcagaagagggacgctaacacattttgctttacaagatttaatgtgcgaaatggaggggggggcaggttgttatctttatccttgtggtacagcagcagtaactaattcgattctttcttttgttaaaactggcgatcatgtgctaatgagtggcgcagcttacgagccaacccaatatttctgtaatattgtgctgaaaaaaatgcagatcgatataacttattacgatcctcttattggtgaagatattgcaacgcttattcaaccgaatacaaaagtacttttcttagaagcaccgagttctattacaatggaaattcccgatattccgactattgtgaaggctgcaagaaaggtgaaccctaatattgtgattatgattgataatacttggtcggcaggtgttctatttaaagcgttagagcatgatattgatatttctattcaggcgggtacgaaatatttagtgggtcattcagatattatgattggtactgccgttgcgaatgcgcgaacttgggatcaacttagagaacattcctatttaatggggcaaatggttgatgcagattccgcttatacgactgctcgtggtatccgtacattgggggtacgattaaaacaacatcaggaaagcagtattaaagtggcaaaatggttgagtgagcaaccagaagtaaaaactgtgtaccatccagctttaccaagttgccctggtcatgaattctttttacgtgattttagtggaagcagtggtttattttcttttgaattaacccagcgattaacttcagagcaagtatcaaaatttatggatcattttcaactgttcgctatggcttattcatggggaggatttgagtctctaattctttgtaatcaaccagaagaaattgcacatattcgtccaaatattaaacgtaatcttacaggttcattaattcgtgtgcatattggttttgaaaatgtggatgaactaattgcagatttgaaagctggttttgagcgaattgcttaa

SEQ ID NO: 18951 - protein, 396 aa, Haemophilus influenzae
MQTKYDLSTMFIHSGRQKRFSQGSVNPVLQRASSLLFDSIEDKKHATQRRAKGELFYGRRGTLTHFALQDLMCEMEGGAGCYLYPCGTAAVTNSILSFVKTGDHVLMSGAAYEPTQYFCNIVLKKMQIDITYYDPLIGEDIATLIQPNTKVLFLEAPSSITMEIPDIPTIVKAARKVNPNIVIMIDNTWSAGVLFKALEHDIDISIQAGTKYLVGHSDIMIGTAVANARTWDQLREHSYLMGQMVDADSAYTTARGIRTLGVRLKQHQESSIKVAKWLSEQPEVKTVYHPALPSCPGHEFFLRDFSGSSGLFSFELTQRLTSEQVSKFMDHFQLFAMAYSWGGFESLILCNQPEEIAHIRPNIKRNLTGSLIRVHIGFENVDELIADLKAGFERIA

SEQ ID NO: 18952 - DNA, 1167 bp, Mycobacterium tuberculosis
  CDS (1)..(1167)
atgagcgaagaccgcacgggacaccagggaatcagcggaccggccacccgcgccatccacgctggctaccgcccggatccggcgaccggggcggtgaacgtgccgatctacgccagcagcaccttcgcccaagacggcgtcggcggtctgcgtggcggtttcgaatacgcacgcaccggcaaccccacccgggccgcattggaggcctcgctggcggcagtcgaggagggtgctttcgcgcgggcattcagttccgggatggccgcgaccgactgcgccctgcgggcgatgttacggcccggagaccacgtcgtcattcccgatgacgcctacggcggcacattccggttgatagacaaggtgttcacccggtgggatgtccagtacacgccggtgcggcttgccgatctggatgcggtgggtgccgcgattactccgcgcacccggctgatttgggtggagacgcccaccaatccgctactgtcgatcgccgatatcacggccattgccgagctgggcacagacagatcggcaaaagtattggtggacaatacctttgcctcacccgcgttgcagcagccgttgcggctgggcgccgatgtggtgttgcactcgactaccaagtacatcggcggccattccgacgtggtgggaggtgcgctggtcaccaacgacgaagagctggacgaggagttcgctttcttgcagaacggcgccggcgcggtgcccggaccattcgacgcctacctgaccatgcgcggcctgaagaccttggtgctgcggatgcagcggcacagtgaaaatgcctgtgcggtagcggaattcctcgctgatcatccgtcggtgagttctgtgttgtatccgggtttgcccagtcatcccgggcatgagattgccgcgcgacagatgcgcggcttcggcggcatggtttcggtgcggatgcgggccggtcggcgtgcggcgcaggacctgtgtgccaagacccgcgtcttcatcctggccgagtcgctgggtggggtggagtcgctgatcgaacatcccagcgccatgacccatgcgtcgacggccggttcgcaattggaggtgcccgacgatctggtgcggctttcggtcggtatcgaagacattgccgacctgctcggcgatctcgaacaggccctgggttaa

SEQ ID NO: 18953 - protein, 388 aa, Mycobacterium tuberculosis
MSEDRTGHQGISGPATRAIHAGYRPDPATGAVNVPIYASSTFAQDGVGGLRGGFEYARTGNPTRAALEASLAAVEEGAFARAFSSGMAATDCALRAMLRPGDHVVIPDDAYGGTFRLIDKVFTRWDVQYTPVRLADLDAVGAAITPRTRLIWVETPTNPLLSIADITAIAELGTDRSAKVLVDNTFASPALQQPLRLGADVVLHSTTKYIGGHSDVVGGALVTNDEELDEEFAFLQNGAGAVPGPFDAYLTMRGLKTLVLRMQRHSENACAVAEFLADHPSVSSVLYPGLPSHPGHEIAARQMRGFGGMVSVRMRAGRRAAQDLCAKTRVFILAESLGGVESLIEHPSAMTHASTAGSQLEVPDDLVRLSVGIEDIADLLGDLEQALG

SEQ ID NO: 18954 - DNA, 1140 bp, Thermotoga maritima
  CDS (1)..(1140)
atgaacacagacgacattctgttttcttacggagaagaagacattcctttgaaggcgctgtcgtttcccatcttcgaaacgacgaatttctacttcgacagtttcgacgagatgtcgaaagccctcagaaacggagactacgaattcgtttacaaaagaggaagtaatcccacaacgagactggtggagaagaaactcgcagcgcttgaagagtgtgaagatgcccgcctcgttgcctctggaatgagcgccatttcgctttccatccttcatttcctcagctcgggagaccacgtcgtgtgtgtggacgaggcttactcctgggcgaaaaagttcttcaactacctttcaaagaagttcgatatagaagtcagctacgttcctcccgacgcggaaagaatagtcgaagccatcacgaagaagacgaagctcatctacctcgaaagtcccacgagtatgagaatgaaagtgatcgatataagaaaggtcacagaagcggcaggagaactcaagataaaaaccgtcatagacaacacctgggcgtcgccgatctttcaaaaaccaaagcttctgggagtggatgtggtggtccactctgcgacgaagtacatctcaggacacggagacgtgatggcaggagtgatcgcaggagacgtcgaagatatgaagaacatcttcgtggatgaatacaaaaacatcggaccggttctctcgcccatagaagcctggctcatcttgagaggtcttagaacgctggaactccgtatgaaaaagcactacgaaaacgctcttgtggtgtctgacttcctcatggatcacccgaaggtcctcgaggtgaactacccgatgaatccaagatcaccgcagtacgaactcgcttcctctcagatgagcggtggctcaggactgatgagcttcaggctgaaaacggacagcgcagagaaagtcaaagagttcgtcgaaagtctgagggttttcaggatggctgtgagctggggaagtcacgagaaccttgttgttccaagggtggcttatggagactgcccgaaaaaagacgtgaacctgataagaatccatgtgggtctcggagatccagaaaagctcgtggaagatctggatcaggcactcaaaaagatttaa

SEQ ID NO: 18955 - protein, 379 aa, Thermotoga maritima
MNTDDILFSYGEEDIPLKALSFPIFETTNFYFDSFDEMSKALRNGDYEFVYKRGSNPTTRLVEKKLAALEECEDARLVASGMSAISLSILHFLSSGDHVVCVDEAYSWAKKFFNYLSKKFDIEVSYVPPDAERIVEAITKKTKLIYLESPTSMRMKVIDIRKVTEAAGELKIKTVIDNTWASPIFQKPKLLGVDVVVHSATKYISGHGDVMAGVIAGDVEDMKNIFVDEYKNIGPVLSPIEAWLILRGLRTLELRMKKHYENALVVSDFLMDHPKVLEVNYPMNPRSPQYELASSQMSGGSGLMSFRLKTDSAEKVKEFVESLRVFRMAVSWGSHENLVVPRVAYGDCPKKDVNLIRIHVGLGDPEKLVEDLDQALKKI

SEQ ID NO: 18956 - DNA, 1170 bp, Neisseria meningitidis
  CDS (1)..(1170)
atgagcaaaaaactccatccgcaaacgctcgccatacgcggcggcaaagaacaaaccgaataccgcgaacacaatcaggcattgttcctgaccagcagcttcatgtgggacaacgcccaacacgctgccgatttgttttcaaaaaaaatcaaaggcttcacttatacccgtaccgccaacccgaccacagccgcctttgaaaaacgcatcgccgctttggaaggtgcggaacgcgcggtcgccacttcgaccggcatgtccgcgattcaggcggcgtttttcacctttttgcaggcgggcgaccatgtgatttccagccgcagcctgttcggcacgaccgtcggctttatcaataacatcgttaccaaattcggcatcgaagtgagtcacgtgtcgccgactgatataaacgaatggaaagccgccgtcaaagccaacaccaaactgctgtttttggaaacgccgtccaatcccttgggagaagtggccgacttggaagccttggcggaattggcgcacggcatcggcgcgctcttggtggtggacaacagcctgctgtcgcctgtcggctctcagcctttgaaacacggcgcggatatttccgtttcctccgcgaccaaagccatagacggacacgggcgcgtgatgggcggcgtgttggcgggttcggaagaactgatggcgcaggtcgccgtttactgcaactcttgcgggctggcaatgtcgccgtttaacgcatggcagttgttgagcggcgtggaaaccctgtctctgcgtatggaaaaacagttcgacaacgccttgaaaatcgcgcaatggctgcaagcgcagccgcaggttcaagccgtgtattacaccggattacccgaccatcctcaggcggagcttatccgcaaacagcaaaacggcggcggcatcgtcatcggctttgaagtcgccgaccaagcagccgcgtggaaagtcgtggacggcgtcgaacttttctcccgtaccgccaacctcggcgacgtgcgctcgaccattacccatccgtggacaaccacgcacggcaggatgcagcccgaagaaaaactcgccgccaacatccgccccggattggtgcgcctgtcggtcggtttggaatatgttggcgatttgattgacgatttgaaacaggcactcgcgcgctga

SEQ ID NO: 18957 - protein, 389 aa, Neisseria meningitidis
MSKKLHPQTLAIRGGKEQTEYREHNQALFLTSSFMWDNAQHAADLFSKKIKGFTYTRTANPTTAAFEKRIAALEGAERAVATSTGMSAIQAAFFTFLQAGDHVISSRSLFGTTVGFINNIVTKFGIEVSHVSPTDINEWKAAVKANTKLLFLETPSNPLGEVADLEALAELAHGIGALLVVDNSLLSPVGSQPLKHGADISVSSATKAIDGHGRVMGGVLAGSEELMAQVAVYCNSCGLAMSPFNAWQLLSGVETLSLRMEKQFDNALKIAQWLQAQPQVQAVYYTGLPDHPQAELIRKQQNGGGIVIGFEVADQAAAWKVVDGVELFSRTANLGDVRSTITHPWTTTHGRMQPEEKLAANIRPGLVRLSVGLEYVGDLIDDLKQALAR

SEQ ID NO: 18958 - DNA, 1218 bp, Xylella fastidiosa
  CDS (1)..(1218)
atgagtattcatgatgtgcacgaaggcacgtgtcacgtgaccacttccgcggtgcgtgctgggatcgattccgacactgctcatggggcagtgacgccaccgattgtgctttcatccaacttttcgtttgaacgtttcggtcataagcgtaagtacgattacacacgtagtgctaatccaacccgggatctgctcggtgaggcgcttgcggagttggagggtggtgtcggtggtgtggtcacggcgactgggatcgctgcgattatgttggtgttgcacgcattgctccggccgggtgatcgtttggttgtgccacatgatgcttacggtggcagttggcgtttgttcaatgcgctggctcaaaagggacattttgaattgatcacggtcgatttgacggatgcacgatcagtggttgaggcattggcactaccaccgaagttggtattgatcgaaactccttccaatccattgttacgtattactgatttgggtgcggtgattgaggcagcgcaccgtgttggtgctttgactgtggtcgacaatacgtttatgtctccggtgttgcagcgtcctttagagttcggcgctgacttggtattgcattcgactacgaagtacatcaatggccacagtgatgttgtcggtggcgttgttgtggcacgtgatgttgcccactatcagcagttggtgtggtgggcgaatgcgctgggtctgaccggctcgccattcgatgcgttcttgacgttgcggggggtgcgcacgctggatgcgcgtttgcgtgtgcatcaggagaatgcgcagatgattgcagcgttactggaggggcatggtgtggtgaagcacgtgcattacccaggcttggcttcgcatccggggcatgtgctggcggggcggcagcaaaaagggttcggtgccatgctcagtttcgagttgcagggtggggaagcggcggtgcgggcttttgtcagtggcttgcgttatttcacgctggctgagtcgctgggtggggttgagagtttgatcgctcatccggcttcgatgacgcatgctgccatgacgccccaggcgcgtgctaaagcgggtatctctgatgggttgttgcgcttgtcggtggggattgaggccagtgaggatttgatcgttgatctggtggctggtttggggcgtgctcaggcggtgtgtgatggggcggcgcgggaagagtgcaacgtgtga

SEQ ID NO: 18959 - protein, 405 aa, Xylella fastidiosa
MSIHDVHEGTCHVTTSAVRAGIDSDTAHGAVTPPIVLSSNFSFERFGHKRKYDYTRSANPTRDLLGEALAELEGGVGGVVTATGIAAIMLVLHALLRPGDRLVVPHDAYGGSWRLFNALAQKGHFELITVDLTDARSVVEALALPPKLVLIETPSNPLLRITDLGAVIEAAHRVGALTVVDNTFMSPVLQRPLEFGADLVLHSTTKYINGHSDVVGGVVVARDVAHYQQLVWWANALGLTGSPFDAFLTLRGVRTLDARLRVHQENAQMIAALLEGHGVVKHVHYPGLASHPGHVLAGRQQKGFGAMLSFELQGGEAAVRAFVSGLRYFTLAESLGGVESLIAHPASMTHAAMTPQARAKAGISDGLLRLSVGIEASEDLIVDLVAGLGRAQAVCDGAAREECNV

SEQ ID NO: 18960 - DNA, 1143 bp, Lactococcus lactis subsp. lactis
  CDS (1)..(1143)
atgacaagtataaaaactaaagtaattcatggtggtatttcaacagacaagacaacaggagcagtatctgttccgatttatcaaacgtcaacttataaacaaaacggacttggacaacctaaagaatacgaatattcacgttctggaaatccaacgcgtcatgctttggaagaattaattgcagatttagaaggtggtgttcaaggatttgcatttagttcaggacttgctggaattcatgcggttctttcgctattttctgcaggagatcatatcattttagctgatgatgtttatggtggaactttccgtttgatggataaagtgctgacaaagacagggattatttatgatttagttgatttgagtaatcttgatgacttgaaagcggcttttaaagaagaaacgaaagctatttattttgaaactccttcaaatcctttattaaaagttttggacattaaggaaatttcagcaattgctaaagctcatgatgccttaacactggtggataatacctttgcgacaccgtatttacaacaaccaattgctttaggagctgatattgttttgcattccgcaacgaaatatttaggtggacattcagatgtagtggcaggactagttacaaccaattcaaaagaactcgccagcgaaattggctttttacaaaattcaattggggcggttcttggaccacaagacagctggttagtgcaaagaggtattaaaacacttgcgcttcggatggaggctcattcggcaaatgctcaaaaaattgctgagtttttagaaacttctaaagccgtctcaaaagtttattatccaggtcttaatagccatccggggcatgaaattgctaaaaaacaaatgtctgcctttggagggatgatttcatttgaattaacggatgaaaatgccgtcaaagattttgttgaaaacttgagctattttacgttggctgaatcactaggtggcgttgaatctttaattgaagtgccagcagtgatgactcatgcttctattccaaaagaacttcgtgaagaaattgggattaaggatggcctaattcgtctatcagtaggggttgaagcaattgaagatttactgacagatatcaaagaagcacttgaaaaaaaataa

SEQ ID NO: 18961 - protein, 380 aa, Lactococcus lactis subsp. lactis
MTSIKTKVIHGGISTDKTTGAVSVPIYQTSTYKQNGLGQPKEYEYSRSGNPTRHALEELIADLEGGVQGFAFSSGLAGIHAVLSLFSAGDHIILADDVYGGTFRLMDKVLTKTGIIYDLVDLSNLDDLKAAFKEETKAIYFETPSNPLLKVLDIKEISAIAKAHDALTLVDNTFATPYLQQPIALGADIVLHSATKYLGGHSDVVAGLVTTNSKELASEIGFLQNSIGAVLGPQDSWLVQRGIKTLALRMEAHSANAQKIAEFLETSKAVSKVYYPGLNSHPGHEIAKKQMSAFGGMISFELTDENAVKDFVENLSYFTLAESLGGVESLIEVPAVMTHASIPKELREEIGIKDGLIRLSVGVEAIEDLLTDIKEALEKK

SEQ ID NO: 18962 - DNA, 1936 bp, Pseudomonas aeruginosa
  CDS (668)..(1879)
cctccgcgagcgtccgaccacgacatcgacgtggtcatcccgatcccggacaccagccgcaccgcgcggctggaactggccaaccggctcggcgtgaagttccgcgagggcttcgtcaagaaccgctacatcggccgcaccttcatcatgcccggccaggcggcgcggaagaaatccgtgcggcagaagctcaacgccatcgagctggagttccgcggcaagaacgtgatgctggtggatgactccatcgtccgcggcaccacctgcaagcagatcatccagatggcccgcgaggccggggcgaagaacgtctacttctgctccgccgcgccggccgtgcgctaccccaacgtctacggcatcgacatgccgagtgcgcacgagctgatcgcgcacaatcgcagcaccgaggacgtcagcaagctgatcggcgccgactggctggtctaccaggacctgcccgacctgatcgacgcggtcggcggcggcaagatcaagatcgatcacttcgactgcgccgtgttcgacggcgagtacgtgaccggcgacgtcaacgaggcctacctgaaccggatcgaacaggcgcgcaacgatgcgaccaaggccaagagccaggcggtcagcgcgatcatcgatctgtacaacgactgacaaaggggagagcggcatgactcaggactgggatgccgggcgtctcgacagcgacctggaaggcgcggccttcgacaccctggcggttcgcgccgggcaacggcggacgccggagggcgagcacggcgaggcgctgttcaccacttccagctacgtcttccgcaccgccgccgacgcggccgcgcggttcgccggcgaagtgccgggcaacgtctattcgcgctacaccaaccccacggtacgcaccttcgaggagcgcatcgccgccctcgaaggagccgagcaggcggtggccacggcgtcgggcatgtcggcgatcctcgccctggtgatgagcctgtgcagctccggcgaccacgtgctggtctcgcgcagcgtgttcggctcgaccatcagcctgttcgacaagtacttcaagcgcttcggtatccaggtcgactatccgccgttgagcgatctcgcggcctgggaggcggcgtgcaagccgaataccaagctgttcttcgtcgagtcgccatccaacccgctggccgagctggtggatatcgccgcgctggccgagatcgcccacgccaagggtgcgctgctggcggtggacaactgcttctgcacgccggccctgcaacagccgctgaagctcggtgcggacgtggtgatccactccgcgaccaagtacatcgacggccagggccggggcatgggcggggtggtcgccggtcgcggcgagcagatgaaggaagtggtcggcttcctccgcaccgccggaccgaccctcagcccgttcaacgcctggctgttcctcaagggcctggaaaccctgcgtatccgcatgcaggcgcacagcgccagtgccctggccctggccgaatggctggagcgccagccgggcatcgagcgggtctactacgcgggcctgccgagccatcctcagcatgagttggcccggcgccagcagagcggcttcggcgcggtcgtcagcttcgacgtgaagggcgggcgcgatgccgcctggcgcttcatcgacgctacccggatggtctcgatcaccaccaacctgggcgacaccaagaccaccatcgcccacccggcgaccacctcccacggtcgactgtcccccgaggaccgcgcgcgcgccgggatcggcgacagcctgatccgggtcgcggtcggcctggaagacctcgacgacctcaaggccgacatggctcgggggctggccgcgctgtgatcgaacccaacctgcgaggcaacggcaaggtcgccctggtcaccggggcggcccggg

SEQ ID NO: 18963 - protein, 403 aa, Pseudomonas aeruginosa
MTQDWDAGRLDSDLEGAAFDTLAVRAGQRRTPEGEHGEALFTTSSYVFRTAADAAARFAGEVPGNVYSRYTNPTVRTFEERIAALEGAEQAVATASGMSAILALVMSLCSSGDHVLVSRSVFGSTISLFDKYFKRFGIQVDYPPLSDLAAWEAACKPNTKLFFVESPSNPLAELVDIAALAEIAHAKGALLAVDNCFCTPALQQPLKLGADVVIHSATKYIDGQGRGMGGVVAGRGEQMKEVVGFLRTAGPTLSPFNAWLFLKGLETLRIRMQAHSASALALAEWLERQPGIERVYYAGLPSHPQHELARRQQSGFGAVVSFDVKGGRDAAWRFIDATRMVSITTNLGDTKTTIAHPATTSHGRLSPEDRARAGIGDSLIRVAVGLEDLDDLKADMARGLAAL

SEQ ID NO: 18964 - DNA, 1185 bp, Pseudomonas aeruginosa
  CDS (1)..(1185)
atgagccagcacgaccagcatcccgacgccccggcccaggcctttgcgacccgggtcatccacgccgggcaggcccccgatccctcgaccggcgcgatcatgccgccgatctacgccaactccacctatatccaggaaagccccggggtacacaaggggctcgactacggccgctcccacaacccgacccgctgggccctggagcgctgcgtggccgacctcgagggcggcacccaggccttcgccttcgcctccggcctggcggcgatctcctcggtgctggagctgctcgacgccggttcccacatcgtttccggcaatgacctctacggcggtaccttccgcctgttcgagcgggtccgccggcgcagcgccgggcatcgcttcagcttcgtcgacccgaccgacctgcaggccttcgaggccgcgctgaccccggaaacccgcatggtctgggtggaaaccccgagcaacccgctgctgcgcctcaccgacctgcgcgccatcgcccagctctgccgcgcccgcggcatcatcagcgtggccgacaacaccttcgccagcccctacatccagcgccccctggagctgggcttcgacgtggtggtgcactccaccaccaagtacctgaacggccattccgacgtgatcggcggcatcgccatcgtcggcgacaacccggacctgcgcgagcgcctgggcttcctgcagaactcggtgggcgccatctccgggccgttcgacgccttcctcaccctgcgcggggtgaagaccctggcgctgcgcatggagcgccattgcagtaacgccctggccctggcccagtggctggagcgccagccgcaagtggcgcgggtctactaccccggcctggcttcgcacccgcagcatgagctggcgaaacggcagatgcgtggcttcggcgggatgatctccctcgacctgcgttgcgacctggccggcgcccggcgcttcctggagaacgtgcggatcttctccctggcggagagcctgggcggggtggaaagcctgatcgagcatccggcgatcatgacccacgccagcatcccggcggaaacccgcgccgacctgggcattggtgactcgctgatccgcctgtcggtgggcgtcgaggcgctggaggacctgcaggccgacctggcgcaggcgctggcgaagatctga

SEQ ID NO: 18965 - protein, 394 aa, Pseudomonas aeruginosa
MSQHDQHPDAPAQAFATRVIHAGQAPDPSTGAIMPPIYANSTYIQESPGVHKGLDYGRSHNPTRWALERCVADLEGGTQAFAFASGLAAISSVLELLDAGSHIVSGNDLYGGTFRLFERVRRRSAGHRFSFVDPTDLQAFEAALTPETRMVWVETPSNPLLRLTDLRAIAQLCRARGIISVADNTFASPYIQRPLELGFDVVVHSTTKYLNGHSDVIGGIAIVGDNPDLRERLGFLQNSVGAISGPFDAFLTLRGVKTLALRMERHCSNALALAQWLERQPQVARVYYPGLASHPQHELAKRQMRGFGGMISLDLRCDLAGARRFLENVRIFSLAESLGGVESLIEHPAIMTHASIPAETRADLGIGDSLIRLSVGVEALEDLQADLAQALAKI

SEQ ID NO: 18966 - DNA, 1146 bp, Bacillus halodurans
  CDS (1)..(1146)
atgagagagaaaaaatttgcaacaaaatcggttcactttacagaaaaagaaataagcaaaaaccgtagtaaatctaagcccatttatcaaacatctgccttcgtgtttcaagacttagatgatatggaaagcttctaccgaggggaaaaggagtatttgtacacaaggtatgggaatccaaacagtgatgaccttggcaaaggggtggcttctttagagcaggcagaggatggcgtagccacatcagcaggaatgtcagccattttagttgcactcctagctttacttgaaaaaggagatcacttgatcgccgcgaatgatttgtatggtgggacttaccaactgttggcggaggagcttccgaagctaggaatcgatgtcagctttgttccatttcaagagcgtgaagtggtgaaacgtgcgattcgaaaagaaacgaaagtgctctattcagagacagtcaccaatccattgctacgggtggaagatattcatcaggtcgttgaattaggaaaggaacacggcctttcaactgttatcgataatacgtttgccacaccttactttgttcaacctttaacatgtggtgtagatgtagtcgtccatagtgcaaccaaatatattggcgggcatagtgatgtgacagcgggtgtcgtcgtaggatctgcagaaatcattcagcaagttcggcaaaaagtcgcgactttgggttgcaacttaagcccatttgaagcgtggctcgcttcgagaggattaaaaacattggcattaagaatggaacgacaaggggaaaatgctcaagctctcgccacattttttgcggaccatccaggggtttcccaagtgttctacccgacgactgtctcgaaacgcggcaatggggcaatagtgacgatccgcctagccgaaaaggtagaggcagcaaccttttttgaatcattagactgggtgaaaattgcaccaacattagcaggtgttgaaacaaccgtgtcttatccgattcaaacgtctcatcgaacagtgccagagtcgcttcgacaagagttaggaatcgacaagcaactagtaagaatttcggttggtattgaagatattgaagacatcatggccgcgttcgataaggccattaaaaaagctggctcttaa

SEQ ID NO: 18967 - protein, 381 aa, Bacillus halodurans
MREKKFATKSVHFTEKEISKNRSKSKPIYQTSAFVFQDLDDMESFYRGEKEYLYTRYGNPNSDDLGKGVASLEQAEDGVATSAGMSAILVALLALLEKGDHLIAANDLYGGTYQLLAEELPKLGIDVSFVPFQEREVVKRAIRKETKVLYSETVTNPLLRVEDIHQVVELGKEHGLSTVIDNTFATPYFVQPLTCGVDVVVHSATKYIGGHSDVTAGVVVGSAEIIQQVRQKVATLGCNLSPFEAWLASRGLKTLALRMERQGENAQALATFFADHPGVSQVFYPTTVSKRGNGAIVTIRLAEKVEAATFFESLDWVKIAPTLAGVETTVSYPIQTSHRTVPESLRQELGIDKQLVRISVGIEDIEDIMAAFDKAIKKAGS

SEQ ID NO: 18968 - DNA, 1167 bp, Mycobacterium leprae
  CDS (1)..(1167)
atgagcgaagattaccggggacaccacggcattaccggactagccaccaaagccatccatgctggctatcgtccggatccggcaacaggggcagtgaatgtcccgatttatgccagtagtacttttgcccaagatggcgtcggtgagttgcgtggcggattcgaatacgcgcgtaccggcaaccccatgcgcgccgctttagaggcatccttggccacggtcgaagagggcgtttttgcgcgagccttcagttccggaatggctgctagcgactgtgccttgcgggtcatgctgcggccgggggaccacgtgatcatcccggatgacgtctacggcggcaccttccggctgatagacaaggtctttactcaatggaacgttgactacacgccggtaccgctgtctgatttggacgcggtccgcgccgcgatcacatcacggacccggctgatatgggtggaaacaccgaccaatccgctgctgtccatcgcagatatcaccagcatcggcgaactaggcaaaaagcactcagtaaaggtgttggtggacaacacctttgcttcacccgcgctgcaacagccgctgatgctgggggcagacgtcgtgttgcactcgaccacaaagtacatcggcggccactctgatgtggtgggcggcgcgctagtcaccaacgacgaagagctggaccaggctttcggcttcttgcagaacggagccggtgcggtgccgagcccgttcgacgcgtacctaacgatgcgcggattgaagactttagtgctgcggatgcagcggcacaacgaaaatgccattactgtagcggaattcctggctgggcatccgtcggtgagcgccgtgctgtatccgggcttgcccagccatcccgggcatgaggtcgctgcacggcagatgcgcggcttcggcggcatggtttcgttgcggatgcgagccggccgactagccgcccaggatctgtgtgcccgcaccaaggtgtttaccttggctgaatccttgggtggagtggagtcgctgattgagcagcccagtgccatgacgcacgcgtcgacaaccgggtcgcaattggaagtacccgacgacctggtgcggctttcggtcggtattgaagacgtcggcgacctgctgtgcgacctcaagcaggcgttaaactaa

SEQ ID NO: 18969 - protein, 388 aa, Mycobacterium leprae
MSEDYRGHHGITGLATKAIHAGYRPDPATGAVNVPIYASSTFAQDGVGELRGGFEYARTGNPMRAALEASLATVEEGVFARAFSSGMAASDCALRVMLRPGDHVIIPDDVYGGTFRLIDKVFTQWNVDYTPVPLSDLDAVRAAITSRTRLIWVETPTNPLLSIADITSIGELGKKHSVKVLVDNTFASPALQQPLMLGADVVLHSTTKYIGGHSDVVGGALVTNDEELDQAFGFLQNGAGAVPSPFDAYLTMRGLKTLVLRMQRHNENAITVAEFLAGHPSVSAVLYPGLPSHPGHEVAARQMRGFGGMVSLRMRAGRLAAQDLCARTKVFTLAESLGGVESLIEQPSAMTHASTTGSQLEVPDDLVRLSVGIEDVGDLLCDLKQALN

SEQ ID NO: 18970 - DNA, 1206 bp, Caulobacter crescentus
  CDS (1)..(1206)
atgcgcgacgaccagaccggcttttccacgcgggcgatccatgcgggctacgatcccgccgacgagcacggcgccctgaccccgccgctgcacctgacctcgaccttcgcgttcgagagcgccgaggcgggtggcgagatgttcgccggaacccgcgaggggcacttctactcgcgcatttccaaccccacgaccgacctcctggagcgtcgtctggccagcctggagggcgccgaggcggcggtcgccacggcctcgggcatgggcgcgatcaccgccaccctgtggagcttcctgcgggccggtgacgaggtgatcaccgaccagaccctgtatggctgcacctttgcgttcctgcgcgatggcctgacccggttcggcgtgacggtgaagcaggtcgacatgacccggcccgaaaccctggcggccgccatctcggaccagacgcggatcgtctattttgagaccccggccaatccgaacatgcgtctggtcgacatcgccgcgatcacccggatcgcgcacgctgcgggcgccaaggtggtggtcgacaacacctacgccacgccctgcctgacccggcctctggccctgggcgccgacatcgtcgtgcactcggcgaccaagtatctgggcggccacggcgacctggtgggcgggatcgccgccggcgggatcgaagacatggcgcgcgtgcgcctgtgcggggtaaaggacatgaccggtgcggtgatgtcgcccttcacggcctttctcgtcctgcgcgggctcaagaccctgtcgctgcgcatggcccgccacagccagagcgcccaggcggtggcccgctggctggaggatcaccccgccgtcgagcaggtgttctatcctggcctgcagagcttcccgcagcgcgatctggcggcgcgccagatggcggcgggcggcggcatgatggcgttcgagctgaagggcggccacgccgctggcgtggcgatgatgaaccggctggcgctgatccgccgcgccgtgtcgctgggcgacgccgagaccctgatccagcatccggccagcatgacccattcgccctacacgcctgaggagcgggccgccgccggaatcggcgagggcatggtgcgcctctccgtgggtctggaggacgtggccgatatcctggctgatcttgcgatggcgctggagcctctcaaggtcgcgcaaccggcttga

SEQ ID NO: 18971 - protein, 401 aa, Caulobacter crescentus
MRDDQTGFSTRAIHAGYDPADEHGALTPPLHLTSTFAFESAEAGGEMFAGTREGHFYSRISNPTTDLLERRLASLEGAEAAVATASGMGAITATLWSFLRAGDEVITDQTLYGCTFAFLRDGLTRFGVTVKQVDMTRPETLAAAISDQTRIVYFETPANPNMRLVDIAAITRIAHAAGAKVVVDNTYATPCLTRPLALGADIVVHSATKYLGGHGDLVGGIAAGGIEDMARVRLCGVKDMTGAVMSPFTAFLVLRGLKTLSLRMARHSQSAQAVARWLEDHPAVEQVFYPGLQSFPQRDLAARQMAAGGGMMAFELKGGHAAGVAMMNRLALIRRAVSLGDAETLIQHPASMTHSPYTPEERAAAGIGEGMVRLSVGLEDVADILADLAMALEPLKVAQPA

SEQ ID NO: 18972 - DNA, 1146 bp, Haemophilus influenzae
  CDS (1)..(1146)
atgcggtcaattttttcattatttttagaggatgttatgacacaacaatatgctatcgatactttattagctcaagcaggcaatcgcagtgatgagcgtacgggcgcggtttctgcaccaatttttctttctacggcttatggtcattgtggtatcggtgaaagtacgggatttgattacacacgtaccaaaaatccaactcgcacagtattagaagaaacgatagctaaattagagaatggagatcgtggttttgcgttttcttctggtatggctgcaattcaagttttgatgacgctttttaccgccccagatgaatggattgtttctagcgatgtgtatggtggtacttatcgattattagatttttcttataaaaataacaatagtgtaaaacctgtttatgttaatacagcatctgcttcagcaattgaggctgccattaacccaaatacgaaagcgatttttattgaaaccccatcgaatcctttaatggaagaatgtgatgtggttgaaattgcaaaacttgcgaaaaaacataacttaatgttgatcgtggataatacgtttttaacgcctgtgctttctcgtccattagatttaggtgcggatgtggtaattcacagcggaactaaatatattgctgggcataatgatgcacttgttggtttaattgttgcgaaagggcaagaactttgtgatcgcattgcttatattcaaaatggtgcaggggcggtgctttctccttttgattcttggctgactattcgtggtatgaagaccctttctttgcgtatgaaacgccatcaagaaaatgcacaagctattgcggaatttttaaaagctcaaccacaagtggaatcggtgctttatccgaataaaggtgggatgttgtctttccgtttgcaagatgaagcttgggttaatacatttttaaaatccatcaaattgattacttttgcagaaagtctaggcggcacagaaagttttattacttatcctgccactcaaactcatatggatattccagaatccgagcgtgtagctcgtgggattactaataccttgttgcgtttttcagtcggtattgaagatgtagaagatattaaagcggacttattacaagcttttgcaaacttaaaataa

SEQ ID NO: 18973 - protein, 381 aa, Haemophilus influenzae
MRSIFSLFLEDVMTQQYAIDTLLAQAGNRSDERTGAVSAPIFLSTAYGHCGIGESTGFDYTRTKNPTRTVLEETIAKLENGDRGFAFSSGMAAIQVLMTLFTAPDEWIVSSDVYGGTYRLLDFSYKNNNSVKPVYVNTASASAIEAAINPNTKAIFIETPSNPLMEECDVVEIAKLAKKHNLMLIVDNTFLTPVLSRPLDLGADVVIHSGTKYIAGHNDALVGLIVAKGQELCDRIAYIQNGAGAVLSPFDSWLTIRGMKTLSLRMKRHQENAQAIAEFLKAQPQVESVLYPNKGGMLSFRLQDEAWVNTFLKSIKLITFAESLGGTESFITYPATQTHMDIPESERVARGITNTLLRFSVGIEDVEDIKADLLQAFANLK

SEQ ID NO: 18974 - DNA, 1182 bp, Bacillus halodurans
  CDS (1)..(1182)
atgaagcgagatcaacattttgaaacaagagcgattcatacaggctataagcctaacgagcattttgacagcttaaccccaccgatttatcaaacctcaacgtttacgtttgcttccatggagcaaggaggtaatcgttttgctggggaggaagctggctatgtttattcaaggttaggcaatccgaccgttcagattcttgaacagcggatagcagagctagaaggaggagaagctgccctggccttcggttcagggatggccgcagtctctgccattcttgttggcttgacgaaagcaaacgaccatatccttgtctcaaatggtgtgtacgggtgtacgttcggtttgctcactatgctgaaagaaaaatacaacattgacgcaacgttttcgccaatggactcagttgaggaaatcttagcaaacattcaagataacacgacgtgtatttatgtggaaacaccgatcaatccaacgatgcagttaatcgaccttgagcttgtcgtgagggtagcaaaagaaaaagggataaaagtaattgtcgataatacatttgccactccgtacttacagcaaccgatcgcattaggatgtgatttcgttgtccacagtgcgacgaaatacattggcgggcatggcgacgttgtggcaggcgtattaattggcgacaaagaaacgattcaactgattcgaaaaacaacgcaaaaagatatgggtggcgtcatttctccgtttgatgcatggttattgctacgggggttaaagacgttagcggtccgaatggatcgtcactgtgaaaacgctgaaaaactagcggaaaaactaaaggaacacccgaaggtaagcacggttctctatccaggtgattttgagcaccctgatcattcgatcgttgcaaagcaaatgaaaaaagggggcgggctactctcatttgagataaaaggaacagaggcagacatagcgaaagttgttaatcagcttaagctcattcgaattgccgttagtttaggtgatgcggaaacattaattcaacaccccgcgacgatgacacatgccgtcgttcctgaaaaaagacggacccaaatggggatctctaaaaaattgctacggatgtctgctggtcttgaagcttggcaagacgtgtgggcagatttagagcaagcattaaatcagttgtag

SEQ ID NO: 18975 - protein, 393 aa, Bacillus halodurans
MKRDQHFETRAIHTGYKPNEHFDSLTPPIYQTSTFTFASMEQGGNRFAGEEAGYVYSRLGNPTVQILEQRIAELEGGEAALAFGSGMAAVSAILVGLTKANDHILVSNGVYGCTFGLLTMLKEKYNIDATFSPMDSVEEILANIQDNTTCIYVETPINPTMQLIDLELVVRVAKEKGIKVIVDNTFATPYLQQPIALGCDFVVHSATKYIGGHGDVVAGVLIGDKETIQLIRKTTQKDMGGVISPFDAWLLLRGLKTLAVRMDRHCENAEKLAEKLKEHPKVSTVLYPGDFEHPDHSIVAKQMKKGGGLLSFEIKGTEADIAKVVNQLKLIRIAVSLGDAETLIQHPATMTHAVVPEKRRTQMGISKKLLRMSAGLEAWQDVWADLEQALNQL

SEQ ID NO: 18976 - DNA, 1155 bp, Clostridium acetobutylicum
  CDS (1)..(1155)
atgggagaaatagattgtagaaattttgagacaaaagcagttcatggggagagtggttttgagagcagaactggggcaataagctacccaatataccaaagttctacctttagacatgaaggcttaaataaaggaactggatatgattattcaagaacaggaaatcccactagagatgaagttgaaaagacagttgcagcacttgaaaatggtagagcgtgtctcgcatactcctctggtatggctgcaatatcaagtgttcttaccatatttaaaggtggagatcatataatcgtttcagatgacttgtatggaggaacctatagaatatttgaggagatatatgaacattatggaattgaagtcacatatacagatacaacaagcactgaaaatatagaaaaggaattgagggaaaatacaaaagccatatacctagaaactccaacaaaccctcttatgaaaattactgatataagagaggttagtaaattagcaaaagaacataatactttacttatagtggacaatacttttatgacgccttactatcaaaaaccactagagcttggagcagacatagttcttcacagcggaactaagtatctttgtggacataatgatgccttagcaggttttgtcattttaaatgatgaaaggttaattgaaaagcttagatttatacaaaactctgttggagctgtgcttgcaccttttgatagttggctaattttaagaggaataaaaacccttcacataagacttgatagacagcaggaaaacgcaattaaaatagcaaacttcttaaaaaaacataagaaaattacaaaggttctttatccaggattagaggagcacgttggtcatgatattttaaaaagtgaagcatcaggttttggagcaatgatttccttttacgtagatagtaaagaaaccgtagaaaaagtacttgaaagcgtaaaagtaataatttttgctgaaagccttggtggagtggaaagtttaataacctatccttatactcaaactcatgcagatattccagatgatataaggaaaaggctaggcgttacagataagcttcttagattttctgtgggaatcgaaaatgtagatgatttaataaaagacttagataaagcattgcaagcataa

SEQ ID NO: 18977 - protein, 384 aa, Clostridium acetobutylicum
MGEIDCRNFETKAVHGESGFESRTGAISYPIYQSSTFRHEGLNKGTGYDYSRTGNPTRDEVEKTVAALENGRACLAYSSGMAAISSVLTIFKGGDHIIVSDDLYGGTYRIFEEIYEHYGIEVTYTDTTSTENIEKELRENTKAIYLETPTNPLMKITDIREVSKLAKEHNTLLIVDNTFMTPYYQKPLELGADIVLHSGTKYLCGHNDALAGFVILNDERLIEKLRFIQNSVGAVLAPFDSWLILRGIKTLHIRLDRQQENAIKIANFLKKHKKITKVLYPGLEEHVGHDILKSEASGFGAMISFYVDSKETVEKVLESVKVIIFAESLGGVESLITYPYTQTHADIPDDIRKRLGVTDKLLRFSVGIENVDDLIKDLDKALQA

SEQ ID NO: 18978 - DNA, 1146 bp, Clostridium acetobutylicum
  CDS (1)..(1146)
atgaaaatagaatcattggtaattcatggaggaaaagatggagacgaatatacaggtgcagtaaatgtccctatatatcaaacttcaacctttaaacaagaaaagttaggtgtaaacaaaggatatgaatattcaagaacaggaaatccaacaagagaagctgttgaaaagcttatttcagatttagaggaaggtcaatctggttttgcatttgcttctggaatggcagctattacagcagttttatctttatttaaaacaggagataaaataattatatcaaacaatgtttatggtggaacttttagagttttagataaggtatttaatcattttaatataggttataaaatagttgatacttcaaaggttcaagagataagggataatatagataaggatgtaaaggctatatacattgaaagtcctactaatccacttatggatattacggatattaagcttgtttcaagtatagcaaaagaaaacaatcttcttactatagttgataatacctttatgacaccatatcttcaaaaaccactaacacttggtgcagatatagtacttcatagcgctacaaagtatttaggtggacacagtgatttggtggcgggtcttgtagtggttaacaataaagatttagctgaaaagcttcattttatacagaattcaactggaggagtacttggaccttttgattcatttcttcttataaggggtataaaaactcttgcagtaagaatggataggcatactgataatgcaaagaagatagcttctctgttaaatcatagaaaagaaatagaaaaagtatactatcctggacttgaggagcatatagggcatgaggtccaaaaaaagcaggcttctggttatggcgcaataatatcatttgttataaatgaaaaatacgactataaaaagtttattgagaatttaaaacttattacctttggagaaagtttaggtggagttgaatcacttatatgccatccagctagtatgacacatgcagcaattccatatgaaataagacagaaagttggtattgtagataacttaataagactttctgtaggaattgaaaatggtgatgatttaatagaagacttgttgaaagctcttgaggggagtgaaaaatag

SEQ ID NO: 18979 - protein, 381 aa, Clostridium acetobutylicum
MKIESLVIHGGKDGDEYTGAVNVPIYQTSTFKQEKLGVNKGYEYSRTGNPTREAVEKLISDLEEGQSGFAFASGMAAITAVLSLFKTGDKIIISNNVYGGTFRVLDKVFNHFNIGYKIVDTSKVQEIRDNIDKDVKAIYIESPTNPLMDITDIKLVSSIAKENNLLTIVDNTFMTPYLQKPLTLGADIVLHSATKYLGGHSDLVAGLVVVNNKDLAEKLHFIQNSTGGVLGPFDSFLLIRGIKTLAVRMDRHTDNAKKIASLLNHRKEIEKVYYPGLEEHIGHEVQKKQASGYGAIISFVINEKYDYKKFIENLKLITFGESLGGVESLICHPASMTHAAIPYEIRQKVGIVDNLIRLSVGIENGDDLIEDLLKALEGSEK

SEQ ID NO: 18980 - DNA, 1182 bp, Pyrococcus abyssi
  CDS (1)..(1182)
atggttatatttaggatcaaaaattatgtcgaaaaagatataaatcttccgtgggatcaacgtgaaggtgagataaaaatgaaaccgcttcacgatcctctctacataacggccgtgttcaagcaagtcggtgatgcttatccaaccgataggggaaccgagttgaagtattccagggaggaaaatccaacggttagaaaactagaggataaactagcagaacttgaaggttcagacaatgctttggccttcaatagcggaatgtcagcgatctcaactctctacttttccctacttgaaggtggtgataaagtagtgctatcgatggaaggctatggaacgacgattgagttggcaaagctccttaggaaattcggcgtagatgttaagctcgcctatccaagtgcagattctctgatagaaaccatagatgaggagactaagctcgttttggtggaaacgatgactaatccaacactgaaagttatagacgttccggaggtcgcgaagaggtgtcgggaagttggggcgatattagttgtagacaacaccttcgtgactccactcctctacaaacccttggaagatggggcaagttacgtcgttcatagcctcacgaagtacatagcgggtcacaatgacgttttaggtggggccgttctctggaatggggaattctccagggatctctgggagtggaggaggaggctcggaacgataatccagcccttcgatgcgtggatgattgagaggggaatgagaacccttgaagttaggttcgaaaggcaatccgagaacgccatggccatagcggaattcttaaaggatcacccaaaggttagggaagtccactatcctggacttaaagacgatccctattataaggtagccaggaggctttttaagaaggatctttacggcggagtagtcgcctttgacttgggtagtggagataatgccctggccttcttgaggggattgaaaaggatattcccatcgccttccctgggaggcgttgagagcatagcaacttatccagtgaaaagtgccgccaaaactctagatgaggagattagagaaattctcgggataactgatggtttaataaggctctcggttggccttgaacctcttgacgagcttattgaggacatagacaacgccttgggggtggtgagatga

SEQ ID NO: 18981 - protein, 393 aa, Pyrococcus abyssi
MVIFRIKNYVEKDINLPWDQREGEIKMKPLHDPLYITAVFKQVGDAYPTDRGTELKYSREENPTVRKLEDKLAELEGSDNALAFNSGMSAISTLYFSLLEGGDKVVLSMEGYGTTIELAKLLRKFGVDVKLAYPSADSLIETIDEETKLVLVETMTNPTLKVIDVPEVAKRCREVGAILVVDNTFVTPLLYKPLEDGASYVVHSLTKYIAGHNDVLGGAVLWNGEFSRDLWEWRRRLGTIIQPFDAWMIERGMRTLEVRFERQSENAMAIAEFLKDHPKVREVHYPGLKDDPYYKVARRLFKKDLYGGVVAFDLGSGDNALAFLRGLKRIFPSPSLGGVESIATYPVKSAAKTLDEEIREILGITDGLIRLSVGLEPLDELIEDIDNALGVVR

SEQ ID NO: 18982 - DNA, 1197 bp, Bacillus halodurans
  CDS (1)..(1197)
atgaatcctcatatgatgatgaacgacaaagcacttggaacgaaagctgtatgggctggagaacgatcctttttagcccatggggcaacacaggtaccggtcgtccatagcgtatcttttgggtatgatgatgtggatgaatggtatgaagtagcaacaggtaaaaaagatgggcacatttacggtcgcaatacaaatccaactgttcaggcgtttgaagaaaaagtgcgggagctggagtttgcagaggctgccacaagctttgccacgggtatggcggcgatctcaaattcgttattgaccgtattaaagccaggagatcgtgtcgtctcgataaaagatacgtatggtgggacgaataaaattttttcagagtttttaccccgtttaaagatagaagtgacgctttgcgaaacaggagatcatgaagccctcgaaagggaaatcaccaaaggttgcactcttgtatatttagaaacaccaacgaatccgacagttaaaattaccgatctggaacgaatcacgtcatttgctcacgagcataatgcgctcgtgtttgttgataacacctttgcgacaccgatcaatcaaaatccactgcttactggagccgatttagtcgttcatagcgcaacaaagtttcttggcggtcatgcggatgctttaggcggtgttgcttgcggaaacaaagagcttgtatcggccatttaccattaccgagaaattaatggcgcaacccttgacccgatggcagcttatttgctgttaagagggatgaagacgttaaagctccgcgttgaaaagcagcaagaaaacgcaatgaaagtggcgagatttcttaccgaacatgacaaagtgagagctgtctactacccaggattagaaacccatcctcaccatgaggttgccaagcgacaaatgcgcggttttggcggtatgctgagctttgcgttaaaaggagagatggaagctgtgcggaaattcctcccagctttaacttacgctaatcgggcagccaaccttggagcagttgaaacgacggtcggccctgctcgaacgacaagtcatgtagagaacacgccagaagaacgggcagcactcggaattcctgaaggattggtccggtattcagctggaattgaagatgccgttgatcttatagaggatttgtcccaagctcttgactcgattacttaa

SEQ ID NO: 18983 - protein, 398 aa, Bacillus halodurans
MNPHMMMNDKALGTKAVWAGERSFLAHGATQVPVVHSVSFGYDDVDEWYEVATGKKDGHIYGRNTNPTVQAFEEKVRELEFAEAATSFATGMAAISNSLLTVLKPGDRVVSIKDTYGGTNKIFSEFLPRLKIEVTLCETGDHEALEREITKGCTLVYLETPTNPTVKITDLERITSFAHEHNALVFVDNTFATPINQNPLLTGADLVVHSATKFLGGHADALGGVACGNKELVSAIYHYREINGATLDPMAAYLLLRGMKTLKLRVEKQQENAMKVARFLTEHDKVRAVYYPGLETHPHHEVAKRQMRGFGGMLSFALKGEMEAVRKFLPALTYANRAANLGAVETTVGPARTTSHVENTPEERAALGIPEGLVRYSAGIEDAVDLIEDLSQALDSIT

SEQ ID NO: 18984 - DNA, 1218 bp, Halobacterium sp. NRC-1
  CDS (1)..(1218)
atggacgacacacctgcgttcgaaaccctcgccgtcagccacggcgaatcaccgcgcgagacgcgccacggcgatgtcgtctcgcccatccacctcgcctcgacgtacgccgtccaggagttggacaccgacctcagcctggagggcgtcgaccccgacgacgggcagttcctgtactcgcgcctcaacaatccgaccagacacgccctcgaacggcgcctcgcagccctcgaaggcggcgaccacggcttcgcgtttggctccggcaccgccgccatcgccaccgccgccttcgccgccgtcgaacccggcgatcacgtcgtcgccttcgacgacctctacgccggcacacggcgcatgctcgaaaccctcttcgaggggaacctcggtgtcgccgtctcgttcgtggacgccaccgacccggacgccgtcgccgacgcgatccgtcccgaaaccgccttcgtctggatggagactcccacaaacccacgcatcaagctctgtgacatcgccgccatcgccgacatcactgacgacgccggcgtcctgttcggtgtcgacaacaccttcctcagcccctacttccaacagcccctggcgctcggcgcggacgtcgttgcccactccacgacgaaatacctcaacggccacagcgacgccgtcggcggcgcactcgtcaccaacaacgacgcgctcgccgacagcgtcgagttcctccagcaggtcggcctcgggaacatgctcgcgccgttcgacgcctacctcgtgttgcgcggcatcaaaaccctcgccccgcggatgcgcgaccacgaggccaacgccctcgccatcgccgaatacctcgccgaccacgaccgcgtgaccgcggttcactaccccggcctcgactcccacccgcaacacgacctcgcggacgcccagcagtccggctacggtggcatcctctcgttcgaactcgacggcgacctcgccgacgccaagcgcttcctcgacgcgctcgacgagttcaacctcgcggtcagcgtcggcggcgtcgaatcactggtggaactccccgccggcatgacccacgaacccatcccgaagcccgaccgcgaagccatgggcatcacggactcgctgatccgcgtgtccgtcggcatcgaagccatcgaggacctcatcgcggatctcgaccgcggcttcgaggcggtccgatcgaccaccccgacagcctaa

SEQ ID NO: 18985 - protein, 405 aa, Halobacterium sp. NRC-1
MDDTPAFETLAVSHGESPRETRHGDVVSPIHLASTYAVQELDTDLSLEGVDPDDGQFLYSRLNNPTRHALERRLAALEGGDHGFAFGSGTAAIATAAFAAVEPGDHVVAFDDLYAGTRRMLETLFEGNLGVAVSFVDATDPDAVADAIRPETAFVWMETPTNPRIKLCDIAAIADITDDAGVLFGVDNTFLSPYFQQPLALGADVVAHSTTKYLNGHSDAVGGALVTNNDALADSVEFLQQVGLGNMLAPFDAYLVLRGIKTLAPRMRDHEANALAIAEYLADHDRVTAVHYPGLDSHPQHDLADAQQSGYGGILSFELDGDLADAKRFLDALDEFNLAVSVGGVESLVELPAGMTHEPIPKPDREAMGITDSLIRVSVGIEAIEDLIADLDRGFEAVRSTTPTA

SEQ ID NO: 18986 - DNA, 1182 bp, Halobacterium sp. NRC-1
  CDS (1)..(1182)
atgagcggcaacgacgacgccgatgacgcagccgaccggttccagacacgcgcgatccacgcgggccaagcgccggactcggagacgggcgcgctgatgacgccgatcttcgcgaactcgacgtacgtccaggacggccccggcgatcaccgcggctacgagtactcccggacgggcaacccgacgcgcacggatctggaagccaacctcgcgagcctggaaggcggcgagcacgggcgcgcgttcgcctccggaatggccgcgatcaacaccgtgttgaacctcctggcggccggcgaccacgtggtggcgggcgacgacgtgtacggcggcacccaccgcatcttcacgcaggtctacgaggactacgacatcgacttcgacttcgtcgacaccaccgaccacgacgccgtccgggaggccatgggggaggcgacggaactcctctgggtggagaccccgacgaacccgttgttgaacgtcaacgacatcggcgcgctcgcggacatcgcccacgagcacgacgcgctgtgtgcggtggacaacacgttcgcgacgccgtacctccagcgccccctggagttcggtgccgacatcgtctcgcacagcctcacgaagtacctcggcgggcacagcgacctcgttgcgggcgcgctgatcaccgacgacgacgacctcgacgagcagttcgggttctaccagaactccgtcggcgcgacgcccagtccgttcgactgcttcctggtgttgcgcggcacgaaaaccctgggcgtgcgcatggaccgccactgtgagacggccatggagcttgcggcgtggcttgcggatcacgagcacgtcagccaggtccactacccgggcctggagagccaccccgaccacgagctggccgccgcgcagatggacggcttcggcggcatggtctccttcgagttggacgccaccctcgaagcggccagcgcgttcgtcgaggagaccgacgtgttcacgctcgcggagtcactgggcggcgtggagtcactgatcgagcagcccgcggcgatgactcacgccgccatcccgaaggccgaacgggaggccgcggggctcaccgacgggctgatccgggcgagcatcggcgtcgagcacgtcgacgacctcaaggcggacctccagcaggccatcgaggccgccctgcagtag

SEQ ID NO: 18987 - protein, 393 aa, Halobacterium sp. NRC-1
MSGNDDADDAADRFQTRAIHAGQAPDSETGALMTPIFANSTYVQDGPGDHRGYEYSRTGNPTRTDLEANLASLEGGEHGRAFASGMAAINTVLNLLAAGDHVVAGDDVYGGTHRIFTQVYEDYDIDFDFVDTTDHDAVREAMGEATELLWVETPTNPLLNVNDIGALADIAHEHDALCAVDNTFATPYLQRPLEFGADIVSHSLTKYLGGHSDLVAGALITDDDDLDEQFGFYQNSVGATPSPFDCFLVLRGTKTLGVRMDRHCETAMELAAWLADHEHVSQVHYPGLESHPDHELAAAQMDGFGGMVSFELDATLEAASAFVEETDVFTLAESLGGVESLIEQPAAMTHAAIPKAEREAAGLTDGLIRASIGVEHVDDLKADLQQAIEAALQ

SEQ ID NO: 18988 - DNA, 1161 bp, Escherichia coli
  CDS (1)..(1161)
atgacgcgtaaacaggccaccatcgcagtgcgtagcgggttaaatgacgacgaacagtatggttgcgttgtccctcccatccatctttccagcacctataactttaccggatttaatgaaccgcgcgcgcatgattactcgcgtcgcggcaacccaacgcgcgatgtggttcagcgtgcgctggcagaactggaaggcggtgctggtgcagtacttactaataccggcatgtccgcgattcatctggtaacgaccgtctttttgaaacctggcgatctgctggttgcgccgcacgactgctacggcggtagctatcgcctgttcgacagcctggcgaaacgcggttgctatcgcgtgttgtttgttgatcaaggcgatgaacaggcattacgggcagcgctggcagaaaaccccaaactggtactggtagaaagcccaagtaatccattgttacgcgtcgtggatattgcgaaaatctgccatctggcaagggaagtcggggcggtgagcgtggtggataacaccttcttaagcccggcattacaaaatccgctggcattaggtgccgatctggtgttgcattcatgtacgaaatatctgaacggtcactctgacgtggtggctggcgtggtgattgctaaagacccggacgttgtcactgaacttgcctggtgggcaaacaatattggcgtgacgggcggcgcgtttgacagctatctgctgctacgcgggttgcgaacgctggtgccgcgtatggagctggcgcagcgcaacgcgaaggcgattgtgaaatatctgcaaacccagccgttggtgaaaaaactgtatcacccgtcgctgccggaaaatcaggggcatgaaattgccgcgcgtcagcaaaaaggctttggcgcaatgttgagttttgaactggatggcgatgagcagacgctgcgccgtttcctgggcgggctgtcgttatttacgctggcggaatcattagggggagtggaaagtttaatctctcacgccgcaaccatgacacatgcaggcatggcaccagaagcgcgtgctgccgccgggatctccgagacgctgctgcgtatctccaccggtattgaagatggcgaagatttaattgccgacctggaaaatggcttccgggctgcaaacaaggggtaa

SEQ ID NO: 18989 - protein, 386 aa, Escherichia coli
MTRKQATIAVRSGLNDDEQYGCVVPPIHLSSTYNFTGFNEPRAHDYSRRGNPTRDVVQRALAELEGGAGAVLTNTGMSAIHLVTTVFLKPGDLLVAPHDCYGGSYRLFDSLAKRGCYRVLFVDQGDEQALRAALAENPKLVLVESPSNPLLRVVDIAKICHLAREVGAVSVVDNTFLSPALQNPLALGADLVLHSCTKYLNGHSDVVAGVVIAKDPDVVTELAWWANNIGVTGGAFDSYLLLRGLRTLVPRMELAQRNAKAIVKYLQTQPLVKKLYHPSLPENQGHEIAARQQKGFGAMLSFELDGDEQTLRRFLGGLSLFTLAESLGGVESLISHAATMTHAGMAPEARAAAGISETLLRISTGIEDGEDLIADLENGFRAANKG

SEQ ID NO: 18990 - DNA, 1131 bp, Sulfolobus solfataricus
  CDS (1)..(1131)
atgaaggacgcgactagagcagtaagggaagacatagatgacttaactggtgctataactactcctatatatcagacttctgcctatcattatcccgagggagaaaaatatagatattctagggaatcaaatcctactgttctagagctagctaagaaaatagtagaacttgagaacgctgagatgggtattgcgttttcttctgggatgggagctatctccactactgccctagcactgctaaagcctggaaatagtgttttggttcatcgtgacatgttcgggaggtcctatcgtttctttacagactaccttaaaaactggggtgttaatgtagaggcatcatatcctgggaacaataatattatagagaaagcaaagtctaagaggtatgatgtaatatttgtggagaatatcacaaatccactattaagggttatagatgtcgctgaattatccaaggtagcaaaggagcaaggaagcatattgattgtagatgcgactttttctaccccaataaatcaaaagccattggagttaggagctgacatagtagtgcacagtgcgtcgaagtttttggctggacataatgacgtaatagcgggattagctgctggttacagtaagtacttaaatgttatagatcaaatgagaaggactttaggaacttctttagatcctcatgcagcatatctaactttgaggggtattaagactcttaaaataaggatggatgttatcaataggaatgcggagcaaatcgctgaatttttagaaggacatcctaaagtcgtaaaagtatattatcctggtcttaagtctcatgtggattacgatatagcgagaaaggttcttaaaggattcggaggcgttttaagttttgaagtaaatggaggtcaagaaagtgcgttaaaagtaatgaaatcacttaagttgataatccctgcacaaacgcttggtggggttaattctgttatatcacatccggccactatgtcacataggacacttagtttagaagaaagaaagatagttgggataactgatagcctcctcagactttccgttggaatagaagatgtaaatgacttgatagaggatctagatagggcattgagcactttatactag

SEQ ID NO: 18991 - protein, 376 aa, Sulfolobus solfataricus
MKDATRAVREDIDDLTGAITTPIYQTSAYHYPEGEKYRYSRESNPTVLELAKKIVELENAEMGIAFSSGMGAISTTALALLKPGNSVLVHRDMFGRSYRFFTDYLKNWGVNVEASYPGNNNIIEKAKSKRYDVIFVENITNPLLRVIDVAELSKVAKEQGSILIVDATFSTPINQKPLELGADIVVHSASKFLAGHNDVIAGLAAGYSKYLNVIDQMRRTLGTSLDPHAAYLTLRGIKTLKIRMDVINRNAEQIAEFLEGHPKVVKVYYPGLKSHVDYDIARKVLKGFGGVLSFEVNGGQESALKVMKSLKLIIPAQTLGGVNSVISHPATMSHRTLSLEERKIVGITDSLLRLSVGIEDVNDLIEDLDRALSTLY

SEQ ID NO: 18992 - DNA, 1134 bp, Clostridium acetobutylicum
  CDS (1)..(1134)
atgaaatttggaaccaagcttatacacagcggatttgaaggagataaggcaacaggagctataagtactcccatatatcaaacttcaacctttcatcaagaaaacatagatggacatgtaacttatgattacgcaagatcaggaaatcctacacgtgaagcattagaaaatacaatagctcttttagaaggaggttacaaaggctttgctttttcatcaggcatggcggcaatttcctcggttttgagcattttttcagcccatgatcacataatcgtaccaaaagacgtttatggaggaacctacagaataacaacacaatttttttcaaggtttgaagttgagtgtgaatttgtagatacaacagatataaatgaagttcagagagcaataaaaaagaacacaaaagcaatttatatagaaacaccatcaaacccacttatgaaaataacagatataagggcaatagttgaacttgcaagagaatacaagttattggttattgcagacaatacatttatgtcaccatatcttcaaagaccactagagcttggagcggatatagtagttcatagtgctacaaaatttttaaatggacacagtgacattgttgcaggccttgttgttgcgaaaaataaagagctagcggataagatttactttgttcaaaatgcctttggagcagtgcttagtccacaagattcatggttattattgagaggaatgaaaacccttaaggtaaggctaaattatcaacaaaataatgccacagagcttgcaaaatggcttctacttaacaaatttgttgatagagtacactatccaggaatgcctagccatgaaggcagagaaatacacctttcccaagcctcaggagcaggagctgtattgtcctttgaagcatgcagcactgaaaaagcaaaaagctttatgaaaaaagtgaaatgtgctgccgttggcgtaagtcttgggggagtagaaactatagtctcatatccagctaaaatgtcccatgcagaaatccctcataatgaaaggattaaacttggaataggtgacaatctaataagagtatctgttggacttgaggacatagaagatttaattgagaatttcaaaatagcacttgagtag

SEQ ID NO: 18993 - protein, 377 aa, Clostridium acetobutylicum
MKFGTKLIHSGFEGDKATGAISTPIYQTSTFHQENIDGHVTYDYARSGNPTREALENTIALLEGGYKGFAFSSGMAAISSVLSIFSAHDHIIVPKDVYGGTYRITTQFFSRFEVECEFVDTTDINEVQRAIKKNTKAIYIETPSNPLMKITDIRAIVELAREYKLLVIADNTFMSPYLQRPLELGADIVVHSATKFLNGHSDIVAGLVVAKNKELADKIYFVQNAFGAVLSPQDSWLLLRGMKTLKVRLNYQQNNATELAKWLLLNKFVDRVHYPGMPSHEGREIHLSQASGAGAVLSFEACSTEKAKSFMKKVKCAAVGVSLGGVETIVSYPAKMSHAEIPHNERIKLGIGDNLIRVSVGLEDIEDLIENFKIALE

SEQ ID NO: 18994 - DNA, 1086 bp, Homo sapiens (man)
  CDS (1)..(1086)
atgcaggaaaaagacgcctcctcacaaggtttcctgccacacttccaacatttcgccacgcaggcgatccatgtgggccaggatccggagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtttggcctttgcttcaggtttagcagccactgtaactattacccatcttttaaaagcaggagaccaaattatttgtatggatgatgtgtatggaggtacaaacaggtacttcaggcaagtggcatctgaatttggattaaagatttcttttgttgattgttccaaaatcaaattactagaggcagcaattacaccagaaaccaagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaattcacagctag

SEQ ID NO: 18995 - protein, 361 aa, Homo sapiens (man) [sequence omitted]

SEQ ID NO: 18996 - DNA, 1197 bp, Pseudomonas putida
  CDS (1)..(1197)
atgcacggctccaacaagctcccaggatttgccacccgcgccattcaccatggctacgacccccaggaccacggcggcgcactggtgccaccggtctaccagaccgcgacgttcaccttccccaccgtggaatacggcgctgcgtgctttgccggcgagcaggccgggcatttctacagccgcatctccaaccccaccctcaacctgctggaagcacgcatggcctcgctggaaggcggcgaggccgggctggcgctggcctcgggcatgggggcgatcacgtccacgctatggacactgctgcgccccggtgacgaggtgctgctgggcaacaccctgtacggctgcacctttgccttcctgcaccacggcatcggcgagttcggggtcaagctgcgccatgtggacatggccgacctgcaggcactggaggcggccatgacgccggccacccgggtgatctatttcgagtcgccggccaaccccaacatgcacatggccgatatcgccggcgtggcgaagattgcacgcaagcacggcgcgaccgtggtggtcgacaacacctactgcacgccgtacctgcaacggccactggagctgggcgccgacctggtggtgcattcggccaccaagtacctgagcggccatggcgacatcactgctggcattgtggtgggcagccaggcactggtggaccgtatacgtctgcagggcctcaaggacatgaccggtgcggtgctctcgccccatgacgccgcactgttgatgcgcggcatcaagaccctcaacctgcgcatggaccgccactgcgccaacgctcaggtgctggccgagttcctcgcccggcagccgcaggtggagctgatccattacccgggcctggcgagcttcccgcagtacaccctggcccgccagcagatgagccagccgggcggcatgatcgccttcgaactcaagggcggcatcggtgccgggcggcggttcatgaacgccctgcaactgttcagccgcgcggtgagcctgggcgatgccgagtcgctggcgcagcacccggcaagcatgactcattccagctataccccagaggagcgtgcgcattacggcatctccgaggggctggtgcggttgtcggtggggctggaagacatcgacgacctgctggccgatgtgcaacaggcactcaaggcgagtgcctga

SEQ ID NO: 18997 - protein, 398 aa, Pseudomonas putida
MHGSNKLPGFATRAIHHGYDPQDHGGALVPPVYQTATFTFPTVEYGAACFAGEQAGHFYSRISNPTLNLLEARMASLEGGEAGLALASGMGAITSTLWTLLRPGDEVLLGNTLYGCTFAFLHHGIGEFGVKLRHVDMADLQALEAAMTPATRVIYFESPANPNMHMADIAGVAKIARKHGATVVVDNTYCTPYLQRPLELGADLVVHSATKYLSGHGDITAGIVVGSQALVDRIRLQGLKDMTGAVLSPHDAALLMRGIKTLNLRMDRHCANAQVLAEFLARQPQVELIHYPGLASFPQYTLARQQMSQPGGMIAFELKGGIGAGRRFMNALQLFSRAVSLGDAESLAQHPASMTHSSYTPEERAHYGISEGLVRLSVGLEDIDDLLADVQQALKASA

SEQ ID NO: 18998 - DNA, 2280 bp, Saccharomyces cerevisiae
  CDS (481)..(1665)
aacccggtgggacaaactcgaagtcattgtggaccgaatgaggctcaataacgagattagcgacctcgaaggcctgcgcaaatatttccactccttcccgggtgctcatgagttgaacccgcttagagactccgaaatcaacgacgacttccaccagtgggcccagtgaccgccacactggaccccataccacttctttttgttattcttaaatatgttgtaacgctatgtaattccacccttcattactaataattagccattcacgtgatctcagccagttgtggcgccacacttttttttccataaaaatcctcgaggaaaagaaaagaaaaaaatatttcagttatttaaagcataagatgccaggtagatggaacttgtgccgtgccagattgaattttgaaagtacaattgaggcctatacacatagacatttgcaccttatacatatacacacaagacaaaaccaaaaaaaatatgactctacaagaatctgataaatttgctaccaaggccattcatgccggtgaacatgtggacgttcacggttccgtgatcgaacccatttctttgtccaccactttcaaacaatcttctccagctaaccctatcggtacttacgaatactccagatctcaaaatcctaacagagagaacttggaaagagcagttgccgctttagagaacgctcaatacgggttggctttctcctctggttctgccaccaccgccacaatcttgcaatcgcttcctcagggctcccatgcggtctctatcggtgatgtgtacggtggtacccacagatacttcaccaaagtcgccaacgctcacggtgtggaaacctccttcactaacgatttgttgaacgatctacctcaattgataaaggaaaacaccaaattggtctggatcgaaaccccaaccaacccaactttgaaggtcaccgacatccaaaaggtggcagaccttatcaagaagcacgctgccggccaagacgtgatcttggttgtcgacaacaccttcttgtccccatatatctccaatccattgaacttcggtgcagacatcgttgtccactccgctacaaagtacatcaacggtcactcagacgttgtgctcggtgtcctggccactaataacaagccattgtacgagcgtctgcagttcttacaaaacgccattggtgctatcccatctcctttcgatgcttggttgacccacagaggtttgaagactttgcatctacgtgtcagacaagctgccctcagcgccaacaaaatcgctgaattcttggcagcagacaaggaaaacgttgtcgcagtcaactacccaggtttgaagacacaccctaactacgacgtagtgttaaagcaacaccgtgatgcccttggtggtggtatgatctccttcagaatcaagggtggtgctgaagctgcttccaagttcgcctcctccacaagactgttcacattggccgaatcccttggtggtatcgaatctctattggaagtgcccgctgtgatgacccacggtggtatcccaaaggaggccagagaggcctctggtgtttttgacgacttggttagaatctctgtcggtattgaagacactgacgatcttttggaagacatcaagcaagccttgaaacaagccaccaactaatcgccagtgccacgtctctgccttcgaccggacctttttaagtacgataaatatccttttataaatatatagtctaaaatatccattaatactgtgctcaactaatcgtgttagatgatttagttttttccaaatcgttattatagtgcagaagtagtatacataaaggcatatgcatgcgatttggaagtaacgctcgccgtagacaagtaagaatgcctgctgtcttgagaaccaggtccaaagaatcctctatagagcagaagcctgcttccagaactagaacgagatcaagaattttcaagtgtggtcgtgacgatgatgatgatgacgacgatgaggaaagcgatgatgcatacgatgaagtaggtaatgactatgacgagtatgcttcaagagcgaagctggccaccaataggcccttcgaaatagtcgcgggactgcctgctagtgtggagctgcccaactataactcttcgcttactcatccgcaatcaattaaaaattctggggtgctttacgactctctggtcagttccagaagaacctgggttcagggtgagatgtttgaactgtattggcgaagacctaagaaaattgttagtgaatctaccc

SEQ ID NO: 18999 - protein, 394 aa, Saccharomyces cerevisiae
MTLQESDKFATKAIHAGEHVDVHGSVIEPISLSTTFKQSSPANPIGTYEYSRSQNPNRENLERAVAALENAQYGLAFSSGSATTATILQSLPQGSHAVSIGDVYGGTHRYFTKVANAHGVETSFTNDLLNDLPQLIKENTKLVWIETPTNPTLKVTDIQKVADLIKKHAAGQDVILVVDNTFLSPYISNPLNFGADIVVHSATKYINGHSDVVLGVLATNNKPLYERLQFLQNAIGAIPSPFDAWLTHRGLKTLHLRVRQAALSANKIAEFLAADKENVVAVNYPGLKTHPNYDVVLKQHRDALGGGMISFRIKGGAEAASKFASSTRLFTLAESLGGIESLLEVPAVMTHGGIPKEAREASGVFDDLVRISVGIEDTDDLLEDIKQALKQATN

SEQ ID NO: 19000 - DNA, 1023 bp, Saccharomyces cerevisiae
  CDS (1)..(1023)
atgattgatcgtaccgagttatcgaagtttggtattactacgcaactgtctgttattggacgtaatccagatgaacaaagtggctttgttaatccacctttgtataaggggtcaaccatcattcttaaaaaacttagtgatttagaacaaaggaaaggaagattttacgggacagcaggttctccaactattgacaatttagaaaatgcctggacgcatttaaccggcggtgctgggacagtgctatcagcttctgggcttggttctatctctttggcgctattggccctttcgaaagctggtgatcatatcttgatgactgatagtgtctacgtgccaacacgtatgctatgtgatggtttattggccaagttcggtgttgaaacggattattatgacccatcaatagggaaggatatagaaaaactagttaagccaaatacaaccgtcattttcctcgaaagcccgggttctgggaccatggaagtacaggatattccagctttggtctctgttgccaaaaagcatgggataaagacaattctagacaacacatgggcaacgccactcttttttgatgctcatgcgcatggtatcgatatttcggtagaagctgggacaaaatatttgggtggtcattcagatcttcttattggtctggcctccgcaaatgaagaatgttggccgctattacggtcaacttatgatgcaatggcaatgttaccaggtgccgaggactgtcaattagcattgcgaggaatgcgtacattgcacttaagattgaaagaggtagaaagaaaagccctggatttggctgcttggctcggaaatcgagatgaggttgaaaaagtgcttcaccccgcctttgaagattgtcccggacatgaatactgggttcgtgactacaaaggttcttcaggcttattttccattgtccttaaaaatgggttcacaagagctggtctggagaaaatggtagaagggatgaaagttttgcaattgggattttcatggggtggctag

SEQ ID NO: 19001 - protein, 340 aa, Saccharomyces cerevisiae
MIDRTELSKFGITTQLSVIGRNPDEQSGFVNPPLYKGSTIILKKLSDLEQRKGRFYGTAGSPTIDNLENAWTHLTGGAGTVLSASGLGSISLALLALSKAGDHILMTDSVYVPTRMLCDGLLAKFGVETDYYDPSIGKDIEKLVKPNTTVIFLESPGSGTMEVQDIPALVSVAKKHGIKTILDNTWATPLFFDAHAHGIDISVEAGTKYLGGHSDLLIGLASANEECWPLLRSTYDAMAMLPGAEDCQLALRGMRTLHLRLKEVERKALDLAAWLGNRDEVEKVLHPAFEDCPGHEYWVRDYKGSSGLFSIVLKNGFTRAGLEKMVEGMKVLQLGFSWGG

SEQ ID NO: 19002 - DNA, 1775 bp, Arabidopsis thaliana (mouse-ear cress)
  CDS (142)..(1536)
cttcggtttctcttcagtcgtctctactctcacttgagcacgagaactgtctccgtcgccgttattatctcgtcggctaatatctcagacgagaaatcgacgccggagaaaaagcaatttagttctctttcatctaccaaaatgacatcttctctgtcacttcactcctccttcgtaccttccttcgctgatctctccgaccgaggtttgatcagtaagaactctccgaccagtgtttccatttccaaggttccaacttgggagaagaagcagatctcaaatcggaactctttcaagctgaattgcgtgatggagaaaagtgtcgatggtcaaactcattctaccgttaacaataccactgatagcttaaatactatgaatatcaaagaagaagctagcgtctctacattattggtgaacttggataataaatttgatccctttgatgcaatgagcactccgctttaccaaactgctacttttaagcagccttctgctattgaaaatggaccttatgattatacaagaagtggcaatcctacacgggatgcattggaaagcctccttgcgaagcttgacaaggcagatagagcattttgctttactagcggaatggctgctcttagtgctgttacacatcttatcaaaaatggcgaagaaattgttgctggagatgatgtatatggtggctctgacagattactatcccaagttgttccaagatctggcgttgtggtaaaacgagtaaacacaactaagttagacgaggttgctgctgcaattggtccccaaacaaagcttgtgtggcttgagtctccaacaaacccaagacaacaaatttctgatatacgaaaaatatctgagatggctcatgctcaaggtgctcttgtgttggtggacaacagtattatgtcaccagtgctctctcggccattagaacttggagctgacatcgtgatgcactcggctactaagtttatagccggacacagtgacgtgatggcaggtgtgcttgctgtaaaaggcgaaaaattggcaaaggaggtgtatttcctccaaaactcagaaggttctggattagctcctttcgactgttggctttgccttcgaggaatcaagacaatggctttacggatagaaaagcaacaggaaaacgcacggaaaattgcaatgtacttgtcttctcatccaagagtaaagaaagtgtactatgctggtctaccagatcatcctggtcaccatctccacttctctcaggcgaagggtgcaggatcagtttttagctttataactggatcagttgcgctttcaaagcatctcgtagaaaccaccaaatacttcagcatagctgtcagttttgggagtgttaagtcactgataagcatgccatgcttcatgtcacatgcaagcatacctgcagaagttcgtgaggccagaggtttgacggaagatcttgtccgtatatctgcaggaattgaagatgttgatgatttgatatctgatcttgacattgccttcaaaaccttccctctctagttttggtttgttcttgtctcagcttttgtagtttcataggttcttgaaataaggatctatgtaacaaaccataaaacataatttggtgtttgaaaacacatcaagcaataaattcattattgttagatttgttatgttacttgtttggggttaaattctgtattatcggcttcaaagccaacaacataagtagtacggatctttcttcaaagtgaaatacaactcttatcaagattctt

SEQ ID NO: 19003 - protein, 464 aa, Arabidopsis thaliana (mouse-ear cress)
MTSSLSLHSSFVPSFADLSDRGLISKNSPTSVSISKVPTWEKKQISNRNSFKLNCVMEKSVDGQTHSTVNNTTDSLNTMNIKEEASVSTLLVNLDNKFDPFDAMSTPLYQTATFKQPSAIENGPYDYTRSGNPTRDALESLLAKLDKADRAFCFTSGMAALSAVTHLIKNGEEIVAGDDVYGGSDRLLSQVVPRSGVVVKRVNTTKLDEVAAAIGPQTKLVWLESPTNPRQQISDIRKISEMAHAQGALVLVDNSIMSPVLSRPLELGADIVMHSATKFIAGHSDVMAGVLAVKGEKLAKEVYFLQNSEGSGLAPFDCWLCLRGIKTMALRIEKQQENARKIAMYLSSHPRVKKVYYAGLPDHPGHHLHFSQAKGAGSVFSFITGSVALSKHLVETTKYFSIAVSFGSVKSLISMPCFMSHASIPAEVREARGLTEDLVRISAGIEDVDDLISDLDIAFKTFPL

SEQ ID NO: 19004 - DNA, 1530 bp, Zea mays (maize)
  CDS (1)..(1530)
atggccactgtctcgctcaccccgcaggctgtcttctccacggagtccggtggcgccctggcctctgctaccatcctccgctttccgccaaactttgtccgccagcttagcaccaaggcacgccgcaactgcagcaacatcggcgtcgcgcagatcgtcgccgccgcgtggtccgactgccccgccgctcgcccccacttaggcggcggcggccgccgcgcccgcggcgtggcctcctcccacgccgcggctgcatcggccgccgccgccgcctccgcggcggcggaggtcagcgcaattcccaacgctaaggttgcgcaaccgtccgccgtcgtcttggccgagcgtaacctgctcggctccgacgccagcctcgccgtccacgcgggggagaggctgggaagaaggatcgccacggatgcgatcaccacaccggtagtgaacacgtcggcctactggttcaacaactcgcaagagctaatcgactttaaggaggggaggcatgctagcttcgagtatgggaggtatgggaacccgaccacggaggcattagagaagaagatgagcgcactggagaaagcagagtccacagtgttcgtggcatcggggatgtatgcagctgcggctatgctcagtgcacttgttccggctggtgggcacattgtgaccaccacggattgctaccggaaaacaaggatttacatggaaactgagctccccaagaggggaatttcgatgactgtcattaggcctgctgacatggatgctctacaaaatgcgttggacaacaataatgtatctcttttcttcacggagactcccacaaatccatttctcagatgcattgatattgaacatgtatcaaatatgtgccatagcaagggagcgttgctttgtatcgacagtacttttgcctcccctatcaatcagaaggcactgactttaggcgctgacctagttattcattctgcaacaaagtacattgctggacacaacgatgttattggaggatgcgtcagtggcagagatgagttggtttccaaagtccgtatttatcaccatgtggttggtggtgttctaaacccgaatgctgcgtaccttatccttcgaggcatgaaaacacttcatctccgtgtgcaatgtcagaataacactgctcttcggatggcccagtttttagaggaacatctaaagattgcccgtgtctactatcctggcttgcctagccaccctgaacatcacattgccaagagtcaaatgactggctttggtggtgtggttagttttgaggttgctggagactttgatgccacaaggaaattcatcgattctgttaagataccctatcatgccccttctttcggaggctgtgagagcataattgatcagcctgctatcatgtcctactgggattcaaaggagcagagggacatctatgggatcaaggacaacctgatcaggttcagcattggagtggaggattttgaggaccttaagaatgatcttgttcaggccctcgagaagatataa

SEQ ID NO: 19005 - protein, 509 aa, Zea mays (maize)
MATVSLTPQAVFSTESGGALASATILRFPPNFVRQLSTKARRNCSNIGVAQIVAAAWSDCPAARPHLGGGGRRARGVASSHAAAASAAAAASAAAEVSAIPNAKVAQPSAVVLAERNLLGSDASLAVHAGERLGRRIATDAITTPVVNTSAYWFNNSQELIDFKEGRHASFEYGRYGNPTTEALEKKMSALEKAESTVFVASGMYAAAAMLSALVPAGGHIVTTTDCYRKTRIYMETELPKRGISMTVIRPADMDALQNALDNNNVSLFFTETPTNPFLRCIDIEHVSNMCHSKGALLCIDSTFASPINQKALTLGADLVIHSATKYIAGHNDVIGGCVSGRDELVSKVRIYHHVVGGVLNPNAAYLILRGMKTLHLRVQCQNNTALRMAQFLEEHLKIARVYYPGLPSHPEHHIAKSQMTGFGGVVSFEVAGDFDATRKFIDSVKIPYHAPSFGGCESIIDQPAIMSYWDSKEQRDIYGIKDNLIRFSIGVEDFEDLKNDLVQALEKI

SEQ ID NO: 19006 - DNA, 2055 bp, Mesembryanthemum crystallinum (common ice plant)
  CDS (235)..(1881)
aaaaatataaacttcacctttcaacaaaccaaagttcccaaccatagttaaagtccctaatccccctcaccagcttttatttgaaaaatttgactcctcagagaaaattaaggccgtcacattttccggaagctagaaaaaaccgagaggcaagcctagcctgtggcacagaaagagagagaaggagagagagaaggagagacagaaaaataacccaccaaccaaaccacaaaaatggccgccatcacgagcagctgctgtgctagggttttgcccccatttgaatgccgccctgagccagcagacttctccactgccgccgccaagcaagagaagaacatccccaaatccttcttcggcggcgccaatggccgcctcttctcctcctcttcttcctctcttatccttcgctttcctcccaactttgtccgtcagctcagcaccaaggctcgccgcaactgcagcaacattggtgtcgcacaggtcgtcgctgcctcctggtccaacaactccgatgccggcgccacctcttgcggtggcgttccggctgctactgccgtcgacgctgccgctatcgccgccgtcgatcatgtggagatcgatggtggtgctgtagttgaggattctaatgatggtggtgtaaaggagttgtcttctaataatagtaatactttggggttgggtgatttcaggcccccatttttaagctccgatgggagcgttgcaattcatgccggtgagagattaggtcgtggcatagtcactgatgcaataactaccccggtagtaaatacttctgcatacttcttcaagaaaactgctgacctcattgattttaaggaggggcgccaaactagctttgagtatggtcgatatggaaatcctacctcagtggttttggaagataagattagtgcgcttgaaggagctgaatcaacaatattgttggcatccggaatgtgtgcaagtattgttctcatgttggctttggttccagctggtggtcatattgtgactactactgactgttatcggaagaccagaatatttattgagactttccttcccaaaatggggatcacggctacagtcattgaccctgctgatgtcgaaggccttaagtctgctcttgatgaaaataatgttactctattcttcactgagtctccgaccaatccatttcttaggtgtgttgacatcaagctggtctcagaactttgccacaagaaaggagcattggtctgcattgatggaacatttgccacacctctgaaccagaaggcccttgctctaggcgctgactttgttgtgcattctatgacaaaattcattggtggacacaatgatgttcttggtggttgcatcagtggttcgaaaaatttgatttcaactattcgaacttttcatcatgtccttggcgggactcttaacccgaatgctgcatatttaatgattcgaggcatgaagaccctccatcttcgtgtacagcaacagaacactacagcactgaggatggccgaaattttagaggcacatcccaaggtgaagcacgtttattatccaggtcttccaagtcatcctgagcacaagctggcaaagcggcaaatgactggctttggcggagtggttagttttgaggttgatggagatttattgaccaccgcgaagtttgttgattcattgaagattgcttatattgctccatcatttggaggctgtgaaagcattgtggatcagcctgcgatcatgtcttactgggatcttagtccatctgacaggctgaaatatggtatcaaggataacttggttcggttcagttttggagttgaggactttgaagatttgaaggctgatgttcttcaggctctggaggccatatgaggcgtgtcattttcattccattcccggcatttggtctttatgatgttttttcattccctgaatatcctgctttgtggtggttggcggatcacttgaacgatgatcctctgttttagtgtaatattggtttactgtgcttttccagagcgataagaaatcaatataattttctgc

SEQ ID NO: 19007 - protein, 548 aa, Mesembryanthemum crystallinum (common ice plant)
MAAITSSCCARVLPPFECRPEPADFSTAAAKQEKNIPKSFFGGANGRLFSSSSSSLILRFPPNFVRQLSTKARRNCSNIGVAQVVAASWSNNSDAGATSCGGVPAATAVDAAAIAAVDHVEIDGGAVVEDSNDGGVKELSSNNSNTLGLGDFRPPFLSSDGSVAIHAGERLGRGIVTDAITTPVVNTSAYFFKKTADLIDFKEGRQTSFEYGRYGNPTSVVLEDKISALEGAESTILLASGMCASIVLMLALVPAGGHIVTTTDCYRKTRIFIETFLPKMGITATVIDPADVEGLKSALDENNVTLFFTESPTNPFLRCVDIKLVSELCHKKGALVCIDGTFATPLNQKALALGADFVVHSMTKFIGGHNDVLGGCISGSKNLISTIRTFHHVLGGTLNPNAAYLMIRGMKTLHLRVQQQNTTALRMAEILEAHPKVKHVYYPGLPSHPEHKLAKRQMTGFGGVVSFEVDGDLLTTAKFVDSLKIAYIAPSFGGCESIVDQPAIMSYWDLSPSDRLKYGIKDNLVRFSFGVEDFEDLKADVLQALEAI

SEQ ID NO: 19008 - DNA, 1335 bp, Caenorhabditis elegans
  CDS (1)..(1335)
atgataagaactgataatctatctgatcttgcatcagcgagagattattggagaactgataaatacatttcatttgtaatcacatttcagttctatttgctgttggacacaatgagtgacagtttcaactggccagctggaaataacgaggcaagagaacgtttgggagaaaaatttgaaagtctccacttggacagtcgaatttcaacatctcatgcaaaaccactttcaaatgctgatccagtagttgttccaatttatcattcaagtacttatcgtttcaaaacagttgatcaattcaatgaagacaatcacggtgccaactttgtatatcgtcgatgcggaaatccaacaactgaaaatgtggaagttgtgattaatgagatagaaggcggtgcaggatccctcctatacaactcgggtcttgcagcgattagtgcagtttttctggaatttctgagttccggtgctcatatgattgttatgaacccaatttatagtggtacatcatcatttattaatgagacattggctcgttttggagttgaaataacttctgttgacgttgaaaaagaaaaggattttgctggagctgttgaaaaagcaattcggccaaatactaagatgatttactttgaatcaattgccaatccaacgatggcagttccagatattttgggaacaattgaagtggcaaagaaatataagattcttacatgtcttgatgcaactttctcatctccatacaacattcaaccactgaaacttggagcagacatcagtcttcatagctgctcaaaatacattggaggacatacggatgtgattgctggagttgttacagtatcatcttatgataattggaaaaaacttaaacttcaacaattgacgactggaagttctttgagtccatacgacgctgccctgttgaccagaggtctcaaaactcttggattgcgagttgataggatttcagaaaatgctcagaaaactgcagaatttctagaatcccatccaaaagttgaacgtgtcttttatccaggacttccatcccacccacagcatcaatatgctaaacaagtaatgaaacaatttgctggaatgattgcatttgatgttggaactgctgaaaatgcaatcaagcttgttgaggctatatctcttggtggtactgaatctttaatcgaacatcctctgtcaatgtctcatggtaaacatttacttcgatatttggatggtccgactgttgcccctggacttctccgatttagcgttggcattgaaaatgtggaggatattattggagatttgaatgatgccctcgagaagctttga

SEQ ID NO: 19009 - protein, 444 aa, Caenorhabditis elegans
MIRTDNLSDLASARDYWRTDKYISFVITFQFYLLLDTMSDSFNWPAGNNEARERLGEKFESLHLDSRISTSHAKPLSNADPVVVPIYHSSTYRFKTVDQFNEDNHGANFVYRRCGNPTTENVEVVINEIEGGAGSLLYNSGLAAISAVFLEFLSSGAHMIVMNPIYSGTSSFINETLARFGVEITSVDVEKEKDFAGAVEKAIRPNTKMIYFESIANPTMAVPDILGTIEVAKKYKILTCLDATFSSPYNIQPLKLGADISLHSCSKYIGGHTDVIAGVVTVSSYDNWKKLKLQQLTTGSSLSPYDAALLTRGLKTLGLRVDRISENAQKTAEFLESHPKVERVFYPGLPSHPQHQYAKQVMKQFAGMIAFDVGTAENAIKLVEAISLGGTESLIEHPLSMSHGKHLLRYLDGPTVAPGLLRFSVGIENVEDIIGDLNDALEKL

SEQ ID NO: 19010 - DNA, 1179 bp, Caenorhabditis elegans
  CDS (1)..(1179)
atggctacttttccacactttggaactgatgcagtccacgttggccaagaaccagaacaatgggatattaatcaggtagttccaccaattagtatgtccactacctacaagcaggataacccaggagagccgaagcggtacgattatgctcgtggtggaaacccaacacgcgatgttcttcagaaaaatttggccgctcttgagggcgccaaacattgtcaagcattttcttctgggctcgctgcatcttcagccgtcatcaatcttctcaatcatggcgatcatattgtgtgctccgatgatgtttacggaggaactatccgttacattcgccaaattgctgttaaaaagtatggaatggaagtggattcggttgatttaactgatgttcagaatctcgagaaagccatcaagccaaacaccaaaatggtttggttcgaatctccatctaacccgcttttgaaggtggttgatatcgcagccgtggtacagactgcaaaaagagctaatccagaaattgttgtggttgttgacaacactttcatgactccgtacttccagcgcccactttctctcggcgcagacattgctgttcattcaataaccaaatatattaatggacattctgatattattatgggagccgctatcactaataatgacgagttccagcagcatctacacttcatgcaacgtgcaatcggaggtgttccatctccattcgactgtttccttgtcaatcgtggactcaaaacacttcacgtcagaatgaaggctcactttgaaaacgcgctagccatagccaaattccttgaagctcatgactgcatcgaatcggttctctatccagctcttccttcgcatccacagcacacggttcatgtgaaacaaaccaagggaatgtccggaatgatatcattctatctgaaaggagaactttgccaaagccgtgcgtttctttctgctctcaaagtgtttacgttggctgaatctctcggaggatgtgaatcactggcagagctcccatcaataatgacgcatgcttcggtgccgtctgcaactcgtgctgaacttggtattactgataatctcattcgtatttctgttggaatcgaagatctggatgacctgattgctgatctggatcaagctttgaaaattgctattccaaacgtataa

SEQ ID NO: 19011 - protein, 392 aa, Caenorhabditis elegans
MATFPHFGTDAVHVGQEPEQWDINQVVPPISMSTTYKQDNPGEPKRYDYARGGNPTRDVLQKNLAALEGAKHCQAFSSGLAASSAVINLLNHGDHIVCSDDVYGGTIRYIRQIAVKKYGMEVDSVDLTDVQNLEKAIKPNTKMVWFESPSNPLLKVVDIAAVVQTAKRANPEIVVVVDNTFMTPYFQRPLSLGADIAVHSITKYINGHSDIIMGAAITNNDEFQQHLHFMQRAIGGVPSPFDCFLVNRGLKTLHVRMKAHFENALAIAKFLEAHDCIESVLYPALPSHPQHTVHVKQTKGMSGMISFYLKGELCQSRAFLSALKVFTLAESLGGCESLAELPSIMTHASVPSATRAELGITDNLIRISVGIEDLDDLIADLDQALKIAIPNV

SEQ ID NO: 19012 - DNA, 1500 bp, Stenotrophomonas maltophilia
  CDS (127)..(1302)
taagccgctgatcgaagacgttcgctgctgaatcccggtttatccgcgtcaaaggtcgttaaggccgtgctggtagacttccgcaccttcgatggcgccgtgcgtcggcgcccctcaggaaacaacatgtccaacgctacttcccaggatcgcgccctggccctggctactctggccatccacggtggccagtcgccggaccccagcactggcgcggtaatgccgccgatytacgccacctcgacctatgcgcagtccagcccgggcgagcatcagggcttcgagtactcgcgtacccacaacccgacccgcttcgcctatgagcgttgcgtggcatcgctggaaggtggcacccgcggcttcgctttcgcctcgggcatggcggcgagctcgaccgtgatcgaactgctggacgccggcagtcacgtggtggcaatggacgatatttacggcggcagcttccgcctgttcgagcgggtgcgtcgccgcaccgccgggctggacttcagcttygtcgacctgaccgatctggccgcgttcgaagccgccatcacgtcgaagacgaagatggtytggattgagaccccgaccaacccgatgctgaagattgttgacatcgccgcggtcaccgccatcgccaagcgccatggcctgattgtggtggtygacagcaccttcgcctcgccgatgctgcagcgtccgctggagctgggtgcggacctggtcctgcattcggccaccaagtacctcaacggtcactcggacatggtcggcggcatggtcgtggtcggcgacaacgccgaactggccgagcagatggccttcctgcagaactcggtgggtggcgtgcagggcccgttcgacagcttcttggccctgcgtggcctgaagaccctgccgctgcgcatgaaggcgcactgcgccaacgcgctggcgctggcccagtggctggaaaagcacccggcggtggagaaggtgatctacccgggtctggcctcgcatccgcagcatgaactggccggcaagcagatggccggttacggcggcatcgtctcgatcgtgctcaagggcggtttcgaagcggccaagcgcttctgcgagaagaccgaactgttcaccctggccgagtcgctgggcggcgtggaaagcctggtcaaccacccggcggtgatgacgcacgcctcgatttcggtcgcgcggcgggaacagctgggtatcagcgatgcgctggtaaggctgagcgtgggcgtggaggagctgggggatctgcaggtggatctggagcgggcgctgggcggctgaccgcactcctgtcctccatgacgtctccagactcctctccggttgctgcatcggtacgcatgtttgcgtggctgcgcagccaggcgtggctgcgcggtgcctaccatctgttgccgaccggcctgcgcgaaggtgcgctgcgattgttttcgcggcgacttcaggcgcggacgcgcttcgtgcgcaccgcggcctggg

SEQ ID NO: 19013 - protein, 391 aa, Stenotrophomonas maltophilia
MSNATSQDRALALATLAIHGGQSPDPSTGAVMPPIYATSTYAQSSPGEHQGFEYSRTHNPTRFAYERCVASLEGGTRGFAFASGMAASSTVIELLDAGSHVVAMDDIYGGSFRLFERVRRRTAGLDFSFVDLTDLAAFEAAITSKTKMVWIETPTNPMLKIVDIAAVTAIAKRHGLIVVVDSTFASPMLQRPLELGADLVLHSATKYLNGHSDMVGGMVVVGDNAELAEQMAFLQNSVGGVQGPFDSFLALRGLKTLPLRMKAHCANALALAQWLEKHPAVEKVIYPGLASHPQHELAGKQMAGYGGIVSIVLKGGFEAAKRFCEKTELFTLAESLGGVESLVNHPAVMTHASISVARREQLGISDALVRLSVGVEELGDLQVDLERALGG

SEQ ID NO: 19014 - DNA, 1161 bp, Corynebacterium glutamicum
  CDS (1)..(1161)
atgtcttttgacccaaacacccagggtttctccactgcatcgattcacgctgggtatgagccagacgactactacggttcgattaacaccccaatctatgcctccaccaccttcgcgcagaacgctccaaacgaactgcgcaaaggctacgagtacacccgtgtgggcaaccccaccatcgtggcattagagcagaccgtcgcagcactcgaaggcgcaaagtatggccgcgcattctcctccggcatggctgcaaccgacatcctgttccgcatcatcctcaagccgggcgatcacatcgtcctcggcaacgatgcttacggcggaacctaccgcctgatcgacaccgtattcaccgcatggggcgtcgaatacaccgttgttgatacctccgtcgtggaagaggtcaaggcagcgatcaaggacaacaccaagctgatctgggtggaaaccccaaccaacccagcacttggcatcaccgacatcgaagcagtagcaaagctcaccgaaggcaccaacgccaagctggttgttgacaacaccttcgcatccccatacctgcagcagccactaaaactcggcgcacacgcagtcctgcactccaccaccaagtacatcggaggacactccgacgttgttggcggccttgtggttaccaacgaccaggaaatggacgaagaactgctgttcatgcagggcggcatcggaccgatcccatcagttttcgatgcatacctgaccgcccgtggcctcaagacccttgcagtgcgcatggatcgccactgcgacaacgcagaaaagatcgcggaattcctggactcccgcccagaggtctccaccgtgctctacccaggtctgaagaaccacccaggccacgaagtcgcagcgaagcagatgaagcgcttcggcggcatgatctccgtccgtttcgcaggcggcgaagaagcagctaagaagttctgtacctccaccaaactgatctgtctggccgagtccctcggtggcgtggaatccctcctggagcacccagcaaccatgacccaccagtcagctgccggctctcagctcgaggttccccgcgacctcgtgcgcatctccattggtattgaagacattgaagacctgctcgcagatgtcgagcaggccctcaataacctttag

SEQ ID NO: 19015 - protein, 386 aa, Corynebacterium glutamicum
MSFDPNTQGFSTASIHAGYEPDDYYGSINTPIYASTTFAQNAPNELRKGYEYTRVGNPTIVALEQTVAALEGAKYGRAFSSGMAATDILFRIILKPGDHIVLGNDAYGGTYRLIDTVFTAWGVEYTVVDTSVVEEVKAAIKDNTKLIWVETPTNPALGITDIEAVAKLTEGTNAKLVVDNTFASPYLQQPLKLGAHAVLHSTTKYIGGHSDVVGGLVVTNDQEMDEELLFMQGGIGPIPSVFDAYLTARGLKTLAVRMDRHCDNAEKIAEFLDSRPEVSTVLYPGLKNHPGHEVAAKQMKRFGGMISVRFAGGEEAAKKFCTSTKLICLAESLGGVESLLEHPATMTHQSAAGSQLEVPRDLVRISIGIEDIEDLLADVEQALNNL

SEQ ID NO: 19016 - DNA, 1221 bp, synthetic construct
  CDS (1)..(1221)
atgcaggaaaaagacgcctcctcacaaggtttcctgccacacttccaacatttcgccacgcaggcgatccatgtgggccaggatccagagcaatggacctccagggctgtagtgccccccatctcactgtccaccacgttcaagcaaggggcgcctggccagcactcgggttttgaatatagccgttctggaaatcccactaggaattgccttgaaaaagcagtggcagcactggatggggctaagtactgtttggcctttgcttcaggtttagcagccactgtaactattacccatcttttaaaagcaggagaccaaattatttgtatggatgatgtgtatggaggtacaaacaggtacttcaggcaagtggcatctgaatttggattaaagatttcttttgttgattgttccaaaatcaaattactagaggcagcaattacaccagaaaccaagcttgtttggatcgaaacccccacaaaccccacccagaaggtgattgacattgaaggctgtgcacatattgtccataagcatggagacattattttggtcgtggataacacttttatgtcaccatatttccagcgccctttggctctgggagctgatatttctatgtattctgcaacaaaatacatgaatggccacagtgatgttgtaatgggcctggtgtctgttaattgtgaaagccttcataatagacttcgtttcttgcaaaactctcttggagcagttccatctcctattgattgttacctctgcaatcgaggtctgaagactctacatgtccgaatggaaaagcatttcaaaaacggaatggcagttgcccagttcctggaatctaatccttgggtagaaaaggttatttatcctgggctgccctctcatccacagcatgagttggtgaagcgtcagtgtacaggttgtacagggatggtcaccttttatattaagggcactcttcagcatgctgagattttcctcaagaacctaaagctatttactctggccgagagcttgggaggattcgaaagccttgctgagcttccggcaatcatgactcatgcatcagttcttaagaatgacagagatgtccttggaattagtgacacactgattcgactttctgtgggcttagaggatgaggaagacctactggaagatctagatcaagctttgaaggcagcacaccctccaagtggaagtcacagcttgtaa

SEQ ID NO: 19017 - protein, 406 aa, synthetic construct
MQEKDASSQGFLPHFQHFATQAIHVGQDPEQWTSRAVVPPISLSTTFKQGAPGQHSGFEYSRSGNPTRNCLEKAVAALDGAKYCLAFASGLAATVTITHLLKAGDQIICMDDVYGGTNRYFRQVASEFGLKISFVDCSKIKLLEAAITPETKLVWIETPTNPTQKVIDIEGCAHIVHKHGDIILVVDNTFMSPYFQRPLALGADISMYSATKYMNGHSDVVMGLVSVNCESLHNRLRFLQNSLGAVPSPIDCYLCNRGLKTLHVRMEKHFKNGMAVAQFLESNPWVEKVIYPGLPSHPQHELVKRQCTGCTGMVTFYIKGTLQHAEIFLKNLKLFTLAESLGGFESLAELPAIMTHASVLKNDRDVLGISDTLIRLSVGLEDEEDLLEDLDQALKAAHPPSGSHSL

SEQ ID NO: 19018 - DNA, 1356 bp, Caenorhabditis elegans
  CDS (1)..(1356)
atgataagaactgataatctatctgatcttgcatcagcgagagattattggagaactgataaatacatttcatttgtaatcacatttcagttctatttgctgttggacacaatgagtgacagtttcaactggccagctggaaataacgaggcaagagaacgtttgggagaaaaatttgaaagtctccacttggacagtcgaatttcaacatctcatgcaaaaccactttcaaatgctgatccagtagttgttccaatttatcattcaagtacttatcgtttcaaaacagttgatcaattcaatgaagacaatcacggtgccaactttgtatatcgtcgatgcggaaatccaacaactgaaaatgtggaagttgtgattaatgagatagaaggcggtgcaggatccctcctatacaactcgggtcttgcagcgattagtgcagtttttctggaatttctgagttccggtgctcatatgattgttatgaacccaatttatagtggtacatcatcatttattaatgagacattggctcgttttggagttgaaataacttctgttgacgttgaaaaagaaaaggattttgctggagctgttgaaaaagcaattcggccaaatactaagatgatttactttgaatcaattgccaatccaacgatggcagttccagatattttgggaacaattgaagtggcaaagaaatataagattcttacatgtcttgatgcaactttctcatctccatacaacattcaaccactgaaacttggagcagacatcagtcttcatagctgctcaaaatacattggaggacatacggatgtgattgctggagttgttacagtatcatcttatgataattggaaaaaacttaaacttcaacaattgacgactggaagttctttgagtccatacgacgctgccctgttgaccagaggtctcaaaactcttggattgcgagttgataggatttcagaaaatgctcagaaaactgcagaatttctagaatcccatccaaaagttgaacgtgtcttttatccaggacttccatcccacccacagcatcaatatgctaaacaagtaatgaaacaatttgctggaatgattgcatttgatgttggaactgctgaaaatgcaatcaagcttgttgagagtcttaaactaatcattcatgcagtatctcttggtggtactgaatctttaatcgaacatcctctgtcaatgtctcatggtaaacatttacttcgatatttggatggtccgactgttgcccctggacttctccgatttagcgttggcattgaaaatgtggaggatattattggagatttgaatgatgccctcgagaagctttga

SEQ ID NO: 19019 - protein, 451 aa, Caenorhabditis elegans
MIRTDNLSDLASARDYWRTDKYISFVITFQFYLLLDTMSDSFNWPAGNNEARERLGEKFESLHLDSRISTSHAKPLSNADPVVVPIYHSSTYRFKTVDQFNEDNHGANFVYRRCGNPTTENVEVVINEIEGGAGSLLYNSGLAAISAVFLEFLSSGAHMIVMNPIYSGTSSFINETLARFGVEITSVDVEKEKDFAGAVEKAIRPNTKMIYFESIANPTMAVPDILGTIEVAKKYKILTCLDATFSSPYNIQPLKLGADISLHSCSKYIGGHTDVIAGVVTVSSYDNWKKLKLQQLTTGSSLSPYDAALLTRGLKTLGLRVDRISENAQKTAEFLESHPKVERVFYPGLPSHPQHQYAKQVMKQFAGMIAFDVGTAENAIKLVESLKLIIHAVSLGGTESLIEHPLSMSHGKHLLRYLDGPTVAPGLLRFSVGIENVEDIIGDLNDALEKL

SEQ ID NO: 19020 - DNA, 1248 bp, Trichomonas vaginalis
  CDS (14)..(1204)
atttttagacaacatgtctcacgagagaatgaccccagcaacagcatgcatccatgctaatccacagaaggatcagtttggagcagccatcccaccaatctaccaaacatcaacattcgttttcgataactgccaacagggtggaaacagattcgctggtcaggaatccggctacatctacacacgtctcggcaacccaacagtttcaaacctcgaaggcaagatcgccttcctcgagaaaacagaagcatgcgttgccacatcttctggcatgggtgccattgctgctacagttttgacaatcctcaaggccggagatcacttaatctccgatgagtgcctttatggctgcacacatgctctctttgagcacgcattgacaaagttcggcatccaggtcgacttcatcaacacagccatcccaggcgaggtcaagaagcacatgaagccaaacacaaagattgtctatttcgagacaccagccaacccaacactcaagatcatcgacatggagcgcgtctgcaaggacgcccacagccaggagggcgtcttagttatcgccgataacacattctgctcaccaatgatcacaaacccagtcgactttggcgtcgatgttgttgtccactctgcaacaaagtacatcaacggccacacagatgtcgtcgctggccttatctgtggcaaggctgacctccttcaacagattcgtatggttggtatcaaggatatcacaggatctgttatcagcccacacgacgcttggctcatcacacgtggcctctcaacactcaacatcagaatgaaggctgagagcgagaacgccatgaaggtcgctgagtacctcaaatctcacccagccgttgagaaggtttactacccaggcttcgaggaccacgagggccacgatatcgctaagaagcagatgagaatgtcgggttcaatgatcacattcatcctcaagtccggcttcgaaggcgctaagaagctcctcgacaacctcaagcttatcacacttgcagtttcccttggtggctgcgagtccctcatccagcacccagcttcaatgactcacgctgtcgttccaaaggaggagcgtgaggccgctggtattacagatggcatgatccgcctttctgtcggtattgaagatgccgacgaactcatcgctgatttcaaacagggccttgacgctcttttataaactctacttagtttcttgactttaattaaaaaaaaaaaaaaaaa

SEQ ID NO: 19021 - protein, 396 aa, Trichomonas vaginalis
MSHERMTPATACIHANPQKDQFGAAIPPIYQTSTFVFDNCQQGGNRFAGQESGYIYTRLGNPTVSNLEGKIAFLEKTEACVATSSGMGAIAATVLTILKAGDHLISDECLYGCTHALFEHALTKFGIQVDFINTAIPGEVKKHMKPNTKIVYFETPANPTLKIIDMERVCKDAHSQEGVLVIADNTFCSPMITNPVDFGVDVVVHSATKYINGHTDVVAGLICGKADLLQQIRMVGIKDITGSVISPHDAWLITRGLSTLNIRMKAESENAMKVAEYLKSHPAVEKVYYPGFEDHEGHDIAKKQMRMSGSMITFILKSGFEGAKKLLDNLKLITLAVSLGGCESLIQHPASMTHAVVPKEEREAAGITDGMIRLSVGIEDADELIADFKQGLDALL

SEQ ID NO: 19022 - DNA, 1305 bp, Trichomonas vaginalis
  CDS (16)..(1212)
gactttatataaaagatgagtggccacgctatcgacccaacacatacagacacactttccatccacgccaacccacagaaggatcagttcggtgctattgttgctccaatctaccaaacatccaccttcctcttcgacaactgcgaccagggtggtgctcgtttcggtggcaaggaagccggttacatgtacacacgtatcggtaacccaacaaactccgcactcgaaggcaagatcgccaagctcgaacacgctgaggcatgcgctgccacagcttctggcatgggtgctattgctgcttctgtctggacattcctcaaggccggtgatcaccttatctccgacgattgcctttatggctgcacacacgccctcttcgagcatcagctccgcaagttcggcgttgaagttgatttcatcgacatggctgtcccaggaaacattgagaagcacttgaagccaaacacaagaatcgtctacttcgaaacaccagctaacccaacattaaaggttatcgacatcgaagacgccgtcaagcaggccagaaagcagaaggatatcctcgttatcgttgataacaccttcgcttcaccaattcttacaaacccactcgacctcggtgttgatatcgtcgttcactccgctactaagtacatcaatggccacaccgatgttgtcgccggccttgtctgctcaagagctgacatcatcgctaaggtcaagtcccagggtatcaaggatatcacaggcgccatcatttccccacacgacgcttggctcatcacaagaggcacacttacactcgatatgcgtgtcaagcgcgctgccgagaacgctcagaaggtcgctgaattcctccatgagcacaaggccgtcaagaaggtctactacccaggccttccagaccatccaggccacgaaatcgccaagaagcagatgaagatgttcggctctatgatcgcattcgatgtcgacggattagagaaggccaagaaagtccttgacaactgccacgttgtttctctcgccgtttccctcggtggtccagaatccctcatccagcacccagcttcaatgacacacgctggtgttccaaaggaggaacgcgaggctgctggcctaacagataacctcatccgcctctctgttggctgtgagaacgttcaggatatcatcgacgacctcaagcaggctctcgacttagtcctctaaatttaactttcgaatttcagtaataaaatcctagatatcttccccccccaaaaaaaaaaaaaaaaaaaaaaaaaaaaaaaaaaaaaaaaaaaa

SEQ ID NO: 19023 - protein, 398 aa, Trichomonas vaginalis
MSGHAIDPTHTDTLSIHANPQKDQFGAIVAPIYQTSTFLFDNCDQGGARFGGKEAGYMYTRIGNPTNSALEGKIAKLEHAEACAATASGMGAIAASVWTFLKAGDHLISDDCLYGCTHALFEHQLRKFGVEVDFIDMAVPGNIEKHLKPNTRIVYFETPANPTLKVIDIEDAVKQARKQKDILVIVDNTFASPILTNPLDLGVDIVVHSATKYINGHTDVVAGLVCSRADIIAKVKSQGIKDITGAIISPHDAWLITRGTLTLDMRVKRAAENAQKVAEFLHEHKAVKKVYYPGLPDHPGHEIAKKQMKMFGSMIAFDVDGLEKAKKVLDNCHVVSLAVSLGGPESLIQHPASMTHAGVPKEEREAAGLTDNLIRLSVGCENVQDIIDDLKQALDLVL

SEQ ID NO: 19024 - DNA, 1940 bp, Fragaria vesca
  CDS (100)..(1737)
ttcaaacccccctaaccactttcctgaaaaattagaaactctcgctccagctaaaaccctgctctcgatccctcatcaatcttcctcactctcaccaccatgggcgtgtacacgtgtcctagggttttcacctcctcctcctcctcctccacctactgctgccgccaccaccccgacctcgccacccgcgccgccgtcaatccccgccccggcttcgccgcaggccgcgtcgactctccggcgccgtttcacggcctatcgtcactcatcctccgcttccctcccaacttcgtccgccagctcagcaccaaggcccgccgcaactgcagcaacatcggcgtcgcgcagatcgtcgcggcttcgtggtccaacaaagactccgacctttcggcggtgccggcggctagtgccgtcgatgccgccgccaccgccgccgatctggtcgtcccggcccagatcgggaccgaggatgacctggcggccgtggatgcggagtacgccgtgtttgggaacggtgtacagttaggaggcttgcctgatttgaaggacgcctcgtttttaagctccgatgggagcatcgcaattcatgccggtgaaagattgggtcgcggtatagtgactgatgcaattacaaccccggtggttaatacttctgcttactttttcaagaaaactgctgacctccttgatttcaaggagaagcgcgcgacgagttttgaatacgggcgctatggaaacccaactaccgtggttcttgaggaaaagattagtgctcttgaaggagcggaatctacactgttgctagcttccggaatgtgtgctagcacggtcttgttgatggctttggttccagctggtgggcatattgtgacaacaacagactgctacaggaagactcggatatttattgagaccatccttcccaaaatggggatcacggcaacaattattgaccctgctgatgttggagcactagaaactgcactgaatgagaataaagtttctcttttcttcacagaatctcctacaaaccctttcctaaggtgtgtggacattaatttggtttcagatctttgccatagcaaaggggcagtagtctgtataaatggcacttttgccacacctataaatcaaaaggcccttgctcttggggctgatcttgttgtgcactctgcaacaaaatatcttgctggccacaatgatgtccttgctggttgcattagcggttcaatgaaattggtttccgaaattcgtatattgcatcatattttgggtggtgctcttaacccgaatgctgcatacctgatcattcgaggcatgaagactttgcatattcgtatacagcaacagaattctactgcattgaggatggccaaaattttagaggcgcatcctaaggtggcgcacgtctattatcctggtttgccaagtcatcctgaacatgagcttgccaagaggcagatgactggtttcggtggtgttgtcagttttgagattgatggagacttgaagagaacaattaagttcattgatgccctgaaaataccatatattgccccctcctttggtggttgtgagagcatcgtggatcagccagccataatgtcttattgggatctcagccagtcagataggctcaagtacggaatcaaggataacctggtccgtttcagcttcggtatcgaagacttcaatgatcttaaggctgacattctgcaggccctggagaaaatatagaccaaaccggccacctaagatgcggattcctgtttaatttttttttacctgttcttttggtgtttcaattgatgtttgatcaccaaaaacggtcgttatcgattccattaggacccaaaacctgtcgaatttcttttgtaatctgctcttaacaattccatatcattatcactatgctgcttcgtttaaaaaaaaaaaaaaaa

SEQ ID NO: 19025 - protein, 545 aa, Fragaria vesca
MGVYTCPRVFTSSSSSSTYCCRHHPDLATRAAVNPRPGFAAGRVDSPAPFHGLSSLILRFPPNFVRQLSTKARRNCSNIGVAQIVAASWSNKDSDLSAVPAASAVDAAATAADLVVPAQIGTEDDLAAVDAEYAVFGNGVQLGGLPDLKDASFLSSDGSIAIHAGERLGRGIVTDAITTPVVNTSAYFFKKTADLLDFKEKRATSFEYGRYGNPTTVVLEEKISALEGAESTLLLASGMCASTVLLMALVPAGGHIVTTTDCYRKTRIFIETILPKMGITATIIDPADVGALETALNENKVSLFFTESPTNPFLRCVDINLVSDLCHSKGAVVCINGTFATPINQKALALGADLVVHSATKYLAGHNDVLAGCISGSMKLVSEIRILHHILGGALNPNAAYLIIRGMKTLHIRIQQQNSTALRMAKILEAHPKVAHVYYPGLPSHPEHELAKRQMTGFGGVVSFEIDGDLKRTIKFIDALKIPYIAPSFGGCESIVDQPAIMSYWDLSQSDRLKYGIKDNLVRFSFGIEDFNDLKADILQALEKI

SEQ ID NO: 19026 - DNA, 1182 bp, Drosophila melanogaster
  CDS (1)..(1182)
atgagctacagagtccagccgagcggcttcgccaccaagtccatccactcgggccaaagccccgaccagtggaagagtgctgccgtgattccgccgatatcgctgagcaccaccttcaagcaagatgcaccgggcgagcacaggggctatgagtactcccgcagtggaaatcccactaggaacgtgctggagacatgcttcgccgccttggataatgccaaatacggcctcacgttctcatcgggattgggagccaccaccgctgtgctaactatgctgagcagcggcgatcacatcatcatgggcgacgatgtttacggaggcaccaaccgtttgatccgacaggttgccacccgtctgggaatctcagccacctttgtggatcccacgaagttggatctaattaaaagttccatcaagccggagaccaaattggtgtggatcgagtcaccaactaatccattggtaaaggtagccgacatcgaggctattgcgcagctggtccatggagtacgcgaggatatcgtcctggccgtcgacaacaccttcctgacctcctacttccagcgacccttggagctgggcgctgatctggtctgctactccctgaccaagtacatgaacggtcatacggatgtggtcatgggtggcatcaccatgaactcggagaagctctacaaaagcttgaagttcctgcagaacgcagtggacattgtgccgtctccattcgactgctatcaggtgaacagaagtcttaagacgctctcgctgcgcatggaacagcaccagaagaatgctctgaaggttgccaaatacctggagacgaatccgttcgtggagaaggtgttgcatccctctttgccatcccatccgcagcacaagatcgctctgaagcaggcctacggatacagcggcgtgttctccttctacattaagggcgagctgaagcactcctcggctttcctcaaggccctcaaggtgttcaccctggcggagagtctgggtggctacgagagtctggccgagctgccatccataatgacccatgcctcggttccggcggaggataggaaaactttgggcatcactgacggtctagttcgcttgtccgtcggactggaggatgccgatgatttgatcaaggatctggagcaggcccttgaaattgcatcgaaggcctaa

SEQ ID NO: 19027 - protein, 393 aa, Drosophila melanogaster
MSYRVQPSGFATKSIHSGQSPDQWKSAAVIPPISLSTTFKQDAPGEHRGYEYSRSGNPTRNVLETCFAALDNAKYGLTFSSGLGATTAVLTMLSSGDHIIMGDDVYGGTNRLIRQVATRLGISATFVDPTKLDLIKSSIKPETKLVWIESPTNPLVKVADIEAIAQLVHGVREDIVLAVDNTFLTSYFQRPLELGADLVCYSLTKYMNGHTDVVMGGITMNSEKLYKSLKFLQNAVDIVPSPFDCYQVNRSLKTLSLRMEQHQKNALKVAKYLETNPFVEKVLHPSLPSHPQHKIALKQAYGYSGVFSFYIKGELKHSSAFLKALKVFTLAESLGGYESLAELPSIMTHASVPAEDRKTLGITDGLVRLSVGLEDADDLIKDLEQALEIASKA

SEQ ID NO: 19028 - DNA, 1615 bp, Pseudomonas putida
  CDS (304)..(1500)
ataggatggcctggtagccagtgatatagccgttgtcttccagcagcttgacccggcgccagcaggggcgaggtggtcaatgccacctggtcggcaagttcggcgacggttaggcgggcgttgtcctgcaaggcggcgagcagggcgcggtcggtgcggtcgaggcttgaaggcatgttttgccctcctggtccgttaattattgtttttgttccagcaagcacgcagatgcgtgggcaattttggaaaaaatcgggcagctcggtggcataagcttataacaaaccacaagaggctgttgccatgcgcgactcccataacaacaccggtttttccacacgggccattcaccacggctacgacccgctttcccacggtggtgccttggtgccaccggtgtaccagaccgcgacctatgccttcccgactgtcgaatacggcgctgcgtgcttcgccggggaggaggcggggcacttctacagccgcatctccaaccccaccctggccttgctcgagcaacgcatggcctcgttggagggtggtgaggcgggattggcgctggcgtcggggatgggagccattacttcgaccctctggaccctgctgcggcctggtgatgagctgatcgtggggcgcaccttgtatggctgcacctttgcgttcctgcaccatggcattggcgagttcggggtcaagatccaccatgtcgaccttaacgatgccaaggccctgaaagcggcgatcaacagcaaaacgcggatgatctacttcgaaacaccggccaaccccaacatgcaactggtggatatagcggcggtcgtcgaggcagtgcgggggagtgatgtgcttgtggtggtcgacaacacctactgcacgccctacctgcagcggccactggaactgggggcagacctggtggtgcattcggcaaccaagtacctcagtggccatggcgacatcactgcgggcctggtggtggggcgcaaggctttggtcgaccgcattcggctggaagggctgaaagacatgaccggggcagccttgtcaccgcatgacgctgcgttgttgatgcgcggcatcaagaccctggcgctgcgcatggaccggcattgcgccaacgccctggaggtcgcgcagttcctggccgggcagccccaggtggagctgatccactacccgggcttgccgtcgtttgcccagtacgaactggcacagcggcagatgcgtttgccgggcgggatgattgcctttgagctcaagggcggtatcgaggccgggcgcggcttcatgaatgccctgcagctttttgcccgtgcggtgagcctgggggatgccgagtcgctggcacagcacccggcgagcatgacgcactccagttacacgccacaagagcgggcgcatcacgggatatcagaggggctggtgaggttgtcagtggggctggaggatgtggaggacctgctggcagatatcgagttggcgttggaggcgtgtgcatgaacttgccttgcaggatcgggaacacttgcccaatgcctcacgggatcaggcgatggcactttggatgagctggtgaattggccggcttatccaagaggagtttaaaatgaccgta

SEQ ID NO: 19029 - protein, 398 aa, Pseudomonas putida
MRDSHNNTGFSTRAIHHGYDPLSHGGALVPPVYQTATYAFPTVEYGAACFAGEEAGHFYSRISNPTLALLEQRMASLEGGEAGLALASGMGAITSTLWTLLRPGDELIVGRTLYGCTFAFLHHGIGEFGVKIHHVDLNDAKALKAAINSKTRMIYFETPANPNMQLVDIAAVVEAVRGSDVLVVVDNTYCTPYLQRPLELGADLVVHSATKYLSGHGDITAGLVVGRKALVDRIRLEGLKDMTGAALSPHDAALLMRGIKTLALRMDRHCANALEVAQFLAGQPQVELIHYPGLPSFAQYELAQRQMRLPGGMIAFELKGGIEAGRGFMNALQLFARAVSLGDAESLAQHPASMTHSSYTPQERAHHGISEGLVRLSVGLEDVEDLLADIELALEACA

SEQ ID NO: 19030 - DNA, 1194 bp, Acinetobacter sp
  CDS (1)..(1194)
atgttagatgataaaaaaccacaaacttcgttaattcatgcgccaagaaaagccccacaatacattcacagcattcaacctcccttgtttcgtgcatctaccattatttttcctactacagcgcacctttttgatcggcattggagcgatccttatgattatagttatggaacacatggcacacccacaacctttactttaggtgatcaattggctgaaattgaagggggacaatattgtttacttgcaccgagcggcttatctgcaattaatctggtcaattcaacttttctaagtcatggcgatgaagtctgggtaccagataatatctatggcccgaacatggaacacctaaacaatttgcgacaacgctatggcattcaagttcgtatctacaatccaattgatgcagaatcgtttataccttcagagaaaaccaggctactctggcttgaagctgctggttcaattacgatggagtttcctgatttaatacaacttgttcgaaaggcacaggcagcacaggtactcacagcattagataatacctggggtgcaggattggccttcaatgccttcgacttttctaatgagcatctatcagtcgatataaccgtacatgctttaacaaaatacccaagcggtggcggtgatattttgatgggtagcgtcataacacgcgacaagaatttgtatcaacaactctttaaaattcatgccaatcagggaatctgtgtgtcgggcgacgataccgcacaaattattcgcagcttggcgcatatgcgtctgcgctatcagcagcaagctgaaaatgcacagaaactattggagtggcttcaacaacaaccgcaatgtattcaggttttacatcccgccgcatcaaatagtcctggacatgattactggaagagcatctgtaaaaatggtcaaagtgctggattggtgagtgtgatttttgatccaaaatatgatttggctgcaatccgtcgcttttgtgatgccctaaacttgtttaaattaggttttagctggggtggtcctgtgagcttggtcatgctatatgacttaaaacagatgcgaatattgaacaatacacatttacaacaaggcttactggttcgattttgtgtaggactggaagatccagaagatttaatacaagatattcaaaacgcactacaacaactcgaatag

SEQ ID NO: 19031 - protein, 397 aa, Acinetobacter sp
MLDDKKPQTSLIHAPRKAPQYIHSIQPPLFRASTIIFPTTAHLFDRHWSDPYDYSYGTHGTPTTFTLGDQLAEIEGGQYCLLAPSGLSAINLVNSTFLSHGDEVWVPDNIYGPNMEHLNNLRQRYGIQVRIYNPIDAESFIPSEKTRLLWLEAAGSITMEFPDLIQLVRKAQAAQVLTALDNTWGAGLAFNAFDFSNEHLSVDITVHALTKYPSGGGDILMGSVITRDKNLYQQLFKIHANQGICVSGDDTAQIIRSLAHMRLRYQQQAENAQKLLEWLQQQPQCIQVLHPAASNSPGHDYWKSICKNGQSAGLVSVIFDPKYDLAAIRRFCDALNLFKLGFSWGGPVSLVMLYDLKQMRILNNTHLQQGLLVRFCVGLEDPEDLIQDIQNALQQLE

SEQ ID NO: 19032 - DNA, 1176 bp, Candida glabrata
  CDS (1)..(1176)
atgggtctattagaatctgacaagtttgctaccaaggctattcatgctggtgctcatgaagacattcatggttctgttattgagccaatttctttgtctactactttcaagcaaagcgagccagccaagccaattggtacatatgaatactctagatcccaaaacccaaacagagagaacctagaagctgccattgcctctttggaaggtggtaagtacggtcttgccttctcttccggttccgctaccaccgctgtgatcttgcaatccttgcctcaaggttctcatgctgtctccatcggtgacgtctacggtggtactcacagatacttcaccaaagttgccaacgcccacggtgttgacacttccttcaccaacaacttgatcgaagacttgccaaagcttgtcaaggacaacaccaagttggtctggatcgagtccccaactaacccaactctaaaggttaccgatatccaattggtcgctgaaaacgtcaagaagatcaacaaggacatcctactggtcgtcgacaacacattcttgtccccatacttgtccaacccattgaagttcggtgctgacatcgtcgtccactccgctaccaagtacatcaacggtcactccgatgtggttctaggtgtcttggccaccaacagcaaggacatctacgaaagattgcaattcctacaaaacgccatcggttgtatcccatccccattcgacgcttggttgacccaccgtggtctaaagaccttgcacttgcgtgttagacaagcatccttgaacgccaccaagatcgccactttcctagagagcaacgaaaacgtcgttgccgtcaactacccaggtctacaatctcatccaaactatgatgtcgtcaagaagcaacacagagaagccctaggtggtggtatgatttctttcagaatcaagggtggtgccgaagccgctgctaagttttcttcctctaccagactattcactttggctgaatctctaggtggtatcgaatctctactagaagtcccagctgtgatgacccacggtggtattccaaaggaagccagagaagcctccggtgtctttgacgatctagttagattatcagtcggtattgaagacggtgaagaccttctagaagacatcaagcaagctttgcaaaaggccaccgcttaa

SEQ ID NO: 19033 - protein, 391 aa, Candida glabrata
MGLLESDKFATKAIHAGAHEDIHGSVIEPISLSTTFKQSEPAKPIGTYEYSRSQNPNRENLEAAIASLEGGKYGLAFSSGSATTAVILQSLPQGSHAVSIGDVYGGTHRYFTKVANAHGVDTSFTNNLIEDLPKLVKDNTKLVWIESPTNPTLKVTDIQLVAENVKKINKDILLVVDNTFLSPYLSNPLKFGADIVVHSATKYINGHSDVVLGVLATNSKDIYERLQFLQNAIGCIPSPFDAWLTHRGLKTLHLRVRQASLNATKIATFLESNENVVAVNYPGLQSHPNYDVVKKQHREALGGGMISFRIKGGAEAAAKFSSSTRLFTLAESLGGIESLLEVPAVMTHGGIPKEAREASGVFDDLVRLSVGIEDGEDLLEDIKQALQKATA

SEQ ID NO: 19034 - DNA, 1143 bp, Staphylococcus aureus subsp
  CDS (1)..(1143)
atgaataagaaaacgaaattaattcacggtggacacacaacggacgactatacaggtgcagttacaacaccaatttatcaaacaagtacatatttacaagatgatattggtgatttacgtcaaggatatgaatattctcgtactgcgaatccaacaagaagttctgtagaaagcgttattgcgtcattagaaaatggcaaacatggctttgcatttagttcaggtgttgcagcaatcagtgcagttgttatgctgttggacaaaggtgatcatattattttaaattcagatgtatacggcggtacttatcgcgcattgacaaaagtatttacacgatttggcgttgaagtggattttgtagatacaacgcatacagattcaattgtacaagcgatacgcccaacaacaaaaatgttatttattgaaacaccttctaatccattattacgtgttactgacattaaaaagtctgctgaaattgcgaaagaacacggtttgatttcagtcgttgataacacatttatgacactttattatcagaatccattagatttaggcatcgatattgtcttacattctgcaacgaaatatttaggtggacatagtgatgtcgttgctggtttagttgcaacatcggatgacaagcttgcagaacgtttagcatttatttcaaattcaacaggtggcattttaggacctcaagatagttatttacttgtgagggggattaaaacattaggtttacgtatggaacaaattaatcgcagtgttattgaaattattaaaatgttacaagcacatccagctgtgcaacaagtgttccatccaagtattgaaagtcatttaaatcatgatgtccatatggctcaagcggatggccatacaggtgtgattgcttttgaagtgaaaaatacagaaagtgccaaacaattgattaaagcaacatcgtattacacattagctgaaagtttaggtgcagtggaaagtttaatttcagtacctgcattgatgacacatgcatctattccagcagatattcgagctaaagaaggtattacagacggacttgtaagaatttctgtaggtattgaagatactgaagatttagtagatgatttaaaacaagcactagatacgttataa

SEQ ID NO: 19035 - protein, 380 aa, Staphylococcus aureus subsp
MNKKTKLIHGGHTTDDYTGAVTTPIYQTSTYLQDDIGDLRQGYEYSRTANPTRSSVESVIASLENGKHGFAFSSGVAAISAVVMLLDKGDHIILNSDVYGGTYRALTKVFTRFGVEVDFVDTTHTDSIVQAIRPTTKMLFIETPSNPLLRVTDIKKSAEIAKEHGLISVVDNTFMTLYYQNPLDLGIDIVLHSATKYLGGHSDVVAGLVATSDDKLAERLAFISNSTGGILGPQDSYLLVRGIKTLGLRMEQINRSVIEIIKMLQAHPAVQQVFHPSIESHLNHDVHMAQADGHTGVIAFEVKNTESAKQLIKATSYYTLAESLGAVESLISVPALMTHASIPADIRAKEGITDGLVRISVGIEDTEDLVDDLKQALDTL

SEQ ID NO: 19036 - DNA, 1179 bp, Bacillus thuringiensis serovar konkukian str
  CDS (1)..(1179)
atgaaaaagaagcatatggagacagcgttaattcatcacggttatacatcagaggaacataaaggaagtttaacaccgcctttatttcaaacgtctacatttacatttgagactgcgcagcaaggagaggcgagttttgcgggagtggatccatcttatatttactcaagacttggaaatccgactgtgaaattatttgaagaacgtatggcggtgttagaaggtggagaagaagcacttgctttcggatccggaatggcagctatttcagctactttaattggttttctaaaagctggagatcatattatttgttcaaatggattatacggatgcacgtacggctttttagaagtgttagaagaaaaatttatgattacgcattcgttttgtgatatggagacagagggtgatattgaaaataaaatttgcccaaatacaaagcttattttcgttgaaacaccaattaatccgacaatgaaactaattgatttaaaacaagtgattcgggttgcgaagcgaaatgggttacttgtcattgttgataatacgttttgttcaccttatttacaaagacctcttgaacttggctgtgacgcggttgttcatagtgcgacaaaatatattggtggccacggtgatgttgtggcgggtgtaacaatttgtaaaacgagagcgttagctgaaaaaatccgcccgatgcgaaaagatatcggcggtattatggcaccgtttgatgcatggttattgttacgcggattaaagacactagcggtaagaatggaccgccattgtgataatgcagaaaaaattgtatcgttcctaaaaaatcatgatgcggtagaaggtgtttggtatccagaaggggagttagcatctcgccaaatgaaacggggcggcggcgttatatctttttcaattaaaggcgggaaagaagagacgcaagcgtttattaatgacctctactttattacaattgcagtcagtttgggagatacagaaacgttaattcagcacccggcaacgatgacacacgctgcgattccagctgagttaagacaagaaatgggtatttatgataatttaatacgtttatctgtcggtttagaatcgtgggaggatatcgtttctgatttagagcaagcattaaagaaaatatctactgttagtaatcaataa

SEQ ID NO: 19037 - protein, 392 aa, Bacillus thuringiensis serovar konkukian str
MKKKHMETALIHHGYTSEEHKGSLTPPLFQTSTFTFETAQQGEASFAGVDPSYIYSRLGNPTVKLFEERMAVLEGGEEALAFGSGMAAISATLIGFLKAGDHIICSNGLYGCTYGFLEVLEEKFMITHSFCDMETEGDIENKICPNTKLIFVETPINPTMKLIDLKQVIRVAKRNGLLVIVDNTFCSPYLQRPLELGCDAVVHSATKYIGGHGDVVAGVTICKTRALAEKIRPMRKDIGGIMAPFDAWLLLRGLKTLAVRMDRHCDNAEKIVSFLKNHDAVEGVWYPEGELASRQMKRGGGVISFSIKGGKEETQAFINDLYFITIAVSLGDTETLIQHPATMTHAAIPAELRQEMGIYDNLIRLSVGLESWEDIVSDLEQALKKISTVSNQ

SEQ ID NO: 19038 - DNA, 1176 bp, Bacillus anthracis str
  CDS (1)..(1176)
atgaaaaagaagcatatggagacagcgttaattcatcacggttatacatcagaggaacataaaggaagtttaacaccgcctttatttcaaacgtctacatttacatttgagactgcgcagcaaggagaggcgagttttgcgggagtggatccatcttatatttactcaagacttggaaatccgactgtgaaattatttgaagaacgtatggcggtgttagaaggaggagaagaagcgcttgctttcgggtccggtatggcagctatttccgcaacgttaattggttttctaaaagctggagatcatattatttgttcaaatggattatacggatgcacgtacggctttttggaagtgttggaagaaaaatttatgattacgcattcgttttgtgatatggagacagaggctgatattgaaaataaaattcgcccaaatacaaagcttattttcgttgaaacaccgattaatccgacaatgaaattaattgatttaaaacaagtgattcgggttgcgaagcgaaatggtttacttgtcattgttgacaatacgttttgttcaccttatttacaaagaccgcttgaacttggctgtgacgccgttgttcatagtgcgacaaaatatattggtggccacggtgatgttgtggcgggtgtaacaatttgtaaaacgagagcgttagctgaaaaaatccgcccgatgcgaaaagatatcggcggtattatggcaccgtttgatgcatggttattgttacgcggattaaagacactagcggtaagaatggaccgccattgtgataatgcagaaaaaattgtatcgttcctaaaaaatcatgatgcggtagaaggtgtttggtatccagaaggggagttagcatctcgccaaatgaaacggggcggcgttatatctttttcaattaaaggcgggaaagaagagacgcaagcgtttattaatgacctctactttattacaattgcagtcagtttgggagatacagaaacgttaattcagcacccggcaacgatgacgcacgctgcgattccagctgagttaagacaagaaatgggtatttatgataatttaatacgtttatctgtcggtttagaatcgtgggaggatatcgtttctgatttagagcaagcattaaagaaaatatctactgttagtaatcaataa

SEQ ID NO: 19039 - protein, 391 aa, Bacillus anthracis str
MKKKHMETALIHHGYTSEEHKGSLTPPLFQTSTFTFETAQQGEASFAGVDPSYIYSRLGNPTVKLFEERMAVLEGGEEALAFGSGMAAISATLIGFLKAGDHIICSNGLYGCTYGFLEVLEEKFMITHSFCDMETEADIENKIRPNTKLIFVETPINPTMKLIDLKQVIRVAKRNGLLVIVDNTFCSPYLQRPLELGCDAVVHSATKYIGGHGDVVAGVTICKTRALAEKIRPMRKDIGGIMAPFDAWLLLRGLKTLAVRMDRHCDNAEKIVSFLKNHDAVEGVWYPEGELASRQMKRGGVISFSIKGGKEETQAFINDLYFITIAVSLGDTETLIQHPATMTHAAIPAELRQEMGIYDNLIRLSVGLESWEDIVSDLEQALKKISTVSNQ

SEQ ID NO: 19040 - DNA, 1158 bp, Picrophilus torridus DSM 9790
  CDS (1)..(1158)
atgttaaatggttttaatacaagggccgtacaggccggtgatttaaaaataagggaaattggaaacgttgttacaccgatatttgaaaacagcacatttatctatccaaacagtgaatccgagtacatggatagctcaagcggcatgccatacatatattcaagatggggaaatcctactgtgcaatcccttgaggataaatacagggtccttgagaataccgggcatgctgttgcattttcatccggaatgggcgcgataacagccgcagtgctatcaaatataaaaaagaaaagaatactatcaattatggatctctatggacaaacgtttcagttcttttcaaggacgttaaaaactcttggaattcatgtggacttcatagacgttgataaattaaacaacctggactttgatgccaaaaattacgatcttgtatatgcagaatcaataacaaacccgcttttaaaggtaattgatataaaaaacgtggcatcgttctgccatgaaaatgatgttttatttatagatgatgcgacctttgcatcgccttataatcaaaatcctgtggaactcggtgctgatattgttgttcacagcgcaacgaaatacatatcaggccattccgatgtaattattggcattgccggcacaaacaattattacaataatttaatagaaatgagaaagacacttggtgcatcgcctgatgcattccaggcatatctatcataccgtggcctaaaaaccctcggcctgaggatggagaggcataataaaaatgccatggagcttgccaggtttttaagggattcaaaaaaggtattgaatgtaaactaccccggccttgatgataataaataccatggcattgccgggaaggagatgaggggctacggtggcatgctgtcattcacattaaacagcatggaggatgcgcataagctaataaagaaccttgagatacctgcctatgctgcaagccttggcggtgtggaatcattgataaccatgcctgttgaaacaacacatgcatcgctttcacctgaggaaagaagatcacttggaatatcagactcgctggtaaggttttcaactggcatagaggatatcgatgatattataaaagattttgaaaatgcactttcaaaattataa

SEQ ID NO: 19041 - protein, 385 aa, Picrophilus torridus DSM 9790
MLNGFNTRAVQAGDLKIREIGNVVTPIFENSTFIYPNSESEYMDSSSGMPYIYSRWGNPTVQSLEDKYRVLENTGHAVAFSSGMGAITAAVLSNIKKKRILSIMDLYGQTFQFFSRTLKTLGIHVDFIDVDKLNNLDFDAKNYDLVYAESITNPLLKVIDIKNVASFCHENDVLFIDDATFASPYNQNPVELGADIVVHSATKYISGHSDVIIGIAGTNNYYNNLIEMRKTLGASPDAFQAYLSYRGLKTLGLRMERHNKNAMELARFLRDSKKVLNVNYPGLDDNKYHGIAGKEMRGYGGMLSFTLNSMEDAHKLIKNLEIPAYAASLGGVESLITMPVETTHASLSPEERRSLGISDSLVRFSTGIEDIDDIIKDFENALSKL

SEQ ID NO: 19042 - DNA, 1095 bp, Picrophilus torridus DSM 9790
  CDS (1)..(1095)
atgattgaaacagatattaatgatatttatggaaggcccctggtatttccaatataccagactggatcttatgagattccaggcggtgaaaaatttagatactcaagggagtacaacccaacagttgagaatttaaataatgtaataaaaagacttgaacatggcgatcttgcaaattccttctcttcaggcatgggcgcaataacaacaacgcttttatcaatcttaaggcctggtgatgaggccgtgacgcatatagatacatttgcaaggagctatcatttcttctctgaatttttgagatcctttggaataaaaacaagaatatcaagacctggaactgaaaatatacttgaggagataaacaagagaacaaagcttgttttcatagaaacgctgagcaatccagtactaagggtatatgatatagacgagatctcaaaggcatgttcagagaacggtgcactgctaatatgcgattccaccttcgcaacgccctataatttaaaaacgcttgatcacggtgcagatgttgttatacacagtgcatcaaaatttttatctggtcataatgacgtaatcgcaggtgttgctgcaggatcatatgatttaataaaaaggatagatgataccaggcgcagtcttggaacgtcaatggatccaaatacagcgttccttgtggaacgcggtattaaaacactggatttaagaatggagagaattaatgaaaacgcaatgaagatagcaaggtttctaaatgaatctcccagggtatcggatgtaatatatccagggcttgaaagccacccggatcatggaatagcatcaagattgctgagaggttactccggcgttattttatttaaattaaaaaaggattttaatgattttatagataaattatcaaatataaaggctgcgaacacccttggtggtttaaatacaattgtttcaaatccatatacgatgtcacacagatcactgaacaatgatgagctaaagattcttggtatagataaggattatgtaaggttatctgccggtatagaaaatccagaaaatataatagaggaactaaacacggccatatcatag

SEQ ID NO: 19043 - protein, 364 aa, Picrophilus torridus DSM 9790
MIETDINDIYGRPLVFPIYQTGSYEIPGGEKFRYSREYNPTVENLNNVIKRLEHGDLANSFSSGMGAITTTLLSILRPGDEAVTHIDTFARSYHFFSEFLRSFGIKTRISRPGTENILEEINKRTKLVFIETLSNPVLRVYDIDEISKACSENGALLICDSTFATPYNLKTLDHGADVVIHSASKFLSGHNDVIAGVAAGSYDLIKRIDDTRRSLGTSMDPNTAFLVERGIKTLDLRMERINENAMKIARFLNESPRVSDVIYPGLESHPDHGIASRLLRGYSGVILFKLKKDFNDFIDKLSNIKAANTLGGLNTIVSNPYTMSHRSLNNDELKILGIDKDYVRLSAGIENPENIIEELNTAIS

SEQ ID NO: 19044 - DNA, 1188 bp, Photobacterium profundum
  CDS (1)..(1188)
atggaaaaaaaagcattagatacaaaaatcataacagcaggtcgctcgaaaaagtggacccagcatctagttaatccacctgtaagccgtgcatcaacaattgtatttgataccgttgctgaaatgaaacatgccactgccaaccgtgcgaataaagagctcttttatggacgccgtggtacgaatacgcattttgcttttcaagacgcaatggttgaactggaaggcggtgttggctgtgcattatatccttgtggtacggctgctatctcaaatgccattttatcgtttgtgaaaacaggcgatcatatcttaatggttgatggcacttacgagccaacgcgtgatttctgtgacaaaattttagataagatgggcgttgaaacaacctattatgacccgatggtcggcgaaggtattcgcgatcttattcgcccgaatacaacggttctattcttagagtctccatgctctatcacgatggaagtgcaagatgtgccgttactcgcgagtattgcacatgagcatgatatcgtcgtgatgttggataatacgtgggcatcaccgattaatttccagccattcgatcatggcgttgatatctcgattcaagcggcaacaaaatatattgtgggtcattcggatgtaatgttaggcacagcaacagcgaatgaacgctgctgggatcaattacgtgaaggtagctatttgatggggcagtgcacctcgccagatgatgtttatcttgctatgcgcgggctacgtacattaggcgttcgtttaaggcagcacgaaaaaaacagcatcaaagttgctcaatggttatctgagcgcgaagaagtggatcatgttcgccatcctgcctttgaaagctgtgaaggtcatgagatttacaagcgcgatttcaaagggtgtaacggtttattctctttggtactgaagcgcggtaatactgcagcgttaacggcgttattagacggcatggagcacttcagcatgggctattcatggggcggttttgaaagcctaatattagcgaatgaaaatgttaactctatacgtacagcgaaaaagaaagaatttgttggaccaatgctgcgtctacacgtgggcttagaagatgttgatgatttgattcgagatcttgaaaaaggttttgaacgttttaatgctgtgcttgagcaataa

SEQ ID NO: 19045 - protein, 395 aa, Photobacterium profundum
MEKKALDTKIITAGRSKKWTQHLVNPPVSRASTIVFDTVAEMKHATANRANKELFYGRRGTNTHFAFQDAMVELEGGVGCALYPCGTAAISNAILSFVKTGDHILMVDGTYEPTRDFCDKILDKMGVETTYYDPMVGEGIRDLIRPNTTVLFLESPCSITMEVQDVPLLASIAHEHDIVVMLDNTWASPINFQPFDHGVDISIQAATKYIVGHSDVMLGTATANERCWDQLREGSYLMGQCTSPDDVYLAMRGLRTLGVRLRQHEKNSIKVAQWLSEREEVDHVRHPAFESCEGHEIYKRDFKGCNGLFSLVLKRGNTAALTALLDGMEHFSMGYSWGGFESLILANENVNSIRTAKKKEFVGPMLRLHVGLEDVDDLIRDLEKGFERFNAVLEQ

SEQ ID NO: 19046 - DNA, 1167 bp, Photobacterium profundum
  CDS (1)..(1167)
atgagtgacaagcaacttgccaccatcgctgtgcgcacaggtatcgaatcagacagtcaacacaatgctgttgtaccacctatctatttgacatcgacttatagtttcccaaagctcggtgagttaccgcagtacgattattctcgatcaggcaatcctacgcgtaatatgctagcagatgccttatctgatcttgaaggtggtgcgagtggcgttgtgacgagctgtggaaccgctgcaattaacttgctcgtatcggccttgcttagccctgatgatttaattattgccccgcatgattgttatggtggtacttaccgcctgtttaatacgcgtgctaataaaggcgattttaacgttttatttatcgaccagtcagatcccgtagcgcttactcaagcgctggcgaaaaaacctaaaattgtttgggttgaaacgccatcaaacccgttattacgtgtgattgatgtggaagcattgtgtcaacaagcgaaagcggttggcgcacaggttgccgttgataacacctttctttctccgcttttacagcaacctattaaattaggggctgattttgtggttcactcgacaacaaaatacatcaatggtcattcggatgttgttggtggcgttttaatttcaaaagatgctgaacaagcagaaaacattgcttggtgggcaaattgtattggtgcaacgggtgcaccgtttgatgcttatctaacgttacgtggtttacgtaccttaggtgcaagaatgcggatgcatgaagaaaatggtgccgagatccttaagtatctacaaacaaatgcactggttggtcaaatttatcaccctagtttgcctgagcacccaggtcatgacattgcagcacgtcagcaaaaaggatttggttctatgcttagctttgagctagctggcacctaccgtcaacttgaagtctttgttgaagcgttaacattattctcattggctgaatcattaggtggaaccgaaagtttaattgcgcatccatcaagcatgacacaccgtgctatgtctgatgaagcacaagcagaagccggtattaaaacgtcactgttacgcctttctgttggtttggaagatcctcaagatttaatcaacgatcttgaacaagcatttactctggctgcggaggcggtgtaa

SEQ ID NO: 19047 - protein, 388 aa, Photobacterium profundum
MSDKQLATIAVRTGIESDSQHNAVVPPIYLTSTYSFPKLGELPQYDYSRSGNPTRNMLADALSDLEGGASGVVTSCGTAAINLLVSALLSPDDLIIAPHDCYGGTYRLFNTRANKGDFNVLFIDQSDPVALTQALAKKPKIVWVETPSNPLLRVIDVEALCQQAKAVGAQVAVDNTFLSPLLQQPIKLGADFVVHSTTKYINGHSDVVGGVLISKDAEQAENIAWWANCIGATGAPFDAYLTLRGLRTLGARMRMHEENGAEILKYLQTNALVGQIYHPSLPEHPGHDIAARQQKGFGSMLSFELAGTYRQLEVFVEALTLFSLAESLGGTESLIAHPSSMTHRAMSDEAQAEAGIKTSLLRLSVGLEDPQDLINDLEQAFTLAAEAV

SEQ ID NO: 19048 - DNA, 1276 bp, Corynebacterium glutamicum
  CDS (101)..(1249)
agataccgactttgctaatcccaccaccgtagccactaggtatttagttgccttggacaagcgtgtacctcgtgcttgatataacaagtaaggaagcctgatgaatttttacccaccatctgtacctattaaccctgcgtggcgtccacccacagtaactgtgcaagcgggacggccagccagaactcctggtgcgccgatgaacccacctatcacgttgtccagcacttatgttcatgattcagaaaaagcttatgggcgcgatggcaatgatggatggggtgcatttgaggctgccatgggaactctagatggtgggttcgcggtatcttattcttcaggtttggcagcggcaacgtcgattgctgatttggttcctactggtggcacagttgttttacctaaagctgcctattatggcgtgaccaatattttcgccaggatggaagcccgcggaaggctgaaggttcgaactgttgatgcagacaataccgaagaagtgattgctgctgctcaaggtgcagatgtggtgtgggtggaatcgatcgctaatccgacgatggtggtagctgatatccctgcaatagtcgacggtgtgcgtgggcttggagttttgactgtcgttgacgcgactttcgcaacgccacttcgtcaacgtccattggaacttggtgctgatattgtgctttactcggcaaccaaacttatcggtggacactctgatcttcttcttggagtcgcagtgtgcaagtctgagcaccatgcgcagtttcttgccactcaccgtcatgatcatggttcagtgccgggaggtcttgaagcgtttcttgctctccgtggattgtattccttggcggtgcgtcttgatcgagcagaatccaacgcagcagaactttcgcggcgacttaacgcgcatccttcggttacccgcgtcaattatccaggacttcctgatgatccccaacatgaaaaagccgtgcgagtcctaccctctggatgtggaaacatgttgtcatttgagcttgatgcaacacctgaacgaactgatgagattctcgaaagcctgtcacttttaacccacgcgaccagttggggaggtgtggaaacagccattgaacgtcgcaccaggcgggatgctgaagtggtggcaggagtaccgatgactctttgccgcgtttccgtaggaattgaagacgttgaagatctatgggaagacctcaacgcctcaatcgacaaagttctgggttagaactcgtagccagtaaccagaccttca

SEQ ID NO: 19049 - protein, 382 aa, Corynebacterium glutamicum
MNFYPPSVPINPAWRPPTVTVQAGRPARTPGAPMNPPITLSSTYVHDSEKAYGRDGNDGWGAFEAAMGTLDGGFAVSYSSGLAAATSIADLVPTGGTVVLPKAAYYGVTNIFARMEARGRLKVRTVDADNTEEVIAAAQGADVVWVESIANPTMVVADIPAIVDGVRGLGVLTVVDATFATPLRQRPLELGADIVLYSATKLIGGHSDLLLGVAVCKSEHHAQFLATHRHDHGSVPGGLEAFLALRGLYSLAVRLDRAESNAAELSRRLNAHPSVTRVNYPGLPDDPQHEKAVRVLPSGCGNMLSFELDATPERTDEILESLSLLTHATSWGGVETAIERRTRRDAEVVAGVPMTLCRVSVGIEDVEDLWEDLNASIDKVLG

SEQ ID NO: 19050 - DNA, 1164 bp, Bdellovibrio bacteriovorus
  CDS (1)..(1164)
atgaaaaaaatgaacgacaaccttggtttttccactcgtgcgattcatgccggccaagctccggatccttccacgggcgccatcatgacgccggtttatctgacctcgacttacgtacaagaatctcctggtgttcacaaaggctgggaatattcccgcacgcacaatcccactcgtcacgcttacgaaagctgcatggcaagtttggagggtggcaaacatggttttgcgttttcttccggttgcgcggcaacgacaactgtattgcatcttctaaaaggtggcgatcatgtgattgccatggatgacatgtacggcggcaccttccgtctgtttgacaaaatccttaagcacgacggcatggagttttctttcgttgatctgacgaaggttgaaaactttgaaaaagccgtaaaaccaaacaccaagctggtatggttggaaactccgaccaatccgactttgaaactggttgatatcaaaaaaatcgcagccattgccaaagccaaaggcattctggtagcggttgataacacgttcatgagcccctacttccaaagacctttggagctgggtgcggatatcgtggttcattctgcgacaaaatacatcggcggccacagtgatacggtcggcggtatggtcgttgtatcccgcgcggatctggcagaaagaatggcgttcctgagcaacggtatcggggcgactcaaggggcgtttgattccttcatgttcctgagaagtttgaaaactttgccacttcgtatgaaggcccatcaggaaaacgccatggcgattgcgaagtttttggaatctcatccaaaagtggacaaagtcatctatccgggtctggaaagccatcctcagcatgctttggcgaaagaacaaatgcatggtttcggtgggatgatcactttctacatcaaagggggcctggattcggctcgtaagttcctggaaaacgtgaatgtcttttcattggccgagagtttgggaggggttgagtccctgatcgagcatccggcgattatgacgcacgcctccgttccacctgaaaaccgcaaggctttggggatcgacgacaccctgatccgcctttctgtaggtgtagaggatctgaacgacctgattgccgaccttaaaactgcttttgataaggcttaa

SEQ ID NO: 19051 - protein, 387 aa, Bdellovibrio bacteriovorus
MKKMNDNLGFSTRAIHAGQAPDPSTGAIMTPVYLTSTYVQESPGVHKGWEYSRTHNPTRHAYESCMASLEGGKHGFAFSSGCAATTTVLHLLKGGDHVIAMDDMYGGTFRLFDKILKHDGMEFSFVDLTKVENFEKAVKPNTKLVWLETPTNPTLKLVDIKKIAAIAKAKGILVAVDNTFMSPYFQRPLELGADIVVHSATKYIGGHSDTVGGMVVVSRADLAERMAFLSNGIGATQGAFDSFMFLRSLKTLPLRMKAHQENAMAIAKFLESHPKVDKVIYPGLESHPQHALAKEQMHGFGGMITFYIKGGLDSARKFLENVNVFSLAESLGGVESLIEHPAIMTHASVPPENRKALGIDDTLIRLSVGVEDLNDLIADLKTAFDKA

SEQ ID NO: 19052 - DNA, 1185 bp, Methylocystis sp
  CDS (1)..(1185)
atgtccgaagaaaagcgaaaagcaaggcgcaaattaaagcccgccactctggtgacgcaagccggccgcgcgcccttcgatcatttcggcttcgtcaatccccctatttatcgcggctcgaccgtgctgttcccgacggtcgcggctctcgaggcgttacggcagccgtacacctacggcaccaaggggacgcccacgactcgcgcgctcgagcagggctggagcgagatcgccggcgccgcggacacggtgttgacgccctccggccttgcggcgatcgggttggcgcttctcaccgccacgcaagcgggcgcgcatgcgctcatcgtggattcggcctatcagccgacgcggatcttctgcgacggtctcctcgcgcgcttcggcgtcaaagtcgactattatgatcccttgatcggcggcggcgtcgccgcgatgatgaagcccgaaacgaccgcggtgctcgtcgagtcgcccggctccctgagcatggaggttcaagacattcctgcgatcgccgcggccgcccacgcccatggcgcctgtgtgatcgcggacaacacctgggcgaccccccttctcttcccgccgcatgagcgcggctgcgacctcgtcatcgacgccggcaccaaatatctctcgggccacgccgatctcctcatggggctcgtttccgccaattctgcatgggcgaagcgcctgcgcgcgaccttcaacgccttcagcatggggtccagtcccgacgacgccgcgctcgccctgcgcgggatgcgcaccatggcgctacggctgcgcgagcaggagcgcgccgcgctcgacgtcgcgcagtggctggagaaccggccggaagtttcgcgcgtgctgcatcccggccttgcgacgcatcccggccacgcgctgtggcgacgagactttaccggcgcctccggcgttttttccgtgatcctcaaagcgacttcaaaaaaggcagtcgccgcttttgtcgacggattggaactgttcggcatcggattctcatggggcggctatgaaagccttgtcctgcccttcgactgctcttcttacaggacggcgacgcgctggacgccggaaggaccgacgctgcgcttctccatcggactggaggacgtcgcggatctgaagtctgatctcgaggcgggcttcgcgcgcctcaacgcccattga

SEQ ID NO: 19053 - protein, 394 aa, Methylocystis sp
MSEEKRKARRKLKPATLVTQAGRAPFDHFGFVNPPIYRGSTVLFPTVAALEALRQPYTYGTKGTPTTRALEQGWSEIAGAADTVLTPSGLAAIGLALLTATQAGAHALIVDSAYQPTRIFCDGLLARFGVKVDYYDPLIGGGVAAMMKPETTAVLVESPGSLSMEVQDIPAIAAAAHAHGACVIADNTWATPLLFPPHERGCDLVIDAGTKYLSGHADLLMGLVSANSAWAKRLRATFNAFSMGSSPDDAALALRGMRTMALRLREQERAALDVAQWLENRPEVSRVLHPGLATHPGHALWRRDFTGASGVFSVILKATSKKAVAAFVDGLELFGIGFSWGGYESLVLPFDCSSYRTATRWTPEGPTLRFSIGLEDVADLKSDLEAGFARLNAH

SEQ ID NO: 19054 - DNA, 1212 bp, Rhodopseudomonas palustris
  CDS (1)..(1212)
atgtccgagtccaaaccgaccattcccgttcccgccaccgcgcatttccgccgcgaaacccgcctggtgcattccggcagcttgcgctcgcagttcggcgagacctccgaggcgttgttcctgactcagggcttcgtctacgaaagcgccgagcagtgcgaggcgcgcttcaccggcgacgacgccggcttccaatattcgcggttctcgaacccgaccgtgttcagcttcgaacagcggatggcggagttcgaaggcgccgaagcggcgcgctcgaccgccaccggcatggccgcggtgacggccgcgatgctggcgccgctgcgggcaggcgatcacgtcgtcgcctccaaggcgatgttcggctcgtgccgctacgtcgtcgaagacctgctgccgcgctacggcatcgagtcgacgctggtcgacggcctcgatctcgaccaatggcagcgtgcggtccggccgaacaccaagacgttcttcctggagagcccgaccaacccgaccctcgacgtgctcgacatcggcgcgatcgcggagattgcccatgcggcgggcgcgcgcctcgtggtcgacaacgtgttcgcaacgccgatctggcaaagcccgctgcagcttggtgccgacgtcgtggtttactccgccaccaagcacatcgacggacagggccgctgtctcggcggcgtggtgctgtcgtcgcaggcgttcatcgaagaacatatccagatgtatctgcgccagaccggcccgtcgctgtcgccgttcaacgcctgggtgctgctgaagggcctggaaacgctggcggttcgtgtcgagaagcagacctccaatgcggccgcgatcgccgatgcgctggccggccaaccgaaggtgccgcgcctggtatatccgggccgggcggatcacccgcaggccgcgacggtcaagaagcagatgggcgcaggctcgaccctggtcggcttcgaggtgaagggcggcaaggccgaagcgttccgcttcctcaatgccctcaagctggtgaagatcagcaacaatctcggcgacgccaagagcctcgttacccatccagccacgacgacgcatcagcggctgaagccggaagcgcgcgccgaactcggcatcagcgaaggcttcatccggttgtcggccggcctcgaacacaaagacgatctgatcgaggacctgctcgccgcgctcgacaaggtgtga

SEQ ID NO: 19055 - protein, 403 aa, Rhodopseudomonas palustris
MSESKPTIPVPATAHFRRETRLVHSGSLRSQFGETSEALFLTQGFVYESAEQCEARFTGDDAGFQYSRFSNPTVFSFEQRMAEFEGAEAARSTATGMAAVTAAMLAPLRAGDHVVASKAMFGSCRYVVEDLLPRYGIESTLVDGLDLDQWQRAVRPNTKTFFLESPTNPTLDVLDIGAIAEIAHAAGARLVVDNVFATPIWQSPLQLGADVVVYSATKHIDGQGRCLGGVVLSSQAFIEEHIQMYLRQTGPSLSPFNAWVLLKGLETLAVRVEKQTSNAAAIADALAGQPKVPRLVYPGRADHPQAATVKKQMGAGSTLVGFEVKGGKAEAFRFLNALKLVKISNNLGDAKSLVTHPATTTHQRLKPEARAELGISEGFIRLSAGLEHKDDLIEDLLAALDKV

SEQ ID NO: 19056 - DNA, 1305 bp, Rhodopseudomonas palustris
  CDS (1)..(1305)
atgcgcaacgagacgcttgccatccacgccggctacgagcccgacccgaccactcatgcggttgcggtgccgatctatcagactgcgtcctacgcattcgacagcgccgaccacggcgcggcgttgttcaatctcgagaccgaaggctatcgctactcgcggatcgccaatccgaccacaagcgtgctggaaaagcgcgttgctgagctggaaggcggcgtcggtgccctggcggtggcgagcgggcaggcagcgctgcatttcgccttcgtcaatctcgccgatcatggcggcaatatcgtctcggtgccgcagctctatggcaccacgcatacgctgctgtcgcacatcctgccgcgacagggcatcactggccgcttcgctgccagcgacaagccagacgacatcgccaagctcatcgatgagggcacccgtgcggtgttctgcgaaaccatcggcaatccggccggcaatgtctgcgacatcgaagcgatcgccgacgtggcgcatcgcgccggcgtgccgctgatcgtcgacaatacggtggcgacgccgatcctgttcaagccgatcgcgtatggtgccgatgtcgtggtgcactcgctcacgaagttcctcggcggccacggtaccacgctcggcggcgccatcgtcgacagcggccggttcgattgggccaagcagccggagcgttttccggctttcaaccagccggaccactcctatcacggcatggtctatgcggagcggtttgggccgaccgcttacgtcgagcgtgcgcggtcgatctatcagcgcaccatgggatctgtgctgtcgccgtttaacgcctttctgctgctgcagggcatcgagacagtcgcgttgcggatggagcgccacgtcgagaacgcccgcaaagtcgccgaattcctgcgcgacgatccgcgcgttgcctgggtcaattacaccggcttcccggacagcccgtattatccgctggtgcagaagtatctcgacggccgcgcgtcgtcgctgttcaccttcggcatcaagggaggcatggaagccggcaaggcgttctacgattcgctcaagctgatcacccggctggtgaacataggtgacgccaagtcgctcgcgtgccacccggcgtcgaccacccatcgccagatgtcggctgagcagcagcgtcaggccggagttttgccggagacgatccggctttcgatcggcattgaacacatcgccgacatcatcgaggatctcgatcaggcgctcgcgcaagcctgcggttcgcagccgcgtctggcggcggccgaatag

SEQ ID NO: 19057 - protein, 434 aa, Rhodopseudomonas palustris
MRNETLAIHAGYEPDPTTHAVAVPIYQTASYAFDSADHGAALFNLETEGYRYSRIANPTTSVLEKRVAELEGGVGALAVASGQAALHFAFVNLADHGGNIVSVPQLYGTTHTLLSHILPRQGITGRFAASDKPDDIAKLIDEGTRAVFCETIGNPAGNVCDIEAIADVAHRAGVPLIVDNTVATPILFKPIAYGADVVVHSLTKFLGGHGTTLGGAIVDSGRFDWAKQPERFPAFNQPDHSYHGMVYAERFGPTAYVERARSIYQRTMGSVLSPFNAFLLLQGIETVALRMERHVENARKVAEFLRDDPRVAWVNYTGFPDSPYYPLVQKYLDGRASSLFTFGIKGGMEAGKAFYDSLKLITRLVNIGDAKSLACHPASTTHRQMSAEQQRQAGVLPETIRLSIGIEHIADIIEDLDQALAQACGSQPRLAAAE

SEQ ID NO: 19058 - DNA, 1209 bp, Rhodopseudomonas palustris
  CDS (1)..(1209)
atgaccaatgcagcgaagcaatggggcccggctacctgggccctgtatatgggtgagcaacaccgccaggtcggagatccggtgacgcccggccctgctctcagtgcgagctttctcaccgcgcccaacgcagtcggcttctccgccaacgacctcggtgccgccgcgccgcatttctacacaagatggagcaatcccaccgtcgagctgctggaggcgcggctggcggcgctcgatgccggcgaagccgcggtgacattcgcgtccggcatggccgccgtggccgcgttgttttccgaccgcctccatgccggcgaccatctggtgctgtccgacgtctgctacgccggcgtcgccgaactcgcccatgatgagctcactcgcaatggcatcgcggttacgaccgtggattcgtcgaagcccgaggcgatcgcggccgcgcttcgtcccaacacccggctggttcatatcgaaacgccggccaatccgatcctgcgcctcgccgacatcgccgcgattgctccgctcgtgcacgcggccggcgccgaattgtcggtcgacgcaacgatcgcgactccgctgggtctacggccactcgaactcggagccgactacgtcgtccactcgctgaccaaatacatctgcggtcacggcgacacgctcggcggcgcggtgatcggacgagccgaggcgatcgcgcgactgcgccgcggcagcctgatccacctcggcggctgtttggcgccgttctcggcgtggttgatcctacggggtctcgagacactcgcgccgcggatgcggctgcacgaggccaacgcaagagccgtcgaagcgcttctcgccaaccacccgaaggtgaaggcggtctactggcccgggtcgcctcgccatccgcagcacgagctggcgcaacgaaccatgcgttgcttctcaggcctgctctcgtttacagtgaatggcgacggaccggcattggccgagcaactcgccgagcggatgcgcgtcgtctcctacgcggtctcgctcggcaagaccaagagcctgctggtctacatcccgaccgaggacattttgcgctcgtcgttccgactgaccggcgacgcggcggcgagttatcgcgcctgggccggcgacggtgtctttcggctgtcagtcggcatcgaggattccgctgatatcatcgcagatctcgagaccgcactcggatga

SEQ ID NO: 19059 - protein, 402 aa, Rhodopseudomonas palustris
MTNAAKQWGPATWALYMGEQHRQVGDPVTPGPALSASFLTAPNAVGFSANDLGAAAPHFYTRWSNPTVELLEARLAALDAGEAAVTFASGMAAVAALFSDRLHAGDHLVLSDVCYAGVAELAHDELTRNGIAVTTVDSSKPEAIAAALRPNTRLVHIETPANPILRLADIAAIAPLVHAAGAELSVDATIATPLGLRPLELGADYVVHSLTKYICGHGDTLGGAVIGRAEAIARLRRGSLIHLGGCLAPFSAWLILRGLETLAPRMRLHEANARAVEALLANHPKVKAVYWPGSPRHPQHELAQRTMRCFSGLLSFTVNGDGPALAEQLAERMRVVSYAVSLGKTKSLLVYIPTEDILRSSFRLTGDAAASYRAWAGDGVFRLSVGIEDSADIIADLETALG

SEQ ID NO: 19060 - DNA, 1197 bp, Rhodopseudomonas palustris
  CDS (1)..(1197)
atggacgcctccgactccagcgggacacccgcgccgctcagcacgcagacccgcctcgtcaccgcggggcgcgacactgcggcgcagaagggcttcgtcaatcctccggtggtgcacggttcgacggtgctgtatccgaccgcggccgacctgcacgcccaccgcggcgagtactcctatggacggcacggtaccccaaccaccaaggcgctgcagcaggcgttgatcgcgcttgaaggtccgcagtgtgccggcgtcggcatcaccccctccggcgtgtcggcgatctcgaccgccctgctcgccgtggtcaaagccggcgatcatgtgctggtctgtgacaacgcctatcgcccgacccggctgttctgcgatcagatgctgaatcggctcggcgtcgagaccagttatttcgatccgctgatcggcgccggcatcgcgtcgcatcttcggccgaacaccgtggcagtggtggtcgaggcgccgggatcgcagtcgttcgagatgccggatatcccggcgatcgccgcggtcgccaagcagcacggtgcgctggtgatcgacgacaacacctgggcgacgccgctgtatcatcgctcgctggaacaaggcgtggatatctcgatccaggccgcgaccaaatatattggcggtcactccgacatcatgttcggcaccgtctcggccaatgcggcggcgtggccgaaggtgtcggaagcgatccggctgctcggcgtctgcgccggaccggacgatgtgttcctggcgctgcgcggcctgcgcaccctggaggtgcggctggcccgccactatcaggccggcctggacatggcgcgctggctcacggcgcgtccggaggtgcagcgcgtgctgcatcccggcctcgacaccgatccgggccatgcgatctggaagcgcgacttcaccggcgcatcgggcctgttctcgatcgtgctgcagccggcgccgcaggccgccgtcgatgcgctgctcgacaccgtgtcgctgttcgggatgggctattcctggggcggcttcgaaagcctggtgatcccgttcgactgcgcgtcataccggacggcgacgcaatggaacccgggcggcccggccctgcggctgcacatcggactggaatcgaccgacgatctgaaggcagatttggagcgcggcttcgccgccttcaacgccgcgcgctga

SEQ ID NO: 19061 - protein, 398 aa, Rhodopseudomonas palustris
MDASDSSGTPAPLSTQTRLVTAGRDTAAQKGFVNPPVVHGSTVLYPTAADLHAHRGEYSYGRHGTPTTKALQQALIALEGPQCAGVGITPSGVSAISTALLAVVKAGDHVLVCDNAYRPTRLFCDQMLNRLGVETSYFDPLIGAGIASHLRPNTVAVVVEAPGSQSFEMPDIPAIAAVAKQHGALVIDDNTWATPLYHRSLEQGVDISIQAATKYIGGHSDIMFGTVSANAAAWPKVSEAIRLLGVCAGPDDVFLALRGLRTLEVRLARHYQAGLDMARWLTARPEVQRVLHPGLDTDPGHAIWKRDFTGASGLFSIVLQPAPQAAVDALLDTVSLFGMGYSWGGFESLVIPFDCASYRTATQWNPGGPALRLHIGLESTDDLKADLERGFAAFNAAR

SEQ ID NO: 19062 - DNA, 1173 bp, Rhodopseudomonas palustris
  CDS (1)..(1173)
atggataagaccaccaacctgcggcagcgcggggccaatacccgcgcggtgcacggcggccagcatttcgatccggcgaccggtgcggtgacgaccccgatctacgccacctcgaccttcgtccagtcggcgccgggcgtgcacaagggctacgaatacgcgcgctcgcagaacccgacgcgcgccgcgttcgaggccgcgatcgccgacgccgagcgcggccacgccggcttcgctttcgcctccggcctcgcggccgaggctgcgctcttggaaatcgccgggcagggcagtcacatcgtcgcgtcggacgacctctatggcggaagctggcggctgttccatcgggtgcgcagccattcggccggcctgacgatcacccatgtcgatccggccaatctcgacgcgctgcgcgacgccatccagccgaacacagccttcatctggatcgagacaccgagcaacccgacgctgcgcctcgccgatctcgaagcgatcgcggcgatcggccgcgaacgcggcgtgctgaccgtggtcgacaacactttcgcttcgccggcggtgcagcgcccgctggagcacggcatcgacatcgtggtgcattctgtgacgaagtacatcggcggccattccgacatcgtcggcggcgcgatcgtggtgcgtgatccggatttggcgcagaagctgcaattcctgcagaacgccacgggaggcatcctcgatccgttctccagcttcctggcgctgcgcggcatcaagacgctgccgctgcgggtgcaacgccacagttcgaatgcgctggcggtcgcccgctggctcgacgcccatcccaagatcgagcgagtggtctatcccgggctcaacagtcatccgcagcacgcgctcgcggtgcgccagatggatggcggcggcggcatggtggcagcttatctgaaggccgacgagcagcaggtcgtcgatgtgctgagccgcttcaggttgttcgcgctggcggaaagtctgggcgccgtggagagcctggtcgggcagccgtggaccatgagccatggctcgctgccggaagccgatcggctggcgcgcgagatcacgcctaatctgatccggctgtcgatcggtatcgaagacgtcgaggacttgaccgacgatctcgagcaggcgctgtccatcctgtga

SEQ ID NO: 19063 - protein, 390 aa, Rhodopseudomonas palustris
MDKTTNLRQRGANTRAVHGGQHFDPATGAVTTPIYATSTFVQSAPGVHKGYEYARSQNPTRAAFEAAIADAERGHAGFAFASGLAAEAALLEIAGQGSHIVASDDLYGGSWRLFHRVRSHSAGLTITHVDPANLDALRDAIQPNTAFIWIETPSNPTLRLADLEAIAAIGRERGVLTVVDNTFASPAVQRPLEHGIDIVVHSVTKYIGGHSDIVGGAIVVRDPDLAQKLQFLQNATGGILDPFSSFLALRGIKTLPLRVQRHSSNALAVARWLDAHPKIERVVYPGLNSHPQHALAVRQMDGGGGMVAAYLKADEQQVVDVLSRFRLFALAESLGAVESLVGQPWTMSHGSLPEADRLAREITPNLIRLSIGIEDVEDLTDDLEQALSIL

SEQ ID NO: 19064 - DNA, 1185 bp, Rhodopseudomonas palustris
  CDS (1)..(1185)
atgaccgaatcgtcccactcgcccggctttgccaccaccgcgatccaccacggctacgacccgctggcgcatcacggtgcgctcaacccgccgctgttcctgacctcgacctacgcgttcgccagcgccgctgagggcgcggcgcggttcgccggcgaggccgaaggcttcgtgtattcgcgggtcggcaatccgacggtggcggtgctggagagccgactggcggcgctggaaggcggcgaggccgcgctcgccaccgcctcgggcgtcggggccctgacggcgctgatctggacgctgctgaagacgggcgacggcatcatcgccgaccagatgctgtacggctgcaccttcggtctgttcgagcatcatctgccacggttcgacatcgaggtggtgttcgccgatctcaccgatccggccaatctgcaggccgcgctgcggccgaatacccgcttggtgttcaccgagaccccgaccaatccgaacatgcggctggtcgacatcgccgcctgcgccgagatctgccggcgcgccgacgctcgcctcgtcgtcgacaacacctactgcacgccctatctgcagcgcccgctcgatctcggcgcagatctcgtcacccattcggcgacgaagtatctcggcggccatggcgacctgctcgccggcgcggtggtggggccgaaggagatcatcgatcaggtccgcttcgtcggcgttaaggagctgaacggtgcctgcatctcggcgttcgacgccttcctgatcctgcgcggcctgaagacgttgaacctgcggatggatcgccacagcgccaccgccgtaaagctcgcgcacgatctcgaagcgcatcccgccgtcgccgctgtgtactaccccggtctcgacagccacaagcagcgcaacctcgcgcagcggcagatgcgccagcccggcggcatgatcgcactcgagctcagaggcggattagcagccggccgcagcttcatggacaaggtgaagctggcgacgcgagcggtcagtctcggcgacgccgagaccctgatccaacacccggccagcatgacccacgcgacctacgatccggccgaacgcgcgcggcacggatttacggacggactgatcaggatctcagtgggactggaggattatgaggatctgaaacaggacttgcttggggcgctatga

SEQ ID NO: 19065 - protein, 394 aa, Rhodopseudomonas palustris
MTESSHSPGFATTAIHHGYDPLAHHGALNPPLFLTSTYAFASAAEGAARFAGEAEGFVYSRVGNPTVAVLESRLAALEGGEAALATASGVGALTALIWTLLKTGDGIIADQMLYGCTFGLFEHHLPRFDIEVVFADLTDPANLQAALRPNTRLVFTETPTNPNMRLVDIAACAEICRRADARLVVDNTYCTPYLQRPLDLGADLVTHSATKYLGGHGDLLAGAVVGPKEIIDQVRFVGVKELNGACISAFDAFLILRGLKTLNLRMDRHSATAVKLAHDLEAHPAVAAVYYPGLDSHKQRNLAQRQMRQPGGMIALELRGGLAAGRSFMDKVKLATRAVSLGDAETLIQHPASMTHATYDPAERARHGFTDGLIRISVGLEDYEDLKQDLLGAL

SEQ ID NO: 19066 - DNA, 1158 bp, uncultured bacterium 578
  CDS (1)..(1158)
atgaaagataacaagtttaatacaaaagcgatccgtgagggatatcaaccaactcaagagcaggaacattcagctgctattttcctgacctcaagcttcaggtttgatagtgctgagcaagcagctaaaaggtttgacaataaagatcagggcaacgtatattcaagatttactaatccaagcgttgtcgcctttgaagagaaattagctgtcctagaaggggccgagcaatgcctcgctactgctagcggtatgtcagctatttttgcaacaattatgacactcctcaagccaggcgaacatatggttgcatcacgtggaatgtttggaaccaccatagttcttcttaataccattatccaaaagtttaatatcgaagtcacatttgttgacttgcctgacttaaatgactggaaaaatagtgttcaaactaatacaaaattatttatgcttgaaacgccctcgaacccacttggcgaggttgttgatttaagagcgctttcagcaatttctaaaaaaaataatattattttagcgattgataattgcattatgacgcctgcccttcaaaagccattagctttaggtgcagacttagttatccactcagcaactaaatacattgatggtcagggtcggtgtctcgctggtgctattgctgggaacaataaactgatagatgaaataagtagctttgcaagaagtacaggtccaactctaagtgcatttaatgcttggattatatttaaaggtcttgaaacgctaagcttgagaatgcaagcacactgtgagaatgcaaaaaaactagcagtatggcttaatgaacaagaatttgtcaaaaaggtacactatcttggattggactcgcaccctcatcatagtattgcgaaagaacaacagtctgattatggtggaattgtgtcattcgaagtaattggtggtaggaaagaggcttttcgtctaattaacaacaccaaaatgatttctattaccgcaaatcttggtgacactaagagcaccattacacatccagccactacaacccatgttagactttcagatgaagaaaaacaacaaagcaatatctctgaaaacctaattcgtatctcggttggattggaagatatcgaagatattattgctgatatcaagccataa

SEQ ID NO: 19067 - protein, 385 aa, uncultured bacterium 578
MKDNKFNTKAIREGYQPTQEQEHSAAIFLTSSFRFDSAEQAAKRFDNKDQGNVYSRFTNPSVVAFEEKLAVLEGAEQCLATASGMSAIFATIMTLLKPGEHMVASRGMFGTTIVLLNTIIQKFNIEVTFVDLPDLNDWKNSVQTNTKLFMLETPSNPLGEVVDLRALSAISKKNNIILAIDNCIMTPALQKPLALGADLVIHSATKYIDGQGRCLAGAIAGNNKLIDEISSFARSTGPTLSAFNAWIIFKGLETLSLRMQAHCENAKKLAVWLNEQEFVKKVHYLGLDSHPHHSIAKEQQSDYGGIVSFEVIGGRKEAFRLINNTKMISITANLGDTKSTITHPATTTHVRLSDEEKQQSNISENLIRISVGLEDIEDIIADIKP

SEQ ID NO: 19068 - DNA, 1278 bp, Rhizobium sp
  CDS (1)..(1278)
atgccctcgaaactggcaggccccctggccaaagccgagagccgcagcccgacgatggcccggccgcacactgccggccacccgagccttgcatgggaaaccctggcgctcgacggcggcctgacgatcgatcctgcgacgaaggcgatcgcccccaatatatcgatgtcggtcaacaacctgctggtccccggcgacggcgccttttcggccgacggcgtcgaggatctgacagcgctgcccttcctctacgcgcgctggaccaatccgacggtgcggcagctcgagctgcgaatggccgcgctcgaaggcgccgacgatgcgctggcgaccgcgaccggcgtcgccgcgatcgccgccaccttcctgacctgcctgaaaaggggcgatcacctgatcatcagcgatgtctgctacgcgggcgccaacgagctggcgcggcggatgttgcccgactacggcatcgaggtgaccgcggtgaacatgtcgcgcctcgacgaggtcgccgcggcgttccggcccaacacgcggctcgtccattgcgaaagcccctgcaacccgatcctgcggttgaccgatctttcggcggtagcggcgctcgcacatcggcacggggcattggtttcggtcgattccactctggcaacgccggttgcgacccggccacttgcgctcggcgtcgacctcgtcattcactccctgacgaagttcatcaatggccacggcgatgcgcttggcgggatcgtttgcggccgcaaggaactcgtcgagaagatccgatcgcgcgccggcgtctatctcggcgcttcgctctcggcccagaatgcctggcttatcatgcgcggcatcgatacgctcttcccgcggctcaaggcgatgtccgattcggcaatgcggattgcccatttcctccgcgatcatccgggcgtcagatcggtcacctaccccggtctggagacgcatccccagcatgcgctggcaagacgtcagatgcgcatcttcggcggtatagtcacgttccagacggacgacccgcagaaaatcgcgctccggctcgccgaacggctgcgcgtcgtgcactacgccttctcgctcggccaccagcgcagcatcgtcgtgcttctcgatacgaaggaaatgatgaactcgacctatgggctggaaggcccgcagctcgatgactatcgcgccttcgccggcgacggcgtcttccggctttccgtcggcctcgagtcggtcgacgacatcatcgccgatctggatcgggcgctccgatga

SEQ ID NO: 19069 - protein, 425 aa, Rhizobium sp
MPSKLAGPLAKAESRSPTMARPHTAGHPSLAWETLALDGGLTIDPATKAIAPNISMSVNNLLVPGDGAFSADGVEDLTALPFLYARWTNPTVRQLELRMAALEGADDALATATGVAAIAATFLTCLKRGDHLIISDVCYAGANELARRMLPDYGIEVTAVNMSRLDEVAAAFRPNTRLVHCESPCNPILRLTDLSAVAALAHRHGALVSVDSTLATPVATRPLALGVDLVIHSLTKFINGHGDALGGIVCGRKELVEKIRSRAGVYLGASLSAQNAWLIMRGIDTLFPRLKAMSDSAMRIAHFLRDHPGVRSVTYPGLETHPQHALARRQMRIFGGIVTFQTDDPQKIALRLAERLRVVHYAFSLGHQRSIVVLLDTKEMMNSTYGLEGPQLDDYRAFAGDGVFRLSVGLESVDDIIADLDRALR

SEQ ID NO: 19070 - DNA, 1125 bp, Listeria monocytogenes str
  CDS (1)..(1125)
atggcaaagctgaaacaagagacgatagcagcgcaaattggaaatagaaaatgtgaaagaacgggtgctgtcaatatgccagtctacttctctacagcttaccagcatgccgatcttggagtgtcaacggggtatgattatactagaactggaaatccgacgcgagatgctttacaggaagcgctcgcggaactagaaaatggaacgcatgcttttgcaacgagttcagggatgagtgcgattcaacttgttttccagctttttaaaactggcgaacatattattagttcacaggatttgtacggggggacttttagatattttgaacagtttggtgcgcaatataatattggattttcgtattgggacggggcggagattgctgatttggagaaattagttcgtccggaaacgaaggcgatttttattgagacaccaacaaatcctttaatgcaggaaacagatattgcggctgtgtctgaatgggcaggtgcgcatgatttacttgtgattgtggataatacattttatacaccaattttacaacagccgttaactttgggcgcggatattgtgattcatagtgcgacgaagtatcttggtgggcataatgatgtgcttgctggggcggttattgtaaaagaggagcgacttgggaatttcttttttaatcagttaaatgcgacgggtgcagtgctatcgccatttgatagttggttattgattcgtggccttaagacgctggttttgcgtgtaagacaacatcaagcgaatgcagagaaaatcgcggcgtttttggaatcacatgaattggtggaggaagttcgttatccagggcgcggtgggatgattagtttctttattcaagatgcggcgctcgtatcgccacttttgaaagaacttgagttatttacttttgcggaaagtttaggcggggtggagagtttgattacttatccaacaacacaaacgcacgcagatattcctgaagagttgcggaattcttatggacttacagacaaattattgcgcatttcggttggaattgaagctagtgaagatttgattgctgatttatctaaggcactcgatgcggttttggaaggggtgagcgctcgtggctaa

SEQ ID NO: 19071 - protein, 374 aa, Listeria monocytogenes str
MAKLKQETIAAQIGNRKCERTGAVNMPVYFSTAYQHADLGVSTGYDYTRTGNPTRDALQEALAELENGTHAFATSSGMSAIQLVFQLFKTGEHIISSQDLYGGTFRYFEQFGAQYNIGFSYWDGAEIADLEKLVRPETKAIFIETPTNPLMQETDIAAVSEWAGAHDLLVIVDNTFYTPILQQPLTLGADIVIHSATKYLGGHNDVLAGAVIVKEERLGNFFFNQLNATGAVLSPFDSWLLIRGLKTLVLRVRQHQANAEKIAAFLESHELVEEVRYPGRGGMISFFIQDAALVSPLLKELELFTFAESLGGVESLITYPTTQTHADIPEELRNSYGLTDKLLRISVGIEASEDLIADLSKALDAVLEGVSARG

SEQ ID NO: 19072 - DNA, 1173 bp, Listeria monocytogenes str
  CDS (1)..(1173)
atggctaatgaatatgcgcaagatacggctgtgattaaagcgagcctcgggattgataaagagacaggtgcgcttaatacgccaattcatttatcgtctactttccatcagcatgactttgataattatcacgcttatgattatgcgagaagtgggaacccaacgagagaaaaagtggaacaagcgattgcggaactggaaggtggtacgaatggttttgcctttgctagtgggatggcggctgtttctgcagcgctctttactctttctaagggagaccattttattattgcgaaagatgtgtacggcgggacgtttcgtttggtggagcaagtgttgccacgttttgggattacgcatacttttgttgatacgacaaatattgacgaagttgcgaaggcatttcaagcgaatacgaaactgatttacttggaaacaccttctaatccgttgctgcatgtgacagatattcggactgttgcaaaacttgcgaaagcgaatgggtgttatacgtttgttgataatacatttttgacgccgttaattcaaaaaccgttagaattaggtgcagacttggttattcatagtgcgacgaaatttcttggagggcatagtgatattttggcggggctaattgtcaccaataatcctaatctggctgaagcagtgtactttttgcaaaattcgactggtggggttcttggagtgcaggattcgtggttgttattgcgcggactaaaaacactttctgtgcggatgaaggctgggacggaaacagcggagaaaattgcgctatttttaaatgcggagccagatgtggtggcagtgcattatccggggttaccttctcatgcgggttatgacattcaagtggaacaggcgacaagtggcggggccgttttatcgtttgatttaggcagtgaggaagctgtgcgagaactagtaacacatttggaattgccggtattttctgtgagtttgggcgcggtggagagtattctttcttacccggctaaaatgtctcatgcggctgttccggaagaggagcgtttggcgcaaggaattacgccaggattattacgtttttcagctggactagaagatgccgatgacttgattgctgatttaaaacaagcactttctttcattaagaagggaagtgttgcgaaatga

SEQ ID NO: 19073 - protein, 390 aa, Listeria monocytogenes str
MANEYAQDTAVIKASLGIDKETGALNTPIHLSSTFHQHDFDNYHAYDYARSGNPTREKVEQAIAELEGGTNGFAFASGMAAVSAALFTLSKGDHFIIAKDVYGGTFRLVEQVLPRFGITHTFVDTTNIDEVAKAFQANTKLIYLETPSNPLLHVTDIRTVAKLAKANGCYTFVDNTFLTPLIQKPLELGADLVIHSATKFLGGHSDILAGLIVTNNPNLAEAVYFLQNSTGGVLGVQDSWLLLRGLKTLSVRMKAGTETAEKIALFLNAEPDVVAVHYPGLPSHAGYDIQVEQATSGGAVLSFDLGSEEAVRELVTHLELPVFSVSLGAVESILSYPAKMSHAAVPEEERLAQGITPGLLRFSAGLEDADDLIADLKQALSFIKKGSVAK

SEQ ID NO: 19074 - DNA, 1179 bp, Bacillus cereus
  CDS (1)..(1179)
atgaaaaagaagcatatggagacagcgttaattcatcacggttatacatcagaggaatataaaggaagtttgacaccgcctttatttcaaacgtctacatttacatttgagactgcgcagcaaggagaagcgagttttgcgggagtggatccatcttatatttactcaagacttggaaatccaactgtgaaattatttgaagaacgtatggcggtgttagaaggaggagaagaagctcttgctttcggatctggtatggcagctatttccgcaacgttaattggttttctaaaagctggagatcatattatttgttcaaatggattatacggatgcacgtacggctttttggaagtgttggaagaaaaatttatgattacgcattcgttttgtgatatggagacagaggctgatatggaaaataaaattcgcccaaatacaaagcttattttcgttgaaacaccgattaatccgacaatgaaattaattgatttaaaacaagtgattcgggttgcgaagcgaaatggtttacttgtcattgttgacaatacgttttgttcaccttatttacaaagaccgcttgaacttggttgtgacgccgttgttcatagtgcgacaaaatatattggtggtcacggtgacgttgtagcgggtgtaacaatttgtaaaacgaaagcgttagctgaaaagattcgcccgatgcgaaaagatatcggcggtattatggcgccgtttgatgcgtggttattgttacgcggattaaagacactagcggtaagaatggaccgccattgtgataatgcagaaaaaattgtatcgtttctaaaaaatcatgatgcggtagaaggtgtttggtacccagaaggagagttagcatctcgccaaatgaaacgtgggggcggcgttatatctttttcaattaaaggtgggaaagaagagacgcaggcgtttattaatgaccttcactttattacaattgcggtaagtttaggagatacagaaacgttaattcagcatccggcaacgatgacgcacgctgcgattccagctgcgttaagacaagaaatgggcatttatgataatttaatacgtttatctgtcggtttagaatcttgggaggatatcgtttctgatttagagcaagcgttaaagaaaatatctactgttagtaatcaataa

SEQ ID NO: 19075 - protein, 392 aa, Bacillus cereus
MKKKHMETALIHHGYTSEEYKGSLTPPLFQTSTFTFETAQQGEASFAGVDPSYIYSRLGNPTVKLFEERMAVLEGGEEALAFGSGMAAISATLIGFLKAGDHIICSNGLYGCTYGFLEVLEEKFMITHSFCDMETEADMENKIRPNTKLIFVETPINPTMKLIDLKQVIRVAKRNGLLVIVDNTFCSPYLQRPLELGCDAVVHSATKYIGGHGDVVAGVTICKTKALAEKIRPMRKDIGGIMAPFDAWLLLRGLKTLAVRMDRHCDNAEKIVSFLKNHDAVEGVWYPEGELASRQMKRGGGVISFSIKGGKEETQAFINDLHFITIAVSLGDTETLIQHPATMTHAAIPAALRQEMGIYDNLIRLSVGLESWEDIVSDLEQALKKISTVSNQ

SEQ ID NO: 19076 - DNA, 1134 bp, Bacillus cereus
  CDS (1)..(1134)
atgagagcaaagacaaagttaattcatggtattcgcataggagaaccttcaactggatctgtaaatgtaccgatttatcaaacgagtacgtacaaacaagaagcagttggtaagcatcaaggatatgaatattcacgtacaggcaacccaacacgtgcagctttagaagaaatgattgcggtattagaaaacggccatgctggtttcgcatttggttcaggaatggcggctattacagctacgattatgttgttctcaaaaggtgaccacgttattttaacagatgatgtgtatggcggaacgtaccgcgtgattacgaaagtattaaaccgtttcggtattgagcatacatttgtagatacaacaaacttagaggaagttgaagaagcgattcgtccaaatacgaaagcgatttatgtagaaacaccaacgaatccgttactaaaaattactgatattaaaaaaatatctactcttgctaaagagaaagatttattaacaattattgataacacattcatgacgccatattggcagtcgccgatttctttaggagcagacattgtacttcatagtgcaacgaaatatttaggaggtcatagtgacgtagttgcaggtctagtagttgtaaatagcccgcaattagcagaagaccttcactttgtacaaaactcaacaggcggcattcttggcccgcaagatagtttcttactacttcgtggtttaaaaacattaggaattcgaatggaagagcatgaaacgaattcacgtgcaattgctgagtttttaaataaccacccaaaagtaaataaagtatattacccaggccttgagtcacatcaaaaccatgaactggcaacagaacaagcaaatggatttggtgctattatctcatttgatgtagatagcgaagaaacattaaataaagtgcttaagaaattacaatactttacgctggctgaaagtttaggagcagtagaaagtttaatttctatcccctctcaaatgacgcatgcatcaatcccagcagatcgtcgcaaagaattaggaattacagatacattaattcgaatttctgtcggtattgaagacggagaagatttaattgaagatttagcacaagcgttagcgtag

SEQ ID NO: 19077 - protein, 377 aa, Bacillus cereus
MRAKTKLIHGIRIGEPSTGSVNVPIYQTSTYKQEAVGKHQGYEYSRTGNPTRAALEEMIAVLENGHAGFAFGSGMAAITATIMLFSKGDHVILTDDVYGGTYRVITKVLNRFGIEHTFVDTTNLEEVEEAIRPNTKAIYVETPTNPLLKITDIKKISTLAKEKDLLTIIDNTFMTPYWQSPISLGADIVLHSATKYLGGHSDVVAGLVVVNSPQLAEDLHFVQNSTGGILGPQDSFLLLRGLKTLGIRMEEHETNSRAIAEFLNNHPKVNKVYYPGLESHQNHELATEQANGFGAIISFDVDSEETLNKVLKKLQYFTLAESLGAVESLISIPSQMTHASIPADRRKELGITDTLIRISVGIEDGEDLIEDLAQALA

SEQ ID NO: 19078 - DNA, 1164 bp, Bacillus cereus
  CDS (1)..(1164)
atgagttattctatagatacactcttactgcacaaccaatataaacatgactcgcaaacaggagctgttaacgttcccatctataacacatcaacatttcaccaatttgatgtagatacgtttgggaaatatgactatagcaggtcaggaaatccaactcgtgaagctcttgaagacatcattgctttattagaaggcggaacaaaaggatttgccttcgcatcaggaattgcagcgatttctactgcattcctcctcctttcacaaggtgatcacgtactcatttcagaagacgtatacggagggacttatcgaatgataactgaagttctctcccgttacggtgtttcacatacatttgttgatatgaccaatttagaagaaataaaacaaaacattaagccaaatacaaaactcttttatgtagaaacaccttccaatccacttttaaaagtaacagatattcgcgctgtttctaaacttgcaaaatctattggcgcccttacttttgttgataatacatttttgacaccactattccagaaaccaattgaccttggcgctgatgtcgttcttcatagtgccacaaaattcattgccggtcatagtgatgttactgccggattagcagttgtaaaagataccgatctcgctcaaaaacttggctttttacaaaattcattcggcgctattctaggcccgcaagattgttctctcgtacttcgtggtctaaaaacattgcatgtacgtcttgagtattcagctgctaatgccaataaaattgcacactatttacaagagcacgctaaagttcaaaatgtctattatccaggattacaaacacatcttggatttaacattcaacaatctcaagctacatcagcaggagctgtcctatctttcactttacaatcagaagacgcactccgccaatttttatcaaaagtaaaattacctgtctttgcggttagtttaggggctgtcgaatcgatcctttcctacccagctaaaatgtcacatgcagcactatcgcaagaagctcgtgatgaaagagggatttcaaattcattacttcggctatccgtcggtcttgaaaatgttgacgatttaatatccgattttgaaaatgccctttcttatgtagaagaacctgtaaatgcatag

SEQ ID NO: 19079 - protein, 387 aa, Bacillus cereus
MSYSIDTLLLHNQYKHDSQTGAVNVPIYNTSTFHQFDVDTFGKYDYSRSGNPTREALEDIIALLEGGTKGFAFASGIAAISTAFLLLSQGDHVLISEDVYGGTYRMITEVLSRYGVSHTFVDMTNLEEIKQNIKPNTKLFYVETPSNPLLKVTDIRAVSKLAKSIGALTFVDNTFLTPLFQKPIDLGADVVLHSATKFIAGHSDVTAGLAVVKDTDLAQKLGFLQNSFGAILGPQDCSLVLRGLKTLHVRLEYSAANANKIAHYLQEHAKVQNVYYPGLQTHLGFNIQQSQATSAGAVLSFTLQSEDALRQFLSKVKLPVFAVSLGAVESILSYPAKMSHAALSQEARDERGISNSLLRLSVGLENVDDLISDFENALSYVEEPVNA

SEQ ID NO: 19080 - DNA, 1212 bp, Wolbachia pipientis wMel
  CDS (1)..(1212)
atgaaggaagagtctatattagttaaagcaggaagaaaatttaatgactataaaggttccatgaacccgccagtttatcattcttctaccatattattccctacttacaaggactacttaaatgcagcaaatggagaaagtatatacgatgtaatcaacgatggtgttgcaagggattatagctacagtaatgttggtactcctactgttcattatctttcaaatgcactggctgaaattgaagggagtggacaagcgcttatttatccttccggactatttgcacttacttttgctattctaactttcgctaaagcaggctcgcacgttttaattcaagataatagttattataggcttaggaggtttgcagaaaatgagctaccaaaaagaggaacagaagtaactttttatgatccaacacaggatataactgatttaattcagagtaatacttcattgataatgatcgagactcctggttctgtaacgtttgagatttcgaatatagagcatatagtaaaagttgctaaggaacataaaattgtgaccgtttgtgacaattcatgggccactcctttgttatttaagccgcttgattatggagttgatgttgcactatatgcggtgacaaagtatctagccggtcactcagatttagtgatgggggctattattgctgaaggtgaaatttttaaattgctttatgagagctataaaaattatggggtaaccattcaatcgcacgactgctaccttgcacataggggacttagaacattgtacacacgtatgaaaaggcaccaaaatacagcaatggaagtggcaaagtggctagaaaaacattcaaaaatcaaaaaagttttgtatccagcacttcccttccatcctcaacacgaattatggaaaagttacttcaaaggagcaagcggcacattcagtatagcactagatagagaatattcatgtgaagaactaagctgcatggttgatcacatgaaaatttttggtatcggtgcttcttggggaggatgcgacagtttgatattaccaatagatcgtagatctatgtcaagatctgtaatgaattcagattatggtggaagttttatacggatattttgtggactggaagatcctgaagatttaatctctgatttaaatgctgcactagcaaggttgccatgtttgaacactaaaactggcagatga

SEQ ID NO: 19081 - protein, 403 aa, Wolbachia pipientis wMel
MKEESILVKAGRKFNDYKGSMNPPVYHSSTILFPTYKDYLNAANGESIYDVINDGVARDYSYSNVGTPTVHYLSNALAEIEGSGQALIYPSGLFALTFAILTFAKAGSHVLIQDNSYYRLRRFAENELPKRGTEVTFYDPTQDITDLIQSNTSLIMIETPGSVTFEISNIEHIVKVAKEHKIVTVCDNSWATPLLFKPLDYGVDVALYAVTKYLAGHSDLVMGAIIAEGEIFKLLYESYKNYGVTIQSHDCYLAHRGLRTLYTRMKRHQNTAMEVAKWLEKHSKIKKVLYPALPFHPQHELWKSYFKGASGTFSIALDREYSCEELSCMVDHMKIFGIGASWGGCDSLILPIDRRSMSRSVMNSDYGGSFIRIFCGLEDPEDLISDLNAALARLPCLNTKTGR

SEQ ID NO: 19082 - DNA, 1206 bp, Treponema denticola
  CDS (1)..(1206)
atgaatagaaaagaattggaaaagttgggatttgcttcaaaacagattcacgcaggaagcattaagaacaagtacggtgctttagctacacctatttatcaaacttcaacatttgcatttgattcggcagaacaaggcggcagaagatttgccttagaggaagaaggttatatctacacccgtttaggtaaccctacgactacggttgttgaagaaaaacttgcctgccttgaaaacggggaagcctgtatgtccgcgagctccggtataggtgccgttacctcatgcatttggtcaattgtaaatgcaggagaccatatcgttgccggaaagactctttacggctgtacatttgcgtttttaaatcacggtctgtcacgattcggtgttgatgtaaccttcgttgatacccgtgatcctgaaaacgttaaaaaagctttaaaaccgaatacaaaaatcgtttatttggaaacgccagccaacccgaacatgtatctttgcgacattgcagcagtaagtaaaattgcccatgctcataatcccgaatgtaaggtaatagtagataatacttatatgactccctatcttcaaaggcctcttgatttaggtgcagacgtcgttcttcattctgcaacaaaatacctaaacggccatggagacgttattgcaggttttgttgtcgggaaaaaagaattcatcgatcaggtacgctttgtaggtgttaaggatatgacaggttctacattaggtccatttgaagcttacttaataggccgaggtatgaagaccctcgatatccgaatggaaaagcactgcgccaatgctcaaaaagttgcagagttcttggaaaaacatccggcagttgagtccatcgccttccccggtcttaaatccttcccgcaatatgagcttgcaaaaaaacagatgaaactttgcggagctatgattgcctttaccgttaagggcggattggaagccggtaaaacccttataaactcggttaaatttgcaaccattgcagtaagcttaggcgatgccgaaacccttattcagcatcctgcaagtatgacccactctccgtatacccctgaagaaagagccgcttcggatattgccgaaggtttggtacgtctttctgtcggtcttgaagatgcggaagatattattgccgatttaaaacaagccttggataaacttgttaaataa

SEQ ID NO: 19083 - protein, 401 aa, Treponema denticola
MNRKELEKLGFASKQIHAGSIKNKYGALATPIYQTSTFAFDSAEQGGRRFALEEEGYIYTRLGNPTTTVVEEKLACLENGEACMSASSGIGAVTSCIWSIVNAGDHIVAGKTLYGCTFAFLNHGLSRFGVDVTFVDTRDPENVKKALKPNTKIVYLETPANPNMYLCDIAAVSKIAHAHNPECKVIVDNTYMTPYLQRPLDLGADVVLHSATKYLNGHGDVIAGFVVGKKEFIDQVRFVGVKDMTGSTLGPFEAYLIGRGMKTLDIRMEKHCANAQKVAEFLEKHPAVESIAFPGLKSFPQYELAKKQMKLCGAMIAFTVKGGLEAGKTLINSVKFATIAVSLGDAETLIQHPASMTHSPYTPEERAASDIAEGLVRLSVGLEDAEDIIADLKQALDKLVK

SEQ ID NO: 19084 - DNA, 1167 bp, Mycobacterium paratuberculosis
  CDS (1)..(1167)
atgagcgacgacggcaacgcacaccccgagttcagcggactggccaccaaggcgattcacgccggctaccggccggacccggcgaccggagcggtcaacacgccgatctacgccagcagcaccttcgcccaggacggggtgggcgcgctgcgcggcgggtacgagtacgcccgcaccggcaacccgacccgggccgcgctggaggccacgctggccgcggtggaggccggcagccacgggcgggccttcgcctccggcatggccgccaccgactgcgcgctgcgggcggtgctgcggcccggcgaccatgtggtgatcccgaatgacgcctacggcggcacctttcggctgatcgacaaggtgttcactcgctggaacgtcgaatacacgccggtgccgttgcatcagctcgacgccgtggccgccgcgatcacgccgcgcacccggctgatctgggtggagaccccgaccaacccgttgctgtcgatcgccgacatcgccgcgctggcccagctgggccaccagcactcggcaaaggtgttggtggacaacacctttgcctcgccggcgctgcagcagccgttgacgctgggcgccgacatcgtgctgcattccaccaccaagtacatcggcgggcactccgacgtggtgggcggtgcgctggtcaccaacgacgccgagctggacgacgcgttcgggttcttgcagaacggggcgggcgcggtgcccggcccgttcgacgcctacctgaccatgcgcgggctgaagaccctggtgctgcggatgcagcggcacaccgaaaacgcctctgccgtagcgcaattcctcgccgggcaccccgcggtgagcgcggtgctctatcccggcctgcccggccatccgggccacgacgtcgccgcccggcagatgtcgggcttcggcggcatggtctcggtgcggatgcgcggcggccggcaggccgcccgaaagctgtgcgccaacacccgggtgttcatcctggccgagtcgctgggcggggtcgagtcgctgatcgagcaccccagcgcgatgacgcacgcgtcgacggcggggtcgcaactggaggtgcccgacgatctggtgcggctgtcggtcggcatcgaggacgtcgacgacctgctggccgacctcgaccgggcgctcagttga

SEQ ID NO: 19085 - protein, 388 aa, Mycobacterium paratuberculosis
MSDDGNAHPEFSGLATKAIHAGYRPDPATGAVNTPIYASSTFAQDGVGALRGGYEYARTGNPTRAALEATLAAVEAGSHGRAFASGMAATDCALRAVLRPGDHVVIPNDAYGGTFRLIDKVFTRWNVEYTPVPLHQLDAVAAAITPRTRLIWVETPTNPLLSIADIAALAQLGHQHSAKVLVDNTFASPALQQPLTLGADIVLHSTTKYIGGHSDVVGGALVTNDAELDDAFGFLQNGAGAVPGPFDAYLTMRGLKTLVLRMQRHTENASAVAQFLAGHPAVSAVLYPGLPGHPGHDVAARQMSGFGGMVSVRMRGGRQAARKLCANTRVFILAESLGGVESLIEHPSAMTHASTAGSQLEVPDDLVRLSVGIEDVDDLLADLDRALS

SEQ ID NO: 19086 - DNA, 1287 bp, Geobacter sulfurreducens
  CDS (1)..(1287)
atgtccgacatccaaaaaggcttcgataccctcgcactccacgccggccaggatccggatcccacgacgctgtcgcgtgcggttcccatttaccagacctcttcctatgcgttccgcagctccgaacacgcggccaatctctttggtctccgggagttcggcaatatctacacgcggatcatgaatccgacctgcgatgtactggaaaagcgcctggcggaacttgacggcggagtgggcgcgcttgctctcgcctcggggcaggcggcaatcacgtatgcggtgcttaacatcgccggcgccgggcagaatatcgtctccaccagctatctctatggcggaacctacaacctcttccactatactctgccaagattggggatatcggtccggttcgtcgacacttctgaccctgaaaacgtccgtcgggccatggatgaaaacactcgcctggtctacaccgaatcggtagggaacccgaaaaacaatgtggacgacttcgagtccattgcccggatcgcccatgaggcgggaatcccgttcatagtggacaacaccgttaccactccgtacctgttcaggccttttgaccatggggccgacatcgccgtctattccctcaccaaattcatcggtggccacggtacgagcatcgggggggcggtggtagacagcggacgttttccctggaacaacggccggttccccgagttcacggaaccggatccctcctaccatggtttgcgctactgggaggccctggggaacctctcctacatcctcaagatgcggatcacgctcctgcgcgatatgggggcctgcctcgcgccgttcaacgcattcctcttcctccaggggctggagaccttgccggtgcgcatggcacgccacgttgacaacgcgcgtactgttgccgagtggctggagcggcatccactggtcacctgggtcaactatccgggcctgcccagccaccgggaccacgacaatgccggcaagtacctccccaagggcgccggtgccatcatcggcttcggagtcaagggagggctcgaggcgggcaagaagttcatcgacagcgtgaagctcctgtcgcatcttgccaacatcggcgacgccaagtccctcgtcatccacccggcatccaccacgcacgagcagctcaccgatgaagagcgtctctcggccggggtaacgccggatttcatccgcctttccgtcggcatcgaggatgtggccgacatcattgccgacatcgaccaggccctgcatgcctcccaatcctga

SEQ ID NO: 19087 - protein, 428 aa, Geobacter sulfurreducens
MSDIQKGFDTLALHAGQDPDPTTLSRAVPIYQTSSYAFRSSEHAANLFGLREFGNIYTRIMNPTCDVLEKRLAELDGGVGALALASGQAAITYAVLNIAGAGQNIVSTSYLYGGTYNLFHYTLPRLGISVRFVDTSDPENVRRAMDENTRLVYTESVGNPKNNVDDFESIARIAHEAGIPFIVDNTVTTPYLFRPFDHGADIAVYSLTKFIGGHGTSIGGAVVDSGRFPWNNGRFPEFTEPDPSYHGLRYWEALGNLSYILKMRITLLRDMGACLAPFNAFLFLQGLETLPVRMARHVDNARTVAEWLERHPLVTWVNYPGLPSHRDHDNAGKYLPKGAGAIIGFGVKGGLEAGKKFIDSVKLLSHLANIGDAKSLVIHPASTTHEQLTDEERLSAGVTPDFIRLSVGIEDVADIIADIDQALHASQS

SEQ ID NO: 19088 - DNA, 1137 bp, Geobacter sulfurreducens
  CDS (1)..(1137)
atgaaattcggcacccgcatcatccatacgggccgtgagatcgatccgaccaccggagcgctctcggttcccatttaccagacgtccacctatcggcaggaatcggtggaccatttcggcaagtacgattacgcccgctcggacaaccccacccgcgaggcccttgaggaaaccgtggcccagctggagaacgggacgcggggattcgccttcgcctcgggcatggccgccatctcctccacgctgctcctgttctcgcccggcgatcacctggtggtctgcgaggatgtctatggcggtaccttccgggcgctgacccagcttttcagccggctgggggtcgagtccaccttcgtggacgccacggacacggccgccattgaggcggccttccgcccgaacaccaagggcctctatctggagaccccctccaatccactcatgaagatcaccgacctggccgccgcggcccgcctggcccgggagaggggggccatcaccctggtggacaacacgttcatgactccctacctgcagcggcccctggacctgggctgcgacgtggtgctccacagcgggaccaagttcctgaacggccacagcgatgtggtctgcggctttgccgtggtgagggacccggagttggggcagcggatcaggttcatccagaatgccttcggcgccatcctgggcccccaggattcatggctcgtgctgcggggtatcaagaccctgcgggtccggatggaggaaagccaggccggggcggtcaaaattgccaactggctggctggggaaaaacgggtgagccgggttttctatcccggactccccgatcatccgggtcacgatatccatggccggcagtcgtcgggccccggcgcggtcctgtcgttcaccctggataccgttgaaaccacccgccgcctgctggaggggatgcgtctggctgcctttgccgtgagcctcggcggggtggaaagcatcatctcctatcccgccaggatgtcccacgcggccatgccgccggccgagcgggccgcccgggggatcggcgataccctggtacggctttccgtggggcttgaggacgccgacgacctcctggccgagatggaccgcctgatcaacggctga

SEQ ID NO: 19089 - protein, 378 aa, Geobacter sulfurreducens
MKFGTRIIHTGREIDPTTGALSVPIYQTSTYRQESVDHFGKYDYARSDNPTREALEETVAQLENGTRGFAFASGMAAISSTLLLFSPGDHLVVCEDVYGGTFRALTQLFSRLGVESTFVDATDTAAIEAAFRPNTKGLYLETPSNPLMKITDLAAAARLARERGAITLVDNTFMTPYLQRPLDLGCDVVLHSGTKFLNGHSDVVCGFAVVRDPELGQRIRFIQNAFGAILGPQDSWLVLRGIKTLRVRMEESQAGAVKIANWLAGEKRVSRVFYPGLPDHPGHDIHGRQSSGPGAVLSFTLDTVETTRRLLEGMRLAAFAVSLGGVESIISYPARMSHAAMPPAERAARGIGDTLVRLSVGLEDADDLLAEMDRLING

SEQ ID NO: 19090 - DNA, 1134 bp, Geobacter sulfurreducens
  CDS (1)..(1134)
atgaacatcgcgacgcaggcagcacagatcggtctcgactgggatacccgcaccggggcggtgacggtacccatctaccagacggcaaccttccggcatccgggattgggccagagcacgggctacgattattcccgctccggcaaccccacccgccaggccctggaagaggggatcgcccggctggacggcggcgccaggggatttgcctatgcctcgggcatggctgccatcgccaatctcctcctgctcttcaagagcggcgaccacctggtggtgaccgaggacctctacggcggcacctgccgtctcttcgaccagattctggtccagtacggcctctcgttcacctatgtggacacgagcgatcctgaggcggtgcgggacgccatccgtcccgagaccagggccctgttcgtggagtccctcaccaacccgctcctcaaggtcgccgatatcgcggccctctcgaccctctgccgcgagcgggggctgctttgtatcgtggacaacaccttcctcactccctatcttctgcggcccctggatctcggggccgacatcacggtctacagcggcaccaagtacctgtccgggcacaacgacacggtgtcggggctggtcgtggtcaaggagccggccctggccgagcgggtctacttcctccagaattccgtgggcgcagtgctggggccccaggatgcgtggctcaccatccgggggatgaagaccctgtcggtgcgactggaccgccagcaggaaaacgccggccggatcgccgaatggctggcgcggcatccgcgggtgccacgggtcttctatccggggctgccgggccatccgggccacgaactgctggcgcgccaggcccggggcttcggcgccatgatcgctttcgaggtggatgataaggctctggtggagcgtttgctcctcaagacggaattgatatcattcgcggaaagcctcggcggcgttgaaaccctgatcacctttccccaggttcagacccatgcggacatcccgccggaggttcgggagcggctcggcatcaatgacgtgctcctgcgcctttcggtggggatcgaggatgcggacgaccttatcgccgacctgtcccgggcattcgcgtaa

SEQ ID NO: 19091 - protein, 377 aa, Geobacter sulfurreducens
MNIATQAAQIGLDWDTRTGAVTVPIYQTATFRHPGLGQSTGYDYSRSGNPTRQALEEGIARLDGGARGFAYASGMAAIANLLLLFKSGDHLVVTEDLYGGTCRLFDQILVQYGLSFTYVDTSDPEAVRDAIRPETRALFVESLTNPLLKVADIAALSTLCRERGLLCIVDNTFLTPYLLRPLDLGADITVYSGTKYLSGHNDTVSGLVVVKEPALAERVYFLQNSVGAVLGPQDAWLTIRGMKTLSVRLDRQQENAGRIAEWLARHPRVPRVFYPGLPGHPGHELLARQARGFGAMIAFEVDDKALVERLLLKTELISFAESLGGVETLITFPQVQTHADIPPEVRERLGINDVLLRLSVGIEDADDLIADLSRAFA

SEQ ID NO: 19092 - DNA, 1242 bp, Yersinia pestis
  CDS (1)..(1242)
atgtccagatgtattgacgtccgtaatttgtgcgtctactctggcgtaacattttctcgatcccggctggtggaaatcaatatgacgcgtaaacaggcaacaatagcagtccgtagcgggttgaatgatgacgagcaatacggctgcgttgtccccccgattcacctttccagtacctacaattttattgattttaatcagccgcgcacgcatgactattcacgtcgtggtaatccaacgcgtgatgttgtccaacgggcgctggcggaattggaagggggggccggtgccgtcatgaccagcagcgggatgtcggcgcttcatttggtttgcactacattcttacagccgggcgatctgttggtcgctccgcatgactgttacggtggcagttaccgtttatttgacagcttgagcaagcgtggtgcgtatcgggtgttatttgttgatcagggcgatgaagcggcactaaactgcgcattggcggagaaaccgaagttggtcttgattgaaacaccgagtaatccattgctacgggttgttgatattgccgccatctgccaagccgcccgtgctgcgggcgcactgacggtttgtgataacaccttcctcagccccgccttacagcagcctctctctcttggggccgatttagtggtgcactcctgtaccaaatatctcaatggtcactctgatgtggtggctggtgctgttattgcgaaagatccagaactggttgtcgagctggcatggtgggcaaataatattggtgtaaccggtgctgcgtttgacagctatctactccttcgtggtttacgcacgttatcaccacgcatggctcaacagcagcgtaacgcggatgacattgtgcgttatttacagcaacagcctttagtgaaaaagctgtatcatccttccctgccacaacatcccggccacgaaatagcctgccgtcagcaatcaggttttggtgcaatgctcagttttgagctggatggtgatgagcaggtcatgcgccgtttcctttctgcccttgagctatttaccttggcagagtctttggggggggtagaaagcctgatctcccatgcagcgaccatgacccacgcgggtatggcggcagaggcgcgtattgccgcaggcattactgatagtttgttgcgtatttccgtgggtattgaagacagtgaagatttgattgctgatttggaccacgcgttccaattggcagtaacgaggtaa

SEQ ID NO: 19093 - protein, 413 aa, Yersinia pestis
MSRCIDVRNLCVYSGVTFSRSRLVEINMTRKQATIAVRSGLNDDEQYGCVVPPIHLSSTYNFIDFNQPRTHDYSRRGNPTRDVVQRALAELEGGAGAVMTSSGMSALHLVCTTFLQPGDLLVAPHDCYGGSYRLFDSLSKRGAYRVLFVDQGDEAALNCALAEKPKLVLIETPSNPLLRVVDIAAICQAARAAGALTVCDNTFLSPALQQPLSLGADLVVHSCTKYLNGHSDVVAGAVIAKDPELVVELAWWANNIGVTGAAFDSYLLLRGLRTLSPRMAQQQRNADDIVRYLQQQPLVKKLYHPSLPQHPGHEIACRQQSGFGAMLSFELDGDEQVMRRFLSALELFTLAESLGGVESLISHAATMTHAGMAAEARIAAGITDSLLRISVGIEDSEDLIADLDHAFQLAVTR

SEQ ID NO: 19094 - DNA, 1182 bp, Ashbya gossypii
  CDS (1)..(1182)
atgggtgttcttccgacagacaagtttgcaacgaaagctattcatgctggcgcacatactgacctacatgggtcggtcatcgagcccatctcgctttcgaccaccttcaagcagtcgagtcccggcaacccagtgggcgcctacgaatactctcgtggtcagaaccccaaccgtcagaacctagaggaagccattgctgcactcgagagcgcaaagtacgggttggctttctcctctggatccgcgaccacagccgtgatagtgcagtctctgccacaaggctcgcacgcgatctcgatcggcgatgtctatggtgggacccatcgctactttacaaaggttgccaatgcccatggtgtggagacctccttcacaaatagcctgcttgaggacctgcctaagctggtccgcgacaacactcgtctagtctggatcgagtctcccaccaaccccactctgcaggtcactgatatccagcaggttgcggacaccgtgaaggccttgaatgaggacattattctggttgtggacaacacattcctctccccatacctgtcgaacccgctcaacttcggtgctgacatcgtcatccattcggctacaaagtacatcaatggccactccgacgttgtgcttggtgctttagccacgaactccaccagtttatatgaacggcttgcattcctacaaaatgccattggcgccatcccatcgccgttcgacgcatggctgacacacagaggcctaaaaaccttgcacctgcgtgtgcgccaggctgctcagtctgctcagaaaattgctgagtacctggagcagtcagagcacgttgtgtctgttaactacccgggcctgccctcgcaccgcggctaccagattgctcagaaacagcacagagatggtttgggcggcggtatgatctcattccgtgttaagggcggcgcgcagggcgctgctctactttctcaatccaccagactatttactctagctgagtctctaggcggcattgagtccttgttggaggtccctgcggtaatgactcatgctggcattccgaaggaggccagagaggcttctggtgtctacgacgatctggtcagagtctccgtgggaattgaggacactgatgaccttctggaggacatcaagcaggcgctgagtgtagtcgctgaatctatctaa

SEQ ID NO: 19095 - protein, 393 aa, Ashbya gossypii
MGVLPTDKFATKAIHAGAHTDLHGSVIEPISLSTTFKQSSPGNPVGAYEYSRGQNPNRQNLEEAIAALESAKYGLAFSSGSATTAVIVQSLPQGSHAISIGDVYGGTHRYFTKVANAHGVETSFTNSLLEDLPKLVRDNTRLVWIESPTNPTLQVTDIQQVADTVKALNEDIILVVDNTFLSPYLSNPLNFGADIVIHSATKYINGHSDVVLGALATNSTSLYERLAFLQNAIGAIPSPFDAWLTHRGLKTLHLRVRQAAQSAQKIAEYLEQSEHVVSVNYPGLPSHRGYQIAQKQHRDGLGGGMISFRVKGGAQGAALLSQSTRLFTLAESLGGIESLLEVPAVMTHAGIPKEAREASGVYDDLVRVSVGIEDTDDLLEDIKQALSVVAESI

SEQ ID NO: 19096 - DNA, 1224 bp, Wolinella succinogenes
  CDS (1)..(1224)
atgaggggattcaccacgagggcgcttcatgttcccaaggccaagagagacgtccatggagcgcttcgcacgcccgtctatgataacgcggcgtttgagtttgaaaatagcgatgagatcgcccaagtttccttgggtagggcacttgggcatgtctatagccgctctagcaaccccacggtggaggatttggagcagcgcctcaagaatctcacgggagccttgggggtgttggcgctagggagtgggatggcagcgatctcaacggcgattttgaccttggcgagggcaggggatagtgtggtcaccaccgatcgtctctttgggcacaccctctcgctctttcaaaagacactgcctagctttggaatcgaggttcgttttgtggatgtgatggattctctagcagtggagcatgcctgtgatgagacaaccaagcttcttttcttggagaccatcagcaatcctcaacttcaagtggccgatctagaggctctctctaaagtggtgcacgccaaaggaatcccactagtggtcgatacgaccatgacccctccctatcttttggaggcaaaacgcttaggggtggacatcgaagtgctctcttcaaccaaattcatctcaggcggaggaacaagcgtgggaggagtcttgattgatcatggactttttgagtggaagagtctcccttcgctcgctccctattatgccaaggcggggccgatggctttcctctacaaggcgcgcaaggaggtgtttcaaaatctaggaccctcgcttagcccccacaacgcctatcttcaaagtttggggttggagacgatggcgcttcgaatcgagcgttcgtgtcaaaacgcccaagagcttgcgcattggcttttgtctatccctcaggtgaaatgcgtcaatcacccttcgctccctgattctcctttttatgcgattgctaagcgtcagtttcgctacgcaggctcgattctcacctttgagttggagagcaaggaggcctcctatcgcttcatggatgcgctcaagctcattcggcgcgccaccaatatccatgacaataaaagcctcatcctctccccctatcatgtcatctatgccctcaatagccacgaagagcgcttaaagcttgagatatctcctgcaatgatgaggctttctgtgggaattgaagagattgaagatctgaaagaggatattttgcaagcgctatgttaa

SEQ ID NO: 19097 - protein, 407 aa, Wolinella succinogenes
MRGFTTRALHVPKAKRDVHGALRTPVYDNAAFEFENSDEIAQVSLGRALGHVYSRSSNPTVEDLEQRLKNLTGALGVLALGSGMAAISTAILTLARAGDSVVTTDRLFGHTLSLFQKTLPSFGIEVRFVDVMDSLAVEHACDETTKLLFLETISNPQLQVADLEALSKVVHAKGIPLVVDTTMTPPYLLEAKRLGVDIEVLSSTKFISGGGTSVGGVLIDHGLFEWKSLPSLAPYYAKAGPMAFLYKARKEVFQNLGPSLSPHNAYLQSLGLETMALRIERSCQNAQELAHWLLSIPQVKCVNHPSLPDSPFYAIAKRQFRYAGSILTFELESKEASYRFMDALKLIRRATNIHDNKSLILSPYHVIYALNSHEERLKLEISPAMMRLSVGIEEIEDLKEDILQALC

SEQ ID NO: 19098 - DNA, 1167 bp, Vibrio vulnificus
  CDS (1)..(1167)
atgagtcaccgcaagccagctacgattgccgttagaacgggcatcgaatccgatactcaataccgtgccgttgtgccaccgatctatttgtcgacgaactatggtttctctgcctttggcgaagtgcctaaatacgactatacccgctcaggcaacccaaatcgtggcctactagagcaagtgttgtttgagcttgaatctggtaaaggtgcggtggtcacaaactgcgggacatcggcactcaacttgtgggtttctgcttttttaagccctgacgatcttattgtggcacctcatgattgttatggcggtacctaccgtcttttcaatactcgagcgaagaaaggggattttaaagtccgttttgtcgaccaatccgacagcgctgcactggatgcggcgttggcgcttaaccccaagctggtgttgcttgaaacgccttcgaacccgctagtgcgtgtggtggacatcgcggaagtgtgtgagaaagcccataaagtgggcgcgttggtggcggtcgataacacctttttgacaccggtgtaccaaaagcctttggagctgggggcagactttgtgattcactcgacaaccaagtacatcaatgggcattctgatgtgattggcggtgtggtgatcaccaaaaccgaagagcacgcaacagagcttgcgtggtgggggaactgccttggtgcaaccggcacgccatttgacagctatatgacgctgcgtggcatccgcacactgggggcacgtatgcgcgtgcatgaagaaagttcgcaacaaatcctttcttatctgcaaactcaagagttagtcggcgccatttatcacccgagtttgccagcgcattccggtcatgagattgccaaaaagcagcaatcgggctttggatcgatgttgagttttgaatttgtgggcagctttgagcaactgaaagtgtttgtgaaagcgctagatctgttttcattagcggaatcactcggtggtgtcgaaagtttggtttgtcatcctgcttccatgactcatcgtgcgatgggagaggaagcgctcgcagaagctggcgtgacgcaacagttattgcgtttatcggtggggctggaagatgcgcaagatctgattgccgacctcaagcaggcctttcaacaagctaaggagagctgttaa

SEQ ID NO: 19099 - protein, 388 aa, Vibrio vulnificus
MSHRKPATIAVRTGIESDTQYRAVVPPIYLSTNYGFSAFGEVPKYDYTRSGNPNRGLLEQVLFELESGKGAVVTNCGTSALNLWVSAFLSPDDLIVAPHDCYGGTYRLFNTRAKKGDFKVRFVDQSDSAALDAALALNPKLVLLETPSNPLVRVVDIAEVCEKAHKVGALVAVDNTFLTPVYQKPLELGADFVIHSTTKYINGHSDVIGGVVITKTEEHATELAWWGNCLGATGTPFDSYMTLRGIRTLGARMRVHEESSQQILSYLQTQELVGAIYHPSLPAHSGHEIAKKQQSGFGSMLSFEFVGSFEQLKVFVKALDLFSLAESLGGVESLVCHPASMTHRAMGEEALAEAGVTQQLLRLSVGLEDAQDLIADLKQAFQQAKESC

SEQ ID NO: 19100 - DNA, 1299 bp, Vibrio vulnificus
  CDS (1)..(1299)
atgtcggggatgtttttgctttgcaacccttgccaagcctatacgctccatgttttaaatagggcattctctcatagacaaggaattaacatgtcggaaggcaaacaaaccaagctggtcaccgctggacgcgataaaaaatggacaaatggcgtggtaaacccgccaattcaacgtgcgtcgacggtggtttttgacacagtggcagacaaacaccacgcgaccgtcaatcgagccaacaaaacacttttttacggccgtcgtggcactcatacccacttcgcctttcaagaagcgatgacacaaattgagggcggtgctggctgcgcactttacccatgtggcaccgccgccatttccaacgcgattctttccttcgtcgaaaccggtgatcacattctgatggtcgatacctgctacgaaccaactcgcgatttctgcgataagatcatgaaaaaaatgggggtagaaaccacctattacgatccgatggttggagaaggcattcgtgagctcatcaaacccaataccaaagtgctgtttttggaatctcccggctctattaccatggaagtgcaagatgtccctaccctcgcacgtattgcgcatgagcacggtatcatcgtgatgctggataacacgtggggtgccggtgtcaacttctcacctttcgagcacggagtagacatctcgattcaagcagcaacgaagtacatcgtcggccattcggatgtgatgctgggaaccgctgtcgcaagcgagccctattgggatcagttgcgtgagcaaagttatttgatgggacagtgcgtctcaccggatgacgcctaccttggtctgcgtggtctgagaacgattgatgtacgtttgcgtcaacacgaacaagccagcctaaaagtagcgcaatggctcgcaacccgaccagaagtggaccatgttcgccacccagcattggagagctgccctggtcacgagttttttaaccgtgatttcactggcggtaatggcctgttttcttttgtattgaagacctcatactctcgtgcaaccacagcgctgctcgatggaatgaaacacttcagcatgggctattcgtggggtggatttgaaagcttaattttggccaatgaaccaaagagtttctcaagcttacgtactgtcgccaatccgaactttgaaggtaccttgatccgcctgcatattggtttagaaaatgtcgaagacctaattgccgatctcgaagcggggtttgaacgttataacgcattgattcttgaaagagaaacctctcttagctag

SEQ ID NO: 19101 - protein, 432 aa, Vibrio vulnificus
MSGMFLLCNPCQAYTLHVLNRAFSHRQGINMSEGKQTKLVTAGRDKKWTNGVVNPPIQRASTVVFDTVADKHHATVNRANKTLFYGRRGTHTHFAFQEAMTQIEGGAGCALYPCGTAAISNAILSFVETGDHILMVDTCYEPTRDFCDKIMKKMGVETTYYDPMVGEGIRELIKPNTKVLFLESPGSITMEVQDVPTLARIAHEHGIIVMLDNTWGAGVNFSPFEHGVDISIQAATKYIVGHSDVMLGTAVASEPYWDQLREQSYLMGQCVSPDDAYLGLRGLRTIDVRLRQHEQASLKVAQWLATRPEVDHVRHPALESCPGHEFFNRDFTGGNGLFSFVLKTSYSRATTALLDGMKHFSMGYSWGGFESLILANEPKSFSSLRTVANPNFEGTLIRLHIGLENVEDLIADLEAGFERYNALILERETSLS

SEQ ID NO: 19102 - DNA, 1182 bp, Porphyromonas gingivalis W83
  CDS (1)..(1182)
atgcgtagtggctttgccacacgtgccatccatggaggcgctatcgagaacgccttcggctgcttagccactcccatttaccaaacatcgactttcgtttttgacactgccgaacagggaggccgccgctttgccggagaggaagacggatacatctatacccgtctgggcaaccccaactgcacccaagtggaagagaaactggccatgctcgaaggcggagaagccgccgcatcggcctcatccggtatcggagccatcagctctgccatctgggtatgcgtgaaggccggcgaccatatcgtagccggcaagacgctctacggctgcaccttcgccttcctcacccacggactgagccgctacggtgtggaagtcaccctcgtggatacccgccatccggaagaggtggaggccgccattcgcccgaatacgaagctcgtctatctggagactccggccaaccccaatatgtacctgaccgacatcaaggcagtctgcgacatcgctcataagcacgaaggcgtacgcgtcatggtggacaatacctactgcacgccctatatctgccgtccgctggagctgggtgccgacatcgtggtacacagcgcgaccaagtacctgaacggacatggcgacgtcatcgccggattcgtcgtaggtaaagaggactacatcaaggaggtgaagctcgtcggcgtcaaggacctcacgggggccaatatgagtccgttcgatgcttatctgatcagccgcggcatgaagacgctgcagatacgtatggagcagcactgccgcaatgctcagaccgtagccgaatttctcgaaaagcatccggccgtagaagcagtttatttccccggacttccgagcttcccccaatacgaattggccaagaagcagatggcactgcccggagccatgatcgccttcgaagtgaagggcggttgcgaagccggtaagaagctgatgaacaacctgcacctctgctccctcgccgtgagcttgggcgatacggaaaccctcatccagcatccggccagcatgacccactcgccctacacacccgaagagcgtgctgccagcgacatatccgaaggactggtacgcctgtccgtgggtctggagaacgtggaggacatcatcgccgacctcaagcacggtctggacagcctgatctaa

SEQ ID NO: 19103 - protein, 393 aa, Porphyromonas gingivalis W83
MRSGFATRAIHGGAIENAFGCLATPIYQTSTFVFDTAEQGGRRFAGEEDGYIYTRLGNPNCTQVEEKLAMLEGGEAAASASSGIGAISSAIWVCVKAGDHIVAGKTLYGCTFAFLTHGLSRYGVEVTLVDTRHPEEVEAAIRPNTKLVYLETPANPNMYLTDIKAVCDIAHKHEGVRVMVDNTYCTPYICRPLELGADIVVHSATKYLNGHGDVIAGFVVGKEDYIKEVKLVGVKDLTGANMSPFDAYLISRGMKTLQIRMEQHCRNAQTVAEFLEKHPAVEAVYFPGLPSFPQYELAKKQMALPGAMIAFEVKGGCEAGKKLMNNLHLCSLAVSLGDTETLIQHPASMTHSPYTPEERAASDISEGLVRLSVGLENVEDIIADLKHGLDSLI

SEQ ID NO: 19104 - DNA, 1173 bp, Photorhabdus luminescens subsp
  CDS (1)..(1173)
atggtagctgatatgacacgcaagccggcaacaatagcagttcgcaatgggctgaataatgatgaacagtatggttgtgttgttccgcctatatatctttccagcacatataactttactgattttaatcagccaaggacacatgattattcccgcaggagtaatccgggccgcgatatggtgcaacaggcattagctgagctggaggggggagcgggtgctatcatgaccagcagtggaatgtcagctattcacctgttatgcatggttttccttcaacctggcgatctgttggttgcgcctcatgactgttatggtggcagttaccgtttatttgacagccagactaaacgcggtgcttatgaagtggcctttgtcgatcagagtgatgaacaggcattaaagcaagtcttgtccaaaaaaccaaagttggtattgattgaaacacccagtaatcctttattgcgtattgtcgatattgctcatatatgccagctttcccatgaggtaggtgcgacagtcattgttgataacactttcctgagtcctgtactacagaagcctttggcgttgggggcagatctggttgtgcattcctgtactaaatatcttaatggacattctgatgtgattgccggagctattattgcaaaggatgaagaggttgcaacggagctcgcttggtgggcgaataatattggtgtaaccggtgcggcgtttgatagctacctgctgttgcgtggcatgcgcactttatcgccacgggtcctgttacagcaaaagaatgcattggaactcgtcaattatcttcaacagcaaccgttagtgaaaaaacttttttatcctgctttgaaagatcatcctgggcatgaaattgcttgtaagcaacaatttggttttggcgcaatgataagctttgagttcgatggtggtgaacaggcgatacgccgttttctgtctgagttgaagttatttactttggcggaatcactgggcggtgtggaaaccttaatttctcatacggctaccatgactcacgctggaatgtcagcacaggcaagggcggaagcggggattacggattcactattgcgtgtttctgtgggtattgaagatagtcaggatttaatcgctgatttggaaaatgcatttcaggcagtagtaaaggagtga

SEQ ID NO: 19105 - protein, 390 aa, Photorhabdus luminescens subsp
MVADMTRKPATIAVRNGLNNDEQYGCVVPPIYLSSTYNFTDFNQPRTHDYSRRSNPGRDMVQQALAELEGGAGAIMTSSGMSAIHLLCMVFLQPGDLLVAPHDCYGGSYRLFDSQTKRGAYEVAFVDQSDEQALKQVLSKKPKLVLIETPSNPLLRIVDIAHICQLSHEVGATVIVDNTFLSPVLQKPLALGADLVVHSCTKYLNGHSDVIAGAIIAKDEEVATELAWWANNIGVTGAAFDSYLLLRGMRTLSPRVLLQQKNALELVNYLQQQPLVKKLFYPALKDHPGHEIACKQQFGFGAMISFEFDGGEQAIRRFLSELKLFTLAESLGGVETLISHTATMTHAGMSAQARAEAGITDSLLRVSVGIEDSQDLIADLENAFQAVVKE

SEQ ID NO: 19106 - DNA, 1191 bp, Photorhabdus luminescens subsp
  CDS (1)..(1191)
atggcagaaaaaaaactggaaactttactggtcaatgcaggtagaagccaaaaatttactcaaggcgcagtcaatcccatcattcagcgaacttcatcggtgatcttcgattctgtcgccgacaaaagacgtgctacgcaaaaccggggcaagagcgagctgttttatggccgccgtggtacacagactcatttttcttttcaagcagcaatggctgaactggaaagtggcgcaggctgtatgctttacccttctggtgctgccgcgattagtcatgccattctcgcttttgccgccgcaggcgatcatattctattaaccggttcagcttatgacccgacgcaaagtttctgtgacaaaatattgtcacggatgaatattaccaccgattatttcgatcccatgattggcgaagagattgctgatctgattaagcccaataccaaagtggtgtttcttgaatcccccggctccatcacaatggaagtacaagatatccccgctattgtccgcgcagtgcgccaagtcaatccagatattgtcatcatgctcgataatacttgggcggcaggtgtgctgtttaaagcgctagaattcggcgtcgatatttcgattcaatcaggcaccaaatatattattggtcactcagacgcaatgttagggattgctgtggctaatgaacgttgttgggcgcaactgcgagaaaactcctatttgatggggcagatagccgatgccgatacggtctatatggccagtcgcggattgcgtactttagccattcgcttgaaacaacatgaaaaaagcagtattgaagtcgcacactggctgcaacaacgaaccgaagttgccgctgtctatcaccccgctctgccttcctgccccggtcacaataattttatccgtgatttcagtggcagtagcggcctgttctcttttcaattgaaaaagaagttaactccccaacaatttacggattatctggataattttcaccattttaaaatggcattctcatggggcggttttgaatctctgatcctaggctatcaaccagaagagataaaaatgatgcgtcaatacgatatttcacaaaggacaggcactctgttccgcctgcatgtcgggctggaaaatgttcaagatttgattgatgacctcgcagagggatttggtcgaatttcgacttga

SEQ ID NO: 19107 - protein, 396 aa, Photorhabdus luminescens subsp
MAEKKLETLLVNAGRSQKFTQGAVNPIIQRTSSVIFDSVADKRRATQNRGKSELFYGRRGTQTHFSFQAAMAELESGAGCMLYPSGAAAISHAILAFAAAGDHILLTGSAYDPTQSFCDKILSRMNITTDYFDPMIGEEIADLIKPNTKVVFLESPGSITMEVQDIPAIVRAVRQVNPDIVIMLDNTWAAGVLFKALEFGVDISIQSGTKYIIGHSDAMLGIAVANERCWAQLRENSYLMGQIADADTVYMASRGLRTLAIRLKQHEKSSIEVAHWLQQRTEVAAVYHPALPSCPGHNNFIRDFSGSSGLFSFQLKKKLTPQQFTDYLDNFHHFKMAFSWGGFESLILGYQPEEIKMMRQYDISQRTGTLFRLHVGLENVQDLIDDLAEGFGRIST

SEQ ID NO: 19108 - DNA, 1155 bp, Photorhabdus luminescens subsp
  CDS (1)..(1155)
atgaccaagttcgatactaaaactgttcacgccggctacacaccagatcacacgggtgcggtaatgccggcaatttatgcaacatcaacttacgcccaatcagcccccggtcaacacactggttatgaatattcccgtagtggcaacccaactcgtgatgctctggaaagcgcgatcgccgaactggaaaacggtagccgaggctacgcttttagttcagggctcgctgccagttccacggtgctagaactcttggataaggatagccatttggtggcagtcgatgatctgtacggtggtacctaccggctactcgaaaaagtacgtagccgcaccgccggtttgcgtgtcacttacgtggaagccaatgatatttccggccttgaagcagccattcgtcccgatacaaaaatgatttgggtggagactcctaccaatccgttgctgaaactggccgatctgacggctatcgcacaaatagcgcaacgtcacagtattattagtgttgcagataacactttcgcttcaccatatctccaacgcccagttgatttgggatttgatatcgtcgtgcactccgccactaaatatttaaacggccactctgatgtgatcgcaggactggccgtcgtcggaaaaaatgcagaactagcagaaaaacttggttttctgcaaaactctgtcggtggcgtgctcgatccctttagtagtttcctggtgctgcgcggaatgcggacacttgccctacgtatgcagcgccacattgatagtgcatcaaagatcgcacattggttggagcaacaacctcagatcgaaaccgttttctatcccggtctcgcttcccatccacagcatgaattggcgaagcgtcaaatgaaaggctttggtggtatgatttctgttcacttaaaaggtgatgatgattatgcccgccggttaattcaagagctaaaactatttaccctggcagaaagtctgggcggggtggagagcctgatcagccaaccattcagtatgactcacgcgtctattccattagaaaaacgccttgcttctgggatcacgccacagttggtacgcatttctgtgggtatagaggatgcagaggatcttatcgccgatttggctcaagcgttagaaaaagccgctcaataa

SEQ ID NO: 19109 - protein, 384 aa, Photorhabdus luminescens subsp
MTKFDTKTVHAGYTPDHTGAVMPAIYATSTYAQSAPGQHTGYEYSRSGNPTRDALESAIAELENGSRGYAFSSGLAASSTVLELLDKDSHLVAVDDLYGGTYRLLEKVRSRTAGLRVTYVEANDISGLEAAIRPDTKMIWVETPTNPLLKLADLTAIAQIAQRHSIISVADNTFASPYLQRPVDLGFDIVVHSATKYLNGHSDVIAGLAVVGKNAELAEKLGFLQNSVGGVLDPFSSFLVLRGMRTLALRMQRHIDSASKIAHWLEQQPQIETVFYPGLASHPQHELAKRQMKGFGGMISVHLKGDDDYARRLIQELKLFTLAESLGGVESLISQPFSMTHASIPLEKRLASGITPQLVRISVGIEDAEDLIADLAQALEKAAQ

SEQ ID NO: 19110 - DNA, 1146 bp, Chromobacterium violaceum ATCC 12472
  CDS (1)..(1146)
atgaaattcgctacccgcgccatccatgtcggctacgacaatgccgaacacaaccgctcggtgatgccgccgctgtaccagacctcggccttcgccttcgaccatgtcggcgaggatttgcgctacgcctacgcccgcaccggcaatccgacccgcagcgcgctgcaggactgcctggccagcctggaagaggccaggcacggcctggccttctccagcggcatggcggcgatagacgcggtgctgcgcgcctgcctgaagccgggcgacgaggtgatcgcggtggcggatctgtacggcggcgcttaccggctgctgacccgggtgatgcagccggccggtatcaaggtgagcttcgtggacctgtccgacccggcgcggctggaggcggcgatcacgccggccacccggctgctgtggctggagtcgccgaccaatccgctgctgggcatggtcgatatcgccgcgctgtccgcgatcgcccatcgccacaatgtaaaagtggcggtggacaataccttcgccacgccgtatctgcagcagccgctgctgctcggcgccgacatcgtcgtgcactcggccaccaagtacctgggcgggcactccgacgtgctgctgggcctggtggcggtcagcgacgacaagctgcaccacgatatccgcttcctgcagaacgccgccggcgcggtgcccgggccgcaggattgcttcctgacgctgcgcggcatcaagacgctggcgctgcggatggagcgccattgcgacagcgcggagaaagtggcggtctggctggccggacagccggccgtggccaaggtgttctaccccggactcccggagcatccggggcatgagctggcgaagcggcagatgcggcgcttcggcggcatcatcagcatccggctgcaggacgacagccgcgaggcggccagccgcgtcgcgcagaggctgaagctgtttgcgctggcggagtcgctgggcggggtggagtcgctggtcaaccatagctacacgatgtcgcacggcggcatgccggccgagcagaaggcggcgctgggcattgtcgagggcggcctgcggctgtcgatcggcatcgaggatctggacgacatcctggcggacctggagcaggcgctgcgcgattga

SEQ ID NO: 19111 - protein, 381 aa, Chromobacterium violaceum ATCC 12472
MKFATRAIHVGYDNAEHNRSVMPPLYQTSAFAFDHVGEDLRYAYARTGNPTRSALQDCLASLEEARHGLAFSSGMAAIDAVLRACLKPGDEVIAVADLYGGAYRLLTRVMQPAGIKVSFVDLSDPARLEAAITPATRLLWLESPTNPLLGMVDIAALSAIAHRHNVKVAVDNTFATPYLQQPLLLGADIVVHSATKYLGGHSDVLLGLVAVSDDKLHHDIRFLQNAAGAVPGPQDCFLTLRGIKTLALRMERHCDSAEKVAVWLAGQPAVAKVFYPGLPEHPGHELAKRQMRRFGGIISIRLQDDSREAASRVAQRLKLFALAESLGGVESLVNHSYTMSHGGMPAEQKAALGIVEGGLRLSIGIEDLDDILADLEQALRD

SEQ ID NO: 19112 - DNA, 1143 bp, Chromobacterium violaceum
  CDS (1)..(1143)
atgaccgatttccacaccctggccgtgaccgccggcgcgcacgaggacccgttcggcgcggtgatgccgccgatctacgccacctccacctaccgccagcacgcgccgggcgagcacaccggctacgagtattcccgctcgcagaacccgacccgcgaggcgctggagcgcgcggtggccgaactggaaggcggcatccgcggctacgctttcggctccggcttggcggcgatctccaccgtgctggagctgctgccggccggcagccacctgatcgcggtcaacgacctgtacggcggcacctatcgtctgttcgagaaggtgcgcaaggccagcgccaacctggaagtgacctatgtcgcctccgacgacagcgccgcgctggaggccgccatccgcccgaacacccggatgatctgggtggaaacgccgtccaatccgttgaaccagctggtggacctgcaacaggtgtcggccatcgcccgccgccacaagctgatcggcgtggtcgacaacactttcgcctcgccggtcaaccagcggccgctggacttcggcttcgacatcgtcgtccactccgccaccaaatacctgaacggccattccgacgtggtggccggcgtggctgtggtcagccgcgaccagccggaactggccgaacagctggccttcctgcataacgcggtgggcgccatcctggacgccttccccagcttcctggtgctgcgcggcttgcgcacgctggcgctgcgcatcgagcagcacaaccgcaacggcctggccatcgcgcgctggctggaggcgcagccttgggtggaaaaggtgctgtacccaggcttggaaagccatccgcagcacgcgctggcgcgccgccagatgcagggctacggcggcatcgtgtcgttctatctgaagggcgacgtcaaggccttcctggccaggctcaagctgttcgcgctggccgaaagcctgggcggcgtcgaaagcctggtctgcctgccggcggcgatgacccacgcgtcgattccggccgagcgccgcgccgcgctcggcatccacgacaacctgatccgcctgtcggtcggcgtcgagggcgaggcggcgctgatcgccgacctggagcaggcgcggcgggacagctga

SEQ ID NO: 19113 - protein, 380 aa, Chromobacterium violaceum
MTDFHTLAVTAGAHEDPFGAVMPPIYATSTYRQHAPGEHTGYEYSRSQNPTREALERAVAELEGGIRGYAFGSGLAAISTVLELLPAGSHLIAVNDLYGGTYRLFEKVRKASANLEVTYVASDDSAALEAAIRPNTRMIWVETPSNPLNQLVDLQQVSAIARRHKLIGVVDNTFASPVNQRPLDFGFDIVVHSATKYLNGHSDVVAGVAVVSRDQPELAEQLAFLHNAVGAILDAFPSFLVLRGLRTLALRIEQHNRNGLAIARWLEAQPWVEKVLYPGLESHPQHALARRQMQGYGGIVSFYLKGDVKAFLARLKLFALAESLGGVESLVCLPAAMTHASIPAERRAALGIHDNLIRLSVGVEGEAALIADLEQARRDS

SEQ ID NO: 19114 - DNA, 1185 bp, Chromobacterium violaceum
  CDS (1)..(1185)
atggcatccgacgcgccgcatcttccgctgcaccctgaaaccctggccatccgggccgggttggaaaccagccagttcaacgagcacagccagggcctgttcctgacgtccagcttcacctacgaatcggccgcgcaggcggcggcgatgttcctgggcgagatcgacggctacacctattcccgcttcaccaatccgaccgtcgccgcgttccagcataggctggcgcagatggagggcggggagcgcgccatcgccaccgccaccggcatggcggcgatccaggccatcatgatgactttgctgcaggctggcgaccacatcgtgtcgtcgcaaagcctgttcggctccaccaccaatctgttcgccaaccagttggccaagttcgccgtggccaccgacttcgtcgacgcgcgcgacctgtccgcctggcgggaggcgctgcggccgaacaccaagctgctgttcctggagacgccgtccaatcccttgaccgaagtggccgacatcgcggccatcgccgacatcgcccacgcgcatggcgcgctgctggtggtggacaacagcttctgttcgccggccttgcagcagccgttgaaactgggcgccgatctggtcatgcattccgccaccaagttcatcgacggccatggccgggtgatgggcggggcggtggtcggcagcgacaagctggtcgagcaggtctatttgcacgtgcgcgccgccggtccctcgctggcgccgttcaatgcctggacgctgctgtccggtttggagacgctgcacctgcggatggagaagcacagcgccaacgcgctggagctggcgcgctggctggaggcgcagcccaatgtggagcgcgtctattacccgggcctggagagccacccccagcacgagctggcgctgcgccagcagaagagcggcggagcggtggtgtccttcgtggtcaagggcggccgcaaggccgcgtggaaagtggtggacgcggtcagggtgatctcgcgcaccgccaatctgggcgatgtgaaaaccaccctcactcatccggccagcaccacccacgcccgcgtgacgcaggaggcgcgcgagcgcgccggcatcgtcgaggggctgttgcgcgtcagcgtcggcctggaaaatgtacgggaccttcaacaagatctgttgcggggccttgactaa

SEQ ID NO: 19115 - protein, 394 aa, Chromobacterium violaceum
MASDAPHLPLHPETLAIRAGLETSQFNEHSQGLFLTSSFTYESAAQAAAMFLGEIDGYTYSRFTNPTVAAFQHRLAQMEGGERAIATATGMAAIQAIMMTLLQAGDHIVSSQSLFGSTTNLFANQLAKFAVATDFVDARDLSAWREALRPNTKLLFLETPSNPLTEVADIAAIADIAHAHGALLVVDNSFCSPALQQPLKLGADLVMHSATKFIDGHGRVMGGAVVGSDKLVEQVYLHVRAAGPSLAPFNAWTLLSGLETLHLRMEKHSANALELARWLEAQPNVERVYYPGLESHPQHELALRQQKSGGAVVSFVVKGGRKAAWKVVDAVRVISRTANLGDVKTTLTHPASTTHARVTQEARERAGIVEGLLRVSVGLENVRDLQQDLLRGLD

SEQ ID NO: 19116 - DNA, 1353 bp, Anopheles gambiae str
  CDS (1)..(1353)
atgtcgtgcgagacggccgcgtgtcgctggacatttaattctacgtcgccgcacgagacggacctggtgtgctgcccgtgtgctcgtcgctcagagttttgccgttttcgagtgttgttactttctgttcaatctgttcaaaacagcatttaccgtgaagcaatggcccaatcaaacagcagcgatggcttcctcagccagccgaagggcttctccaccaaagcgatccacgttgggcaggatccggagcagtggaacagcatggcggtggtgccaccgatcagcatgagcaccacgttcaagcagcacggcccggggcagcatgcgggcttcgagtacgggcgcagcggaaacccaacgcgcgacgtgctggaacgctgccttgcctcgctggacaatggacgcttcgggctaacgttctcgtccgggctcggtgcgacgacgaccatcattacgatgctgcagaacggtgaccacatcgtggccggtgacgatctgtacggtggcaccaaccggttgctgcgcaatgtcgccctcaagatgggcattgaggttgatttcgtcgatcttaccaacatgcagctggtggagcaagcgatcaaaccgaacacgcggctgttctggatggaaacgccaaccaatccgctgctgaaggtggtggacatacgggcggtgtcggagatcgcccacaagcatccgggtatcgtggtggttgtggacaacacgttcctgtcgtcgtacctgcagcgcccgcttgatttgggcgcggacgtcgtcatgtactcgctgacgaagtacatgaacggtcactcggatgtcattatgggtgccatggtaacgaacgatgaggctgtgtacgaacgtttgaagttcctgcaaaatgccgccggtattgtgccatccccgttcgactgctatctggtcaaccggagcctgaaaacgctcgccctgcgcatggaacgccacaagagcaactcgctggcgattgccaggttcctcgaaacgcatccaaaggtggagcgggtgctgcacccgggcctgccaagccacccacagcatgagctggccaagcgacaaacgtacgggcacagcggcatcatgtcgttctacatccgcggcgggctggaggagtcgagcaacttcctgaaggcgctgcacgtgttcacgctcgcggaaagcctcggcgggtacgaaagcctggccgagctgccgtcggtgatgacgcacgcgtcggtgccgctgcagcagcgccaggagctcggcatcaccgacggactggttcggctttccgtcgggctggaggatgtggatgatctgatcgccgatttgcagcaagcgctggataaggcataa

SEQ ID NO: 19117 - protein, 450 aa, Anopheles gambiae str
MSCETAACRWTFNSTSPHETDLVCCPCARRSEFCRFRVLLLSVQSVQNSIYREAMAQSNSSDGFLSQPKGFSTKAIHVGQDPEQWNSMAVVPPISMSTTFKQHGPGQHAGFEYGRSGNPTRDVLERCLASLDNGRFGLTFSSGLGATTTIITMLQNGDHIVAGDDLYGGTNRLLRNVALKMGIEVDFVDLTNMQLVEQAIKPNTRLFWMETPTNPLLKVVDIRAVSEIAHKHPGIVVVVDNTFLSSYLQRPLDLGADVVMYSLTKYMNGHSDVIMGAMVTNDEAVYERLKFLQNAAGIVPSPFDCYLVNRSLKTLALRMERHKSNSLAIARFLETHPKVERVLHPGLPSHPQHELAKRQTYGHSGIMSFYIRGGLEESSNFLKALHVFTLAESLGGYESLAELPSVMTHASVPLQQRQELGITDGLVRLSVGLEDVDDLIADLQQALDKA

SEQ ID NO: 19118 - DNA, 1194 bp, Rhodopirellula baltica
  CDS (1)..(1194)
atgagctcttccaactcgaaccacaagtttcgaactcgcgcgattcatgtcggcaacgaagtggatccacaaaccggcgcggttgttccgcccattcacttcgccagtacgtttcgacaacccggtgcgggtgagtggggacaatacgactattcgcgtagcggcaacccaactcgaacgggcctgcaagacacgctctcctcgctggaaaatggttgtggatcgcttgcgttttcgtccggcatggctgccattcacgcggtcaccatgctgttggaatcgggcgatcacgtcgtcgcgggatctgatatctacggtggtgcctaccgactgctacaccagatctgcaatcgcagcggtatcgaagtcaccttggtcgacgtcaccgatttacaggcaatcgaaaacgcaatcaccgatcggaccaaactgatctggaccgaatcgatcggtaatccccgcatgacgatttccgatttaccagccatcgctcgcctagccaaatccaaaggaatcctttcgggtgtcgacaacacattcggcaccccggcacttttgcggccgctggacttcggcatcgacatcgtcatgcactcggcaacgaagtacctgggcgggcacagcgattgtctgggtggcaccctcgcggtcgcggattccgagctttatgaccaactctattttgtccaaaacgcgactggcgccgtgctcgacccgatgagcagtttcttgatcgctcgcgggctgaagactctcgatctgcgtgttcgcgaacaatcaagaacggcgcttcgattggcgaaatggctggaagcccatcccatggttcgatcggtgctttacccaggcttgccatcgcacaaccagcacgaacttgcccgccaactgttcggacaacatcaaagtgactcagaagaaacacacttcggcgctatgatcacgttcgaactggatgcgaccttggaccaagttcgcgaggtttgccaatcgaccgaattattccacctggcggtcagcctcggtgcggtggaatccttgatcgagcaacccgccacgatgtctcacgcttcctacgctccggaagctcgtgcggctcacgggatcacggattcattgatccgtctttcggtcggcctagaatctccttccgatctggaagccgatttggaacgcgcgatcgccattatcgggtag

SEQ ID NO: 19119 - protein, 397 aa, Rhodopirellula baltica
MSSSNSNHKFRTRAIHVGNEVDPQTGAVVPPIHFASTFRQPGAGEWGQYDYSRSGNPTRTGLQDTLSSLENGCGSLAFSSGMAAIHAVTMLLESGDHVVAGSDIYGGAYRLLHQICNRSGIEVTLVDVTDLQAIENAITDRTKLIWTESIGNPRMTISDLPAIARLAKSKGILSGVDNTFGTPALLRPLDFGIDIVMHSATKYLGGHSDCLGGTLAVADSELYDQLYFVQNATGAVLDPMSSFLIARGLKTLDLRVREQSRTALRLAKWLEAHPMVRSVLYPGLPSHNQHELARQLFGQHQSDSEETHFGAMITFELDATLDQVREVCQSTELFHLAVSLGAVESLIEQPATMSHASYAPEARAAHGITDSLIRLSVGLESPSDLEADLERAIAIIG

SEQ ID NO: 19120 - DNA, 1305 bp, Rhodopirellula baltica
  CDS (1)..(1305)
atgtttagggatttgcggccgcttgcagcctcactgctaaaaagccaacacatgaaaccgatcgcaatcgatccggtcgaaatgaccgatcatgcgtcccgcgccgcgggaccttcttccacgggtttgtcgactcagtgcgttcacgggaacattgatcccgattcgccttcgcgacaacacgccgagggcgccatcacggcaccgatctactcggcctcgaccttcacgttcgaatccaccgacaaactcttggatttcgtcgaaggtcgcgagcaacgcgaagagtacggacgctacgggaatccaaacgaacgcttggtcgaacagaaactggctgcgctcgacaatgcggaagacgcggtggtttattccagcggcatggcggcgattgtcgggttgctgatgagccgcttgtcgtccggcgatgaaatcatcttctttgaccagtgttaccaccgcagccgtgagttttgcgggaagcatctggccaaatttggtgtcgtcacccggcaagttccgaccggtgactttgccgcgatggaagcggcgatcaccccgcgaaccaaaatgctggtcagcgagtcgcccaccaacccgcacctaacctgcgtggacctggagcagtttgtcgctttgggcaaagctcacgagattgaaacgctgatcgatgcgacattggcgactccgatgaacgttcggccgttagatcatggcgtcgattacgtttggcactccgccaccaaatacctcggcgggcacaacgatttgttggcaggagtcatctctggtcgcaaggaattgctggatccaatccgtgcccttcgtggatgtttgggaagcgtcacgtcgccgcacagcatgtacttgctcgaacgcggtttaaaaaccttctcgttgagaatgcagcgtcacaacgaaaatggtcaagcggtggccgaattccttcatcaacatccaaagatcgaccgggtttattacccgggtctgccaagccacccgactcacgcgatcgccaaagaacaaatgttgggatacggcggcctgatcactttcacggtcaaagacgccgactggaaaacaacctcacgcgtggtcgacgccgccaaaatcgctcgtatcgctcccagcctcggtggcaccgaatcattgatcgaacaaccgctggtaatgagttacttccattacagcccggaagaaagagcctgctttggaatcgctgacaacatgattcgtttttcttgtggcattgaagattctgcagacctgatcgctgatctggatcaagccttggcggcgatttga

SEQ ID NO: 19121 - protein, 434 aa, Rhodopirellula baltica
MFRDLRPLAASLLKSQHMKPIAIDPVEMTDHASRAAGPSSTGLSTQCVHGNIDPDSPSRQHAEGAITAPIYSASTFTFESTDKLLDFVEGREQREEYGRYGNPNERLVEQKLAALDNAEDAVVYSSGMAAIVGLLMSRLSSGDEIIFFDQCYHRSREFCGKHLAKFGVVTRQVPTGDFAAMEAAITPRTKMLVSESPTNPHLTCVDLEQFVALGKAHEIETLIDATLATPMNVRPLDHGVDYVWHSATKYLGGHNDLLAGVISGRKELLDPIRALRGCLGSVTSPHSMYLLERGLKTFSLRMQRHNENGQAVAEFLHQHPKIDRVYYPGLPSHPTHAIAKEQMLGYGGLITFTVKDADWKTTSRVVDAAKIARIAPSLGGTESLIEQPLVMSYFHYSPEERACFGIADNMIRFSCGIEDSADLIADLDQALAAI

SEQ ID NO: 19122 - DNA, 1170 bp, Prochlorococcus marinus subsp
  CDS (1)..(1170)
atggaatcaacagaacttaaggagggctcccacccaggaataaatacaagggtaattcatcacggtgaaagtttcgctaaaaccactggcacagttatgccgcctatatttcaaagctcaacttttagacaaggtaatgaagaaggatttgattacacccgctcaggaaatccaaactttcgaatattagagtctgttttagcatctttagaagattgcaagtattcaacagtttttggttccggagtaagtgctattacggctatcgcaagttcccttaaatcaggagatcttgtcttatgtgaggaaaacctttatggctgtacagttcggttatttgaaaaggtatttagtaaattcggtctgcgaactaaatggttagatttctcgaacccatcttgcttcgatgagattaagaagctaagcccagcaatgatttggttagaaagtccaactaatcctctattaaaagttcttgatttgaagacaatttgtacgaaagcaaaagagaatcaaatcccagtagtagttgacaacacattctctacggccattttacaaaaaccattggacctaggagcaagcctgtctctcacaagtacaacaaagtacattaatgggcattctgatgccttaggtggcgcagtgtgcactcaagactcttattggcatgagcaaatgagatttgctcaaaaagctttaggactgcaagcctctccatttgattgttggctaatcactagaggcgttaaaactctccctcttcgtttgcaaaggcaagtttccaatgcaacatctcttgctaatcaattagctaagaatgaatatgtgcaatggattagctatccatttagatcagaccaccctcaatatgaaattgcaaaaaagcaaatggcagcaggaggggcaattatcacaatcagactgaaagcaaatcttgatcaaacttatgcattttgtgaaaggcttaaatatttcaccatggctgagagccttggaggagtggaaagtcttgtttgccatccagccactatgactcatgcatcagtatcatctcaaacaaaagaaaagttaggcatcagcgaatcactagttcgcttttcaataggatgtgaagacgttttagatctcgatcaagatctaaaacaaagtttagaaaaactgaagtga

SEQ ID NO: 19123 - protein, 389 aa, Prochlorococcus marinus subsp
MESTELKEGSHPGINTRVIHHGESFAKTTGTVMPPIFQSSTFRQGNEEGFDYTRSGNPNFRILESVLASLEDCKYSTVFGSGVSAITAIASSLKSGDLVLCEENLYGCTVRLFEKVFSKFGLRTKWLDFSNPSCFDEIKKLSPAMIWLESPTNPLLKVLDLKTICTKAKENQIPVVVDNTFSTAILQKPLDLGASLSLTSTTKYINGHSDALGGAVCTQDSYWHEQMRFAQKALGLQASPFDCWLITRGVKTLPLRLQRQVSNATSLANQLAKNEYVQWISYPFRSDHPQYEIAKKQMAAGGAIITIRLKANLDQTYAFCERLKYFTMAESLGGVESLVCHPATMTHASVSSQTKEKLGISESLVRFSIGCEDVLDLDQDLKQSLEKLK

SEQ ID NO: 19124 - DNA, 1152 bp, Helicobacter hepaticus
  CDS (1)..(1152)
atgaaaagcacgcttgatacattgctgatacacgggggagcaaccacagacccacgaacaggtgcagttaatatccctatctatcaaacttctacctatgcccaaagtgcgctcggagaacatttaggatatgaatactcacgcactaagaatccaacgcgagatggcattgagagccttattgcccaatgtgagggtggaaaatttggcttcgcttttgcttcgggtatggcagctattggcacgattttaagtctctttcaaagtggagattgcattatcatttcaaataatgtctatggtggcacttttagaatcttagataaagttttttcacattttaatattagctataaaattgttgatacacgtgatttgaaagcattagaatctgctattacgcctgaagtcaaagctgtgcttattgaaactccagcaaatccgcttctaagtgttacgcctttagagcaggttgctatacttgcgaaaaaaaaaggtattttaagcattgtagataatacctttatgacgccttatttacaaaaacctttagagcttggcattgatatcgtgatgcattcagcaacaaaatatcttggaggacatagcgaccttatagcaggactcgtagttgtaaatgattctgcacttgcagaacgtatcggctttttacaaaatagtattgggggagtgttagcaccttttgatagctttttgcttattcgcggtatgaaaacactcggggtgcgtctccagcgccattgtgaaaatgctctctttttagcacaagcacttagcgagcatagtggggttgaaaaggtatattatcccggacttaaaagtgatgaaggctatcaaatacaaaactcacaggctcgtagcggtggaggaatgctaagttttgaactcaaaaaaaattatgattatagaatcttttttaaatccacgcaaacaatcgttttagccgaaagtttaggaggtgtagaatccttgctttgccaccctgcatctatgactcatgcttcaatccccaaagatgtgcgtgagcgtatgggtataagcgaacatcttatccgcctttctgttggtattgaatatgcacaagatttacttgatgatttaaatcaagccattaaaaaagcaaaggtatag

SEQ ID NO: 19125 - protein, 383 aa, Helicobacter hepaticus
MKSTLDTLLIHGGATTDPRTGAVNIPIYQTSTYAQSALGEHLGYEYSRTKNPTRDGIESLIAQCEGGKFGFAFASGMAAIGTILSLFQSGDCIIISNNVYGGTFRILDKVFSHFNISYKIVDTRDLKALESAITPEVKAVLIETPANPLLSVTPLEQVAILAKKKGILSIVDNTFMTPYLQKPLELGIDIVMHSATKYLGGHSDLIAGLVVVNDSALAERIGFLQNSIGGVLAPFDSFLLIRGMKTLGVRLQRHCENALFLAQALSEHSGVEKVYYPGLKSDEGYQIQNSQARSGGGMLSFELKKNYDYRIFFKSTQTIVLAESLGGVESLLCHPASMTHASIPKDVRERMGISEHLIRLSVGIEYAQDLLDDLNQAIKKAKV

SEQ ID NO: 19126 - DNA, 1176 bp, Candidatus Blochmannia floridanus
  CDS (1)..(1176)
atgaaagatgaaactaaaattattaattctgggcgaaatatacaatttacccacagagccattaatcctattgttcaaagaacatcctcaataatttttaattctattgcacaaaaaaaacatgctgcaaaaaattacaaaaacggagaactattttacggaagatatggaaccctatcccatttttccttacaaaaatctatgattgaactagaaaatggatcaggttgtatgttatttccatgtggaacagctgctattactcacacaatttttgcctttatcacttacggagatcatattttaattacagaatcggcatacgcaccaacacaaaatttttgtcgatttctcttgaataaaatgaatgttcatactacttggtttcattcatcaattagtaataatattactaatcttattcaacataatactaagttaattatattagaatcacctggttccataactatggaagtacaagatattccaactcttattcaagcaacgcgcaaaaaaaaaccagatattataatattattagataacacttggtcatcaggagtatttttaaaagcattagatatcggagtagacatctctattcaatccggaacaaaatatattataggacattcagatggaatgatgggaacagcagtttctaatgcgcgatgttggaacacattacaagaacaatcctacttaatgggccaaactatagatgcagatactgcatacatagcagctcgaggactgcgaacattatatgttagattaaaacaacatgaaaaaactggattacatctagcacaatggttaaataatcatccaaaagtagaccgagttaatcatcctgctctgccttcatgtcaaggtcataaatattttataagagattttacaggatccagtggattattttcttttattttaaaaaaacgattaactgataaacaattatctaactttcttgacaacatgaagtattttaaaatggcatattcttggggaggtttcgagtcattgatcacaaccatgcaaatagaagaactcaattctattcgtcctattaataaattaaacttcacagggacactaatacgtatacatgcaggattagaacatcaagaagatttaattcaagatttatcggatggtttaaatcgaatctaa

SEQ ID NO: 19127 - protein, 391 aa, Candidatus Blochmannia floridanus
MKDETKIINSGRNIQFTHRAINPIVQRTSSIIFNSIAQKKHAAKNYKNGELFYGRYGTLSHFSLQKSMIELENGSGCMLFPCGTAAITHTIFAFITYGDHILITESAYAPTQNFCRFLLNKMNVHTTWFHSSISNNITNLIQHNTKLIILESPGSITMEVQDIPTLIQATRKKKPDIIILLDNTWSSGVFLKALDIGVDISIQSGTKYIIGHSDGMMGTAVSNARCWNTLQEQSYLMGQTIDADTAYIAARGLRTLYVRLKQHEKTGLHLAQWLNNHPKVDRVNHPALPSCQGHKYFIRDFTGSSGLFSFILKKRLTDKQLSNFLDNMKYFKMAYSWGGFESLITTMQIEELNSIRPINKLNFTGTLIRIHAGLEHQEDLIQDLSDGLNRI

SEQ ID NO: 19128 - DNA, 1194 bp, Bordetella pertussis
  CDS (1)..(1194)
atgaccgacgaatcccgccacatcgacaccctgctccagcacctgggcaccgcgcccttcgaccccgataccggcgccgccccggtcaacctgccgtcgatgcgcgccagcacggtgcgctttcgtgacctggccgcgctggaacaggcgcagcgccgcaaggccggcggcgaccgggccgtgacctatggccggatgggcatggatacgcatgcggcgctggaacacgtgttcaaggagctggaagccggcacgcactgctacctggcgtcttcgggcatgggcgccgtcacgatggcgtttctgtcgctgctgtcggccggcgagcatgcgctggtggccgattgcgtctatggcccggtctacgaactggacaacgcggtgctcaagcgcatgggtatcgagctgaccttcttcgcgcccggcgacgacctgcaggcgctggtgcgtcccaacacccgcctgctgtatgtcgagtcgccggggtcgctgctgttccagatgctggatctgcccgcgctggccgagttcgcgcgccgcaaccagctggtgctggccaccgacaacacctggggctcgggctacatctatcgcccgctggaactgggcgcgcaggtttcggtgatcgccggcaccaagtacgtgggcggccactccgacctgatgctgggcgcggtggttaccaatgacgaggccgtggcgcagcgcctgaaccgcacgcagtacgccatgggctactcggtcagcgccgacgatgcctggctggcgttgcgcggcgtgcgtacgctgccgatacgcatggcccagcacgcgcgccacgcccagcgcgtgtgcgagttcctgcagggccgtcccgaggtcgcgcgcatctaccatccggcctggcctcaggaccccggccacgcgctgtggctgcgcgactgctccggctccaacggcatgctgacggtcgagctgcgcctgtcgcagcccgcggcgcgcgtgttcgtcgagtcgctgcagctgttcgacatcggcttctcgtggggcggcttcgaaagcctggtgcagctggtcacgcccggggagctggcccgccaccgctattggcagggcggcggcaatgcgctggtgcggctgcatatcgggctggagtcgcccgaggatgtcattgccgacctgacccaggcgctggcgcgcgcagcctcggcctga

SEQ ID NO: 19129 - protein, 397 aa, Bordetella pertussis
MTDESRHIDTLLQHLGTAPFDPDTGAAPVNLPSMRASTVRFRDLAALEQAQRRKAGGDRAVTYGRMGMDTHAALEHVFKELEAGTHCYLASSGMGAVTMAFLSLLSAGEHALVADCVYGPVYELDNAVLKRMGIELTFFAPGDDLQALVRPNTRLLYVESPGSLLFQMLDLPALAEFARRNQLVLATDNTWGSGYIYRPLELGAQVSVIAGTKYVGGHSDLMLGAVVTNDEAVAQRLNRTQYAMGYSVSADDAWLALRGVRTLPIRMAQHARHAQRVCEFLQGRPEVARIYHPAWPQDPGHALWLRDCSGSNGMLTVELRLSQPAARVFVESLQLFDIGFSWGGFESLVQLVTPGELARHRYWQGGGNALVRLHIGLESPEDVIADLTQALARAASA

SEQ ID NO: 19130 - DNA, 1164 bp, Bordetella parapertussis
  CDS (1)..(1164)
atgaaacccgatacccggttggtgcacctgggccgcgatcccgagcggttcgaggggctggtgaacattccgccgtgcaggacctcgaccttcctgcacgcgtcggtggcggattaccaggcggcggcgtcgcgcaagcaggacagcctgtactacggccgcttcggcagccagaccagccgggcgctggaggccgcctgcaccgagctcgacggcggccatggcgccatgctgttcccgtgcgggctggcggccatcacgcgcgtgctgggcagcctgctcgaaccgggccagtatctgctgatggccgacacggtgtatgggccggcgcgggcgttctgcgaacaggagctggcccggctgggcgtcgagaccacctggtacgcgccggacgcggacctcgacgcgctggtgcggcccgccacgcgcgtgatctacggcgaggcgcccggttcgctgaccttcgaaatgcaggacctgcgcgcgctggccgaggtggcgcgccgccacggcctggtctcggtggtggacaacacctgggccacgtcgtggttctgccagccgctggcgctgggcatagacatcagcatccagtcggcctccaagtacatcgtgggccattcggacgcgatgctgggcgtggcggtggccaacgaggcacagtttccggcgctgcggcgcgcggccgcgcagtatggcaacgccgtcagcccggacgattgctatatggcgctgcgcgggctgcgcacgctgggggtgcggctggagcgccaccaggccagcgcgctgcgcgtggcgcagtggctgcgcacgcgcgccgaggtcgagcaggtgctgcatccggcgctgcccgacagccccggccacgccttgtggcggcgcgatttctccggggccagcggcctgttcggcgtggcctttcgcgccggcgacgacgccgcgctggcgcgcttcgtggacgatctgcggctctttggcatcggcgtgagctggggcgggttcgaaagccttgccttgcccagccatccggtgcgcaatacgtcggcggcggccctgggcggccggccgctggtgcgcctgcacatcggcctggaagacccggacgacctgattgccgacctggctcgcgcgctggaccgccatatggcggcggcgcgcggctga

SEQ ID NO: 19131 - protein, 387 aa, Bordetella parapertussis
MKPDTRLVHLGRDPERFEGLVNIPPCRTSTFLHASVADYQAAASRKQDSLYYGRFGSQTSRALEAACTELDGGHGAMLFPCGLAAITRVLGSLLEPGQYLLMADTVYGPARAFCEQELARLGVETTWYAPDADLDALVRPATRVIYGEAPGSLTFEMQDLRALAEVARRHGLVSVVDNTWATSWFCQPLALGIDISIQSASKYIVGHSDAMLGVAVANEAQFPALRRAAAQYGNAVSPDDCYMALRGLRTLGVRLERHQASALRVAQWLRTRAEVEQVLHPALPDSPGHALWRRDFSGASGLFGVAFRAGDDAALARFVDDLRLFGIGVSWGGFESLALPSHPVRNTSAAALGGRPLVRLHIGLEDPDDLIADLARALDRHMAAARG

SEQ ID NO: 19132 - DNA, 1194 bp, Bordetella parapertussis
  CDS (1)..(1194)
atgaccgacgaatcccgccacatcgacaccctgctccagcacctgggcaccgcgcccttcgaccccgataccggcgccgccccggtcaacctgccgtcgatgcgcgccagcacggtgcgctttcgtgacctggccgcgctggaacaggcgcagcgccgcaaggccggcggcgaccgggccgtgacctatggccggatgggcatggatacgcatgcggcgctggaacacgtgttcaaggagctggaagccggcacgcactgctacctggcgtcttcgggcatgggcgccgtcacgatggcgtttctgtcgctgctgtcggccggcgagcatgcgctggtggccgattgcgtctatggcccggtctacgaactggacaacgcggtgctcaagcgcatgggtatcgagctgaccttcttcgcgcccggcgacgacctgcaggcgctggtgcgtcccaacacccgcctgctgtatgtcgagtcgccggggtcgctgctgttccagatgctggatctgctcgcgctggccgagttcgcgcgccgcaaccagctggtgctggccaccgacaacacctggggctcgggctacatctatcgcccgctggaactgggcgcgcaggtttcggtgatcgccggcaccaagtacgtgggcggccactccgacctgatgctgggcgcggtggttaccaatgacgaggccgtggcgcagcgcctgaaccgcacgcagtacgccatgggctactcggtcagcgccgacgatgcctggctggcgttgcgcggcgtgcgtacgctgccgatacgcatggcccagcacgcgcgccacgcccagcgcgtgtgcgagttcctgcagggccgtcccgaggtcgcgcgcatctaccatccggcctggcctcaggaccccggccacgcgctgtggctgcgcgactgctccggctccaacggcatgctggcggtcgagctgcgcctgtcgcagcccgcggcgcgcgtgttcgtcgagtcgctgcagctgttcggcatcggcttctcgtggggcggcttcgaaagcctggtgcagctggtcacgcccggggagctggcccgccactactattggcagggcggcggcaatgcgctggtgcggctgcatatcgggctggagtcgcccgaggatgtcattgccgacctgacccaggcgctggcgcgcgcagcctcggcctga

SEQ ID NO: 19133 - protein, 397 aa, Bordetella parapertussis
MTDESRHIDTLLQHLGTAPFDPDTGAAPVNLPSMRASTVRFRDLAALEQAQRRKAGGDRAVTYGRMGMDTHAALEHVFKELEAGTHCYLASSGMGAVTMAFLSLLSAGEHALVADCVYGPVYELDNAVLKRMGIELTFFAPGDDLQALVRPNTRLLYVESPGSLLFQMLDLLALAEFARRNQLVLATDNTWGSGYIYRPLELGAQVSVIAGTKYVGGHSDLMLGAVVTNDEAVAQRLNRTQYAMGYSVSADDAWLALRGVRTLPIRMAQHARHAQRVCEFLQGRPEVARIYHPAWPQDPGHALWLRDCSGSNGMLAVELRLSQPAARVFVESLQLFGIGFSWGGFESLVQLVTPGELARHYYWQGGGNALVRLHIGLESPEDVIADLTQALARAASA

SEQ ID NO: 19134 - DNA, 1242 bp, Bordetella parapertussis
  CDS (1)..(1242)
atgcgcgggcgcgcatttcgctcctgcccgggcggcgcctgtcgcgccgcgggcaggtccgtccgaacactttcacttctgcaggtgctcatgaagttcgatacgctgctgacccatggcggtcgcgacccgaaggcgcacaaggggatggtgaacacacctgtctaccgcacctcaaccgttgtattcgagtccatggccgagtacaaggcaacccgtggcgcgaagttcgaccacgtacgctacgggcggctcggcacgcacaccgtgaaggagctggagaacctggtggccgccatcgaaggcggccatcgggcggttctcacgccctcgggcgtttcggccatcgccacgaccctcaataccctggcccgtccgggctcgcacatcctggtgccggacaacgtctattacccctgtcgcgagttctgcgaaaaggtgctggcgccgcgcggcgtgcgcgtcgagtactacgccggttcggaggtcgagcgcctggtccgccccgatacctcggtcgtgtactgcgagagccctggttcgctgaccatggaaatgcaggatttcgcccgcatcgccgccgccgcgcatgcggtcggcgccaaggtggtggccgacaacacctgggcgacgccggtattcctgcagccgttcgagcacggcatcgacgtctccatccatgccgccaccaagtacctggtgggccattcggacgtgatgatggggacggtgacggcgcatgaccccgagctgtggctggccatccgcacggaagcggccgcgcagggcctgtccatcagccccgacgacgcctatctggccacgcgcggtatccgcacgctgggggtgcgcatggcggcgcactaccgcaacgcgctggacgtggcgcaatggctggccgggcatccacgggtggcgcaggtgctgtatccggcgctgccgcagcaccccgaccacgcgctgtggcgccgccagatgcgcggcgcctcgggcctgctgaccctcgaactggagccctgcagcctcgagcagcgcgacgccttcatcgaccggctgacgctgtttgccatcggcgcgagctggggcggctacgagagcctggtgctgccggccgataccgccggcaagcgcagcctggcgggcagggactatgccgggccgctggtgcggctgcatatcggattggaagatgtcgaagacttgaagcgcgacctggaccaggcgctgcgccgggaggattga

SEQ ID NO: 19135 - protein, 413 aa, Bordetella parapertussis
MRGRAFRSCPGGACRAAGRSVRTLSLLQVLMKFDTLLTHGGRDPKAHKGMVNTPVYRTSTVVFESMAEYKATRGAKFDHVRYGRLGTHTVKELENLVAAIEGGHRAVLTPSGVSAIATTLNTLARPGSHILVPDNVYYPCREFCEKVLAPRGVRVEYYAGSEVERLVRPDTSVVYCESPGSLTMEMQDFARIAAAAHAVGAKVVADNTWATPVFLQPFEHGIDVSIHAATKYLVGHSDVMMGTVTAHDPELWLAIRTEAAAQGLSISPDDAYLATRGIRTLGVRMAAHYRNALDVAQWLAGHPRVAQVLYPALPQHPDHALWRRQMRGASGLLTLELEPCSLEQRDAFIDRLTLFAIGASWGGYESLVLPADTAGKRSLAGRDYAGPLVRLHIGLEDVEDLKRDLDQALRRED

SEQ ID NO: 19136 - DNA, 1227 bp, Bordetella bronchiseptica
  CDS (1)..(1227)
atgacagacaccacttccccccgccgcttgcagacccgtttgctgcacgcaggcaagaagcccgcctacgacggcggcgccccggtcaacccgccggtcgtgcgggccagcacggtgatattcgacaacgtcgcgcagcagcgcgacctgcgcgcgcggcgctcgggcgaacgcctgttcacctacggcgcgcgcggcaaccccaccaacttcgcgctggaggacgcggtcagcgagctggaaggcgcgtaccgcaccaagctgtttcccaccggcctggccgccatcgccatggcgctgctgtcgtacctcaagccgggcgaccatctgttgatgtccgacgcggtctacgagccggcgcgcaagctggtgcattcgttcctggcgccgtaccagatccgttgcactttctttgccgcggacggctcggacgtgcaggacaagctggagcccgccacgcgcatgatctacgccgagtgtcccggctcgctggtgtacgagatgtgcgacctgccccggctggccgagatcgcgcaccgccacggcgcgctgctggcctgcgacaacacctggggctcgggctgccagtaccggccgctggcgctgggcgcggacgtgtccatcatggcggccaccaaatacctcagcggccactcggacgtcatgatgggcacggtggccaccaccgaggcggcctggccggcgctgtccgagcgcagcgacgcgttcggcatgacggtcagcccggacgacgcatacctggtgctgcgcggcatacgcagcctggcggcgcgcctggccatgcacgagcgccacgcgctgcgcatcgccggctacctgcaggagcgccccgaggtgcgcaccgtgttctgcccggcgctgcccggccatcccggacacgacatctggcgccgcgactgcaccggcaccaacggcctgctgtcgttcgaactgcaagccggattcgaccgcgccgccgccgagcaatggatcgacagcctggcgctgttcggcctgggcgcctcatggggcggctacgaaagcctggtgacgctggccgacctgggcgccgcgcgcagcgtggccgactggtccggacgcggcgtcgtggtgcggctgcacatcggcctggaagacccgcaagacctgatcgccgacctggaccaggcgttcgccgccatcggtccggccggcaggcacaacactgtatcgaggagcgaagcgtga

SEQ ID NO: 19137 - protein, 408 aa, Bordetella bronchiseptica
MTDTTSPRRLQTRLLHAGKKPAYDGGAPVNPPVVRASTVIFDNVAQQRDLRARRSGERLFTYGARGNPTNFALEDAVSELEGAYRTKLFPTGLAAIAMALLSYLKPGDHLLMSDAVYEPARKLVHSFLAPYQIRCTFFAADGSDVQDKLEPATRMIYAECPGSLVYEMCDLPRLAEIAHRHGALLACDNTWGSGCQYRPLALGADVSIMAATKYLSGHSDVMMGTVATTEAAWPALSERSDAFGMTVSPDDAYLVLRGIRSLAARLAMHERHALRIAGYLQERPEVRTVFCPALPGHPGHDIWRRDCTGTNGLLSFELQAGFDRAAAEQWIDSLALFGLGASWGGYESLVTLADLGAARSVADWSGRGVVVRLHIGLEDPQDLIADLDQAFAAIGPAGRHNTVSRSEA

SEQ ID NO: 19138 - DNA, 1176 bp, Bacillus cereus
  CDS (1)..(1176)
atgaaaaagaagcatatggagacagcgttaattcatcacggttataaacctgaggaatataaaggaagtttaacaccacctttatttcaaacttctacatttacatttgagactgcgcagcaaggagaggcgagttttgcgggagtggatccatcttatatttactcacggcttggaaatccaactgtgaaattatttgaagaacgtatggcggtgttagaaggaggagaagaggcacttgccttcgggtctggtatggcagctatttcagcgactttaatcggttttttaaaggctggagatcatattatttgttcaaatggattatacggatgcacgtacggttttttagaagtgttagaagaaaaatttatgattacgcattcgttttgtgatatggagacagaggctgatattgaaaataaaattcgctcaaatacaaagcttattttcgttgaaacaccaattaatccaacgatgaaattaattgatttaaaacaagtgattcgggttgcgaagcgaaaaggcttacttgttattgttgataatacattttgttcaccttatttacaaagaccgcttgagcttggctgtgacgctgttgtgcatagtgcgacaaaatatattggtggtcacggtgacgttgtagcgggcgtaacaatttgtaaaacgaaagcattagctgaaaagattcgcccgatgcgaaaggatatcggcggtattatggcaccgtttgatgcgtggttattattacgcgggttaaagacgttagcagtaagaatggatcgtcattgtgataatgcagaaaaaattgtatcgttcttaagaaaacatgatgcggtagaaggtgtttggtatccagaaggagagttagcatctcgtcaaatgaaacgcgggggcggtgttatttctttttcagtaaaaggcggaaaagaagagacgcaagcgtttattaatgatcttcactttattacaattgcggtgagtttaggagatacagaaacgttaattcagcatccagcaacgatgacgcacgctgcgattccagctgaactaagaaaagaaatgggcattttcgataatttaatacgcttatcagtcggtttagaatcgtgggaggatatcgtttctgatttagagcaggcattaaagaaaatatctactgttaatcaataa

SEQ ID NO: 19139 - protein, 391 aa, Bacillus cereus
MKKKHMETALIHHGYKPEEYKGSLTPPLFQTSTFTFETAQQGEASFAGVDPSYIYSRLGNPTVKLFEERMAVLEGGEEALAFGSGMAAISATLIGFLKAGDHIICSNGLYGCTYGFLEVLEEKFMITHSFCDMETEADIENKIRSNTKLIFVETPINPTMKLIDLKQVIRVAKRKGLLVIVDNTFCSPYLQRPLELGCDAVVHSATKYIGGHGDVVAGVTICKTKALAEKIRPMRKDIGGIMAPFDAWLLLRGLKTLAVRMDRHCDNAEKIVSFLRKHDAVEGVWYPEGELASRQMKRGGGVISFSVKGGKEETQAFINDLHFITIAVSLGDTETLIQHPATMTHAAIPAELRKEMGIFDNLIRLSVGLESWEDIVSDLEQALKKISTVNQ

SEQ ID NO: 19140 - DNA, 1164 bp, Bacillus cereus
  CDS (1)..(1164)
atgagctattctatagatacactcttactacacaaccaatataaacacgactcgcaaacaggcgctgtgaacgttcctatttataatacatcaacttttcaccagtttgatgtagatacgttcggaaaatatgactatagcaggtcaggaaatccaactcgtgaagctcttgaagatatcattgctttattagaaggcggaacaaaaggattcgcctttgcatcaggcattgcagcgatttccactgcattcctccttctttcacaaggtgatcacgtactcatttcagaagatgtgtacggaggcacttaccgagtgataactgaggtactctcccgttacggtgtttcacatacatttgttgatatgaccaatttagaagaaataaaacaaaacattaaaccaaatacaaagctcttttatgtagaaacaccttctaacccacttttaaaagtgacagatattcgcgaggtttctaaactcgcaaaatctattggcgctcttacttttgttgataatacatttttgacaccactattccaaaaaccacttgaacttggagctgatgtcgttcttcatagtgctacaaaatttattgctggtcatagtgatgttactgccggattagcagtagtaaaagattcagaactcgctcaaaagcttggatttttacaaaatgcattcggtgctattttaggacctcaagattgttctctcgtacttcgcggtctaaaaacattgcatgtacgcctcgaacattcagctaaaaatgccaataaaatcgcacattatttacaagagcactctaaagtaaaaaatgtctattatccgggattacaaactcatctcggatttgatattcaacaatctcaagcaacatcagctggagcggtcttatcgtttactttgcagtcagaagatgcactccgcaaatttttatcaaaagtaaaattacctgtttttgcagttagtttaggagctgtagagtcaattctttcttatccagcaaaaatgtcacatgcagcactgtcgcaagaagctcgtgataaaagaggaatctctaattcattacttcggttatcagtcggtcttgaaaatgttaacgatttaatatccgattttgaaaatgccctttcttatgtagaagaacctgtaaatgcatag

SEQ ID NO: 19141 - protein, 387 aa, Bacillus cereus
MSYSIDTLLLHNQYKHDSQTGAVNVPIYNTSTFHQFDVDTFGKYDYSRSGNPTREALEDIIALLEGGTKGFAFASGIAAISTAFLLLSQGDHVLISEDVYGGTYRVITEVLSRYGVSHTFVDMTNLEEIKQNIKPNTKLFYVETPSNPLLKVTDIREVSKLAKSIGALTFVDNTFLTPLFQKPLELGADVVLHSATKFIAGHSDVTAGLAVVKDSELAQKLGFLQNAFGAILGPQDCSLVLRGLKTLHVRLEHSAKNANKIAHYLQEHSKVKNVYYPGLQTHLGFDIQQSQATSAGAVLSFTLQSEDALRKFLSKVKLPVFAVSLGAVESILSYPAKMSHAALSQEARDKRGISNSLLRLSVGLENVNDLISDFENALSYVEEPVNA

SEQ ID NO: 19142 - DNA, 1155 bp, Streptomyces avermitilis
  CDS (1)..(1155)
atgagcgacaggcacatcagtcagcacttcgagaccctcgcgatccacgcgggcaacaccgccgatcccctgaccggcgcggtcgtcccgccgatctaccaggtctcgacctacaaacaggacggcgtcggggggctgcgcggcggctacgagtacagccgcagcgccaaccccaccaggaccgccctggaagagaacctcgccgccctcgagggcggccgccgcggcctcgcgttcgcgtccggactggcggccgaggactgcctgttgcgtacgctgctcagccccggcgatcacgtggtcatccccaacgacgcgtacggcggaacgttccgtctcttcgcgaaggtcgtctcccggtggggcgtggagtggtcggtcgccgacaccagcgaccccgaggccgtccgggccgcgatcaccccgaagaccaaggccatctgggtggagaccccgtccaacccgctcctcggcatcaccgacatccccgcgatcgcccagatcgcgcgcgaggccggcgccaagctggtcgtcgacaacaccttcgccaccccctacctccagcagccgctcgcgctcggcgcggacgtcgtcgtgcactcgctgaccaagtacatgggcggccactcggacgtcgtcggcggtgcgctcgtggtgagtgaccaggagctgggcgaggagctcgcctaccaccagaacgcgatgggcgcggtcgccgggcccttcgactcctggctggtactgcgcggcaccaagacgctctccgtgcgcatggaccggcacagcgagaacgccaccaaggtcacggagatgctcacccggcacgcgcgcgtgacgcgcgttctgtacccgggcctgccggagcaccccggtcacgagatcgccgccaagcaaatgcgggcgttcggcggcatggtctccttccaggtcgagggcggcgaggaggcggccgtcgaggtctgcaaccgcgccaaggtcttcaccctcggcgagtccctgggcggcgtcgagtccctgatcgagcaccccgggcggatgacgcacgcgtccgcggccggctccgcgctcgaggtccccgccgacctcgtacgcctctccgtgggcatcgagaacgtcgacgacctgcttcaggacctccagcaggccctgggctag

SEQ ID NO: 19143 - protein, 384 aa, Streptomyces avermitilis
MSDRHISQHFETLAIHAGNTADPLTGAVVPPIYQVSTYKQDGVGGLRGGYEYSRSANPTRTALEENLAALEGGRRGLAFASGLAAEDCLLRTLLSPGDHVVIPNDAYGGTFRLFAKVVSRWGVEWSVADTSDPEAVRAAITPKTKAIWVETPSNPLLGITDIPAIAQIAREAGAKLVVDNTFATPYLQQPLALGADVVVHSLTKYMGGHSDVVGGALVVSDQELGEELAYHQNAMGAVAGPFDSWLVLRGTKTLSVRMDRHSENATKVTEMLTRHARVTRVLYPGLPEHPGHEIAAKQMRAFGGMVSFQVEGGEEAAVEVCNRAKVFTLGESLGGVESLIEHPGRMTHASAAGSALEVPADLVRLSVGIENVDDLLQDLQQALG

SEQ ID NO: 19144 - DNA, 1176 bp, Nitrosomonas europaea ATCC 19718
  CDS (1)..(1176)
atgacgaacgatctggatccggaaacactggccattcataccggtgttcaccgcagtcaattcaatgaacattcggaatcactttacctgacctcgagttttgtatttgacagtgctgcccaggctgcagcgcgtttttccggacaagagcccgggaatatctattcgcgtttcactaacccgaccgtgactgcaatgcaggaacggctggctgttctggagggtgcagaagcctgtattgcgactgcttccggtatgtctgccattctcacctgtgtcatgggcctgttgtctgccggggatcatatcgttgcttctcgcagcctgtttggatctactgtcagtctgttcaacaatattctcagtcgcttcggtattcaaacgacatttgtttcagcgacggatcctgctgaatggcaggctgcagtcaggcccaacaccaggttgtttttcctggaaacaccttccaatccgctgactgagatttccgatattgctgcactggcagaaatagccaaacgagccggtgtgtggctggcagtggataactgtttctgtacgccgatcatacagcagccactcaagctgggtgcggatctggtgattcattcagcaacgaaatatctggacgggcagggcagagtactggggggggccatcctgggtaaacgtgatttactcatggacagcggcatattcagttttctgcgtactgccggcccgtctctgagtgcattcaatgcctggatcatcctgaaagggatggaaacattgagccttagagtaaaggcgcattcggatcatgcactggaagtggcacgctggctggaaacccatccccgggtggggcgtgtgttttatcccggtctgccatcacatccgcaacatgagcttgcaatgcgccagcagaaaacaggagggggtatcgtttcgttcgaggtgaaaggcggcagggaggctgcctggcgtgttgtcgatgccgcccggctgatgtcgattacagccaatcttggtgataccaaaagtacactgacgcatcctgctaccacgactcacggacgaatcagtcaggaagcacgtgaagctgccggaatcagggatggtttgctgcgtatcgcggtaggtctggaatcaccagatgacctcaaggccgatcttgctcgcggattgcaataa

SEQ ID NO: 19145 - protein, 391 aa, Nitrosomonas europaea ATCC 19718
MTNDLDPETLAIHTGVHRSQFNEHSESLYLTSSFVFDSAAQAAARFSGQEPGNIYSRFTNPTVTAMQERLAVLEGAEACIATASGMSAILTCVMGLLSAGDHIVASRSLFGSTVSLFNNILSRFGIQTTFVSATDPAEWQAAVRPNTRLFFLETPSNPLTEISDIAALAEIAKRAGVWLAVDNCFCTPIIQQPLKLGADLVIHSATKYLDGQGRVLGGAILGKRDLLMDSGIFSFLRTAGPSLSAFNAWIILKGMETLSLRVKAHSDHALEVARWLETHPRVGRVFYPGLPSHPQHELAMRQQKTGGGIVSFEVKGGREAAWRVVDAARLMSITANLGDTKSTLTHPATTTHGRISQEAREAAGIRDGLLRIAVGLESPDDLKADLARGLQ

SEQ ID NO: 19146 - DNA, 1188 bp, Enterococcus faecalis
  CDS (1)..(1188)
atgcatgttgagaatgatgaaaatatttgctgtgaagtggaaaaaggaatggaaaaaatgtatcatccgatggtgcccgagttggttcaaacctcttccttttattttccaacttacgaagaatttatggcagcgagtatagatgaaaaaaataattatgtttacacacgtggcaccaaccccacaacagaaattttagagaaaaaaattgctcgtttggaacgtggagaaaaatgtaaagtttttgcctcaggaatgggcgctatttcggcaacgctgtttacgttgctccaacaaggtgatcatgttttaatggtcaatacaatttatggagaatctgtttcgtttgtgcaatatttagagaaatttggcgtatccttgaccaaagtagacgttgcagaaacagaagaactttttcaatttgttcaggaaaacaccaaagtcatttactttgaaagtccgtcctcacaaaagtttgaactgctagatttagaaaaaataactgcgttagcacaaaaaattggcgcatacactgtcattgataacacgtgggcgtcaccgttatttcagcatcctttatgccataatgtggacctggtgattcattcttgttccaaatatattggtggtcattcggatattgtagcgggggctgtcattggcaaagcagcgcttgtagatcaaatttttgaacatggtcatcaagcattaggcgcagtcaatagtcccttcaattcttggttagcgttacgaggtattcgtaccatgcccgttcggttggcgcatcagtctcaagccatccaaacggtgctgttggctttgcaaaaggatccgcgaattagtcgcttatatcatccttttgtaggaaatcaacaacaacaagcgttagcagaaaaatatttgacaggttatggctcattgtttgcgattgatttaaaagataccgattttgaacgtttgaaaacatttgtgaacgcattgacgctggtcacaattggggtcagttggggtggctttgaaagtttggccttgcctgtattcaaaggcaataacttggcggctgttcagaaaagaggcttgtcgccagcgcacattcgcatgtacgttggtttggaagagccaacatctattatcgaagatattcaacaagccttggatcaagcctatggcgaagaatcgcttttgtga

SEQ ID NO: 19147 - protein, 395 aa, Enterococcus faecalis
MHVENDENICCEVEKGMEKMYHPMVPELVQTSSFYFPTYEEFMAASIDEKNNYVYTRGTNPTTEILEKKIARLERGEKCKVFASGMGAISATLFTLLQQGDHVLMVNTIYGESVSFVQYLEKFGVSLTKVDVAETEELFQFVQENTKVIYFESPSSQKFELLDLEKITALAQKIGAYTVIDNTWASPLFQHPLCHNVDLVIHSCSKYIGGHSDIVAGAVIGKAALVDQIFEHGHQALGAVNSPFNSWLALRGIRTMPVRLAHQSQAIQTVLLALQKDPRISRLYHPFVGNQQQQALAEKYLTGYGSLFAIDLKDTDFERLKTFVNALTLVTIGVSWGGFESLALPVFKGNNLAAVQKRGLSPAHIRMYVGLEEPTSIIEDIQQALDQAYGEESLL

SEQ ID NO: 19148 - DNA, 1185 bp, Enterococcus faecalis V583
  CDS (49)..(1185)
gtgaccgttatttatcaaaaaatatttattcttaggaggaaaacttttatgaaattcaataccaaattaattcatggcggcattagtaaagatacaacaacaggtgcagtgagtgttcctatttatcaaacatcaacctttgaacaaaatggcgtgggccagccaaaagaatatgaatattctcgttcaggtaatcccacacgtcacgcgttagaaaccttaatcgctgagttagaaggtgggagccatggctttgcgtttagctcaggcttagctggtattcatgcaatcatttctatgtttggacccgaagatcatattttattaggtgacgatgtctatggggggagtttccgtttattggataaagtatttgtagcaaatgggttaagctacacgattgtaaacgccagcgacttatcaacaattgaagccgcaattcagccaaatacaaaagccttgtttttggaaacaccaagtaatccactgttaaaaattacagatattgaagcggcggctaagcttgctaaaaaacatcagttgttaactattgtcgataatacatttgcgacgccttattttcaacggccgttagcgttaggtgctgatattgtcgttcacagcgggacaaaatatttagggggccatagtgatgtagtctctggtttggtcgtaacgaatcatccagaaagcgcagaaaagattgcctttttacaaaatgcgattggtgctgttttaggaccacatgatagttggctggtccaacgtagtttaaaaacattaggcgtccggatggcagcacatgcccaaaatgctcaaaaaatcgcagaatttttagaagcgcatccagcggtagcaacggtgtattatccaggactagcgagtcatcctggtcacgaaattgcgcaaaaacagatgtcgggatttagtggcatgatttcttttgaattagccaaggatgagcaagtcgttcctttcgtagaagcgttggaaatttttactttagcggaaagtttaggtggcgtagaaagtttaattgaagtacctgccattatgactcacgcatctattcccaaagaaaatcgtgaagctgtgggaattaaagatggactcattcgtttatctgtaggaattgaagcagtcgaagatttattggctgatttagaaaagggattacaagcataa

SEQ ID NO: 19149 - protein, 378 aa, Enterococcus faecalis V583
MKFNTKLIHGGISKDTTTGAVSVPIYQTSTFEQNGVGQPKEYEYSRSGNPTRHALETLIAELEGGSHGFAFSSGLAGIHAIISMFGPEDHILLGDDVYGGSFRLLDKVFVANGLSYTIVNASDLSTIEAAIQPNTKALFLETPSNPLLKITDIEAAAKLAKKHQLLTIVDNTFATPYFQRPLALGADIVVHSGTKYLGGHSDVVSGLVVTNHPESAEKIAFLQNAIGAVLGPHDSWLVQRSLKTLGVRMAAHAQNAQKIAEFLEAHPAVATVYYPGLASHPGHEIAQKQMSGFSGMISFELAKDEQVVPFVEALEIFTLAESLGGVESLIEVPAIMTHASIPKENREAVGIKDGLIRLSVGIEAVEDLLADLEKGLQA

SEQ ID NO: 19150 - DNA, 1164 bp, Coxiella burnetii RSA 493
  CDS (1)..(1164)
atgacagctaacaacaataaaaaatcacacatcgatacacgtgtcattcacgccggacaaaaaccggaccccttaaccggcgccgtcatgacgcccatctataccgcttccacttatgcgcaaaaaagtccaggcgttcatcaagggtacgaatattctcgcagccaaaatccgacgcgctttgcttatgaacgttgtgttgcggatttagagtctggacaacacggttttgcttttgcgtcaggaatggccgccaccgccactattttagaactcttgcaaccgggcgatcatgtagtggtgatggacgacgtttatgggggctcctatcgtttatttgaaaatgtacgaaagcgatcagccggcctttctttttcgttcgtcgatttcacggacgaaaataaagtgcgagaagccgtcaccgcaaaaactaaaatgttgtgggtagaatcaccaagcaatcctcggcttaaaatcgttgatcttgcaaaaattgcggaaatcgcaaaagaaaaaaatatcatcgcggttgccgacaacaccttcgccacaccgattattcaacgcccattagaattaggcttcgatatcgttacacattcggcaacaaaatatttaaatggccattctgatatcatcggcggcgtagccgtggtgggcgacaataaaactttagccgaacaattaaaatatttacaaaacgccataggcgctatcgccgcgcctttcgatagttttatggttttacgcggattaaaaacgttagccattcgaatggaacgccattgtgaaaatgcgatgcagttagcccaatggctagaaaaacaccccaaagtaaaacgcgtttattaccctggcttaccaagccacccccagcactcgattgctaaaaaacaaatgcgttattttggcggcatgatttctgtcgaactaaaatgcgatttaaatgagactaaaaaagtactcgaacgctgccaactgttcaccttagcggaaagcctcggcggtgttgaaagcctcatcgaacaccccgccataatgacccacgcctccattccacaagcagaacgccaaaaactgggcataacggatggttttatccgcctctccgttggcatcgaagcgataactgatttgcgccacgatctagaagcagcgctttaa

SEQ ID NO: 19151 - protein, 387 aa, Coxiella burnetii RSA 493
MTANNNKKSHIDTRVIHAGQKPDPLTGAVMTPIYTASTYAQKSPGVHQGYEYSRSQNPTRFAYERCVADLESGQHGFAFASGMAATATILELLQPGDHVVVMDDVYGGSYRLFENVRKRSAGLSFSFVDFTDENKVREAVTAKTKMLWVESPSNPRLKIVDLAKIAEIAKEKNIIAVADNTFATPIIQRPLELGFDIVTHSATKYLNGHSDIIGGVAVVGDNKTLAEQLKYLQNAIGAIAAPFDSFMVLRGLKTLAIRMERHCENAMQLAQWLEKHPKVKRVYYPGLPSHPQHSIAKKQMRYFGGMISVELKCDLNETKKVLERCQLFTLAESLGGVESLIEHPAIMTHASIPQAERQKLGITDGFIRLSVGIEAITDLRHDLEAAL

SEQ ID NO: 19152 - DNA, 1338 bp, Shigella flexneri 2a str
  CDS (1)..(1338)
atgacatcgtgtaatgcacctgtcggcgtgataatgcatataattttaacggctatttgggatttgctcaatctatacgcaaagaagtttagatgtccagatgtattgacgtccattaacacaatgtttactctggtgcctgacatttcaccgacaaagcccaggaaacttcatcacatgacgcgtaaacaggccaccatcgcagtgcgtagcgggttaaatgacgacgaacagtatggttgcgttgtccctcccatccatctttccagcacctataactttaccggatttaatgaaccgcgcgcgcatgattactcgcgtcgcggcaacccaacgcgcgatgtggttcagcgtgcgctggcagaactggaaggcggtgctggcgcagtacttactaataccggcatgtccgcgattcacctggtaacgaccgtctttttgaaacctggcgatctgctggttgcgccgcacgactgctacggcggtagctatcgcctgttcgacagtctggcgaaacgcggttgctatcgcgtgttgtttgttgatcaaggcgatgaacaggcattacgggcagcgctggcagaaaaacccaaactggtactggtagaaagcccaagtaatccattgttacgcgtcgtggatattgcgaaaatctgccatctggcaagggaagtcggggcggtgagcgtggtggataacaccttcttaagcccggcattacaaaatccgctggcattgggtgccgatctggtgttgcattcatgtacgaaatatctgaacggtcactctgacgtggtggctggcgtggtgattgctaaagacccggacgttgtcactgaacttgcctggtgggcaaacaatattggcgtgacgggcggcgcgtttgacagctatctgctgctacgcgggttgcgaacgctggtgccgcgtatggagctggcgcagcgcaacgcgcaggcgattgtgaaatatctgcaaacccagccgttggtgaaaaaactgtatcacccgtcgctgccggaaaatcaggggcatgaaattgccgcgcgtcagcaaaaaggctttggcgcaatgttgagttttgaactggatggcgatgagcagacgctgtgtcgtttcctgggcgggctgtcgttgtttacgctggcggaatcattagggggagtggaaagtttaatctctcacgccgcaaccatgacacatgcaggcatggcaccagaagcgcgtgctgccgccgggatctccgagacgctgctgcgtatctccaccggtattgaagatggcgaagatttaattgccgacctggaaaatggcttccgggctgcaaacaaggggtaa

SEQ ID NO: 19153 - protein, 445 aa, Shigella flexneri 2a str
MTSCNAPVGVIMHIILTAIWDLLNLYAKKFRCPDVLTSINTMFTLVPDISPTKPRKLHHMTRKQATIAVRSGLNDDEQYGCVVPPIHLSSTYNFTGFNEPRAHDYSRRGNPTRDVVQRALAELEGGAGAVLTNTGMSAIHLVTTVFLKPGDLLVAPHDCYGGSYRLFDSLAKRGCYRVLFVDQGDEQALRAALAEKPKLVLVESPSNPLLRVVDIAKICHLAREVGAVSVVDNTFLSPALQNPLALGADLVLHSCTKYLNGHSDVVAGVVIAKDPDVVTELAWWANNIGVTGGAFDSYLLLRGLRTLVPRMELAQRNAQAIVKYLQTQPLVKKLYHPSLPENQGHEIAARQQKGFGAMLSFELDGDEQTLCRFLGGLSLFTLAESLGGVESLISHAATMTHAGMAPEARAAAGISETLLRISTGIEDGEDLIADLENGFRAANKG

SEQ ID NO: 19154 - DNA, 1197 bp, Citrobacter freundii
  CDS (1)..(1197)
atgtctgactgtcgtacttacggattcaacacccagatcgttcacgcggggcaacaacccgacccttctacaggcgcgctcagtacgcctattttccagacttcaacgtttgtttttgacagcgccgaacaaggtgccgcccgctttgcgctcgaagagtccgggtacatttacacccgtttgggtaaccccaccaccgatgcgctggagaaaaagctggcggtactggaaagaggtgaagccgggctggcaaccgcatccggtatttctgccatcaccaccacgctgctgacgttgtgccagcagggcgaccatatcgtttccgccagcgcgatttacggctgcacccacgcgtttttgtcgcacagcatgccgaagtttgggattaacgtcaggttagtggatgcgggaaagcctgaagaaatccgcgccgccatgcgcccggaaaccaaagtagtgtatatcgaaacgcccgctaacccgacgctgtcgctggtcgacattgaaacggtagccggtatcgcccatcaacaaggcgcattgctggtggtggataacacctttatgtcaccgtactgccagcagcctttacagctaggcgcggatattgtggtgcacagcgtcactaaatatatcaacggtcacggagacgtgattggcgggatcattgttggtaagcaggagtttattgaccaggcgcggtttgttggtctgaaagatatcaccggcggctgcatgagtcctttcaacgcgtggctgacgctacgcggcgttaaaacactggggattcgtatggaacgccactgtgaaaacgcattgaaaatcgcccgcttcctcgaggggcatccgtccattacccgcgtttattatcctggcttgtcttcacacccgcagtatgagctgggccagcgacagatgagcctgccaggaggaattatcagcttcgaaatcgctggcggcctcgaggctggcagacggatgatcaattctgtagaattgtgcctcctcgcggtcagtctcggtgataccgaaaccctcattcagcacccagcgtctatgacacattcgcccgttgcgccagaggaacggcttaaagcaggtattaccgacgggcttatccgtctttctgtgggtcttgaagatccagaagatattattaacgaccttgaacacgccatcagaaaggcaacattctga

SEQ ID NO: 19155 - protein, 398 aa, Citrobacter freundii
MSDCRTYGFNTQIVHAGQQPDPSTGALSTPIFQTSTFVFDSAEQGAARFALEESGYIYTRLGNPTTDALEKKLAVLERGEAGLATASGISAITTTLLTLCQQGDHIVSASAIYGCTHAFLSHSMPKFGINVRLVDAGKPEEIRAAMRPETKVVYIETPANPTLSLVDIETVAGIAHQQGALLVVDNTFMSPYCQQPLQLGADIVVHSVTKYINGHGDVIGGIIVGKQEFIDQARFVGLKDITGGCMSPFNAWLTLRGVKTLGIRMERHCENALKIARFLEGHPSITRVYYPGLSSHPQYELGQRQMSLPGGIISFEIAGGLEAGRRMINSVELCLLAVSLGDTETLIQHPASMTHSPVAPEERLKAGITDGLIRLSVGLEDPEDIINDLEHAIRKATF

SEQ ID NO: 19156 - DNA, 1179 bp, Entamoeba histolytica
  CDS (1)..(1179)
atgtctcaattgaaggatttacaaacaagagttttacatactccatctaagtggggagaaccattacatgcacatactttcccaattttccaaacatcaacatacctttttgatgatactcaaatgggagccgatttatttggaggaaaaagagaaggacatatgtattctcgtatgggaaatccaactgttgaatattttgaagaacttgttaattcattagaaggaggagttggaactgctgcttttggttcaggaatgggtgctattcattctgcaacaatgggacttcttaaagctggtgatattcttatttctggtgatactctttgtggatgtactgttgaattatttggaaatagatttaaagatatgggtgttgatgtttcatttgttaatactgcatctgatgaagctgttgtaaaagcatggaaaccaaataccaagatggtttatttagaatcaccagcaaatccaacatgtaaagtttcagatattaaaggaattgctaagatttgtcatgaaaaaggtgctattttagttgttgattgtacttttactacaccagtattccttccagctttagaacttggagcagatgttgttcttcattcaattactaagtacattaatggacatggtgatgtagttggtggtgttgttacaactaaaaacccagaacttcttcaaaagattaaagcatttagaaaagatacaggatcattaatggcaccaatggatgcattcttatgtattcgtggagttaaaacacttccaatgagaatgaaagttcatatggagaatggacttaaagttgccaaattcttagaacaacatccaaaaattaaacaagttaatcatccaggacttgaatcattcccaggtcataaaattgctatggaacaaatgaaaggatttggttctactttctcatttgaaatgaaatcatttgaagctgctaaaaaacttatggaacatgttaaattatgtggattagctgtttctcttggaactttagatacccttattgaacatcctgcttcaatgacgcatgctgctgttccagaacatcttcttaaacaacaaggtttaactagagaacttgtaagaatttccgttggattagaaaatccagatgatatcattgctgatttaaaacaagctcttgaacaatgctaa

SEQ ID NO: 19157 - protein, 392 aa, Entamoeba histolytica
MSQLKDLQTRVLHTPSKWGEPLHAHTFPIFQTSTYLFDDTQMGADLFGGKREGHMYSRMGNPTVEYFEELVNSLEGGVGTAAFGSGMGAIHSATMGLLKAGDILISGDTLCGCTVELFGNRFKDMGVDVSFVNTASDEAVVKAWKPNTKMVYLESPANPTCKVSDIKGIAKICHEKGAILVVDCTFTTPVFLPALELGADVVLHSITKYINGHGDVVGGVVTTKNPELLQKIKAFRKDTGSLMAPMDAFLCIRGVKTLPMRMKVHMENGLKVAKFLEQHPKIKQVNHPGLESFPGHKIAMEQMKGFGSTFSFEMKSFEAAKKLMEHVKLCGLAVSLGTLDTLIEHPASMTHAAVPEHLLKQQGLTRELVRISVGLENPDDIIADLKQALEQC

SEQ ID NO: 19158 - DNA, 1170 bp, Entamoeba histolytica
  CDS (1)..(1170)
atgactgctcaagatattactactactcttcttcatccaaaaggtgatcatgttttacattcacatgcttatccaatcttccaaacttctacattctgttttgattcaactcaacaaggtgctgatttgtttatgggtaaaggagaaggtcatatctactctagacttggaaatccaactgttgaacaatttgaagaaatggtatgttctattgaaggtgcagctggttctgctgcatttggttctggaatgggagctatttcatcatcaacacttgctttcttacaaaaaggagatcatttaattgcaggagatacattatatggatgtactgtttcattatttacacattggttaccaagattcggtattgaagttgatcttattgacacttctgatgtagaaaaagtaaaagcagcttggaaaccaaatactaaaatggtttatttagaatcaccagctaatccaacatgtaaagtctctgatattaaaggtattgctgttgtttgtcatgaacgtggagcacgtttagttgttgatgccactttcacttcaccatgtttccttaaaccattagaacttggagcagatattgaccttcattctgttagtaaatatattaatggacatggtgatgttattggtggtgtttcatcagcaaaaacagcagaagatattgcaactattaaattctatagaaaagatgcaggatcattaatggcaccaatggatgcattcttatgtgcaagaggaatgaaaactcttcctataagaatgcaaattcatatggaaaatggacttaaagttgctaaattcttagagcaacatgaaaaaatagttaaagttaatcatccaggacttgaatcattcccaggtcatgacattgctaaaaaacaaatgactggttatggttcaacattctcatttgaaatgaaatcatttgaagctgctaaaaaattaatggaacatcttaaagtatgtactttagcagtttcacttggatgtgttgatactcttattgagcatcctgcttcaatgactcatgcagctgttcctgaaaatataatgagaaaacaaggaattactcctgaattagttagaatttctgttggaattgaaaatgttgatgatattattgctgatttaaaacaagcattagagctttggtaa

SEQ ID NO: 19159 - protein, 389 aa, Entamoeba histolytica
MTAQDITTTLLHPKGDHVLHSHAYPIFQTSTFCFDSTQQGADLFMGKGEGHIYSRLGNPTVEQFEEMVCSIEGAAGSAAFGSGMGAISSSTLAFLQKGDHLIAGDTLYGCTVSLFTHWLPRFGIEVDLIDTSDVEKVKAAWKPNTKMVYLESPANPTCKVSDIKGIAVVCHERGARLVVDATFTSPCFLKPLELGADIDLHSVSKYINGHGDVIGGVSSAKTAEDIATIKFYRKDAGSLMAPMDAFLCARGMKTLPIRMQIHMENGLKVAKFLEQHEKIVKVNHPGLESFPGHDIAKKQMTGYGSTFSFEMKSFEAAKKLMEHLKVCTLAVSLGCVDTLIEHPASMTHAAVPENIMRKQGITPELVRISVGIENVDDIIADLKQALELW

SEQ ID NO: 19160 - DNA, 1203 bp, Xylella fastidiosa
  CDS (1)..(1203)
atgagcattcatgatgtgcacgaaggcacgtgtcacgtgaccacttccgcggtgcgtgctgggatcgattccgacactgctcatggggcagtgacgccaccgattgtgctttcatccaacttctcgtttgaacgtttcggtcataagcgtaagtacgattacacacgtagtgctaatccaacgcgggatctgctcggcgaggcgcttgcggagttggaggggggtgccggtggtgtggttacggcgactgggatcgctgcgattacgttggtgttgcacgcattgctccggccgggtgatcgtttggttgtgccacatgatgcttacggtggcagttggcgtttgttcaatgcgttggctcaaaagggacattttgaattgatcactgtcgatttgacggatgcacgatcactggttgaggcattggcactaccaccgaagttggtattgatcgaaactccttccaatccattgttacgtattactgatttgggtgcggtgattgaggcagcgcaccgtgtcggtgctttgactgtggtcgacaatacgtttatgtctccggtgttgcagcgtcctttagagttcggcgctgacttggtattgcattcgaccacgaagtacatcaatggccacagtgatgttgtcggtggcgttgttgtggcacgtgatgttgcgcactatcagcagttggtgtggtgggcgaatgcgctgggtctgaccggctcgccattcgatgccttcttgacgttgcggggggtgcgcacgctggatgcgcgtttgcgtgtgcatcaggagaatgcgcagatgattgcagccttactggaggggcatggtgtggtgaagcacgtgcattacccaggattagcttcgcatccggggcatgtgctggcggggcggcagcaaaaagggttcggtgccatgctcagtttcgagttgcagggtggggaagaggcggtgcgggcttttgtcagtggcttgcgttatttcacgctggctgagtcgctgggtggggttgagagtttgatcgctcatccggcttcgatgacgcatgctgccatgacgcccgaggcgcgtgctaaagcgggtatctctgatgggttgttgcgcttgtcggtggggattgaggccagtgaggatttgatcgttgatctggtggctggtttggggcgtgctcaggcggtgcgggaagagtgcaaggtgtga

SEQ ID NO: 19161 - protein, 400 aa, Xylella fastidiosa
MSIHDVHEGTCHVTTSAVRAGIDSDTAHGAVTPPIVLSSNFSFERFGHKRKYDYTRSANPTRDLLGEALAELEGGAGGVVTATGIAAITLVLHALLRPGDRLVVPHDAYGGSWRLFNALAQKGHFELITVDLTDARSLVEALALPPKLVLIETPSNPLLRITDLGAVIEAAHRVGALTVVDNTFMSPVLQRPLEFGADLVLHSTTKYINGHSDVVGGVVVARDVAHYQQLVWWANALGLTGSPFDAFLTLRGVRTLDARLRVHQENAQMIAALLEGHGVVKHVHYPGLASHPGHVLAGRQQKGFGAMLSFELQGGEEAVRAFVSGLRYFTLAESLGGVESLIAHPASMTHAAMTPEARAKAGISDGLLRLSVGIEASEDLIVDLVAGLGRAQAVREECKV

SEQ ID NO: 19162 - DNA, 1161 bp, Vibrio parahaemolyticus
  CDS (1)..(1161)
atgagcacccgcaagcctgcgaccattgctgtacgcactggtatcgaatcagacagccaataccacgctgttgttccaccaatctacctttcaaccaactatggtttccctgcttttggtgaagtccctaaatacgattacacgcgttcaggtaacccaaaccgtggtttgctagagagtgcgttatcagagttagagtctggcaaaggcgcagtggtgactaactgcggtacttccgcacttaacttgtgggtatcggcttttcttgggccagatgatctgattgttgcaccgcatgattgctatggtggcacataccgtttgttcaatacacgagctaacaaaggcgacttcaaagtgcagttcgttgatcaatcggatgagcaagctctagaggctgcactagcgaaaaagccaaagcttattttgttagaaactccatcgaaccctttggttcgtgtggttgatattgcagcggtatgcgaaaaagccaaacaagtgggcgctttggtggcggtagacaatacctttttgacaccggtgtaccaaaagcctttggagctcggtgctgattttgttatccactcaactacaaaatacattaacggtcactcggacgtgattggtggtgtggtgatcaccaaaacagaagcgcacgcagaagagcttgcatggtggggaaactgtattggcgccacgggtacgcctttcgatagttacatgacgttgcgtgggatccgcactttaggcgcccgtatgcgagtgcacgaagaaagctctcaacacgtactcaactacctacaacagcaggctttggtcgcgaagatttaccatccgagcttgccagatcaccctggtcacgaaatcgcgaaaaagcagcagtcgggttttggttctatgctgagctttgaatttgcaggctcatttgagcaacttaaagtgtttgttaaagagctcgaactgttttctcttgcagagtcgcttggtggcgtggagagtttgatttgtcacccagcatctatgacgcatcgagccatgggggaagaagcattagcggaagcaggcgtgtcgcatcagctgcttcgtctgtctgtgggtttagaggatgcacaagacctgattgccgatctcgatcaagcctttgtaaaagctgctcagtaa

SEQ ID NO: 19163 - protein, 386 aa, Vibrio parahaemolyticus
MSTRKPATIAVRTGIESDSQYHAVVPPIYLSTNYGFPAFGEVPKYDYTRSGNPNRGLLESALSELESGKGAVVTNCGTSALNLWVSAFLGPDDLIVAPHDCYGGTYRLFNTRANKGDFKVQFVDQSDEQALEAALAKKPKLILLETPSNPLVRVVDIAAVCEKAKQVGALVAVDNTFLTPVYQKPLELGADFVIHSTTKYINGHSDVIGGVVITKTEAHAEELAWWGNCIGATGTPFDSYMTLRGIRTLGARMRVHEESSQHVLNYLQQQALVAKIYHPSLPDHPGHEIAKKQQSGFGSMLSFEFAGSFEQLKVFVKELELFSLAESLGGVESLICHPASMTHRAMGEEALAEAGVSHQLLRLSVGLEDAQDLIADLDQAFVKAAQ

SEQ ID NO: 19164 - DNA, 1209 bp, Vibrio parahaemolyticus
  CDS (1)..(1209)
atgtcagagggcaaaaagaccaaactcattaccgcaggccgcgataagaagtggaccaacggcgtggtaaacccaccagtacaacgcgcttctactgtcgtgtttaatactgttgcagagaaaaaccaagccgcaataaaccgcgcaaacaaaacgctgttttacggacgtcgtggcactaacactcactttgcttttcaagatgcaatggtcgagatcgaaggcggtgcgggttgtgctctttacccttgcggaacggcagctatttctaacgcgatcctttctttcgttgaagctggcgaccatattttgatggttgatacgtgttacgaaccaacacgtgatttttgcaacgtgatcatgaaaaagatgggcgtagaaaccacttactacgatccgatgatcggcgaaaacattcgtgatttgattcaaccaaacaccaaaatactgtttcttgaatcgccggggtcaatcacaatggaagtgcaagacgttccaaccatggcgcgcattgctcacgagcacgatatcattgtgatgctcgataacacgtggggcgccggcgtgaacttctcacctttcgaacatggcgtggacatttctattcaagcggcgacaaagtacatcgttggacactctgacgtcatgctcggcaccgcagtggcgtctgagaaatactgggatcagcttcgcgaacaaagctacctgatggggcaatgcgtttctcctgatgacgcttaccttggcctacgtggcattcgcactttggatgttcgcttacgccagcatgctgaaaacagtttgaaagtcgcacagtggttggcaaaccgccctgaagtggatcatgttcgtcaccctgccctagagacttgccctggtcatgagttctttgagcgtgattttactggcggcaatggcttgttctcatttgtgctgaaaacctcgtatccaaaagcgaccacagctttgcttgatggcatgaaacacttcagcatgggttactcttggggtggttatgagagtttgattttggctaacgaacctcgcagctttaacagcttacgcacggtcgccaatccgaactttgaaggcactctgattcgtattcatgtaggcttggaagatgttgaagacttaatcgccgatttagaagccggatttgttcgatacaacgccctagtgcttgaaaaagaagtctctctgaaataa

SEQ ID NO: 19165 - protein, 402 aa, Vibrio parahaemolyticus
MSEGKKTKLITAGRDKKWTNGVVNPPVQRASTVVFNTVAEKNQAAINRANKTLFYGRRGTNTHFAFQDAMVEIEGGAGCALYPCGTAAISNAILSFVEAGDHILMVDTCYEPTRDFCNVIMKKMGVETTYYDPMIGENIRDLIQPNTKILFLESPGSITMEVQDVPTMARIAHEHDIIVMLDNTWGAGVNFSPFEHGVDISIQAATKYIVGHSDVMLGTAVASEKYWDQLREQSYLMGQCVSPDDAYLGLRGIRTLDVRLRQHAENSLKVAQWLANRPEVDHVRHPALETCPGHEFFERDFTGGNGLFSFVLKTSYPKATTALLDGMKHFSMGYSWGGYESLILANEPRSFNSLRTVANPNFEGTLIRIHVGLEDVEDLIADLEAGFVRYNALVLEKEVSLK

SEQ ID NO: 19166 - DNA, 1170 bp, Pseudomonas syringae pv
  CDS (1)..(1170)
atgaaaaaatataaaagcgtccaaactctgcttgcccatgcgtctattgaacctgagcagcatcacggattcgttaatacgcccgtttaccggggctcaaccgttgcctttcccacctgcgagtcgatgcgcgaaggacgtcaaaaatacgcctatggacgttggaacaatccttcaacggaggcactcactgaggcccttcagcacttggaaggatcggaaggcacggttctatgcccttcagggctgtccgcgtgtacgactgcgatactctccgtagtcgggacgggtgatcacattttgattgccgacaatgtctatgcgccagtgagggttttctgcgaagaagtgggaaagcgcttagggatcggggtgtcgttttacgatcctacgataggttccggcattgttgatttcatccgacctaacacgaaagcgatttatctagaatcccctggttccctgacgttagagatacaggacatccctgccatagcgaatgttgcccatgaccatgacatcatggttattgcagacaatacatggggcacaccgctttactgcccgacgatggagcttggcgtcgacctttccatcatggcagcaacgaaatacatcgtcggccactccgacgcagttcttggcaccgtatccgcatccaagcgagcatgggaaagcctcaagcgataccacttcaatatgggcttatttgccagcccggacgacgtgaccctagcccttcgagggatgagaacgctagacgtgcgcctggagcgtcactataagaatgcgacgatagtagccaagtggttggagggccgagaggaggtaatcgccgttcattacccggcattagaatcccatccccaacacgacttatggaaacgggatttcaaaggagcatctggcttgctgtcgtttacgacaaagccttccagccagccagcagcagatgctctcttggataatctatcgctgtttgctatcggttactcatggggtggtttcgaaagtttggcaatgcttgcgaatcctaaaccagtcagaagtgtgacccaatgggacattgacggccatctagtgcgactgcatatcggtctcgaggatccgtatgacttaatcgccgatctcgaagttggctttgcacatttcaatagattacgccgctag

SEQ ID NO: 19167 - protein, 389 aa, Pseudomonas syringae pv
MKKYKSVQTLLAHASIEPEQHHGFVNTPVYRGSTVAFPTCESMREGRQKYAYGRWNNPSTEALTEALQHLEGSEGTVLCPSGLSACTTAILSVVGTGDHILIADNVYAPVRVFCEEVGKRLGIGVSFYDPTIGSGIVDFIRPNTKAIYLESPGSLTLEIQDIPAIANVAHDHDIMVIADNTWGTPLYCPTMELGVDLSIMAATKYIVGHSDAVLGTVSASKRAWESLKRYHFNMGLFASPDDVTLALRGMRTLDVRLERHYKNATIVAKWLEGREEVIAVHYPALESHPQHDLWKRDFKGASGLLSFTTKPSSQPAADALLDNLSLFAIGYSWGGFESLAMLANPKPVRSVTQWDIDGHLVRLHIGLEDPYDLIADLEVGFAHFNRLRR

SEQ ID NO: 19168 - DNA, 2796 bp, Pseudomonas syringae pv
  CDS (1)..(2796)
atgagccagaacatcaccccggcgcacctgcaacaatggctgttcgacgggcaggaaattgccctgttcgatgtgcgtgagcatggccagtatggcgaagcgcatctgtttcacggggtgacgctgccctacagccgtctggaactggacatccgccgtctggcaccgaacactgccgtgcgcctggtgatttacgaccatagcggcagcgatgtcgcaccgcgagcagccctgcgactcgctgcgttgggctacggcaacgtgcacattctgcagggcggcgcgcagggctggcgagaatcgggccgacagctgtttgcaggcgtgcatgtgccgtccaaggcatttggcgagctggtcgagcaggtcagccacacgccgcatgtcacggccacgcaactggcacagtggcaggcgcgcggcgagccgctggtggtgctggacggcaggccgttcgatgagtaccgcaagatgaccatcccaggttccgtgtgctgccccaatggcgagctgggttatcgcattcgggaactggttggcgatgacagcacgccgattgtcgtcaactgcgccgggcgcacacgcagcatcatcggcgctcagacgctgatcgatatgggcctgaaaaaccctgtatatgcactcgagaacggtacacagggttggtacctggccgatctgcaactggaacacggcagtgtccggcgctacccggatgaggtgtccgcagcggcgctgacccgacagcgcaatgctgccgaggcgctggccaggcgcgcgcaggtgcagaccgtgacgggcggacaagtgcagcgctgggctgaggagtccggtcgcagcctgtttctgtgtgatgtacgcagcgccgaagaatttgccgcaggcagcctgccctgcgcgcaacacacgcctggcggacagttgattcaggccaccgatctgtacgttggggtgcgcaacgcacggctggtgttgctggacgccgatggcattcgcgcgcccattgtcgccagttggctaaggcaactggggcatgatgcatatgtgctggctgacggcgtcgagagcggcctgtcgctgccggtggctgaagctaacgtggccacggcagacgtgccgatcagcattcaggcactggaagacgcgttgaaagacgcggcggttgcgctgatcgatctgcgttccagcacgcgctaccgcaaggcacatatcgacggctcgcgctggtcgattcgcccgttgctcgcaggtgttctggcgcaggaaatcaggccggtggtgctggtcgccgacgatccgctgattgcgcaactggccgtgcaggaattgcctttggcgcagcgtcagcagactcgcgtgcttgaaggcggcgttgaggcctggcaggcggccgggcggccagtgcgcgaaggcagcgcaagtctggcagacgagcactgtatcgattttctgttcttcacccatgatcggcactcgggcaacaaggacgctgcacgtcagtacctggcctgggagataggcttgctggggcaaatgaccgcgcaggagattgccagcttcaagcccctgcaactcgaaccggcgtctggcgggccgcgcaatccgtcgctgcgcgatcctttgctacgtacaaggctggtgcatgcagcacgtacggccaagggcgatggaatgcgcggtgtcaatgtgcccgtcacgcgtctgagtacggtgctgttcgacagtttgagcgagatgcgcgatgtgcgtaagcgtcgcgacagcgagcggctgttgagttatggcgcgcgaggcaatccgacgggctttgcccttgaagacctggtcaccgagctggaaggtggttatcgcacccggctgttcagcagcggcctggctgcggtggcgcagacgtttctggcctacctgcgccccggcgatcatgtgttgctgaccgacgccgtctattcaccggtacgccgtgtggcgcaggagtttttgcagccgttcgggatcgaggtcagctattacgccgccgacggtcgagggctggaagcgcagttgcaggacaacacacgcatggtctacgccgaagtgcccggctcactgctgtatgagctgtgcgacctgcctgcacttgcggcgttgtgtcggccgcgtggaattctgctggcggtggacaacacctggggcagtggctatctgtaccggccgctggcgctgggtgcggacatttccatcatggccctgaccaaatacctgtgtggccacagtgatgtggtgatgggcagcgtctgcacccgcgaagacgtctgggcgccaattggacggatgggcgacactttgggcaacgcgaccagccctgatgatgcctggctgatactgcgcggcgcacgcacgctggcctcgcgcgtggaggtgcatgagcgccaggcgctggaggtcgcgctgtggcttgacgcccacccgcaggttggccgggtgtttcatccgggcttgcccacacatccgcagcattggctgtggaagcgcgatttcagtggcagtaacggtctgctgtcgttcgagttgcgtgacgatgatcccgcattggcagagcacttcatcggcgccttgcagctgttcggcctcggggcgtcgtggggcggttatgagagcctgatcacagtggccgagctcacggcgcggagcagcgaagaagacaggcagctcaacaccgtgctgcgcctgcacatcggcctggaggatggctcggcgctgatcgaagatttacagcgcgggtttttggcctgcatggaggctcgaacgcgaggatga

SEQ ID NO: 19169 - protein, 931 aa, Pseudomonas syringae pv
MSQNITPAHLQQWLFDGQEIALFDVREHGQYGEAHLFHGVTLPYSRLELDIRRLAPNTAVRLVIYDHSGSDVAPRAALRLAALGYGNVHILQGGAQGWRESGRQLFAGVHVPSKAFGELVEQVSHTPHVTATQLAQWQARGEPLVVLDGRPFDEYRKMTIPGSVCCPNGELGYRIRELVGDDSTPIVVNCAGRTRSIIGAQTLIDMGLKNPVYALENGTQGWYLADLQLEHGSVRRYPDEVSAAALTRQRNAAEALARRAQVQTVTGGQVQRWAEESGRSLFLCDVRSAEEFAAGSLPCAQHTPGGQLIQATDLYVGVRNARLVLLDADGIRAPIVASWLRQLGHDAYVLADGVESGLSLPVAEANVATADVPISIQALEDALKDAAVALIDLRSSTRYRKAHIDGSRWSIRPLLAGVLAQEIRPVVLVADDPLIAQLAVQELPLAQRQQTRVLEGGVEAWQAAGRPVREGSASLADEHCIDFLFFTHDRHSGNKDAARQYLAWEIGLLGQMTAQEIASFKPLQLEPASGGPRNPSLRDPLLRTRLVHAARTAKGDGMRGVNVPVTRLSTVLFDSLSEMRDVRKRRDSERLLSYGARGNPTGFALEDLVTELEGGYRTRLFSSGLAAVAQTFLAYLRPGDHVLLTDAVYSPVRRVAQEFLQPFGIEVSYYAADGRGLEAQLQDNTRMVYAEVPGSLLYELCDLPALAALCRPRGILLAVDNTWGSGYLYRPLALGADISIMALTKYLCGHSDVVMGSVCTREDVWAPIGRMGDTLGNATSPDDAWLILRGARTLASRVEVHERQALEVALWLDAHPQVGRVFHPGLPTHPQHWLWKRDFSGSNGLLSFELRDDDPALAEHFIGALQLFGLGASWGGYESLITVAELTARSSEEDRQLNTVLRLHIGLEDGSALIEDLQRGFLACMEARTRG

SEQ ID NO: 19170 - DNA, 1167 bp, Pseudomonas syringae pv
  CDS (1)..(1167)
atgccgcacagcaaagaccctcgcgcccacactgccctgtcgcaacgtggtcgcagcgccagtagcggcccggggcttgcggtcaatccgccggttgtgcgcctcagcacggtagtgttcgacagcctggaaagcttgcgcgaagccgaggttcgcacggccgggccggagcgttcgctgacttacggggccaatggcaacccgactgcgtttgccttgcaggacctgatctctgagcttgaaggcgcgcacggcacgtgtctttacccgaccgggcttgccgccgtcgcacagatgtttcaatcctttctgcgccccggcgatcacgtactgctcaccgaatcggtctatggacctgtccggcgtctggcgaacacgatgttgaaggctttcgatattcagttcgacttctatgccgccgatggcagtgacgtggaatcgatgatcaaaaccaacacgcggatgatctacgccgaagtaccgggctcgctgaccttcgagatgtgcgacctgcccgccctggcgcagttgtgcaaagcgaagagcatgctattggcggtggataactcctggggttccggggttttatacaagccgctggagctgggcgcggacatctcgctgatggccctgaccaaatacatggccgggcactcggatgtgatgatgggcagtgtcagtaccacccaaactcactggcaaaccctcaagaccatgaacaccgctgtcggcaacaccgtcagcccggatgacgcctatctggtgctacgcggggcgcgcagtctggcggcacgcatggccatgcacgaacgccacgcgatgcaggtcgcgcaatggctgcaggatcagcctgaagtcgcgcgcgttctgtatcccgcgctgccgagcgatccggggcacgccctctggaaacgcgatttccatggttgcaacggcttgctcagtttcgagttcaaaacggctgatcggcaggtgctggatcgttttacaggtgccttgacgctgtttggcatcggttattcctggggcggttttgaaagcctggtcacggaaatcgagcagcatggtccagaccgcggtatggggcctatgctgcggctgcaggttggccttgaaagcccggatgatctgatcgccgacttgcagaacgggtttgctgcgggttga

SEQ ID NO: 19171 - protein, 388 aa, Pseudomonas syringae pv
MPHSKDPRAHTALSQRGRSASSGPGLAVNPPVVRLSTVVFDSLESLREAEVRTAGPERSLTYGANGNPTAFALQDLISELEGAHGTCLYPTGLAAVAQMFQSFLRPGDHVLLTESVYGPVRRLANTMLKAFDIQFDFYAADGSDVESMIKTNTRMIYAEVPGSLTFEMCDLPALAQLCKAKSMLLAVDNSWGSGVLYKPLELGADISLMALTKYMAGHSDVMMGSVSTTQTHWQTLKTMNTAVGNTVSPDDAYLVLRGARSLAARMAMHERHAMQVAQWLQDQPEVARVLYPALPSDPGHALWKRDFHGCNGLLSFEFKTADRQVLDRFTGALTLFGIGYSWGGFESLVTEIEQHGPDRGMGPMLRLQVGLESPDDLIADLQNGFAAG

SEQ ID NO: 19172 - DNA, 1182 bp, Pseudomonas putida
  CDS (1)..(1182)
atgggcctgaccatgtccgacaagccgcgcaatttcgccacccgtaccattcacgccggcgagcagttcagcgttgccgataacgccattttcccggctatcgtcaccgccagttcgttcaccaagcgcagcctggacgataagccggaatattcctacagccgcgtcggcaaccccacccggcatgcctacgaaacctgtgtcgctgccttggaagaaggcgtgggcgctgtggcctgcgcctcgggagtcaatgccaccgcaaccgtgcttgagctgctgcccaaggatgcccacgtggtggtgatgaacggcgtgtacggtggcacgttccgcatcatggaagattaccgcagccgcacctcggggctgaccaccacctatgtcgatctcaacgacattgaagccgtagcggctgcgatcaagccggaaacccagctgatctggatcgagtcgccgaccaacccgttgctgcacctggtcgacatcaaggcggtgtgcgacctggccaaggccaagggcatcctcacctgcatcgacaacaccttctgctcgccgtggaaccagcgcccgatcaccctgggcgtggacttggtgatgcactcggccagcaagtacatcggtggccactccgacctcaccggcggtgtggtggtggcggccaacgatgcgttgctggcacgcctgcgccgtatcagcatggcgattggtgcggtgcaggggccgttcgactgctacctggccctgcgcggtctgaagaccctggatgtgcgcatggagcgccagtgcgccaatgccctgcaggtggcgcgcttcctggaaggtcacgcgcaggtcgagcaggtgtattacccggggctggaaagccacccgcagcatgaactgtgcaaacgccagatgcgcagtggcggggcggtggtggcgatgaaagtaaaaggcgaccgcgccgcgctcaaccgcctggtggaggcgctgcagatttttgtgctggccgactcgctgggcggggtggagagcatgatcaaccactcctggagcatgtcgcactgctcgctgagcccagagcagaaaggggtgatggggatcagcgagaacctgctgcggttgtcggtagggatcgaggattaccgtgacctggtcgaggacctggatggggcgttgaaagcgctggtcgctgtgtga

SEQ ID NO: 19173 - protein, 393 aa, Pseudomonas putida
MGLTMSDKPRNFATRTIHAGEQFSVADNAIFPAIVTASSFTKRSLDDKPEYSYSRVGNPTRHAYETCVAALEEGVGAVACASGVNATATVLELLPKDAHVVVMNGVYGGTFRIMEDYRSRTSGLTTTYVDLNDIEAVAAAIKPETQLIWIESPTNPLLHLVDIKAVCDLAKAKGILTCIDNTFCSPWNQRPITLGVDLVMHSASKYIGGHSDLTGGVVVAANDALLARLRRISMAIGAVQGPFDCYLALRGLKTLDVRMERQCANALQVARFLEGHAQVEQVYYPGLESHPQHELCKRQMRSGGAVVAMKVKGDRAALNRLVEALQIFVLADSLGGVESMINHSWSMSHCSLSPEQKGVMGISENLLRLSVGIEDYRDLVEDLDGALKALVAV

SEQ ID NO: 19174 - DNA, 1095 bp, Pseudomonas putida
  CDS (1)..(1095)
atggagtgcaccagctatttagtcgacacctttgatcagctgccacccatcaatgaagaaagcctagcagacatagacaatgatcttttcagtggtctgtactatggcggcgttgacacaccaacgactcgacaactttctcagcgggtagccgacctcgagaagggcaagttcgcagtcttaacaccttccgggcagtccgccttcaacctgttgctgacaacattcgtgaaaccaggtgatcacgtacttgctggagataccatcgtttactccacacgatggctgctgaatcactttgaaaatattggtgtaaaaattgaatacttcacacctagcgaagccgcgactctaaaaaataaactaactctaaagacaaaattaatcatatttgaaaacccaggcgcattcacgtacgaggtcatggatattagtgcgatcgtcgaatcaagacacgaccacccagcgctgattgtggccgacaacacatgggcagcatcactatttcaccaccccttatcactcggcgcggacatcagcttgatttcaatgagcaaataccacggggctgtagagggcatctctctcggagcactaataaccaagcgaaaagatctgtatgtaaaccttaaaaccacctccgcattaacgggcaaccatgtgagctcacacgcctgctcagcagcaattcgatcaatcagcacgctcggcgctcgcctatcatttcaaatgagtacgactcgcaaggtacttagaagcctcaagccactgcctcttttaaaacaggcaatacatcccattctccaaaacactgagctccacctacaaaactcgatgatctatggattcaacagccttttcaccgctgaattttcatgctctcgcaacgaactgatatctcgcctgaaccgactaaacctaataaagatcggctatggatggggcggcacgacaagcctcgtcaatcttattgatactcacgacatgccctcagcaaaaagactaggcattaacagtgagtgcgcaaggatatacctcggacttgaagacccagacgaattaactcgcgatcttaccaatgcatttactcaataa

SEQ ID NO: 19175 - protein, 364 aa, Pseudomonas putida
MECTSYLVDTFDQLPPINEESLADIDNDLFSGLYYGGVDTPTTRQLSQRVADLEKGKFAVLTPSGQSAFNLLLTTFVKPGDHVLAGDTIVYSTRWLLNHFENIGVKIEYFTPSEAATLKNKLTLKTKLIIFENPGAFTYEVMDISAIVESRHDHPALIVADNTWAASLFHHPLSLGADISLISMSKYHGAVEGISLGALITKRKDLYVNLKTTSALTGNHVSSHACSAAIRSISTLGARLSFQMSTTRKVLRSLKPLPLLKQAIHPILQNTELHLQNSMIYGFNSLFTAEFSCSRNELISRLNRLNLIKIGYGWGGTTSLVNLIDTHDMPSAKRLGINSECARIYLGLEDPDELTRDLTNAFTQ

SEQ ID NO: 19176 - DNA, 1197 bp, Pseudomonas putida
  CDS (1)..(1197)
atgcgcgactcccaccacaacaccggtttttccacgcgggccattcatcatggctatgacccgctttcccatggtggcgccctggtgccaccggtgtaccagacggctacctatgccttccccactgtcgagtacggtgctgcctgcttcgccggggaggagcctgggcatttctacagccgcatttccaaccccacgctggccttgctggagcagcgcatggcttcgctggagggcggtgaagcggggttggcgttggcatcggggatgggcgcaattacctcaaccctctggaccctgctcaggcctggggatgagctgattgtcgggcgcaccctgtatggctgtaccttcgcttttctgcaccacggtattggtgagttcggggtgaaagttcgccatgtcgatctcaacgatgccaaggccctgaaagcggcgatcagcagcaaaacacggatgatctacttcgaaacaccggccaaccccaacatgcaacttgtggatatcgcggcggttgtggaggccgtgcgggggcatgatgtgcatgtggtggtcgataacacctactgtacgccgtacctgcagcggccactggagctgggggcggacctggtggtgcactcggcaaccaagtacctcagtgggcatggtgatatcactgccgggttggtggtggggcgcaaggtgttggtcgatcgcattcgcctggaagggctgaaggatatgaccggggcagtgctgtcgccccatgacgcggcgctgctgatgcgcgggatcaagacgcttgccttgcgcatggaccggcattgtgccaatgcccagcaggtggcggagtttctcgtccggcagccgcaggtggaattgattcattacccggggctaccgtcttttgcccagtacgcgttggcccagcgacagatgcgtttgcctggcgggatgattgcctttgagctcaagggtggcattgaggcggggcggcgcttcatgaatgcactgcagctctttgcccgggcggtgagcctgggggatgcagaatcgctggcgcagcatccggcgagcatgacgcattccagctatacgccgcaggagcgggcgcatcacgggatatcggaggggttggtgcgtctgtcggtggggctggaggatgtggaggacctgctggcagatgtcgaacaggcattgcaggcctgctgttag

SEQ ID NO: 19177 - protein, 398 aa, Pseudomonas putida
MRDSHHNTGFSTRAIHHGYDPLSHGGALVPPVYQTATYAFPTVEYGAACFAGEEPGHFYSRISNPTLALLEQRMASLEGGEAGLALASGMGAITSTLWTLLRPGDELIVGRTLYGCTFAFLHHGIGEFGVKVRHVDLNDAKALKAAISSKTRMIYFETPANPNMQLVDIAAVVEAVRGHDVHVVVDNTYCTPYLQRPLELGADLVVHSATKYLSGHGDITAGLVVGRKVLVDRIRLEGLKDMTGAVLSPHDAALLMRGIKTLALRMDRHCANAQQVAEFLVRQPQVELIHYPGLPSFAQYALAQRQMRLPGGMIAFELKGGIEAGRRFMNALQLFARAVSLGDAESLAQHPASMTHSSYTPQERAHHGISEGLVRLSVGLEDVEDLLADVEQALQACC

SEQ ID NO: 19178 - DNA, 1272 bp, Pseudomonas putida
  CDS (1)..(1272)
atgaacaacaacgaaaaattcgagggcaatgctgcggccggtgtggggacgcgggtcgtgtggagcggggagcaggtacagcacccgtacaacgccacgcagaccccgatcgtggtcagcgccgcttatggctacaacgacatcgatgcctggtacgacgtggcgcagggcaagcagccgggcttcatctacagccgcatgagcaaccccacggtcgccacgctggaagcaaaactggccgagctggagcaagccgagtcggcagtcgcgttcagcagcggcatggcggccatcagtgccgtgctgcacaccttcctgtccaacggcaaacgcgtggtgtcgacccgcgacagctatggcggcaccaacaagatcttcgaagagttcctgccgcgcatgggcgtgcaagtgtgcctgtgcgataccttggacactgaagcgctggagcgcgagattgccgccggttgcgacctgctgtacctggaaacccccaccaacccgacgctgaaggtgctggacattcgtcggctgagcgccgctgcgcacaaggtgggggcgctggtggtggccgacaacacctttgccacgccactgaaccagaacccgctggcgctgggcgtggatgtggtggtgcacagcgcaaccaagtttctgtccgggcatggtgacgtgctgggtggggtggtgtgcggcgcggaggcgttgatggcccaggtgcggcactaccgggaaatcaacggcgcggcgctggacccgttctcggcctacctgatcatccgcggtatcaagaccctggcagtgcgcctgcgccagcagcaagccagtgccatggcgttggcccattacctgagcaccgagccgctggttgaagcggtgaactacccaggtttgccggcgcatgccgggcatgccattgccaaggcgcaaatgcgcgggtttggcgccattgtcagcttcgtgctgaagggcggcatgccaaccgtggcccgtttgctgccgcggctgaagtatgcccatcgggccggcaacctcggcgcggtagagaccatctatggcccggcgcgcaccaccagccatgtcgagaacactttggaagagcgcctggcgctgggcatttccgaagggctggtgcgcatttcagtgggcatcgaggaaaccgatgacctgctggcggacctggcacaggcctgtgcatcggtgcgtgaggaactggccgtcgcaaaggaattgcacgctgacgcagacgcctgccagagcccggtgcaggcctga

SEQ ID NO: 19179 - protein, 423 aa, Pseudomonas putida
MNNNEKFEGNAAAGVGTRVVWSGEQVQHPYNATQTPIVVSAAYGYNDIDAWYDVAQGKQPGFIYSRMSNPTVATLEAKLAELEQAESAVAFSSGMAAISAVLHTFLSNGKRVVSTRDSYGGTNKIFEEFLPRMGVQVCLCDTLDTEALEREIAAGCDLLYLETPTNPTLKVLDIRRLSAAAHKVGALVVADNTFATPLNQNPLALGVDVVVHSATKFLSGHGDVLGGVVCGAEALMAQVRHYREINGAALDPFSAYLIIRGIKTLAVRLRQQQASAMALAHYLSTEPLVEAVNYPGLPAHAGHAIAKAQMRGFGAIVSFVLKGGMPTVARLLPRLKYAHRAGNLGAVETIYGPARTTSHVENTLEERLALGISEGLVRISVGIEETDDLLADLAQACASVREELAVAKELHADADACQSPVQA

SEQ ID NO: 19180 - DNA, 1146 bp, Lactobacillus plantarum WCFS1
  CDS (1)..(1146)
atgaaatttgaaacccaattaattcacggtggtatcagtgaggatgccactactggcgcgacttcggtacccatctacatggcctcgaccttccgccaaacaaaaatcggtcaaaatcaatacgaatattcacggacgggaaatccaacccgggccgccgtcgaagcattaattgccaccctcgaacatggcagcgctggcttcgcatttgcttctggctccgctgccattaataccgtcttctcactattctcggctggtgatcacattattgtgggaaatgatgtctacggtggcaccttccgcttgatcgacgccgttttgaaacactttggcatgacttttacagccgtagatacgcgtgacttggccgccgttgaagccgcaattacccccacaactaaggcgatttatttggaaacaccgacgaacccgttattacacattacggatattgctgccattgcgaagctcgcgcaagcacacgatttactgagtatcatcgacaacaccttcgcctccccatacgtccagaagcccctggatttaggcgttgacattgttttacacagtgcttccaagtatctcggtggtcacagtgatgttatcggtggcttggttgtcaccaagacgccagcacttggcgaaaaaatcggctacttgcaaaatgccatcggtagtattttggccccgcaagaaagctggctattacaacgtggtatgaagactctggcattgcgcatgcaagcccacctgaataatgccgctaaaatctttacttacttaaagtctcacccagcagttactaagatttactatccaggcgatcctgataatcccgatttttcgattgccaagcaacagatgaatggcttcggcgcaatgatctcgtttgaattacaaccaggaatgaacccccagaccttcgttgaacatttacaagtcatcacgctcgccgaaagtctcggagcattggaaagtttaattgaaattccagccttaatgactcacggtgccatcccacgcacaattcggctacagaatggcatcaaagacgagctgattcgcttatcagtcggtgttgaagccagtgacgatttgttagcagaccttgagcgcgggttcgctagcattcaggcagattaa

SEQ ID NO: 19181 - protein, 381 aa, Lactobacillus plantarum WCFS1
MKFETQLIHGGISEDATTGATSVPIYMASTFRQTKIGQNQYEYSRTGNPTRAAVEALIATLEHGSAGFAFASGSAAINTVFSLFSAGDHIIVGNDVYGGTFRLIDAVLKHFGMTFTAVDTRDLAAVEAAITPTTKAIYLETPTNPLLHITDIAAIAKLAQAHDLLSIIDNTFASPYVQKPLDLGVDIVLHSASKYLGGHSDVIGGLVVTKTPALGEKIGYLQNAIGSILAPQESWLLQRGMKTLALRMQAHLNNAAKIFTYLKSHPAVTKIYYPGDPDNPDFSIAKQQMNGFGAMISFELQPGMNPQTFVEHLQVITLAESLGALESLIEIPALMTHGAIPRTIRLQNGIKDELIRLSVGVEASDDLLADLERGFASIQAD

SEQ ID NO: 19182 - DNA, 1197 bp, Clostridium tetani
  CDS (1)..(1197)
atggatataaaaaatatgggatttggtactaaagcaatacatgggggaaataaaaaagatacacagtatggagcattgtctacaccaatatatcagacatcaacctttatatttgactctgctgaacagggtggaaaaagatttgcaggagaagaaagtggacatatatatacaagactaggaaatcctacaactggtcaattagaggataaaatggctatattagaaggtggagaggctgtaatagcaactgcatcaggtatgggagctatatcttcagcattatggacagctctaaaggcaggggatcatgtagtagcaggtgaaacattatatggatgtacatttgctttattatgccatggtttaccaagattcggtgttgaagttacttttgtagatactactaatttagaggaagtagaaaaggctataaaagaaaatacaaaagtagtttacttagaaacacctgctaatcctaatttaaaggtagcagatataaaagctataagtgaaattgctcacaaaaaggaagattgtatggtttttgtagataacactttctgtacaccatgtattcaaagacctttagagttaggagcagatgtggtagttcactcagctactaagtacttaaatggacatggagatgttcttgctggatttgtagtaggaaagcaagagtttataaataatgttagaggttttggagtaaaggatatgacaggatcagttttaagtccttttgatgcattcttggttttaagaggattaaaaacattagaaattagaatggaaagacattgtgcaaatgctcaaaaagtggcagaatttttacaaggacatgaagctgttagtaaggtatactacccaggtttaaatgattctgaatattatgatatagctaaaaaacaaatgagaatgcctggagctatgatttcctttgaagttaatggaggtttagaagaaggtaaaaagattatggatagtgttaagttagctaatttagctgtaagcttaggggatgctgaaaccttaatacaacatccagcgtctatgacacattctccatatactaaggaagagagagaagcggcaggcattagtgataatttagttagattatctgttggacttgaaaatgttgaagatataattgaagatttaagacaagcgttagatactataaaaaaataa

SEQ ID NO: 19183 - protein, 398 aa, Clostridium tetani
MDIKNMGFGTKAIHGGNKKDTQYGALSTPIYQTSTFIFDSAEQGGKRFAGEESGHIYTRLGNPTTGQLEDKMAILEGGEAVIATASGMGAISSALWTALKAGDHVVAGETLYGCTFALLCHGLPRFGVEVTFVDTTNLEEVEKAIKENTKVVYLETPANPNLKVADIKAISEIAHKKEDCMVFVDNTFCTPCIQRPLELGADVVVHSATKYLNGHGDVLAGFVVGKQEFINNVRGFGVKDMTGSVLSPFDAFLVLRGLKTLEIRMERHCANAQKVAEFLQGHEAVSKVYYPGLNDSEYYDIAKKQMRMPGAMISFEVNGGLEEGKKIMDSVKLANLAVSLGDAETLIQHPASMTHSPYTKEEREAAGISDNLVRLSVGLENVEDIIEDLRQALDTIKK

SEQ ID NO: 19184 - DNA, 1185 bp, Bradyrhizobium japonicum USDA 110
  CDS (1)..(1185)
atggattcctcgcacccctcccagcagcaggccgagacccggctggtcacctccggccgcgacaccaaggcgcagaaggggtttgtcaatccgccggtgttccacggctcgaccgtgctctatccgaccgccgaggacctgcatgcccatcgcggcgagttcacctatggccgccacggcaccccgacgaccagggcgttccaggacacgctgatggcgctggaggggccgcaatgcgccggcgtcggcatcgtgccatccgggctgtcggcgatctccaccaccctgctctcggtgctgaagaccggcgaccacattctggtctgcgacaatgtctatcggccttcgcgcaatttctgcaacggcatgctcgcccgctacggcgtcgagaccacctatttcgatccgctgatcggcgccggcatcgacaagctgttcaagcccaacacgcgtgcggtgctggtggaggcgccgggctcgcaatcgttcgagatgcccgacatccgcgccatcgccgaggtcgcgcatgcgcgcgatgcgctcgtcatcgacgacaacacctgggccaccccgctctatcatcgctcgctcgagcagggcgtcgacatcagcatgcaggcggcgaccaaatatatcggcggccattccgacatcatgttcggcaccatctcggccaacgcaaaagcctggccgcagatcgccgagggcatccgcctgctcggcgtctgcgccggccccgacgacgtcttcctggcgctgcgcggcctgcgcacgctatcggtgcgattggcgcagcatcatcgttccggcctcgacatggcgcgctggctcgcaagccgtcccgaggtcgcgcgcgtgctgcatcccgggctcgagaccgatccgggccatgcgatctggaagcgcgacttcaccggcgcctcgggcctgttcagcatcgtgctgaagccggccccgcagaaggccgtcgacaccatgctcaacacgctcaagctgttcggcatgggcttctcctggggcggcttcgaaagtcttgcgattcccttcgactgcgacggctatcgcaccgcgaccaagtgggcgccgggcggccctaccctgcgtctgcatatcgggctcgaaagtaccgacgacctcaaagcggatctcgatcgcggcttcgctgccctcaagacagcaatgtga

SEQ ID NO: 19185 - protein, 394 aa, Bradyrhizobium japonicum USDA 110
MDSSHPSQQQAETRLVTSGRDTKAQKGFVNPPVFHGSTVLYPTAEDLHAHRGEFTYGRHGTPTTRAFQDTLMALEGPQCAGVGIVPSGLSAISTTLLSVLKTGDHILVCDNVYRPSRNFCNGMLARYGVETTYFDPLIGAGIDKLFKPNTRAVLVEAPGSQSFEMPDIRAIAEVAHARDALVIDDNTWATPLYHRSLEQGVDISMQAATKYIGGHSDIMFGTISANAKAWPQIAEGIRLLGVCAGPDDVFLALRGLRTLSVRLAQHHRSGLDMARWLASRPEVARVLHPGLETDPGHAIWKRDFTGASGLFSIVLKPAPQKAVDTMLNTLKLFGMGFSWGGFESLAIPFDCDGYRTATKWAPGGPTLRLHIGLESTDDLKADLDRGFAALKTAM

SEQ ID NO: 19186 - DNA, 1254 bp, Bradyrhizobium japonicum USDA 110
  CDS (1)..(1254)
atggatatatccaggccggttttttttgtgaccgttttcgacgagacggtcatgtcggaggtacctatgtcgaagtcgcctgccacttaccgtcccgaaacccgcctggtccattccggcaccctgcgctcgcaattcggcgagacgtcggaggcgctgttcctgacccagggctacgtctacaacagcgccgaggagtgcgaggcgcggttcaagggcgaggatcccggcttcatctattcgcgttattcgaacccgaccatctcgatgttcgagcgccgcatgatcgagctagaaggcgccgaagcggcgcgttcggcggcgaccggcatggccgctgtgacgaccgcgatcctggcgccgctgaagaccggcgaccacgtggtcgcctcccgcgcgctgttcggctcgtgcctctacgtcattcaggatctgttgccgcgctacggcatcgaaaccacgctggtcgacggcctcgatctcgaccagtggcagcgggccttgcggccgaacaccaagacgttcttcctggagagcccgaccaacccgacgctcgacgtgctcgacatccccggcatcgccgagatcgcgcacaagggcggcgcgcggctcgtcgtcgacaacgtgtttgcgacgccgatctggcagagcccgctcgcgctcggggccgacgtcgtggtctattccgcgaccaagcacatcgacggccagggccgctgcctcggcggcatcatcctgtcgtcggaagccttcgtcgccgagcacctccacaatttcatgcgccagaccgggccgtcgatctcgccgttcaacgcctgggtcttgcttaagggcctggagacgctggccgtgcgcgtgcgcgcgcagaccgacaccgcggcaagcgttgcggaagtgctggccggccatccgaagatctcgcgattgatctatcccggccgcgccgatcatccgcaggcagcgctggtgaagaagcagatgcgcggcggctcgacgctggtcggcttcgaggtcaagggcggcaaggcggccgcgttccgcgtgctcaacgagctcaagcttgcgaagatctcgaacaatctcggcgacgccaagagcctcgtcacccatccggcgaccacgacgcatcagcgcctgaagccggaagaccgcgccgcgctcggcatcagcgagggcttcatccgcttctccgcggggctggagcatgcggacgatctgatcgaggatctgacggcggcgctggagaaggcgtga

SEQ ID NO: 19187 - protein, 417 aa, Bradyrhizobium japonicum USDA 110
MDISRPVFFVTVFDETVMSEVPMSKSPATYRPETRLVHSGTLRSQFGETSEALFLTQGYVYNSAEECEARFKGEDPGFIYSRYSNPTISMFERRMIELEGAEAARSAATGMAAVTTAILAPLKTGDHVVASRALFGSCLYVIQDLLPRYGIETTLVDGLDLDQWQRALRPNTKTFFLESPTNPTLDVLDIPGIAEIAHKGGARLVVDNVFATPIWQSPLALGADVVVYSATKHIDGQGRCLGGIILSSEAFVAEHLHNFMRQTGPSISPFNAWVLLKGLETLAVRVRAQTDTAASVAEVLAGHPKISRLIYPGRADHPQAALVKKQMRGGSTLVGFEVKGGKAAAFRVLNELKLAKISNNLGDAKSLVTHPATTTHQRLKPEDRAALGISEGFIRFSAGLEHADDLIEDLTAALEKA

SEQ ID NO: 19188 - DNA, 1287 bp, Bacteroides thetaiotaomicron VPI
  CDS (1)..(1287)
atggaaagaaagaatttacactttgagacattacaggttcatgtaggacaggaacaagcagatccggcaacagacgcacgcgcagtacctatttatcagaccacttcttatgtattccacaattccgctcatgcagccgcacgtttcggtttgcaagatccgggcaatatctacggccgcctgaccaactccacccaaggagtttttgaagaacgtgtagccgtcctcgaaggaggcgtagcaggtctggcagttgcctccggtgccgccgctattacttatgctttcgaaaacattactcgtgcaggcgaccacatcgtagctgccaaaacaatttacggaggaagctataacttactggcacatactttgcccaattatggcgttaccaccactttcgttgatccgagcgacctttccaactttgagaaagcgattcaggagaacaccaaagccgtatttatcgaaacactcggaaacccgaattccaatattatagacatagaagcggtatccgaaattgctcaccgtcacaaaatacctttgattatagacaatacgttcggcactccctacttaatccgccccatcgaacacggagcagacattgtggtacactccgccaccaaattcattggcggtcatggcagttccttgggaggagtaatcgttgactccggtaaattcgactgggtagcttcgggtaaattcccgcagttgacagagcccgatccgagttaccacggagtacgctttgtagacgctgccggtccggctgcttacgtcacccgcattcgtgccactttgctacgggatacgggagcaacgatcagtccgttcaatgccttcatcctgctgcaagggctggaaacactttctttgcgtgtagaacgtcatgtagaaaacgcgctaaaagtggtgaacttcctgaataatcatccgaaggtgaagaaagtcaatcatccgtcactctccgatcatccggatcatgcactctatcaacgctatttcccgaatggtgcaggctccatctttacgtttgaagtaaaaggaggacaggaagaagcacaccgcttcatcgacagtctggagattttctcgttgctggccaatgtagctgacgtgaaatcactagtcatccatccggcaagtaccacacactcgcaacttaatgcgcaggaacttgcagaacaggagatttatccgggcactgtacgtctatccatcggaacggaacatatcaatgacctgatagccgatctggaacaggcactcgccaaaatctga

SEQ ID NO: 19189 - protein, 428 aa, Bacteroides thetaiotaomicron VPI
MERKNLHFETLQVHVGQEQADPATDARAVPIYQTTSYVFHNSAHAAARFGLQDPGNIYGRLTNSTQGVFEERVAVLEGGVAGLAVASGAAAITYAFENITRAGDHIVAAKTIYGGSYNLLAHTLPNYGVTTTFVDPSDLSNFEKAIQENTKAVFIETLGNPNSNIIDIEAVSEIAHRHKIPLIIDNTFGTPYLIRPIEHGADIVVHSATKFIGGHGSSLGGVIVDSGKFDWVASGKFPQLTEPDPSYHGVRFVDAAGPAAYVTRIRATLLRDTGATISPFNAFILLQGLETLSLRVERHVENALKVVNFLNNHPKVKKVNHPSLSDHPDHALYQRYFPNGAGSIFTFEVKGGQEEAHRFIDSLEIFSLLANVADVKSLVIHPASTTHSQLNAQELAEQEIYPGTVRLSIGTEHINDLIADLEQALAKI

SEQ ID NO: 19190 - DNA, 1146 bp, Staphylococcus epidermidis ATCC 12228
  CDS (1)..(1146)
atgaataaaaaaacgcaaatgatacatgggggacatacgacagacaactatactggagcagtgacaacacctatttatcaaacaagtacttatttacaagatgatattggtgatttaagacaagggtacgaatattcacgtactgcaaatcctacacgtgcgtctcttgaaagtgttattgctaatttagaacatggtaagcatggttttgcttttggttcaggaatggcagcaattagtgcagttatcatgttattagataaaggagatcacttagttcttaattctgatgtttatggtggcacatatcgtgcattaactaaagtatttactcgctttggtatagacgtagattttgttgatacaactaaaattgaaaacattgaacaatatattaaacctgaaactaaaatgttatatgtagaaacaccttcaaatccattattgcgtgtgactgatattaaagcatcagcaaaaattgcaaaaaaatatgatttgatatctgtagtcgataatacatttatgacaccttactaccaaaaccctttagactttggtattgatatcgtattgcattcggctacaaaatatattggaggccatagtgatgttgtagctggtcttgttgctactgctgatgatgatttagcagaacgtctaggctttatttcaaattctacaggtggtgtacttggacctcaagatagctatttattaatcagaggtattaaaacgctaggtctaagaatggagcaaataaaccgaaacgttgaaggtattgtgcaaatgttacaaaagcaccctaaagttcaacaagtattccatcctagtattaaggaacatatgaactatactatccatcaaaatcaagcaactgggcatacaggggtagtatcttttgaagttaaagatacagaagcggctaaacaagtgattcacgcaacaaactactttacactggcagagagtttaggggcagttgaaagtctaatttctgtaccggcacttatgacgcatgcgtccatcccatcagatgtaagagccaaggaaggtattacggatggtctcattcgtttatctattggtattgaagacacagaagacttagttaatgatttagaacaagccttaaatactttgagataa

SEQ ID NO: 19191 - protein, 381 aa, Staphylococcus epidermidis ATCC 12228
MNKKTQMIHGGHTTDNYTGAVTTPIYQTSTYLQDDIGDLRQGYEYSRTANPTRASLESVIANLEHGKHGFAFGSGMAAISAVIMLLDKGDHLVLNSDVYGGTYRALTKVFTRFGIDVDFVDTTKIENIEQYIKPETKMLYVETPSNPLLRVTDIKASAKIAKKYDLISVVDNTFMTPYYQNPLDFGIDIVLHSATKYIGGHSDVVAGLVATADDDLAERLGFISNSTGGVLGPQDSYLLIRGIKTLGLRMEQINRNVEGIVQMLQKHPKVQQVFHPSIKEHMNYTIHQNQATGHTGVVSFEVKDTEAAKQVIHATNYFTLAESLGAVESLISVPALMTHASIPSDVRAKEGITDGLIRLSIGIEDTEDLVNDLEQALNTLR

SEQ ID NO: 19192 - DNA, 1134 bp, Oceanobacillus iheyensis
  CDS (1)..(1134)
atgagagataagacaaaaatgatacatggtggaattacttcagatgaacgtactggagcagtaaatgtcccgatatatcaagtaagcacatataaacaagatgctccaggagaacaccgtggttacgagtattctcgtacgggaaatcctactagacatgcactcgaaactgtaattgccgaattagaagaagggaatgctggctttgcttttggatcaggaatggctgccattacttcgattatgatgttattggaatccggagatcatgtcatcatgacagatgatgtctacggcggatcttaccgattaatgactaaagtgttgaatcagtataatatagagcatacttttattgatacaagttcagaggaatctgtgatcaatgcgattaaaccaaatacaaaagcgatttatgtagaaacaccaactaatccgttgttgaaaattacagatattaaggaaatatcaacgattgcgcaaaaacataatcttttactaattgtagataacacttttgcaactccctattggcaaaaaccactaacaatgggtgcagatattgtattgcatagtgctacgaagtatattggtggacatagtgatgttgttgcgggattagtggcagtgaaatccaatgaattagcggaacggattcattttatacaaaactctgtaggagcagtacttggcccacaagactcatggctcttacaacgtggaattaaaaccttagcaattcgtatggaagctattgagcaaaacacgaaaaaactaattgcttatttagaacagaatccaagagtagaaaaaatatattatcctggactagaaaatcatccaggacaccatattgccaaacaacaagcatccgggtttggtggaatggtatcgatagatgtaggaagtggcgaccttgcagataaaattttaagcaaagtagaattttttacactggcagaaagtcttggtgccattgaaagtttgatatcgattcctgccaaaatgacacatgcctctatacctgctgaccgtagacaagaacttggtattactgacggattaattcgtttatcggttggtattgaagatatagatgaccttattgacgatttagaaaaatcgatgcagtaa

SEQ ID NO: 19193 - protein, 377 aa, Oceanobacillus iheyensis
MRDKTKMIHGGITSDERTGAVNVPIYQVSTYKQDAPGEHRGYEYSRTGNPTRHALETVIAELEEGNAGFAFGSGMAAITSIMMLLESGDHVIMTDDVYGGSYRLMTKVLNQYNIEHTFIDTSSEESVINAIKPNTKAIYVETPTNPLLKITDIKEISTIAQKHNLLLIVDNTFATPYWQKPLTMGADIVLHSATKYIGGHSDVVAGLVAVKSNELAERIHFIQNSVGAVLGPQDSWLLQRGIKTLAIRMEAIEQNTKKLIAYLEQNPRVEKIYYPGLENHPGHHIAKQQASGFGGMVSIDVGSGDLADKILSKVEFFTLAESLGAIESLISIPAKMTHASIPADRRQELGITDGLIRLSVGIEDIDDLIDDLEKSMQ

SEQ ID NO: 19194 - DNA, 1230 bp, Corynebacterium efficiens YS
  CDS (1)..(1230)
atggacagcttggtctattattgcccacagccccgcagtatatttcttcaggagttgatccagttgtcccacaagcccaccgaccagggtttttccaccgcctcgatccacgccggatacgagccggacgaatactatggttcgatcaacgtcccgatctacgcctccaccaccttcgcgcagaacggccccaatgagctgcgccgtggttatgaatacacccgtgtgggtaaccccaccatcaccgtgctggagcaaaccgtcgccgcactcgagggcgccgagtacggtcgtgccttctcctccggcatggcggccaccgacatcctgttccgcattctgctcaagccgggcgaccacatcatcctgggcaatgacgcctacggtggcaccttccggctcatcgacaccgtcttcgtcgcctggggtgtggaatacaccgtggtggacacctccaacgttgatgaggtcaaggccgccatccgcgacaacaccaagctgatctgggtggagacccccaccaacccggcactggccatcaccgacatcgaggccgtggccaaggccgccgagggcaccgacgccaagctcgtggtggataacaccttcgcctccccctacctgcagcagccgctgaagctcggcgcctacgccgtgctgcactccaccaccaagtacatcggtggtcactccgatgtggtcggtggactcgtggtgaccaatgaccagcagctggatgaggaactgctgttcatgcagggtagcatcggcccgatccccagcgtgttcgacgcctacctcaccggccgcggcgtcaagaccctcgctgtgcgcatggaccgccactgcgacaacgccgagaagatcgccgaattccttgactcccgccccgaggtgtccaccgtgctctacccgggcctggaatcccacccgggacacgaggtggccaagcgccagatgaagcgcttcggcggcatgatctccgtgcgcttcgccggcggagaggaggccgccaagaagttttgtacctccaccaagctgatctgcctggcggaatccctcggcggtgtggaatccctgctggagcaccccgccaccatgacccaccagtccgcagccggttcccagctggaggtgccccgtgacctggtgcgcatctccatcggcatcgaggacatcgaggacctgcttgccgacgttgaacaggccctggaccagctgccccagtag

SEQ ID NO: 19195 - protein, 409 aa, Corynebacterium efficiens YS
MDSLVYYCPQPRSIFLQELIQLSHKPTDQGFSTASIHAGYEPDEYYGSINVPIYASTTFAQNGPNELRRGYEYTRVGNPTITVLEQTVAALEGAEYGRAFSSGMAATDILFRILLKPGDHIILGNDAYGGTFRLIDTVFVAWGVEYTVVDTSNVDEVKAAIRDNTKLIWVETPTNPALAITDIEAVAKAAEGTDAKLVVDNTFASPYLQQPLKLGAYAVLHSTTKYIGGHSDVVGGLVVTNDQQLDEELLFMQGSIGPIPSVFDAYLTGRGVKTLAVRMDRHCDNAEKIAEFLDSRPEVSTVLYPGLESHPGHEVAKRQMKRFGGMISVRFAGGEEAAKKFCTSTKLICLAESLGGVESLLEHPATMTHQSAAGSQLEVPRDLVRISIGIEDIEDLLADVEQALDQLPQ

SEQ ID NO: 19196 - DNA, 1167 bp, Vibrio vulnificus CMCP6
  CDS (1)..(1167)
atgagtcaccgcaagccagccacgattgccgttagaacgggcatcgaatccgatactcaataccgtgccgttgtgccaccgatctatttgtcgacgaactatggtttctctgcctttggcgaagtgcctaaatacgactatacccgctcaggcaacccaaatcgtggtctactagagcaagcgttgtttgagctcgaatctggtaaaggtgcggtggtcacaaactgcgggacatcagcacttaacttgtgggtgtctgcttttttaagccctgacgatcttattgtggcacctcatgattgttatggaggtacctaccgtcttttcaatactcgagcgaagaaaggggattttaaagtccgctttgtcgaccaatccgacagtgctgcactggatgcggcgttggcgcttaaccccaaactggtgttgcttgaaacgccttccaacccgctcgtgcgtgtggtggacatcgcggaagtgtgtgagaaagcccataaagtgggcgcgttggtggcggtcgataacacctttttgacaccggtgtaccaaaagcctttggagctgggggcagactttgtgattcactcgacaaccaagtatatcaatgggcattctgatgtgattggcggtgtggtgatcactaaaaccgaagagcacgcaacagaactatcgtggtgggggaactgccttggcgcaaccggtacgccatttgatagctatatgacgctacgtggtatccgtacattgggggcacgtatgcgcgtgcatgaagaaagttcgcaacaaattctctcttatctgcaaactcaagagttagtcggtaccatttatcacccgagtttgccagcgcatcccggtcatgagatcgccaaaaagcagcaatcgggctttggatcgatgttgagctttgaatttgctggcagctttgagcaattgaaagtgtttgtgaaagcgctagatttgttttcattagcggagtcacttggtggtgtcgaaagcttggtttgtcatccggcatctatgactcatcgtgcgatgggagaggaagcactcgcagaagctggcgtgacgcaacagttattgcgtttatcggtggggctggaagatgcgcaagatctgattgccgacctcaagcaggcctttcaacaagcgaaggagagctgttaa

SEQ ID NO: 19197 - protein, 388 aa, Vibrio vulnificus CMCP6
MSHRKPATIAVRTGIESDTQYRAVVPPIYLSTNYGFSAFGEVPKYDYTRSGNPNRGLLEQALFELESGKGAVVTNCGTSALNLWVSAFLSPDDLIVAPHDCYGGTYRLFNTRAKKGDFKVRFVDQSDSAALDAALALNPKLVLLETPSNPLVRVVDIAEVCEKAHKVGALVAVDNTFLTPVYQKPLELGADFVIHSTTKYINGHSDVIGGVVITKTEEHATELSWWGNCLGATGTPFDSYMTLRGIRTLGARMRVHEESSQQILSYLQTQELVGTIYHPSLPAHPGHEIAKKQQSGFGSMLSFEFAGSFEQLKVFVKALDLFSLAESLGGVESLVCHPASMTHRAMGEEALAEAGVTQQLLRLSVGLEDAQDLIADLKQAFQQAKESC

SEQ ID NO: 19198 - DNA, 1182 bp, Shewanella oneidensis
  CDS (1)..(1182)
atgaccgaaggaaaattagtgactgagcgtcaattagccacattggcagtgcgtcagggtatcgaaagcgatactcaatatggcgccgtggtgccgccaatttacctgtcgacgaattacgctttcgatggtcataaaaatccgcgcgaatttgactacagtcgctccggcaatccgactcgcagtattttaggcgatgccttagccaagttggaaaagggcgcaacgggtgtggtgacttgtactggtatggcagccattaccttagtgaccactttactgggccccgatgatttactggtggtgccccatgattgttacggtggctcttaccgtttattcactaacttggcgaaaaaaggccaatttaaattgctggtggtggatcaaaccgacaaccaagcgcttgcgcaagccatcgcccagcagcctaaaatggtgtggattgaaaccccctctaaccctttgctgcgagtcgtcgatattgaggctatcgcgaaggcgagccatggtgtgggcgcgttagtggtagtggacaacactttcctgtcgccgattttgcagcaaccgctattgctcggcgccgatatcgttatccactccaccacgaaatacattaatggccatagcgatgtggtgggcggcgcggtgatcgccaaagacccccaaattggtgagaccttacattggtggtcaaataccttaggcttaaccggtagcgcgtttgatagttatcaaaccctgcgtggcctgcgtactttggccgtgcgcattcgcgagcaccaacgcaatgctcagcgtattgtggagttactgagtaacagccctgtggtcagtaaagtgtattacccaggtcttgcggatcatcctggccatgccattgccgccaagcaacaaaaaggctttggcgctatgctgagttttgagcttaagggcggtgaggctgaagtggtcgcctttttagatgcgttaagtttatttagcgttgccgagagtttaggtggcgttgagagtttagtggccgtgcctgcgaccatgacccacagggcgatggagccgcaggcgcgttttgaagctggcattaaagacaccctattacgtttgtcggttggtattgaagatgccgacgacttagttgcagatattcaagcaggattggccgccgtagcggcttgtcagtag

SEQ ID NO: 19199 - protein, 393 aa, Shewanella oneidensis
MTEGKLVTERQLATLAVRQGIESDTQYGAVVPPIYLSTNYAFDGHKNPREFDYSRSGNPTRSILGDALAKLEKGATGVVTCTGMAAITLVTTLLGPDDLLVVPHDCYGGSYRLFTNLAKKGQFKLLVVDQTDNQALAQAIAQQPKMVWIETPSNPLLRVVDIEAIAKASHGVGALVVVDNTFLSPILQQPLLLGADIVIHSTTKYINGHSDVVGGAVIAKDPQIGETLHWWSNTLGLTGSAFDSYQTLRGLRTLAVRIREHQRNAQRIVELLSNSPVVSKVYYPGLADHPGHAIAAKQQKGFGAMLSFELKGGEAEVVAFLDALSLFSVAESLGGVESLVAVPATMTHRAMEPQARFEAGIKDTLLRLSVGIEDADDLVADIQAGLAAVAACQ

SEQ ID NO: 19200 - DNA, 1200 bp, Shewanella oneidensis
  CDS (1)..(1200)
atgacagataaacatcagctcgccacccaaatcgtcagcgtcggtcgcgataaaaaatggaccaagggcgtgattaatccgcccgtatttcgcgcatcgaccatagtgttcgacacgatggaggatatgcgtcatgccgccaaaaacaaaaccaatggcgaaatgttttacggccgccgcggcaccccgacccactttgcgtttcaagcggcggtaagcgaactcgaaggtggcgctggcacagcactgtatccctctggcgcggcagcgattagcgcggctttgttatcgtttttacaggcgggcgatcatctgctgatggtcgatagcgtttacgagccaacacgcgatttttgcagccatattctggcaggctttaatattgagaccacctattacgatcccctgattggtgaaggcattcgcgcgcttatccgccccaatactaaggtattgtttttagagtctcccggctccatcaccatggaagtgcaagacgtcccaaccctatgccgcatcgcccatgaacatggattggtgaccattctcgacaacacatgggcctcgccaatcaatagcaagcccttcgagatgggtgtcgatgtgtcgattcaagccgccacaaagtatattgtcggccactcggatgtgatgataggcacggcgaccgccaacgagcaatactggccgcagctgcgtgagcgcagttatttactggggcaaaccacttcccccgatgatgtgtatctcgccacgcgcggattacgcaccttaggcgtgcgcatggcgcaacatgagaaaaatgccctaaaagtagctaactggttacaaacccgtcctgaagtagaccatttacgtcatcccgcctttgagacctgcccaggacatgaattctttaaacgcgactttagcgcatcaaatggtttgttttcctttgtattaaaacaaggcgatcaggaagcggttaccgcactcgttgaaaatatgcagcactttaaaatgggcttttcttggggtggttatgagagtctgatcttagggatttttggcattgaaagaatccgtagtgcgaccaagtgggatgctagcaaaccgttgatccgtgttcatattggtcttgaagatcccgaggatttaattgccgatctcagcgcaggattcgagcgttttaatgccgtgctcgccgctaaggtcaaataa

SEQ ID NO: 19201 - protein, 399 aa, Shewanella oneidensis
MTDKHQLATQIVSVGRDKKWTKGVINPPVFRASTIVFDTMEDMRHAAKNKTNGEMFYGRRGTPTHFAFQAAVSELEGGAGTALYPSGAAAISAALLSFLQAGDHLLMVDSVYEPTRDFCSHILAGFNIETTYYDPLIGEGIRALIRPNTKVLFLESPGSITMEVQDVPTLCRIAHEHGLVTILDNTWASPINSKPFEMGVDVSIQAATKYIVGHSDVMIGTATANEQYWPQLRERSYLLGQTTSPDDVYLATRGLRTLGVRMAQHEKNALKVANWLQTRPEVDHLRHPAFETCPGHEFFKRDFSASNGLFSFVLKQGDQEAVTALVENMQHFKMGFSWGGYESLILGIFGIERIRSATKWDASKPLIRVHIGLEDPEDLIADLSAGFERFNAVLAAKVK

SEQ ID NO: 19202 - DNA, 1194 bp, Shewanella oneidensis
  CDS (1)..(1194)
atgcaagataaatcaagcaaaatgtggaaagcggcgacccaagccattcatgccggacatgagcgagaggccttcggttctttagtcacaccactttatcaaactgcaacttttgtgtttgattcggcgcagcaggggggcgaacgttttgcgggtaacgagccaggctatatctacacccgccttggtaatccgaccgttgcagagctcgagcgtaaaatggcgatattagaacgggctgaagccgcagcagcaactgcatcggggatgggggcggtttcggcagcgctacttgcaaacttacagataggtgatcatcttgtggcatctaatgcggtatatgggtgtacttttgcgctaatgaccaaccaatttgcccgtttcggtattgaggtgactttagttgactttagtgatgtagagttgattgagcgggctattaaacccaataccaaggtgattttttgtgaaacgccagtgaatcctcatttgcaggtatttgatctgagcgccattgcagctattgccaaacgacatagtctgacaagtattgtcgataatacgtttatgacgccgctgctgcagcaaccgatagcgctgggcattgatgttgtggtgcacagtgcgactaagtacttaaatgggcatggtgatgtgattgcgggcattgtttgtggtagtgaagcacaattgcaccgagtcaaatatgaaattcttaaagatattggtgcggtgatgtctccccacgatgcttggcttatcctacgaggccttaaaaccttagatgtgcgcttgcaacgccattgtgagagtgcgcagcgggttgctgagtttttagagcaacaccctgcagtgacacgagtttactatccaggacttaaatcccattcaggtcatcgatttatcggccaacagatgcggcgtgcaggaggggtgatcgcctttgaattagccgctgattttactcaggcgatggcgtttgttggcaaccttaaattattttcgattgcggtcagtctgggcgatgcggaatctcttattcaacatccggcttcaatgacccactctccttattcgccagaagcgcgtgccgcagccggaattggtgataatctgctgagaatttctgtcggtttagaggattgcgacgatatcatcgctgatttgagccaggcattagctgcgttagtgtaa

SEQ ID NO: 19203 - protein, 397 aa, Shewanella oneidensis
MQDKSSKMWKAATQAIHAGHEREAFGSLVTPLYQTATFVFDSAQQGGERFAGNEPGYIYTRLGNPTVAELERKMAILERAEAAAATASGMGAVSAALLANLQIGDHLVASNAVYGCTFALMTNQFARFGIEVTLVDFSDVELIERAIKPNTKVIFCETPVNPHLQVFDLSAIAAIAKRHSLTSIVDNTFMTPLLQQPIALGIDVVVHSATKYLNGHGDVIAGIVCGSEAQLHRVKYEILKDIGAVMSPHDAWLILRGLKTLDVRLQRHCESAQRVAEFLEQHPAVTRVYYPGLKSHSGHRFIGQQMRRAGGVIAFELAADFTQAMAFVGNLKLFSIAVSLGDAESLIQHPASMTHSPYSPEARAAAGIGDNLLRISVGLEDCDDIIADLSQALAALV

SEQ ID NO: 19204 - DNA, 1179 bp, Oceanobacillus iheyensis
  CDS (1)..(1179)
atgaaatataaacatatggagacttcagttattcatgaaggatacgactcaacacagatgcttgggagcttgactcctccaatatttcaaacgtcaacatacacctttgactcggcagaacaaggggaagcacgatttgccgcagaggaagaaggatatatctattctcgtttaggtaatccaactgtgcgcattttagaagagaaaattgcagcattagaaggcggagagcgagggttagctttttcatctggaatggcggcggtatctgctattttatttgcattaacaaaagctaatgatcatattatttgctcttcaggattatatggttgtacttatggattgttatcaatgatgaaagaaaaatataatattaaaacggattattccaatatgtcatccgaacaggaattggaaaatcagataacgaaagaaacagtattaatctatgtggaaacaccgattaatcctaccatgcaagtaattgatttagaattagttgtgaaagtagctaagaagcatcaacttttagtagtggtagataatactttttcctcaccttacttgcaacgtcctttagagataggatgtgattttgttattcatagtgcaacgaagtatattagtggacatggtgatgtgattgcaggacttgcggttggaaaaaaagatatcatggataccattgctttaactacgcaaaaagatattggcggagttttgtctccttttgatgcttggttattgattcgaggattaaaaacattaccattgcgaatggatagacatagtagtaacgcagaaaaaatagttcaacaactaaagttacacaaagcggttaaaaatgtctattatcctggagaccctgatttttctaatgttgctatcaccaataagcaaatgaaactcgcaggaggcgtacttgcttttgaaatcaatggtggaaagaaagaagcgcaaaaagtgttaaatcaattacactttatcaaaattgctgttagcttaggggatgcagaatcattaatggaacatccagcttccatgacacatgctgtaattcctgttgaagaacgagagaaaatgggcataacggaatctttattaagactttcagtgggaattgaagcatgggaggatatttgggaagatatccaacaagcacttgataacatctaa

SEQ ID NO: 19205 - protein, 392 aa, Oceanobacillus iheyensis
MKYKHMETSVIHEGYDSTQMLGSLTPPIFQTSTYTFDSAEQGEARFAAEEEGYIYSRLGNPTVRILEEKIAALEGGERGLAFSSGMAAVSAILFALTKANDHIICSSGLYGCTYGLLSMMKEKYNIKTDYSNMSSEQELENQITKETVLIYVETPINPTMQVIDLELVVKVAKKHQLLVVVDNTFSSPYLQRPLEIGCDFVIHSATKYISGHGDVIAGLAVGKKDIMDTIALTTQKDIGGVLSPFDAWLLIRGLKTLPLRMDRHSSNAEKIVQQLKLHKAVKNVYYPGDPDFSNVAITNKQMKLAGGVLAFEINGGKKEAQKVLNQLHFIKIAVSLGDAESLMEHPASMTHAVIPVEEREKMGITESLLRLSVGIEAWEDIWEDIQQALDNI

SEQ ID NO: 19206 - DNA, 1206 bp, Oceanobacillus iheyensis
  CDS (1)..(1206)
atgacagataagaagaaagtaaacgtaggtacagaagcagtttgggcgggagaaaaggaatatcttgtacatggagcaacgcaagtacctgttgtccttagtgttgcctacaattatgacgatatggatgaatggtatgatgtagcaattggaaaaaagaaggggcatatttatggacgaaacacaaacccaacagttcaagcttttgaagataaagtgaagcagttagaaggagcagaggctgctactagtttttctacaggaatggcagcaataagtaatacactctctacgtttttattaccaggagatcgcattgtttcgattaaagacacgtatggtggaacgaataaaatatttactgaatttcttcctcgtcagcaagtagaagtaacgttatgtgagactggagatcatgaacaaattgaaaaagaagtgaataaaggctgtaagattctatatttagaatcaccaacaaatcctactgtgaaaattaccgatctgaagaaaatggcggaagtaggaaaacgagcaggagccattgtgatcgtcgataacacgttcggtactccaataaatcaaaatccattagcacttggagccgatttggttattcatagtgctacaaaatttctaggtggtcatgcagatgcgttaggaggagtagtttgtggccctgaagattatgtagagcaaatttaccattttcgtgaaataaatggagcaacaatggatccaatggctgcttatttaacattacgtggcatgaagacattgcatctacgggtaagggaacaatcatttaatgcaatgcaattagcaaagttcctacagcagcaagatattgtagaagaagtgttttacccaggattaacgacacatccgaatcatgatattgcaaaagaacaaatgaaagactttggcggtatgttaagtttttcagtaaaaggcggcgtggacacggtaagagaattgttaccgaagctgcagtatgcacatcgagcagcaaatctaggtgcagtggaaacaacagtcggccctgcacgtacaacaagtcatgtcgaatgtacaccagaggaacgggcagcaatgggaattccagaagggcttattcgcgtgtcctgtggtattgaatatattgatgatatattggaagactttgctcaagcatttgctcatatagaaaatagcttagaaatttcttag

SEQ ID NO: 19207 - protein, 401 aa, Oceanobacillus iheyensis
MTDKKKVNVGTEAVWAGEKEYLVHGATQVPVVLSVAYNYDDMDEWYDVAIGKKKGHIYGRNTNPTVQAFEDKVKQLEGAEAATSFSTGMAAISNTLSTFLLPGDRIVSIKDTYGGTNKIFTEFLPRQQVEVTLCETGDHEQIEKEVNKGCKILYLESPTNPTVKITDLKKMAEVGKRAGAIVIVDNTFGTPINQNPLALGADLVIHSATKFLGGHADALGGVVCGPEDYVEQIYHFREINGATMDPMAAYLTLRGMKTLHLRVREQSFNAMQLAKFLQQQDIVEEVFYPGLTTHPNHDIAKEQMKDFGGMLSFSVKGGVDTVRELLPKLQYAHRAANLGAVETTVGPARTTSHVECTPEERAAMGIPEGLIRVSCGIEYIDDILEDFAQAFAHIENSLEIS

SEQ ID NO: 19208 - DNA, 1323 bp, Escherichia coli CFT073
  CDS (1)..(1323)
atgcgtttacgcagtaaaaaagtcaccagcacgccatttgcgaaaattttctgctttatgccaattcttcaggatgcgcccgcgaatattcatgctagtttagacatccagacgtataaaaacaggaatcccgacatggtggacaaaaagcttgatactcaattggtgaatgcaggacgcagcaaaaaatacactctcggtgcggtaaatagcgtgattcagcgcgcgtcttcgctggtctttgacagtgtggaagccaaaaaacacgcgacacgtaatcgcgccaatggcgagttgttctatggacggcgtggaacgttaacccatttctccttacaacaagcgatgtgtgaactggaaggtggcgcaggctgtgtgctatttccctgcggggcggcagcggttgctaattccattcttgcttttgtcgaacagggcgatcatgtgttgatgaccaacaccgcctatgaaccgagtcaggatttctgtagcaaaatcctcagcaaactgggcgtaacgacatcgtggtttgatccgctgattggtgccgatatcgttaagcatctgcagccaaacactaaaatcgtgtttctggaatcgccaggttccatcaccatggaagtccacgatgttccggcgattgttgccgccgtacgcagtgtggtcccggatgccatcattatgatcgacaacacctgggcagccggtgtgctgtttaaggcgctggattttggcatcgatgtttctattcaggccgccaccaaatatctggttgggcattcagatgcgatgattggcactgccgtgtgcaatgcccgttgctgggagcagctgcgagagaatgcctatctgatgggccagatggtcgatgccgataccgcctatataaccagccgtggcctgcgcactttgggggttcgcctgcgtcaacatcatgaaagcagtctgaaagtggctgaatggctggcagaacatccccaagtagcgcgagttaaccaccctgctctgcctggcagtaaaggccacgaattctggaaacgagactttacaggcagcagcgggctattttcctttgtgcttaagaaaaaactcaatgatgaagagctggcgaactatctggataacttcagtttattcagcatggcctactcgtggggcgggtatgaatcgttgatcctggcaaatcaaccagaacatatcgccgccattcgcccacaaggcaagatcgattttagcgggaccttgattcgcctgcatattggtctggaagatgtcgacgatctgattgccgatctggacgccggttttgcgcgaattgtataa

SEQ ID NO: 19209 - protein, 440 aa, Escherichia coli CFT073
MRLRSKKVTSTPFAKIFCFMPILQDAPANIHASLDIQTYKNRNPDMVDKKLDTQLVNAGRSKKYTLGAVNSVIQRASSLVFDSVEAKKHATRNRANGELFYGRRGTLTHFSLQQAMCELEGGAGCVLFPCGAAAVANSILAFVEQGDHVLMTNTAYEPSQDFCSKILSKLGVTTSWFDPLIGADIVKHLQPNTKIVFLESPGSITMEVHDVPAIVAAVRSVVPDAIIMIDNTWAAGVLFKALDFGIDVSIQAATKYLVGHSDAMIGTAVCNARCWEQLRENAYLMGQMVDADTAYITSRGLRTLGVRLRQHHESSLKVAEWLAEHPQVARVNHPALPGSKGHEFWKRDFTGSSGLFSFVLKKKLNDEELANYLDNFSLFSMAYSWGGYESLILANQPEHIAAIRPQGKIDFSGTLIRLHIGLEDVDDLIADLDAGFARIV

SEQ ID NO: 19210 - DNA, 1284 bp, Brucella suis
  CDS (1)..(1284)
atgactgcgccgcgcccatcgaagatccgtttgggcaatcatcttcttcatccagaaacgcagatgctgaattatggctacgacccggagctttccgagggcgcggtcaagccgcctgtgtttctcacatcgaccttcgttttcaagacagcggaagacggacgcgatttcttcgatttcgtttcggggcgcaaggagccgccggccggtgtcggggcggggcttgtctattcacgcttcaaccacccgaacagcgagattgtggaggaccgtctggcggtctatgagggggcggaaagtgcagcccttttctcgtccggcatgtccgccattgccaccacgcttttcgcttttgtgcgcccgggcgatgtcatcctgcattcgcagccactttatggcggcacggaaacgcttctggcgaagaccttcttcaattttggcgtggaggctgtcgcttttgcggatggtgttcacgaggccaccatcgagaaagcagccgaagaggcgctggcgaaaggtcgtgtttcggtcattttgatcgaaaccccggccaatccgaccaatagtattgtcgatgtcgcagcggttcgccgcgtggcggagaagattgaagcgcggcagggcagccgcccggtcatcgcctgcgacaataccctgctcgggccggtgttccagaagcctcttgatcacggggccgatctctcggtctattcgctgaccaaatatgtcggcggtcattccgatcttattgcaggggcggtgctgggcgcaaaatccgttgtgcgccaggtaaaggccctgcgcggagcaatcggtacacagctcgatccgcattcatgctggatgcttggccgctccctggaaacgctgggcctgcgcatggagcgggctgacagcaatgcccgcgccattgctgaattcctgcgtaatcaccccaaggtggaaaagctgcattatctgccttttgccgatgagcgttccgatatcgcagccttgttcaagcgccaatgtaccggcgctggctcgaccttttccttcgatataaagggcgggcaggctgctgctttccgtttcctgaatgcgctgcaaatcctgaaactcgcggtaagcctcggtggcaccgaatcgcttgcgagccatcccgcggcgatgacgcattcaggtgttccggtcgatgtgcgtgagcggatcggcgtgctggaatcgaccatccgcctttccataggtatcgagcatcccggcgacctgatcgccgatctggcacaggctttggatgcggcctga

SEQ ID NO: 19211 - protein, 427 aa, Brucella suis
MTAPRPSKIRLGNHLLHPETQMLNYGYDPELSEGAVKPPVFLTSTFVFKTAEDGRDFFDFVSGRKEPPAGVGAGLVYSRFNHPNSEIVEDRLAVYEGAESAALFSSGMSAIATTLFAFVRPGDVILHSQPLYGGTETLLAKTFFNFGVEAVAFADGVHEATIEKAAEEALAKGRVSVILIETPANPTNSIVDVAAVRRVAEKIEARQGSRPVIACDNTLLGPVFQKPLDHGADLSVYSLTKYVGGHSDLIAGAVLGAKSVVRQVKALRGAIGTQLDPHSCWMLGRSLETLGLRMERADSNARAIAEFLRNHPKVEKLHYLPFADERSDIAALFKRQCTGAGSTFSFDIKGGQAAAFRFLNALQILKLAVSLGGTESLASHPAAMTHSGVPVDVRERIGVLESTIRLSIGIEHPGDLIADLAQALDAA

SEQ ID NO: 19212 - DNA, 1170 bp, Brucella suis
  CDS (1)..(1170)
atggctaagcagcagttgaagacagagaagttgggcataaacacgcggcttgctcatgacggttattgccccggcgactatcacggctttgtcaacccgcccgtcgtgcgcgcatcgaccgtgctttttcccgatgcagaaaccatggcaagcaacggccagaaatatacctatggcacacgcggcacgcccacaagcgaagcgctttgcaaagccatagacgcgctggagggctctgcgggaacggtttgcgttccatcggggctagcggccataaccgttccgctgctgggatttctttcacccggcgatcatgcgcttcttgtcgattcgatttattacccgacccgccacttcgccaatacgatcctgaaacgcatgggtgtggacgtcgaatattacgatccggaaatcggtgcggacattgcaaagctgatgcgcccgaacaccaaggtcgtgtttacggaatcacccgcctccaacacattcgagatacaggatattcctgccatcgctgaagccgcccacaagggcaatgccatcgtcatgatggacaatacctgggcgacaccgctttatttccgggcgctcgatttcggcgtggacatcagcattcacgccgcaaccaaatatccctccggccattccgacattcttttcggcaccatttcgaccaatgagaaatgctggccgcaattgctggaaacacacggcacgatgggcctttgtgccgggcctgacgacacctaccagatcttgcgcggactgcgcaccatgggcatccggctggaacatcatcgcaaaagcgcactggagattgcccgctggctggaaaatcatccaatggtggaacgcgttctgcatccagccctcgaaagccatcccggccatgaaatctggaaacgcgatttttccggttcgtccggcattttctcctttgttctggcaaagggcggacatgcgcaagcgagcgccttcctcaacgcgctggagattttcggcctcggctattcgtggggtggctatcaaagccttgcgcttgaagtgaagcttggcgaccgcaccgtttcgaagaacgattatgccgggccggtcatccgccttcagatcggtctggaagacgtgctcgacctcatcgccgatctcgaaagaggttttgctgcaatctga

SEQ ID NO: 19213 - protein, 389 aa, Brucella suis
MAKQQLKTEKLGINTRLAHDGYCPGDYHGFVNPPVVRASTVLFPDAETMASNGQKYTYGTRGTPTSEALCKAIDALEGSAGTVCVPSGLAAITVPLLGFLSPGDHALLVDSIYYPTRHFANTILKRMGVDVEYYDPEIGADIAKLMRPNTKVVFTESPASNTFEIQDIPAIAEAAHKGNAIVMMDNTWATPLYFRALDFGVDISIHAATKYPSGHSDILFGTISTNEKCWPQLLETHGTMGLCAGPDDTYQILRGLRTMGIRLEHHRKSALEIARWLENHPMVERVLHPALESHPGHEIWKRDFSGSSGIFSFVLAKGGHAQASAFLNALEIFGLGYSWGGYQSLALEVKLGDRTVSKNDYAGPVIRLQIGLEDVLDLIADLERGFAAI

SEQ ID NO: 19214 - DNA, 1524 bp, Bifidobacterium longum
  CDS (1)..(1524)
atgtttgacctcaacaggcaacttggctatataaccacagattttccaggtatgcaaatcggccccctacgcgaaccttgttttaccgcggaattctgcggttttatcggcgtgtctcacagcgtgttttcagggcccgcttcggccctgcaaacagccccgaccaaggctgcaccccgcacttcacccaatcattttttcttatatggtgctctagaaccttgcaatggcgcggttttcgagcgatgtcgcctgtttgcgcggcacggcgcatgctggcatgctgggcgcatggcttctgatcttgtacatcacggacaatcattcgacgaccagccgctcggattcggcacgctggccattcacctcggtaacggggtcgacgccgaaaccggcgcgatccgtcgccccatcacgctggcgaacgcctacgcgctgccctacgacccctcggacatcaactggtccagttcggacgtgaacctctacacgcgcaacgggcatccgaaccagcgctatctggaagaaaagctggcccgtcttgaaggtgccgaggatgcggtggtgctcgcttccggcgtggccgcgctggccgccacgttcaccacgttcctcaaccgaggcgaccacgcgatcttctccgacaccacctatatcgccgcctaccgcctgttgaaccagattctgccggagaagtacggcatcgaaacctccatcctggatacctccgatcccgagaacgtacgcgcggcgcttcgccccaacaccaagctggtgcatatcgagacaccggcgaacccgacgctcaaggtctcggacatcgccaccatcgccaaactggcccacgaagcgaacccggacattctggtttcggtggacaacaccttcaacacgccgtacaacgtgcgcccgctcaatctcggcgcggatatcgtcatcgaatcgctcaccaaatacatcaacggccatggcgacgcgctgggcggctcgatcgccaccaccaaggcgcgcacggaccagatccgcttcaccgcgcaggtgaacttcggcggcatcatctcgccgttcaatgcctggctgatcaatcgcggctcggtgacgctgccactgcgcatccgccagcacaacgccttggccttggcgattgccaagcatctcgaatcgctggatgtggtgcgtttcgtggcgtaccccggtctggaatcgcacccgcaccacgaggtggcggtcagccagctggcccgcccggactccgggttcggcggcgtgctgtcgttcggcctcgacaccaatcatgacgggcacaaccggttcgtttccaagctcaatgtgattacgtcggccgtctcgctcggccatgacgaatcgctgatcgtgttcctcggcgaggatgacgagcgccagtacctgtacccgcctgagttccaccgcggcttcttccgtctggccgtgggtctggaggatacggacgatttgattcgcgacatcgatcacgcgctggtggaggccggattcgaggtgtga

SEQ ID NO: 19215 - protein, 507 aa, Bifidobacterium longum
MFDLNRQLGYITTDFPGMQIGPLREPCFTAEFCGFIGVSHSVFSGPASALQTAPTKAAPRTSPNHFFLYGALEPCNGAVFERCRLFARHGACWHAGRMASDLVHHGQSFDDQPLGFGTLAIHLGNGVDAETGAIRRPITLANAYALPYDPSDINWSSSDVNLYTRNGHPNQRYLEEKLARLEGAEDAVVLASGVAALAATFTTFLNRGDHAIFSDTTYIAAYRLLNQILPEKYGIETSILDTSDPENVRAALRPNTKLVHIETPANPTLKVSDIATIAKLAHEANPDILVSVDNTFNTPYNVRPLNLGADIVIESLTKYINGHGDALGGSIATTKARTDQIRFTAQVNFGGIISPFNAWLINRGSVTLPLRIRQHNALALAIAKHLESLDVVRFVAYPGLESHPHHEVAVSQLARPDSGFGGVLSFGLDTNHDGHNRFVSKLNVITSAVSLGHDESLIVFLGEDDERQYLYPPEFHRGFFRLAVGLEDTDDLIRDIDHALVEAGFEV

SEQ ID NO: 19216 - DNA, 1185 bp, Bifidobacterium longum
  CDS (1)..(1185)
atgtccgctgaatacaacgccaagttcgccaacaccgacatcgccactcgcgccatccacgccggccaggagcccgacccgaccaccggtgcggtcgtcacgccgatcttcgccacctccactttcaagcaggatggcgtgttgggcctcaggggaggccacgactactcccgctccatcaaccccactcgcaccagcttcgacgagcagctcgccgccgtggaaggcggcaagtacgcgctgagcttctcctcgggcttggccgccatcgacgtgctgctgcgctccaccatcaagcccggcgacaacatcctgctcggcaacgatgtgtacggcggcacctaccgcctgctctccaaggtgttcgtgccgtggggtgtgggcctcgacgtggtgaacatcaccgatctgaaagccgtggaaaccgcattggcctccaagcactaccagtatgtgtgggtcgagaccccgtccaacccgctgctcaacatcaccgacatcgcggccaccaccgaagtcgcccacaagtacggcaccaaggtcgctgtcgacaacaccttcgcctcgcccgcccttcagcacccgctggccgatggcgccgatgtggtggtctactccaccaccaagtacatcggcggccactccgacgtggtcggcggtgccgtggtggtcaacgatgaggagacccgcgagaaggtcgccttcctgcagaacgccgccggcgcagtgccctccccgttcgactcctggctggacatccgcggcctgaagaccctggatctgcgcgtcaagcgccacagtgccaacgccctgaaggtggccgaatggctcgaatcccagccctctgatgtgattgagcgcgtctggtacccgggcctcgagtcccacccgggtcatgaaatcgccgcccgccagatgcacggcggcttcggcggcatcgtctccgtgcagctcgcggccggcgccgaggcggccaagcacttcgtggaccacacgcagatcttcacactggccgaatcgctcggcggtgtggaaagcctcatcgaggtgcccgccgccatgacccacgcctccgtggccggcaccaccctgcaggtgcccgccaacctggtgcgcatttcggtcggtatcgagaacgccgacgaccttatcgccgatctcaagcaggcgttggatcgtatctga

SEQ ID NO: 19217 - protein, 394 aa, Bifidobacterium longum
MSAEYNAKFANTDIATRAIHAGQEPDPTTGAVVTPIFATSTFKQDGVLGLRGGHDYSRSINPTRTSFDEQLAAVEGGKYALSFSSGLAAIDVLLRSTIKPGDNILLGNDVYGGTYRLLSKVFVPWGVGLDVVNITDLKAVETALASKHYQYVWVETPSNPLLNITDIAATTEVAHKYGTKVAVDNTFASPALQHPLADGADVVVYSTTKYIGGHSDVVGGAVVVNDEETREKVAFLQNAAGAVPSPFDSWLDIRGLKTLDLRVKRHSANALKVAEWLESQPSDVIERVWYPGLESHPGHEIAARQMHGGFGGIVSVQLAAGAEAAKHFVDHTQIFTLAESLGGVESLIEVPAAMTHASVAGTTLQVPANLVRISVGIENADDLIADLKQALDRI

SEQ ID NO: 19218 - DNA, 1239 bp, Bifidobacterium longum
  CDS (1)..(1239)
atgaccaggttcaacactcagctcgtccacggactgccggttggagacaacaacaccggagccgtgaacccgccgatctacaactcaacgacatatgccttcgagaaggtcgacgcgatgccccgttacgactatgcgcgcagcggcaatcccacacgtgacttcctggaacagcagatcgcccagctcgagcagggaacgcgtggttttgcgttcgcctccggtctcgcggcgattcacgcggtgctgagcattttcaagcccggcgaccgcatcgtggtcggtgacaatatttatggcggatcgtattcccagctcaatgagttcttcactcgctggggaatcctcgtcgaggccgtcgacactcaggacatcgcagcattggaggccgccgtcaagggcgaccgcgcgaacggcatcgtgcctgcccaagccgtctactttgaaaccctgaccaatcctctactcaaggtgaacgacgtgcgcgccatctccacggtggcccaccgtttcggggcgctttcgattgtggataacacgttcgtgaccccgtatctgcagaagccgcttgctttgggtgccgatgtggtgattcactccgccaccaagtatctggccggtcattctgatgtgaacgccggtctggtggtcgtttccggtgaggatctggcgagccgcgtgtacttcgcgcagaaccgtttgggtggtgtgttggctcctgctgagtgcgacgcggtgcgccgcggcattcagacgctggcccttcgcatggatcgtcagcaggagaatgccaatgccatcgcccgctacctgctggtgcatccgctggttaaggcggtgcattacccgggtctgcccggcgcaggcgaccagcgtctggctgccaaaggtctcaagggggccggtggcgtgttgagcttcgaggtcgtgcctggcgttgatccggctgacgtgctcaacaacctgcacctgttccgtcttgctgtgtcgttgggtgcggtggagtctcttgccgagctgccgtgtcgtatgacgcatttcgaactgcctcgcgaggagcgtctgaagatcggcatcaccgatgaattggtgcgtctcgccgttggcatcgaggacgccaacgatctgatcgaagatctcggccaggcgttcgatatcgcttacgcccgttacatcgatcggcatgccgacttcgacgtgttccaacagctgacttcggggggtgtttgcctgatctaa

SEQ ID NO: 19219 - protein, 412 aa, Bifidobacterium longum
MTRFNTQLVHGLPVGDNNTGAVNPPIYNSTTYAFEKVDAMPRYDYARSGNPTRDFLEQQIAQLEQGTRGFAFASGLAAIHAVLSIFKPGDRIVVGDNIYGGSYSQLNEFFTRWGILVEAVDTQDIAALEAAVKGDRANGIVPAQAVYFETLTNPLLKVNDVRAISTVAHRFGALSIVDNTFVTPYLQKPLALGADVVIHSATKYLAGHSDVNAGLVVVSGEDLASRVYFAQNRLGGVLAPAECDAVRRGIQTLALRMDRQQENANAIARYLLVHPLVKAVHYPGLPGAGDQRLAAKGLKGAGGVLSFEVVPGVDPADVLNNLHLFRLAVSLGAVESLAELPCRMTHFELPREERLKIGITDELVRLAVGIEDANDLIEDLGQAFDIAYARYIDRHADFDVFQQLTSGGVCLI

SEQ ID NO: 19220 - DNA, 1221 bp, Streptococcus pyogenes
  CDS (1)..(1221)
atggtttgtgcaaccattggggtgggaccattgtctaaaagagagttcattggagttaacgctattgcggaggtgcacgaaatgagagaaaatacgaccttattacatggctatacggttattgacgagtttacaggagcagcttcagttcccatctatcagacttcgacgttccacaattcagaactgtattgtcctagtcaaaaacatttgtacacacgcttttcaaacccaacgactgaagctttagaagacgggttagcctgtttagaaaaagcgacttatgcggtggcttatgcatctggtatggctgctatttcaactgttttgatgctcttaaaagctggagatcatgtgattttcccattggaggtctatggagggacttgtcaatttgcgacagctattttacccaattatcagattgaaacaagctttgtagatatggctgatttagcaacagtaaaagcaagtatcaggcctaatacacgtatgatttatctagagacaccgtcaaatccgctcttgaaaatttgtgatatttcagagcttgtgcaactcgccaaagcttatggtgtgctaactgtggctgataatacctttatgacaagtttgtatcaagaacccttagctatgggtgtggatattgtggtagaaagtgtgacaaaatttatcaatggtcatagtgatgtggtagctggtttagctgctaccaataatgaggctatctacaaccagctcaagctttttcaaaaaaactttggagcaattgttggggtcgaagacgcttggctgattcttcgtggcatgaaaactatggggatccgtatggaacaagcggtaaaaaatgctcagcagctcgctaactatttagcgaagcaccccaaagttcttaaggtacattaccctggcttagacagtcatcctaatcacgatacccacctgcaacaagctaagaatggtggtgctgttttatcctttgagttggcttctaaggaggagctgatgacctttacccatcgtattcagttgccgattttagccgttagtctaggtggagtagagtccattttgtcacatccagcaacgatgtctcatgcttgtttatcgtcacaagcgcggttggaacaaggggttgttgatggtttgctgcgcttgtcttgtggtgttgaaaatatcgaagacttattggccgattttgagcaagcacttgctttttaa

SEQ ID NO: 19221 - protein, 406 aa, Streptococcus pyogenes
MVCATIGVGPLSKREFIGVNAIAEVHEMRENTTLLHGYTVIDEFTGAASVPIYQTSTFHNSELYCPSQKHLYTRFSNPTTEALEDGLACLEKATYAVAYASGMAAISTVLMLLKAGDHVIFPLEVYGGTCQFATAILPNYQIETSFVDMADLATVKASIRPNTRMIYLETPSNPLLKICDISELVQLAKAYGVLTVADNTFMTSLYQEPLAMGVDIVVESVTKFINGHSDVVAGLAATNNEAIYNQLKLFQKNFGAIVGVEDAWLILRGMKTMGIRMEQAVKNAQQLANYLAKHPKVLKVHYPGLDSHPNHDTHLQQAKNGGAVLSFELASKEELMTFTHRIQLPILAVSLGGVESILSHPATMSHACLSSQARLEQGVVDGLLRLSCGVENIEDLLADFEQALAF

SEQ ID NO: 19222 - DNA, 1143 bp, Chlorobium tepidum
  CDS (1)..(1143)
atgcactttgaaaccatcgccatccatgacggcaatacgccggagagctgcaccggatcggtgacgccgccggtttaccagacctcgactttcgcgcgtcccagcctcgacgagcggggtgaatttttctattcgcgcatcggcaacccgacgcgctcggcgctcgaatcgaccctcgcgctgcttgaaaatggcaaacatgcaacgacctttgcctccggcgtagcggcgatgatggccgctatgcaggtgctcaaaccgggcgatcacgtcgtttcgagcctcgacgtttatggcggcagctaccggattttcgagcagctcatgcgtccgtggggcgtcgaaacctcctacgcggcgagcgaagcaacggagagttatatcgagtgcatccgcccggaaacccgcatgatctggatcgaatcgccctcgaatcctcttttgcagatttgcgacatccgcgccctcgccgagatcgccaacgaacgtggcatcgtactcgcggtcgataacaccttcgccagcccctacttccagcgcccgctcgacctcggcgcgcacattgtcgtgcacagcaccaccaagtatctcggcgggcacagcgacgtgatcggcggcgcggtcgtcgcgtcggacgacaacctcaatctcacgatccgcaactaccagggcgcggcgggcgcgattcccggcccgtgggattgctggctgatttcgcgcggcatcaagacgctgaaaatccgtatggaggagcaccagaaaaacgcgctgcatctggcgcgagcgctcgaaaagcacccggcggtgagccgcgtcatctaccccggactagagtctcacccgcagcacgagctggccaaacgccagatgagcggcttcggcggaatgctgaccatcgcgctgaaaggcggacttccggcagtccgcaaaatgatcgagagcctgaaactcttcgtcatcgccgacagcctcggcggcgtggagtcactcgtcgcctcgcccgcgcggatgactctcggcccactgagtcaggccgagcgcgaccgacgcgcctgcaccgacgacctcgtgcggctctcgattggcctcgaaaacgcggaggatctcgaagcggacctcctgcaagcccttgcaaccatctaa

SEQ ID NO: 19223 - protein, 380 aa, Chlorobium tepidum
MHFETIAIHDGNTPESCTGSVTPPVYQTSTFARPSLDERGEFFYSRIGNPTRSALESTLALLENGKHATTFASGVAAMMAAMQVLKPGDHVVSSLDVYGGSYRIFEQLMRPWGVETSYAASEATESYIECIRPETRMIWIESPSNPLLQICDIRALAEIANERGIVLAVDNTFASPYFQRPLDLGAHIVVHSTTKYLGGHSDVIGGAVVASDDNLNLTIRNYQGAAGAIPGPWDCWLISRGIKTLKIRMEEHQKNALHLARALEKHPAVSRVIYPGLESHPQHELAKRQMSGFGGMLTIALKGGLPAVRKMIESLKLFVIADSLGGVESLVASPARMTLGPLSQAERDRRACTDDLVRLSIGLENAEDLEADLLQALATI

SEQ ID NO: 19224 - DNA, 1329 bp, Fusobacterium nucleatum
  CDS (64)..(1251): n means a or g or c or t/u
tttataaatcgttttatgttaatattataatataaaaacatcaaatatactaggaggtaaattatggaaacgaaaaaatatggtttaggaacaactgctatacatgcaggaactttaaaaaatttatatggaactcttgcaatgccaatatatcaaacttctacttttatatttgactcagctgaacaaggtggaagaagatttgctcttgaagaagctggatatatttatacaagattagggaatcctacaacaacagttttagaaaataaaattgcagctcttgaagaaggagaagctgctgttgctacatcatctggtatgggagctatatcttcaacattatggactgttttaaaagcaggggatcatgttgttactgataaaactttatatggttgtacttttgctttaatgtgtcatggacttacaagatttggaatagaagttacttttgttgatacttcaaatttagatgaagttaaaaatgctatgaaaaaaaatacaagagttgtttatcttgaaacacctgctaacccaaatttaaaaatagttgatttagaagcactttctaaacttgctcatacaaatccaaatactttggttattgttgacaatacttttgcaactccatatatgcaaaaacctttaaaattaggtgcagatattgttgttcactctgtaacaaaatatataaacggacatggagatgtaatagcaggtcttgttataacaaataaagaacttgcagatcaaattcgttttataggtctaaaagatatgacaggagcagttttaggaccacaagatgcttattatatcattagaggtatgaaaacttttgaaattcgtatggaaagacattgtaaaaatgctaaaaaagttgttgaatttttaaataaacacccaaaaattgaaagagtttattatcctggacttgaaacacaccctggtcatgaaatagcaaaaaaacaaatgaaagattttggagcaatgatttcttttgaactaaaaggtggttttgaagcaggtaaaactttactaaataacttaaaactttgttcattagctgtttcattgggagatactgaaactcttattcaacacccagcatctatgacacactcaccttatacaaaagaagaaagagaagctgctggaataactgatggcttggttagattatcagttggtcttgaaaatgttgaagatattatagcagatttggaacaaggactagaaaaaatttaattttactcatttatcttcattccttacttgtttatggttgttgnaatagagttttaccaacaacccatttaaccaaac

SEQ ID NO: 19225 - protein, 395 aa, Fusobacterium nucleatum
METKKYGLGTTAIHAGTLKNLYGTLAMPIYQTSTFIFDSAEQGGRRFALEEAGYIYTRLGNPTTTVLENKIAALEEGEAAVATSSGMGAISSTLWTVLKAGDHVVTDKTLYGCTFALMCHGLTRFGIEVTFVDTSNLDEVKNAMKKNTRVVYLETPANPNLKIVDLEALSKLAHTNPNTLVIVDNTFATPYMQKPLKLGADIVVHSVTKYINGHGDVIAGLVITNKELADQIRFIGLKDMTGAVLGPQDAYYIIRGMKTFEIRMERHCKNAKKVVEFLNKHPKIERVYYPGLETHPGHEIAKKQMKDFGAMISFELKGGFEAGKTLLNNLKLCSLAVSLGDTETLIQHPASMTHSPYTKEEREAAGITDGLVRLSVGLENVEDIIADLEQGLEKI

SEQ ID NO: 19226 - DNA, 1173 bp, Rhodococcus erythropolis
  CDS (1)..(1173)
atgagtgagcaacgcagcaaggccgacaacatcagctggcagggtttctccacgaaagcggtgcatgcgggttacgaacccgatccgctgaccggcgcggtcaacgtgccgatctacgcaagttccaccttcgcccaagacggcgtcggtggaatgcgcagtggcttcgagtacgcgcgaacgggcaaccccacccgtcgcccgctcgaggcgaaccttgccgcgctcgaatccggaacctacggccgagcgttcagttcgggaatggcggccaccgactgcctgctccgttcggtacttcgaccgggcgatcacctggtcatccccgacgacgcgtacggcggaaccttccgtctcatcgacaaggtgttcacgcagtgggggatcgagtacaccccggctccggtgtccgacgtcgatgcggtgcgcgcggcgatgaagtccaacaccaagctggtctgggtcgagacgcccacgaacccgctgctcaatatcggtgacatcgagcttcttgccgaggtcgcccacgagggcaacgcaaagatcgtggtggacaacaccttcgcgtcgccgtacctgcagcagccgctgcagctcggtgccgacatcgcgctgcactccacgaccaagtacatcggcggacactccgacgtggtcggtggcgctctcgtctgcaacgacgaagaactggacaccgcgtttgccttcctgcagaacggatccggcggcgttcccggcccgttcgacgcgttcctgacgttgcgcggaatcaagacactggcgctgcgtatggagcgtcacagtgacaacgcggagaaggtcgtcgaattgctcgacggccaccccgcggttgccagcgtcatctacccgggcctggcttcgcatccgtcacacaaggtcgcggccaagcagatgcgacgcttcggcggcatgatctccgtccgcctcaagggcggcaaggcggcagctctcgacctgtgctcgcgcaccgagatcttcacgctggcagaatctctcggcggcgtcgaatctctcatcgagttccccggcgcgatgacccacgcctcgacggccggttccgctctcgaggttcccgacgatctggttcgcctgtcggtcggcatcgaagacgcctccgatctggtcggcgacatcgagcaagcgctgtcctga

SEQ ID NO: 19227 - protein, 390 aa, Rhodococcus erythropolis
MSEQRSKADNISWQGFSTKAVHAGYEPDPLTGAVNVPIYASSTFAQDGVGGMRSGFEYARTGNPTRRPLEANLAALESGTYGRAFSSGMAATDCLLRSVLRPGDHLVIPDDAYGGTFRLIDKVFTQWGIEYTPAPVSDVDAVRAAMKSNTKLVWVETPTNPLLNIGDIELLAEVAHEGNAKIVVDNTFASPYLQQPLQLGADIALHSTTKYIGGHSDVVGGALVCNDEELDTAFAFLQNGSGGVPGPFDAFLTLRGIKTLALRMERHSDNAEKVVELLDGHPAVASVIYPGLASHPSHKVAAKQMRRFGGMISVRLKGGKAAALDLCSRTEIFTLAESLGGVESLIEFPGAMTHASTAGSALEVPDDLVRLSVGIEDASDLVGDIEQALS

SEQ ID NO: 19228 - DNA, 1287 bp, Xanthomonas campestris
  CDS (1)..(1287)
atgaccgatccgcagtggaagcctgaaaccatcgccgtgcacggtggctaccgtcctgatcccaccacccgcgcggtggcggtgccgatctatcagaccgtggcgtatgccttcgacgacacccagcatggcgcggatctgttcgacctgaaagtgcagggcaacatctacagccgcatcatgaatcccaccaacgacgtgctggaacagcgcgtggctgcgctggaaggcggcatcggtgcgctggcactggcgtcggggcaggcggcggtgacctatgcgatccagaccattgccgaggctggcgacaacatcgtctcctccagcgcgttgtatggcggcacctacaatctgttcgcgcacacgctgccgcagttcggtatcaccacgcgctttgccgattaccgcgatccgcaggcgtttgccggcttgatcgacgagcgcaccaaggcggtgttcgtcgagtcgatcggcaacccgcgcggcaacatcaccgacatcgaagcggtggcggcagtggcgcatgcgcacggtgtgccgctgatcgtggacaacaccgtcgccacgccgtcgctgctgcgcccgatcgacttcggcgcggatatcgtggtgcattcgctgaccaaatacctgggcgggcacggcaacagcatcggcggtgcgatcgtggacagcgggcgcttcccgtgggcggcgcacaaggcgcgctttgcgtgtctcaacgagccggacgtgagttaccacggcgtggtctataccgaagccctgggcgaggccgcctatatcggtcgtgcgcgcgtggtgccgctgcgcaataccggtgcggcgttgtcgccgttcaatgcattcctcattttgcaaggcatcgagaccctgccgctgcgcatggagcgcatcaatgccaacacgttggcgattgcccggtatctgcaggaacacgcgcgcgtggcctgggtcaattacgccgcattgctggatcaccccgagcatgcgttggcgcagaagtatctgggcgggcatggctcgggcgtgttgaccttcggactgccgggtggacgcgcggcgggtgcgcggtttctggatgcactgcagctgttcacacggttggtcaacattggcgacgccaaatcgctggccacgcatccggcctccaccacgcaccgtcagctcggcccggccgaactggagcatgccggcgtcagcgaggacaccgtgcggttgtcgattgggatcgagcacatcgatgatctgctggcggatctggagcaggcgctgcagggcgcgtga

SEQ ID NO: 19229 - protein, 428 aa, Xanthomonas campestris
MTDPQWKPETIAVHGGYRPDPTTRAVAVPIYQTVAYAFDDTQHGADLFDLKVQGNIYSRIMNPTNDVLEQRVAALEGGIGALALASGQAAVTYAIQTIAEAGDNIVSSSALYGGTYNLFAHTLPQFGITTRFADYRDPQAFAGLIDERTKAVFVESIGNPRGNITDIEAVAAVAHAHGVPLIVDNTVATPSLLRPIDFGADIVVHSLTKYLGGHGNSIGGAIVDSGRFPWAAHKARFACLNEPDVSYHGVVYTEALGEAAYIGRARVVPLRNTGAALSPFNAFLILQGIETLPLRMERINANTLAIARYLQEHARVAWVNYAALLDHPEHALAQKYLGGHGSGVLTFGLPGGRAAGARFLDALQLFTRLVNIGDAKSLATHPASTTHRQLGPAELEHAGVSEDTVRLSIGIEHIDDLLADLEQALQGA

SEQ ID NO: 19230 - DNA, 1218 bp, Xanthomonas campestris
  CDS (1)..(1218)
atgagctttcgtgaccctgccgacgcgccctgtagcgctgccaccgccgccgtccgtgccggaatcgaccgggacaccgcctacggcgcggtgacgccgccgatcgtgctgtcgtcgaacttctccttcgacggcttcggcaacaagcgccaatacgactacacccgcagcggcaaccccacccgcgacctgctcggcgaagctttggccgaactggaaggcggcgccggcggcgtgatcacctctaccggcatgggcgcgatcaacctggtgctcaatgccttgctgcagcccggcgacaccctggtggtgccgcacgatgcctacggcggcagctggcggttgttcaacgcgctggccaagaagggccatttcgccctgatcaccgccgacctcaccgacccgcgctcgctggccgatgcattggcgcagtcgcccaagctggtgctgatcgaaaccccgtccaacccgttgctgcgcatcactgatctgcgctttgtcatcgaggccgcgcacaaggtgggcgcgctgaccgtggtggacaacaccttcctgtctccggcgctgcaaaagccgctggaatttggcgccgatctggtgctgcattcgaccaccaagtacgtcaacggccacagcgatgtggtgggtggcgcagtgatcgcgcgcgatgcggagctgcaccagcagctggtgtggtgggccaacgcgctgggcctgaccggttcgccgtttgacgcgtttttgaccttgcgcgggctgcgcacgctcgatgcccgcctgcgggtgcaccaggaaaacgccgatgcgatcgcggtgctgctggacgaacacgcggcagtgaaccaggtgtatttccccgggctggcatcgcatcctggccatgcgctggcggcgcgccagcagaagggcttcggcgcgatgatcagcttcgagctcaatggcggtgaggcggcggtgcgtgcgttcgtcgacgggctgcgttatttcaccctggccgaatcgctgggcggcgtggagagcctgatcgcgcatccggcctcgatgacgcacgcggcgatgaccgccgaagcgcgcgctgcggccggtatttccgatggcttgttgcggctgtcggtgggcattgaatccgctgaggatctgctgatcgatctgcgcgccggcctggcgcgtgcggaagccgcggtgagcgcggtcgcgcgcaaacaggtcgacgcgtga

SEQ ID NO: 19231 - protein, 405 aa, Xanthomonas campestris
MSFRDPADAPCSAATAAVRAGIDRDTAYGAVTPPIVLSSNFSFDGFGNKRQYDYTRSGNPTRDLLGEALAELEGGAGGVITSTGMGAINLVLNALLQPGDTLVVPHDAYGGSWRLFNALAKKGHFALITADLTDPRSLADALAQSPKLVLIETPSNPLLRITDLRFVIEAAHKVGALTVVDNTFLSPALQKPLEFGADLVLHSTTKYVNGHSDVVGGAVIARDAELHQQLVWWANALGLTGSPFDAFLTLRGLRTLDARLRVHQENADAIAVLLDEHAAVNQVYFPGLASHPGHALAARQQKGFGAMISFELNGGEAAVRAFVDGLRYFTLAESLGGVESLIAHPASMTHAAMTAEARAAAGISDGLLRLSVGIESAEDLLIDLRAGLARAEAAVSAVARKQVDA

SEQ ID NO: 19232 - DNA, 1200 bp, Xanthomonas campestris pv
  CDS (1)..(1200)
atgtccaaccgcaccgcaaacagccacgatggcgagcgcgcgctgtcgctcgcaacgctggcgatccatggtggacagtcgccggaccccagcaccggggcggtgatgccgccgatctacgcgacgtccacctatgcgcagtccagcccgggcgagcatcagggctttgagtactcgcggacccacaaccctacgcgttttgcctatgagcgctgtgttgccgtgctggaaggcggcacccgcgggtttgccttcgcctccggcatggccgcgacctccacagtgatggagttgttggacgccggcagccacgtggtagcgaccgatgacctgtacggcggctcgttccgtctgttcgagcgtgtgcgtcgccgcaccgccggcctggacttcagtttcgtcgacctgaccgacccggccgcgttcgaggccgcgatccgcccgaccaccaagatggtctggatcgaaaccccgaccaacccgatgctcaagctggtcgacatcgccgccattgcggcgatcgcgcgtaggcacggcctgctggtggtggtggacaacaccttcgcctcgccgatgctgcagcgcccgctggaattgggcgccgacctggtggtgcattcggccaccaagtacctcaatggccactcggacatggtgggcggcatcgccgtggtcggcgacaacgccgaactcgccgaacagatggccttcctgcagaactcgatcggcggcgtacaaggcccgttcgacagcttcctggccctgcgcgggctcaagaccctgccgctgcgcatgcgcgcgcactgcgaaaacgccctggcgctggcgcagtggctggagacccaccaggcgatcgaaaaagtgatctaccccggcttggcctcgcacccgcagcacgcactcgccaagcagcagatgtccggcttcggcggcatcgtctcgatcgtcctcaagggcggcttcgaggcagccaagcgtttctgcgaaaagaccgaactgttcaccctggccgaatcgttgggtggtgtggaaagtttggtcaatcatcccgccgtcatgacccatgcctcgatccctgtggcccgccgtgaacagctaggcatcagcgatgcgctggtgcggctgagtgtgggggttgaggatgtgggggatttgcggggggatttggagcgtgcgcttgaggcgtctcagtctccatga

SEQ ID NO: 19233 - protein, 399 aa, Xanthomonas campestris pv
MSNRTANSHDGERALSLATLAIHGGQSPDPSTGAVMPPIYATSTYAQSSPGEHQGFEYSRTHNPTRFAYERCVAVLEGGTRGFAFASGMAATSTVMELLDAGSHVVATDDLYGGSFRLFERVRRRTAGLDFSFVDLTDPAAFEAAIRPTTKMVWIETPTNPMLKLVDIAAIAAIARRHGLLVVVDNTFASPMLQRPLELGADLVVHSATKYLNGHSDMVGGIAVVGDNAELAEQMAFLQNSIGGVQGPFDSFLALRGLKTLPLRMRAHCENALALAQWLETHQAIEKVIYPGLASHPQHALAKQQMSGFGGIVSIVLKGGFEAAKRFCEKTELFTLAESLGGVESLVNHPAVMTHASIPVARREQLGISDALVRLSVGVEDVGDLRGDLERALEASQSP

SEQ ID NO: 19234 - DNA, 1197 bp, Xanthomonas axonopodis
  CDS (1)..(1197)
atgtccaatcgcaccactcatagccatgacggcgagcgcgcgctgtcgctcgcaacgctggcgatccatggagggcagtcgccagatccgagcaccggcgcggtgatgccgccgatctacgcgacgtccacctatgcgcagtccagccccggcgagcatcagggtttcgagtattcgcgtacccataaccccacgcgcttcgcctacgagcgttgcgtcgccgcgctggaaggaggcacgcgcgcatatgcgttcgcctccggcatggccgccacctcgacggtgatggagttgctggatgccggcagccacgtggtggcgatggacgacctgtacggcggcacctttcgcttgttcgagcgcgtgcgtcgccgcactgccggcctggatttcagcttcgtcgacctgaccgacccggctgcgttcgaggcggcgattcgccccgataccaagatggtgtggatcgagaccccgaccaacccgatgctcaagctggtcgatatcgctgccattgccgagatcgcgcgcaagcgcggcctgctgatcgtggtcgacaacacctttgcttccccgatgctgcagcgcccgctcagcctgggtgcggacatcgtcgtgcactcggccaccaagtatctcaacggccactcggacatggtgggcggtatcgcggtcgttggcgacaacgccgagctcgccgagcagatggcgttcctgcagaactccatcggcggcgtccagggcccgttcgacagcttcctcgccttgcgcggcctcaagaccctcccgctgcgcatgcgggcgcactgcgaaaacgcactggcgcttgcgcaatggctggaaacccaccctgcgatcgaaaaggtcatttaccccggccttgcctcgcacccgcaacatgcgctcgcgaagagccagatgtccggcttcggcggcatcgtctccatcgtcctcaagggcggcttcgacgcagccaagcgtttctgcgaaaagaccgaattgttcaccctggccgaatcgctcggtggtgtggaaagcctggtgaatcatcccgccgtcatgacgcacgcctccattccggtggcccgccgcgaccagctcggtatcagcgatgcgctggtgcggttgagtgtggggatcgaggatgtggaggatttgcgtggggatttgcaggctgctttggcgggagatgaagggtaa

SEQ ID NO: 19235 - protein, 398 aa, Xanthomonas axonopodis
MSNRTTHSHDGERALSLATLAIHGGQSPDPSTGAVMPPIYATSTYAQSSPGEHQGFEYSRTHNPTRFAYERCVAALEGGTRAYAFASGMAATSTVMELLDAGSHVVAMDDLYGGTFRLFERVRRRTAGLDFSFVDLTDPAAFEAAIRPDTKMVWIETPTNPMLKLVDIAAIAEIARKRGLLIVVDNTFASPMLQRPLSLGADIVVHSATKYLNGHSDMVGGIAVVGDNAELAEQMAFLQNSIGGVQGPFDSFLALRGLKTLPLRMRAHCENALALAQWLETHPAIEKVIYPGLASHPQHALAKSQMSGFGGIVSIVLKGGFDAAKRFCEKTELFTLAESLGGVESLVNHPAVMTHASIPVARRDQLGISDALVRLSVGIEDVEDLRGDLQAALAGDEG

SEQ ID NO: 19236 - DNA, 1218 bp, Xanthomonas axonopodis
  CDS (1)..(1218)
atgagctttcgtgaccccgccgacgccccctgtactgctgccactgccgccgtgcgtgccggtatcgatcgcgacaccgcctacggtgcggtgaccccgccgatcgtggtgtcgtcgaatttctcgttcgatggtttcggcaacaagcgccagtacgactacacccgcagcggtaatccgacccgcgacctgttaggcgaagcgctggccgaactggaaggcggcgcgggcggcgtgatcacctccaccggcatgggcgcgatcaatctggtgctcaatgcggtgctgcagcccggcgatacgctggtggtgccgcacgatgcgtacggcggcagctggcgcctgttcaatgcgttggccaagaagggccacttcgcgctggtcaccgctgacttgaccgatccgcgctcgctggccgatgcattggcgcagtcgcccaaactggtgctgatcgaaaccccgtccaacccgctgctgcgcatcaccgatctgcgcttcgtcatcgaagctgcaaagaaggtcggcgcactgacggtggtggacaacaccttcttgtcgccggcattgcagaagccgctggatttcggtgccgatctggtcctgcattccaccaccaaatacatcaacggccatagcgatgtggtgggcggtgcggtggtggcacgcgatgcccagctgcatcagcaactggtgtggtgggccaatgcgttgggcctgaccggctcgccgttcgatgccttcctcaccttgcgcggtctgcgcacgctggatgcccggctgcgcgtgcatcaggaaaacgccgatgcgatcgccgcgctgctggatgggcatgcggcggtgaatcaggtgtatttcccgggtctggcctcgcatccgggccacgcactggccgcgcgccagcagaagggcttcggggcgatgatgagtttcgaactggaaggcggcgaagcggccgtgcgtgcgttcgtcgatggcttgcgttacttcaccctggccgaatcgttgggcggcgtggaaagcctgatcgcgcatccggcctcgatgacgcacgcggcaatgaccgccgaagcgcgtgcggcagccggcatttccgatggcttgctgcgcttgtcgatcgggatcgaatcggccgaagatctgctggccgatctgcgcgccggtctggcccgtgccgaagcgaccctgactaacgccagccgcaaacaggtcgacgcgtga

SEQ ID NO: 19237 - protein, 405 aa, Xanthomonas axonopodis
MSFRDPADAPCTAATAAVRAGIDRDTAYGAVTPPIVVSSNFSFDGFGNKRQYDYTRSGNPTRDLLGEALAELEGGAGGVITSTGMGAINLVLNAVLQPGDTLVVPHDAYGGSWRLFNALAKKGHFALVTADLTDPRSLADALAQSPKLVLIETPSNPLLRITDLRFVIEAAKKVGALTVVDNTFLSPALQKPLDFGADLVLHSTTKYINGHSDVVGGAVVARDAQLHQQLVWWANALGLTGSPFDAFLTLRGLRTLDARLRVHQENADAIAALLDGHAAVNQVYFPGLASHPGHALAARQQKGFGAMMSFELEGGEAAVRAFVDGLRYFTLAESLGGVESLIAHPASMTHAAMTAEARAAAGISDGLLRLSIGIESAEDLLADLRAGLARAEATLTNASRKQVDA

SEQ ID NO: 19238 - DNA, 1185 bp, Methanosarcina mazei
  CDS (1)..(1185)
atggaaaggaaatttaagttcgcaacccaatgcgttcatgcgggagaaaaaccggatccggtattcggagctcatacaactccaatatttcaaacttcaactttcatttttgatagtgttgaacagggagcttcaagatttgcagaagaggaagacgggtatgtctatacgcgcattcccccgaacacgcccacacacgccgtcctgtcagaaaagttcgctgcactcgaaggaggggaagcagggcagacctttgcttcaggaatggcagcaatcactgcagttgctctgacagccctcaaaaagggagaccacctggtctcaactgatgtggtctacggatgcacctacagccttttttcagaaattcttcccgggctcgggatagatgttactttcgtagacacaacagatgcggaaaacgtgagaaaagttctcaggccggagactaaaatggtttttctggaaactcctgccaaccctaccctgaatgtatgtgatatcagaatgatttccgggcttgcaaaagcacagggagccatctgtgttgtggataacacattttccacgccttatttccagaaacctcttcttcttggggcagatatttccctcagcagctgtacaaaatatataggcgggcatgcagatctgcttggcggaatcattgtatgcgacaaagcttttctaaaaaatctggcaaaggttgccggatatacgggcggaacaatgggcttgcacgaagcctggctctgcataagagggctgaaaaccctccatatcaggatggaaagacacgccgagaacgcgctgaaggttgctaacttccttgagtctcatcccgcagttgaatgggtaagataccccgggctttcatcccatccgcagcacgaaatcgcaaaaaaacagatgagcgggtacggagggatgctttctttcggagtaaaggacgggattgatgccggaagcaagctcatgaacagcgtcaggctctgttctctcgcagtaagcctcggggcaactgataccctgattcagcatcctgcttccatgacgcatgcctgcgtcccgaaagaagtaagaggaaaagtgggtattactgatgggcttgtcaggctttccataggaatcgaagaccctgaggacataattgcagacctcaaacaggcgcttgagaaaatttga

SEQ ID NO: 19239 - protein, 394 aa, Methanosarcina mazei
MERKFKFATQCVHAGEKPDPVFGAHTTPIFQTSTFIFDSVEQGASRFAEEEDGYVYTRIPPNTPTHAVLSEKFAALEGGEAGQTFASGMAAITAVALTALKKGDHLVSTDVVYGCTYSLFSEILPGLGIDVTFVDTTDAENVRKVLRPETKMVFLETPANPTLNVCDIRMISGLAKAQGAICVVDNTFSTPYFQKPLLLGADISLSSCTKYIGGHADLLGGIIVCDKAFLKNLAKVAGYTGGTMGLHEAWLCIRGLKTLHIRMERHAENALKVANFLESHPAVEWVRYPGLSSHPQHEIAKKQMSGYGGMLSFGVKDGIDAGSKLMNSVRLCSLAVSLGATDTLIQHPASMTHACVPKEVRGKVGITDGLVRLSIGIEDPEDIIADLKQALEKI

SEQ ID NO: 19240 - DNA, 1284 bp, Thermoanaerobacter tengcongensis
  CDS (1)..(1284)
atgaggagaaaatacggtttttctactatagcaattcatgagggatgggaacctgaccctactactggtgcagtagcgctgccaatctaccaaactacctcctttgcctttaagagcacgcagcatgcagcagacttattttctctaaaggaagacggatatatttacacgaggatgatgaatcccactgtagacgcttttgaaaggaaaatggctgcattagaagggggagtaggagcgctggcagtagcttcagggcaggctgctataactatagctgttacaaatattgcaggggctggagatgagattgtagcttctacgaatctctacggcgggacttataacctttttgcctctacccttaagaaatttggtataaatgtgaagtttgcagatccaagtgaccctgaaaattttagagaaaaaataacggagaagaccaaagctttatacgtagagacaattggcaatcccaaaattgatgtggctgatatagaaaaaatagcatcagttgctcacaatgcaggtataccccttattgtagataatacttttgcaactccatatctttcaaggcctatagaatttggggcagacatagtagtccactcaaccacaaagtttataggagggcatggtacttctatcggaggtgtaattgtggactctggaaaatttaattgggcgaatggcaagtttccagagcttacagaacctgacccctcttaccacgggataaggtatgtgaaagagtttggagagagggcttatatagtcaaagcgagagtgcagcttttaagagacttgggggcggctctttcgccttttaacgctttcttgttcgttcaagggcttgagacacttgcactcagaatggaaaggcatagttataatgcacttcgcgtggcagaatttctggcttctcatcctcttgtgagctgggtaaactatcctggccttaagtcaagcccttattatgagcttgctcaaaaatatcttccaaaagggcagggtggagttttgacttttggaataaaaggaggctttgaggcaggggtaaagtttatagagaacttaagattattcacccatcttgcaaatataggagatgtaaggtctttggtcatacatcctgctagcaccacccatcagcagctttcaaaagaagaacaattggcttcaggcgttactgaggatatgattaggctttctattggccttgaagatatagaggatattcttgaagacctggattttgcactttacagttctcaaaagtaa

SEQ ID NO: 19241 - protein, 427 aa, Thermoanaerobacter tengcongensis
MRRKYGFSTIAIHEGWEPDPTTGAVALPIYQTTSFAFKSTQHAADLFSLKEDGYIYTRMMNPTVDAFERKMAALEGGVGALAVASGQAAITIAVTNIAGAGDEIVASTNLYGGTYNLFASTLKKFGINVKFADPSDPENFREKITEKTKALYVETIGNPKIDVADIEKIASVAHNAGIPLIVDNTFATPYLSRPIEFGADIVVHSTTKFIGGHGTSIGGVIVDSGKFNWANGKFPELTEPDPSYHGIRYVKEFGERAYIVKARVQLLRDLGAALSPFNAFLFVQGLETLALRMERHSYNALRVAEFLASHPLVSWVNYPGLKSSPYYELAQKYLPKGQGGVLTFGIKGGFEAGVKFIENLRLFTHLANIGDVRSLVIHPASTTHQQLSKEEQLASGVTEDMIRLSIGLEDIEDILEDLDFALYSSQK

SEQ ID NO: 19242 - DNA, 1185 bp, Thermoanaerobacter tengcongensis
  CDS (1)..(1185)
atgaaaaaagagtttagatttgatacaaaggcgattcacggcgaagagcttaagaaaaatcctgaaaacgcattgaatccccctatttttcaaaccactacttttgtctttgaagatttggaccatgttgagaaggtaatgtcttttgagtctcaagactatgtttacacacgcggcaacaatcccaccctgaggctgtttgaaaacagaatggcagagctggagtacgggaagggagctgtagcattttcatcgggaatggcggcaataagttctgtgctcttttctcttttaaggcctaatgacaaagttttagcacacaaaactctgtacggctcaagctacaacgtgataactaaccttttgcccaaatacggggttaaatataaactcatagacatgacaagtttagaagagttaaaagagagtttagatgataccgtgaaggtgatttactttgaaactccctccaatcctgatttgtcaataatagacatagaagaagtgagtaagatagcctatcaaagaggtataaaagtagtggtagacaacacttttgccacaccttgttttcaaaatcctcttcttttgggagccgatgtggtagtacatagtgctactaagtatatatgcgggcatggggatgcgctgggaggagttgctatttcaaaagatgaagcctatattcactatttaaaattcgactacatgtgcgagtttggaggggttatgagcccttttaacgcttggcttatgttaaggggtataaagactttagggctcaggatgaggcagcatgagaagaatgccatggaggtcgcaaaatttttgagtaggcatcccaaagtgaaaaatgttttgtaccctggtcttgaatcctttaaaggacatggaattgcaaaaaagcagatgagaggatttggagctataataagttttgagatagagggtggaaggaaagaattagaagaattcataaaagggttgaaactttgccagctggcggtgagtctgggggacgcagagactttggtggaagttccttctattatgacccacagaggatatccaaaggaaaaactagaagattttggatttaaagaaaataccgtgaggatttcagtagggcttgaagattacaacgacataatagaggatttagaagatgccttgaagagaatttaa

SEQ ID NO: 19243 - protein, 394 aa, Thermoanaerobacter tengcongensis
MKKEFRFDTKAIHGEELKKNPENALNPPIFQTTTFVFEDLDHVEKVMSFESQDYVYTRGNNPTLRLFENRMAELEYGKGAVAFSSGMAAISSVLFSLLRPNDKVLAHKTLYGSSYNVITNLLPKYGVKYKLIDMTSLEELKESLDDTVKVIYFETPSNPDLSIIDIEEVSKIAYQRGIKVVVDNTFATPCFQNPLLLGADVVVHSATKYICGHGDALGGVAISKDEAYIHYLKFDYMCEFGGVMSPFNAWLMLRGIKTLGLRMRQHEKNAMEVAKFLSRHPKVKNVLYPGLESFKGHGIAKKQMRGFGAIISFEIEGGRKELEEFIKGLKLCQLAVSLGDAETLVEVPSIMTHRGYPKEKLEDFGFKENTVRISVGLEDYNDIIEDLEDALKRI

SEQ ID NO: 19244 - DNA, 1182 bp, Thermoanaerobacter tengcongensis
  CDS (1)..(1182)
atggaacttcatttcaaaacaaaagtagttcatattggaaattatgtggatgaaaaaattcctccaaaacccaaaactctccctatatatcaaacttctgtatttacttttgatactcttgaagaagtttatgattacttagacggcaatccttcaaggtatatgtacacaaggcttggaaacccaaaccaaactgctgtagaagaattaattgcaaatttagaaggagcagaggcagggcaagcctgtgcttcagggatggcagcaatttcctcagctctcctggcagaagtaaattcaggcgaccacataatcgcagcaaaagacatatacggaggaacaaacagcctttttaatttggagtttaagagattgggaattgaaataagtttggtggatttttcggacttagaatctgtagaaaaggctatcaagccaaatacaaaagtcatatacatggaaatcatgacaaatcctttgataagagtatttgacattgaagaagttgtaaaaatagcaaaaaggcacggattaaaacttatagtagacaatacttttacaactccttacctgataaggcctttagaagtcggcgcttatgctgtaatacatagcgccacaaaatacataaacggacacagtgatgtaataggaggacttatagcaggaaataaagaatttattttccgcacaaggagaatagtccacaattttggaggctctatgagtccttttgacgcatggctcactttaagaggtgctaaaacactgtttttaaggatgagagagcactgcaaaaacgcaatgcgattggccgaatttttagaaagccatccaaaagtgaaaaaggtcttctatccaggactgccttctcaccctgattacagcatcgccaaaaagctttttaaggatgaatttggaggcatgttgagctttgaaattgacggtggtgaacaatctgtaaatagattcatgcaggagctcaaacttataaaatttgctccatcactggcaggagttcaaaccatgataacacatccgaagtccacttcccacagggctttgagcaaagaagaattaaaagctcttggaatttcagaaggactcataagggtgtctgtcggaattgaggaaatagaagatgtgataagagactttaaacaggctctagataaagtgtaa

SEQ ID NO: 19245 - protein, 393 aa, Thermoanaerobacter tengcongensis
MELHFKTKVVHIGNYVDEKIPPKPKTLPIYQTSVFTFDTLEEVYDYLDGNPSRYMYTRLGNPNQTAVEELIANLEGAEAGQACASGMAAISSALLAEVNSGDHIIAAKDIYGGTNSLFNLEFKRLGIEISLVDFSDLESVEKAIKPNTKVIYMEIMTNPLIRVFDIEEVVKIAKRHGLKLIVDNTFTTPYLIRPLEVGAYAVIHSATKYINGHSDVIGGLIAGNKEFIFRTRRIVHNFGGSMSPFDAWLTLRGAKTLFLRMREHCKNAMRLAEFLESHPKVKKVFYPGLPSHPDYSIAKKLFKDEFGGMLSFEIDGGEQSVNRFMQELKLIKFAPSLAGVQTMITHPKSTSHRALSKEELKALGISEGLIRVSVGIEEIEDVIRDFKQALDKV

SEQ ID NO: 19246 - DNA, 1188 bp, Fusobacterium nucleatum
  CDS (1)..(1188)
atggaaatgaaaaaatctggtttaggaacaactgctatacatgcaggaactttaaaaaatttatatggaactcttgcaatgcctatatatcaaacttctacttttatatttgattcagcagaacaaggaggaagaagatttgcccttgaagaagctggatatatttacacaagactaggcaatcctacaacaacagtgttagaaaataaaattgctgctcttgaagaaggtgaagctggaatagctatgtcatctggtatgggagctatctcttcaacattgtggactgtattaaaagctggagatcatgttgttacagataaaactttatatggttgtacttttgctttgatgaatcatggacttacaagatttggagttgaagttacttttgttgatacttctaatttagaagaagttaaaaatgctatgaaaaaaaatacaagagttgtttatcttgaaactcctgccaatccaaatttaaaaatagttgatttagaagctttatctaaaattgctcacacaaatccaaatactttggttatagtagataatacttttgcaactccatatatgcaaaaacctttaaaattaggtgtagatattgttgtacactctgcaactaaatatttgaatggacatggagatgtaatagcaggtcttgttgtaacaagacaagaacttgcagatcaaatccgttttgttggattaaaagatatgacaggagctgttttaggacctcaagaagcatattacattataagaggattgaaaacatttgaaattcgtatggaaagacactgtaaaaatgcaagaactattgtagatttcttaaataaacatccaaaagttgaaaaagtttattatcctggacttgagactcatcctggttatgaaatagctaaaaaacaaatgaaagattttggagcaatgatttcatttgaattaaaaggtggctttgaagcaggtaaaactttattaaataatttaaaactttgttcattagcagtttcattaggagatactgaaactcttattcaacacccagcatctatgacacactctccttatacaaaggaagaaagagaagttgctggaatcactgatggtttagttagattatcagttggacttgaaaatgttgaagatattatagctgatttagaacaaggactagaaaaaatttaa

SEQ ID NO: 19247 - protein, 395 aa, Fusobacterium nucleatum
MEMKKSGLGTTAIHAGTLKNLYGTLAMPIYQTSTFIFDSAEQGGRRFALEEAGYIYTRLGNPTTTVLENKIAALEEGEAGIAMSSGMGAISSTLWTVLKAGDHVVTDKTLYGCTFALMNHGLTRFGVEVTFVDTSNLEEVKNAMKKNTRVVYLETPANPNLKIVDLEALSKIAHTNPNTLVIVDNTFATPYMQKPLKLGVDIVVHSATKYLNGHGDVIAGLVVTRQELADQIRFVGLKDMTGAVLGPQEAYYIIRGLKTFEIRMERHCKNARTIVDFLNKHPKVEKVYYPGLETHPGYEIAKKQMKDFGAMISFELKGGFEAGKTLLNNLKLCSLAVSLGDTETLIQHPASMTHSPYTKEEREVAGITDGLVRLSVGLENVEDIIADLEQGLEKI

SEQ ID NO: 19248 - DNA, 1260 bp, Fusobacterium nucleatum
  CDS (1)..(1260)
atggcttactttaatattcgctttataattttaatattattacatggaggtagaattatgtttaaagaatttgatgaaactttatcttttgaaacaaatattcttgaagctggagcatattttagattatctacttcaaatcctgaagcattaccaatacatctgactacagctcacaatgtggaagatttagaagatttacaaaaaagatatgatgaaaaaggattttgctataatcgtaatcgtaatccaaacagaacagctcttattgaattaatgaattatgttgaaggaggtgaggattctattggatgctcctcaggaatggcagcgatttcttcaagtataatagcacacactaaaacaggagatcatatactttcagataaaactctttatggagaaactttagaaatatttacaaaaatattacaaaaatatggagtagaaactacatttgtagattttactaatatagaagaagttaagaaaaatataaaatcaaatactgttattctttatactgaaactgtttctaatccattaattggagttcctaatttaaaagtattggctaacattgctcattcaaataatgctatttttattgtagataatacatttatgacaggagctttagtacaacctttaaaatttggagctgatattgttgtaaattctttaactaaatttgcaaatggacatagtgatgttgtatgtggagctgccacaggaaaatctgaacttattaaaaaaatatatgaattacaggttcttcttggaacgcaatctgatccattttcaagttggcttacagtgcgtggaatgagaacaatggaattaagaataaaaaaacaatgtgaaaatgcttctgcacttgctttagaacttgaaaagtctccttatattcttaaagtaaaccatccaagtcttgttaataatccttatcataatttagctcatgaacaatttggagattattatggaggaatgttaagtattgaacttccagaagatttaaaaaaaataaataaatttatgagaactttaaagttggctcactatgcaatgactcttggaggatatagaacttcttttgcttaccctgtcatgagttctcatagtgatatgactagagatgaaagattagcaatcggaattactgatggattattaagaatatctgttggaatagaaaatataaaagatttaataaatgattttaaaaatgctcttgaagtagcttatggaaataaataa

SEQ ID NO: 19249 - protein, 419 aa, Fusobacterium nucleatum
MAYFNIRFIILILLHGGRIMFKEFDETLSFETNILEAGAYFRLSTSNPEALPIHLTTAHNVEDLEDLQKRYDEKGFCYNRNRNPNRTALIELMNYVEGGEDSIGCSSGMAAISSSIIAHTKTGDHILSDKTLYGETLEIFTKILQKYGVETTFVDFTNIEEVKKNIKSNTVILYTETVSNPLIGVPNLKVLANIAHSNNAIFIVDNTFMTGALVQPLKFGADIVVNSLTKFANGHSDVVCGAATGKSELIKKIYELQVLLGTQSDPFSSWLTVRGMRTMELRIKKQCENASALALELEKSPYILKVNHPSLVNNPYHNLAHEQFGDYYGGMLSIELPEDLKKINKFMRTLKLAHYAMTLGGYRTSFAYPVMSSHSDMTRDERLAIGITDGLLRISVGIENIKDLINDFKNALEVAYGNK

SEQ ID NO: 19250 - DNA, 1191 bp, Fusobacterium nucleatum
  CDS (1)..(1191)
atggaaaaagaatatgcagaagctacagaattgctttataagggaagaaaagtaaaaggaatggattttaataaaccagaagcatttccattatttactacaacagcatttacaatgaatagtttaacagaagtgaaaaaagcatatgctgaaaaatatacctacattagaacatgtaatccaaatagagatgctcttgcagatatggttacatttttagaagcaggtgaaaaatctttgatattttcatcaggaatgggagcaattacaactaccataatgacaatattaaaaccaggagatcatgttgtttgtaacagaaatatttatggtgaaacatttgatgtatttacaaaattaatgccaaaatttgggattagtgcagatttagtagattttgatgacattgaaaattgtaaaaaggcaattaaagctgagacaaaattaatttattctgaagtatttgcaaaccctacattaaatattgcagatatcccaactttagctgatattgcacataaaaatggagcattgttaatgatagacaatacattttcaacaccaatcgcaataaaacccattaagtttggagcagatattgtaattaatagtttaactaaatttatgaatggacatagtgatgctattgctggttctattacttcaactactgaaattatagatgctatacatcctgtaagaatgttatgtggtactccaggagatcctcatgcagctcatgctatgatgaaaagttttgcaactatggatcttcgtttaaaaaaacaaatgtctaatgcagcaaagttagcagcagcattagaagaaaataaatatgtatctaaagtaaatcatccaagccttaaaagtttttcacaacatgaattagctcttaaattatttacttctaatgatactatgagtggaatgatgagttttattgttcctgaagattttgaaaaaatagataaatttatgttacgattaaattttgcacactatgcaatgactcttggtggtgtgcgtacaacacttgttcatccagtaacaagttctcatagtcatatgcctgatgaagcgagaagggctatgggtatcactcctgggttgtttagattatcagttggaatagaagatgtagatgatttaatagaagactttaaccaagcacttaaagtttttggagaataa

SEQ ID NO: 19251 - protein, 396 aa, Fusobacterium nucleatum
MEKEYAEATELLYKGRKVKGMDFNKPEAFPLFTTTAFTMNSLTEVKKAYAEKYTYIRTCNPNRDALADMVTFLEAGEKSLIFSSGMGAITTTIMTILKPGDHVVCNRNIYGETFDVFTKLMPKFGISADLVDFDDIENCKKAIKAETKLIYSEVFANPTLNIADIPTLADIAHKNGALLMIDNTFSTPIAIKPIKFGADIVINSLTKFMNGHSDAIAGSITSTTEIIDAIHPVRMLCGTPGDPHAAHAMMKSFATMDLRLKKQMSNAAKLAAALEENKYVSKVNHPSLKSFSQHELALKLFTSNDTMSGMMSFIVPEDFEKIDKFMLRLNFAHYAMTLGGVRTTLVHPVTSSHSHMPDEARRAMGITPGLFRLSVGIEDVDDLIEDFNQALKVFGE

SEQ ID NO: 19252 - DNA, 1341 bp, Oryza sativa
  CDS (1)..(1341)
atggccaccgtctcctccctcccgtccccggcgttcctggccgccgacccggccgccgcgctcccctccgccaccatcctccgcttcccgccaaacttcgtccgccagctcagcaccaaggcccgccgcaactgcagcaacatcggcgtcgcgcagatcgccctgctcggttcagacgccagcctcgccgtccacgcgggcgagaggctgggcagaaggatcgccacagacgcgatcaccacgccagtagtgaacacctcggcctactggttcaacaactcgcaggagctcattgacttcaaggaggggaggcatgctagcttcgagtatgggaggtatggtaacccgaccactgaggcattggagaagaagatgagtgcactggagaaagccgagtccactgtctttgtggcatccgggatgtatgcaagtgtggctatgctcagcgcgcttgttccagcaggtgggcacgttgtgaccaccactgattgttaccgcaagacgagaatttacatggagactgaactacctaagaggggaattacgatgaccgttattagacctgctgacatggatgctctccaaaatgcactggataataataatgtatccctattcttcaccgagactcctactaatccatttctgagatgcatcgacattgatcttgtctcaaaaatgtgccatagcaagggagcattgctttgtattgatagtacctttgcatccccaatcaatcagaaggcactaactctaggtgctgacttagttatccattcagcaacaaagtacattgctgggcacaatgatgttattggaggctgcatcagtggcagagatgagctagtttccaaagtccgcatctatcaccatgtagttggtggtgttctaaatccgaatgctgcctacttgattcttcgaggcatgaagacactgcatctccgtgtacaatgtcagaataatactgcaatgcggatggcccaatttttagaggaacatccaaagattgcacgtgtctactatcctggtctgccaagtcacccagaacatcacattgccaagagtcagatgaccggctttggtggtgtcattagttttgaggttgctggagactttgatgctactaggagatttattgattctgttaagataccctatcatgccccatcatttgggggctgtgagagcattattgatcagcctgccatcatgtcttactgggattcaaaggagcagagagaaatctatggaatcaaggacaacttgatcaggttcagcattggagtggaggattttgaggatttgaagaatgacgttgttcaggcgcttgacaagatctaa

SEQ ID NO: 19253 - protein, 446 aa, Oryza sativa
MATVSSLPSPAFLAADPAAALPSATILRFPPNFVRQLSTKARRNCSNIGVAQIALLGSDASLAVHAGERLGRRIATDAITTPVVNTSAYWFNNSQELIDFKEGRHASFEYGRYGNPTTEALEKKMSALEKAESTVFVASGMYASVAMLSALVPAGGHVVTTTDCYRKTRIYMETELPKRGITMTVIRPADMDALQNALDNNNVSLFFTETPTNPFLRCIDIDLVSKMCHSKGALLCIDSTFASPINQKALTLGADLVIHSATKYIAGHNDVIGGCISGRDELVSKVRIYHHVVGGVLNPNAAYLILRGMKTLHLRVQCQNNTAMRMAQFLEEHPKIARVYYPGLPSHPEHHIAKSQMTGFGGVISFEVAGDFDATRRFIDSVKIPYHAPSFGGCESIIDQPAIMSYWDSKEQREIYGIKDNLIRFSIGVEDFEDLKNDVVQALDKI

SEQ ID NO: 19254 - DNA, 1221 bp, Methanosarcina acetivorans
  CDS (1)..(1221)
atggaaagagaacttaagtttgcaaccaaatgtgtgcatgcaggagaagagccggaccctgtcttcggggcgcatacgactccgatatttcagacttcaactttcatttttaagaatgtcgaacagggggctgccaggtttgcaggagaggaatcagggtacgtatacacaagaatccctccgaacacacctacacatgcggtccttgccgaaaaggttgctgtacttgagggcggggaggcaggacagacctttgcttccggaatggctgcaataaccgcagttgtactctcaaccctgaaacagggagaccacctgatctcaacggatgtggtgtacggctgcacctacagcctcttttcggagatcctgcccgggtttgggatagatgtcagttttgttgatacatccgatataaaaaaggtgagagcagcctttaagccggaaaccagaatggtttttctggaaacgcctgccaatcccacaataacggtctgcgacatcagggagatttccaaacttgcaaaggcacagggggccatttgcatcgtggataatacctttgcaacgccgtatttccagaaaccccttgaactcggggcagacatatccctaagcagctgcacaaaatacataggcgggcacgctgaccttctcggtggaatcgttgtagggagcagggattttatgaaaagcctgggaaaggttgttgggtataccggagggatcatgggactgcacgaagcctggctctgtatcagggggcttaagactctgcacatccggatggaaaggcatgctgaaaacgccctgacggttgcaaacttccttgaggctcatcccacagtagaatgggtcaggtatcccggactttcaaaccatcctcagcacgaggtcgcaaaaaaacagatgagcggctatggtggaatgctctctttcgagatcaggggaggagttgaagccgggcgcaggcttatggacagcgtcaggctctgctctcttgcagtgagcctgggggcaactgatacccttatccaacaccccgcttccatgacccatgcctgcattcccgggcatataagaaacaaggtcggaatcaaagacggacttgtcaggctgtctgttggaatcgaagaccctgaagatataattgcagaccttgaacaggccctctcaaaagtttattgccggagaggaaacggattcgacccatgtaattga

SEQ ID NO: 19255 - protein, 406 aa, Methanosarcina acetivorans
MERELKFATKCVHAGEEPDPVFGAHTTPIFQTSTFIFKNVEQGAARFAGEESGYVYTRIPPNTPTHAVLAEKVAVLEGGEAGQTFASGMAAITAVVLSTLKQGDHLISTDVVYGCTYSLFSEILPGFGIDVSFVDTSDIKKVRAAFKPETRMVFLETPANPTITVCDIREISKLAKAQGAICIVDNTFATPYFQKPLELGADISLSSCTKYIGGHADLLGGIVVGSRDFMKSLGKVVGYTGGIMGLHEAWLCIRGLKTLHIRMERHAENALTVANFLEAHPTVEWVRYPGLSNHPQHEVAKKQMSGYGGMLSFEIRGGVEAGRRLMDSVRLCSLAVSLGATDTLIQHPASMTHACIPGHIRNKVGIKDGLVRLSVGIEDPEDIIADLEQALSKVYCRRGNGFDPCN

SEQ ID NO: 19256 - DNA, 1101 bp, Pyrococcus furiosus DSM 3638
  CDS (1)..(1101)
atggagcctcttcattatcctatctatttgactgcagtattcaagcagataggggatgcctatcttactgaaagaggtacagagctaaagtattcaagggaagaaaatccaacagtaagaaatttggaagataagcttgctaagctagagaatgctgagaatgccctggcatttaacagtggaatgggggctatctcgactttgttcctatccttgcttaaagctggagacgaaattgttatgtcaatggaggggtatggaaccacaattgaggtaccaaagcttttagaaaaatttggagttagagtaaggcttgcctatccctcagcagaaaaaatttgtgaaactataacgtccaatacaactcttgttttcattgaaacaatgactaacccaactttaaaggtaatcgacgttagggaagttgctaaaaaatgcagagaggaagaaatcactttaatagttgacaacacatttgttacccccatcctctacaggccccttgaagatggagttaatttcgtcgttcatagcttgacaaagtacattgcgggacacaacgatgttactggtggtgtaattctttggaatggaaaattcttaaatgatttatgggactggaggagaagattgggaacgataatccaaccatttgacgcctggatggttgaaagaggcatgagaaccctaaatgttaggtttgaaaagcagagtaaaaatgccttagcaatagcagaattcctgcaggatcatccaaaggttaggaaagtacactacccaggactacctagtgatccttatcatggcatagctaggagattatttaggaaggatctttatgggggagtagtttcttttgacctgggaagtgaaaaaagcgcacttgcattccttagaagcctaaagaaaatatttccctctccctctcttggaggtgtggaaagtcttgcaacttatcctgtaaaaagcgccgtaaagaacatggaaaaagaaactagagaccttcttggaataacggatggtctaattaggctttctgtgggaatagaagaggttgatgagctaatagaggacttagatagggcccttaaggggtgttag

SEQ ID NO: 19257 - protein, 366 aa, Pyrococcus furiosus DSM 3638
MEPLHYPIYLTAVFKQIGDAYLTERGTELKYSREENPTVRNLEDKLAKLENAENALAFNSGMGAISTLFLSLLKAGDEIVMSMEGYGTTIEVPKLLEKFGVRVRLAYPSAEKICETITSNTTLVFIETMTNPTLKVIDVREVAKKCREEEITLIVDNTFVTPILYRPLEDGVNFVVHSLTKYIAGHNDVTGGVILWNGKFLNDLWDWRRRLGTIIQPFDAWMVERGMRTLNVRFEKQSKNALAIAEFLQDHPKVRKVHYPGLPSDPYHGIARRLFRKDLYGGVVSFDLGSEKSALAFLRSLKKIFPSPSLGGVESLATYPVKSAVKNMEKETRDLLGITDGLIRLSVGIEEVDELIEDLDRALKGC

SEQ ID NO: 19258 - DNA, 1155 bp, Clostridium perfringens str
  CDS (1)..(1155)
atgaagaagaattctttattaatacatgggggtataagtatagatgaaaaaactggggcagtaaatattccaatatatcaaacatccacatacaagcaaagatcttttggggaaaatagtggatatgaatattcaagaacaggaaacccaactagggaatcattagaaaagttaattgcagatatagaatatggaaaaagaggatttgcctttgcatcaggtcttgcagcaattactgcagtattaagtttatttaaaagtggagataaattattaattactaataatctttacggtggaacatttagagtaattgataagatattctctaactttgggataggttatgaaataattgatgactttaccaatattgaagaaaaaattgacaagagtgttaaagctatttatatagaaacacctacaaatcctctgttagatgtcatagatataaaaatagcatcagataaagctaaaaagtataatttattaacaatagtagataacacatttatgactccatattttcaaaatccattaaatcttggggcagatatagttattcattcagcaactaaatatcttggggggcacagtgatttagttgctgggcttgtagttgtgaaagatgaagagcttggagagaaaatacactttatacaaaactctactggtggaatacttcaaccttttgatagcttcttactaataagaggaatcaaaactttatcagtaagaatggatagacatgaattaaatgctaattttatagctgaaaagttaggtgatttagaggggatagataatgtatattatccaggacttaaaactcatattggacatgacatacaaaagaaacaagcttcaggttttgggggaataatctctttcactttaaataagaaatataattatgagaagttctttaatagtttagaacttataacctttggggaaagcttaggtggagtggagtctttggcatgtcacccagcttctatgactcatgcagctatgccattagaacttagagaacgtataggaataacagataggttaataagaatttcagttggtatagaagataaagaggatattttagaagatatacaaaaagctttagtaaaggctggtgataaaaatgaaatattataa

SEQ ID NO: 19259 - protein, 384 aa, Clostridium perfringens str
MKKNSLLIHGGISIDEKTGAVNIPIYQTSTYKQRSFGENSGYEYSRTGNPTRESLEKLIADIEYGKRGFAFASGLAAITAVLSLFKSGDKLLITNNLYGGTFRVIDKIFSNFGIGYEIIDDFTNIEEKIDKSVKAIYIETPTNPLLDVIDIKIASDKAKKYNLLTIVDNTFMTPYFQNPLNLGADIVIHSATKYLGGHSDLVAGLVVVKDEELGEKIHFIQNSTGGILQPFDSFLLIRGIKTLSVRMDRHELNANFIAEKLGDLEGIDNVYYPGLKTHIGHDIQKKQASGFGGIISFTLNKKYNYEKFFNSLELITFGESLGGVESLACHPASMTHAAMPLELRERIGITDRLIRISVGIEDKEDILEDIQKALVKAGDKNEIL

SEQ ID NO: 19260 - DNA, 1215 bp, Ralstonia solanacearum
  CDS (1)..(1215)
atgaccgacgaaaccaagctcccgcccccattccccgccacgcaggccgtccatccggacctgcacatcccgcccggattcgcggcgttctcgcatgccacgcaccgtgcttccacggtggtcttcaagaacctggccgacatgcgtgccttcgggcacggcagcgtggtgcactggcgctacggcctgcatgccacgccgacatccgacacgctgtgccaggcgctggcccagatcgaaggcggcaggcacgcgctgctgctgccgtcggggctgggggcgatttcgctggtgtatttcgcgctggtcaagtcgggcgacgacgtgctgatcccggacaacgcctacggcccgacccgtgaccacggcgaatggatggcgcgccagttcggcatcacggtgcgctattacgatccgatgatcggtgccggcatcgccggcctgatccgccataacacgcggctggtgtggctggaagcgcccggctcggtgacgatggaggtgccggactgcaccgccatcgccgaggcggcgcgcgcggccggggccatcaccgcgatcgacaacacctggagcggcggcctgtactaccagccgttcgcgcacggcatcgacatctcggtccaggcgctgaccaagtaccagtcgggcggcagcgacgtgctgatgggggccaccatcaccaacgacgaagcgctgtaccacacgctgctgtccacgcgcatgcgcatgggctggggtgtgtcggcggacgactgcttcctggtgctgcgcgggctgcccagcctgccggcccggctggcggcgcacgacgcccacgcgcgcgaagtggcggaatggctggccgagcggcccgaggtggtgcgtgtgctgcatccggcgctgcccgactgtccggggcacgcgtactggaagcgcgatttcaccggcgcgagcgggttgttttcgatcgtgctgcacacgcgctatgcgccggcgcagatcgacgcctttgtcgaggcgctgcgctatttcgcgatcggcttttcgtggggcggggcgaacagcctggcgctgccgtacagcgtcccgtcgatgcgcaccgcgacggtctggccgccggcgggctgggagagcgcgggcggcctggtccgcctgtacatcggcctggaagacccgcgcgacctgatcgccgacctgaagaaggcgatggaagcgcacctgcgggcggcctga

SEQ ID NO: 19261 - protein, 404 aa, Ralstonia solanacearum
MTDETKLPPPFPATQAVHPDLHIPPGFAAFSHATHRASTVVFKNLADMRAFGHGSVVHWRYGLHATPTSDTLCQALAQIEGGRHALLLPSGLGAISLVYFALVKSGDDVLIPDNAYGPTRDHGEWMARQFGITVRYYDPMIGAGIAGLIRHNTRLVWLEAPGSVTMEVPDCTAIAEAARAAGAITAIDNTWSGGLYYQPFAHGIDISVQALTKYQSGGSDVLMGATITNDEALYHTLLSTRMRMGWGVSADDCFLVLRGLPSLPARLAAHDAHAREVAEWLAERPEVVRVLHPALPDCPGHAYWKRDFTGASGLFSIVLHTRYAPAQIDAFVEALRYFAIGFSWGGANSLALPYSVPSMRTATVWPPAGWESAGGLVRLYIGLEDPRDLIADLKKAMEAHLRAA

SEQ ID NO: 19262 - DNA, 1152 bp, Pyrobaculum aerophilum
  CDS (1)..(1152)
atgcgcaaaggtacagtcgccgtgagggggtataaacacagcgacccctacggcgctttacaacctcctatttacctaactgctcttttcaggatggagggagaggctttgaagtcagacagggggtttgaccttaaatacagccgggaggaaaaccccactctgcgccccctggaagaggtagtggccaatttagagggcggcgtagactctcttgcttttaatagcggcatggccgctctctccacggtgtttttctcacttctctccgccgacgcctccgtgttgacgccaatggaggcgtacggggctactctcagacttctaaacgccttggagaaatacggcgtcagaatgcgaaaggcatatcctgacactgaaacgtatatagaggccttaaaggcggttaagcctaatttggcgttttttgaaactattacaaatcccatgttgagagttttagacggacctgagattattaaggcggctaaggatttaggagctgtggtagtggtggacaacacctttgccactcccgtactgacaacgcctatttcctacggagctgatgtagtagtgcactcggccactaaatatctggcgggacataacgacgtagtagggggaatagctgttgtggccagaggcgatttattagaggagctttggatttggcgggcgatgctaggcagcataatgcaaccttttgaggcgtttttaacgcttagaggactgaagacgttatttgtacgttttgaaaaacagtgtaagacggcaatggccgtggcccagttcctagagggacacggcaaagtggctgaggttatataccccggcctatctagccacccccaccacgccactgctaagaggctatttggcgacaaattcggcgcggttgtctcctttagaattaagggaggtagggatgctgtcgtgaggtttttcaagtcgttgagacttataactccgggtccaagtcttggcggagtggagagcaatgcgacgtacccagtggcgagtgcagcgtcgccaattcctgaagacgagagaaagatcttgggaataactgaggatttagtgaggctgtctatagggctggaggaggctgaggatttaatagaggatttagacagggctttaaacagctaa

SEQ ID NO: 19263 - protein, 383 aa, Pyrobaculum aerophilum
MRKGTVAVRGYKHSDPYGALQPPIYLTALFRMEGEALKSDRGFDLKYSREENPTLRPLEEVVANLEGGVDSLAFNSGMAALSTVFFSLLSADASVLTPMEAYGATLRLLNALEKYGVRMRKAYPDTETYIEALKAVKPNLAFFETITNPMLRVLDGPEIIKAAKDLGAVVVVDNTFATPVLTTPISYGADVVVHSATKYLAGHNDVVGGIAVVARGDLLEELWIWRAMLGSIMQPFEAFLTLRGLKTLFVRFEKQCKTAMAVAQFLEGHGKVAEVIYPGLSSHPHHATAKRLFGDKFGAVVSFRIKGGRDAVVRFFKSLRLITPGPSLGGVESNATYPVASAASPIPEDERKILGITEDLVRLSIGLEEAEDLIEDLDRALNS

SEQ ID NO: 19264 - DNA, 1173 bp, Rhizobium meliloti
  CDS (1)..(1173)
atgaacaacggtctcgatccgttcgagagagcctcccttatcgtcgcgcatgacgagagcaacgctttcgacgccgtcgtaccgccgatcgtgcagacctcgctcttcaccttcaaggactatgacgagatggtcgcctcctatcggggagagcgcgtgcggcccatctacacccgcggcctcaatccgacggtcaggcatttcgaggagatgctggcgaagctcgaaggcgccgaggacgccatcggtttcgcaagcggcatgtcggcgatctcctccacagtcctctccttcgtcgagccgggcgaccgcatcgtcgccgtgaagcatgtctatcccgatgcgttccgactcttcggcacgcatctgaagcgcatgcgtgtcgaggtcacctatgtcgacgggcgcgacgaagaggcggttgccaaggcgcttcccggcgcaaagctcttctacatggaaagcccgaccagctgggtgatggacacgcacgatgtcgcagcgcttgcggctcttgcacgccggcaggggatcgtcacggtcatcgacaacagctgggcgagcccggtgtttcagcagccggtctcgctcggcgtcgacctcgtcattcactccgcatcgaaatatcttggtggccatagcgatgtcgtcgccggcgtcgtcgccgggtcgggcgagctgatcggccgcatccgttcggaagcctatccctatctcggcggcaagctttcgcccttcgacgcctggctgctgatccggggcatgcgcacgctgccggtgcggatgaaggcacatgagcgctcggcgctcgcggtcgcccgccgcctggccgagcatccgctggtggaaaccgtctgccacccgggcctcggcaaccatctgcctcccggtctctccggcacctccgggctcttctccttcatcttccgcgaaggcgtcgacgtgcgccgattcgccgatcacctgaaactgttcaagctcggcgtctcctggggcggccacgaaagcctcatcgtgccgggcgaagtcgttctggcgcagaaagccgagcccaattccgcggcagccttcggcatttcaccgcggtcggtacggctccatgtcggcctggagggaacggaggccctctggagcgatctcgaagcggcgatgacggccgcttcgtcaggctga

SEQ ID NO: 19265 - protein, 390 aa, Rhizobium meliloti
MNNGLDPFERASLIVAHDESNAFDAVVPPIVQTSLFTFKDYDEMVASYRGERVRPIYTRGLNPTVRHFEEMLAKLEGAEDAIGFASGMSAISSTVLSFVEPGDRIVAVKHVYPDAFRLFGTHLKRMRVEVTYVDGRDEEAVAKALPGAKLFYMESPTSWVMDTHDVAALAALARRQGIVTVIDNSWASPVFQQPVSLGVDLVIHSASKYLGGHSDVVAGVVAGSGELIGRIRSEAYPYLGGKLSPFDAWLLIRGMRTLPVRMKAHERSALAVARRLAEHPLVETVCHPGLGNHLPPGLSGTSGLFSFIFREGVDVRRFADHLKLFKLGVSWGGHESLIVPGEVVLAQKAEPNSAAAFGISPRSVRLHVGLEGTEALWSDLEAAMTAASSG

SEQ ID NO: 19266 - DNA, 1188 bp, Rhizobium meliloti
  CDS (1)..(1188)
atggcagacaacaagatcgggaaggcggagcagggcatcaatacccgtctcgcgcacaccggcaacaacccctccgacttccatggcttcgtcaatccgccggtggttcacgcctccaccgtgctgttcccgaatgcgaggacgatggagacgcgggcgcagaaatatacctatgggacgcgcggcacaccgacgaccgacgcgctctgcgaggccgtgaacgagttggagggcgcagcgggcacgatcctcgttccctccgggctcgctgcggtcacggtgccgttcctcgcctatctctcctcgggcgaccatgtgctcattgtcgattcggtctatttccccacccgccacttctgcgacacgatgctctccaggctcggcgtcacggtcgaatattatgacccgacgatcggcgccggcatcgaaaacctgatcaggccgaacacgcggctggtgcatacggaagccccgggctcgaatacgttcgagatgcaggatattccggcaatcgccgccgcggcgcaccggcacggctgtatcgtgaccatggacaatacctgggcgacgccggtctacttccggcccctcgaccacggcgtcgacgtgtcgatccatgcggcgaccaagtacccttccggtcactcggacgttcttctcggaaccgtttcggccaatgcggcccattggccggcactcagcgaggcgatggtcacgctcggcgtctccgtttcgccggacgacagctatcagatcctgcgcggcctgcgcacgatgggcgttcgcctggtgcgtcatcaggcaagcgcgctcgcgatcgctgaatggctggagggccgagacgaggtggcgcgcgtgcttcatccggcactgccgagctttcccggacacgaattgtggaagcgcgacttcggcggcgcgagcgggatattctccttcgtgctcaaggcggaaccggaagacggcaaggcaaaggcgcatgccttcctggatgcgctctcgctgttcgggctcggctactcctggggcggcttcgaaagcctcgccgttcacgtgaacctctccgatcgcaaggtggcgaaggcaccgtccgaagggccggtcatccggctgcagatcggactcgaggatgtaccggacatccgccgggatatcgaggcgggcctcgccgcggcaaacgccgtctga

SEQ ID NO: 19267 - protein, 395 aa, Rhizobium meliloti
MADNKIGKAEQGINTRLAHTGNNPSDFHGFVNPPVVHASTVLFPNARTMETRAQKYTYGTRGTPTTDALCEAVNELEGAAGTILVPSGLAAVTVPFLAYLSSGDHVLIVDSVYFPTRHFCDTMLSRLGVTVEYYDPTIGAGIENLIRPNTRLVHTEAPGSNTFEMQDIPAIAAAAHRHGCIVTMDNTWATPVYFRPLDHGVDVSIHAATKYPSGHSDVLLGTVSANAAHWPALSEAMVTLGVSVSPDDSYQILRGLRTMGVRLVRHQASALAIAEWLEGRDEVARVLHPALPSFPGHELWKRDFGGASGIFSFVLKAEPEDGKAKAHAFLDALSLFGLGYSWGGFESLAVHVNLSDRKVAKAPSEGPVIRLQIGLEDVPDIRRDIEAGLAAANAV

SEQ ID NO: 19268 - DNA, 1185 bp, Rhizobium meliloti
  CDS (1)..(1185)
atgagcaagaattggcgcccggcaacccagctcgtccacggcggaacgctccgctcccagtatggcgagacctcggaagcgatcttcctgacgcagggcttcgtctacgacagctccgaagcggcggaggcccgcttcaagggcgagaccgacggtttcatctatgcacgctacggcagcccgaccaacgacatgttcgagaagcgcatgtgcatgctcgaaggggcggaagacgcgcgcgccaccgcctccggcatggcggcggtttctgcggcaatcctttgccaggtgaaggcgggtgaccacatcgtcgccgcccgggcgctcttcggctcctgccgctgggtcgtggaaacgctggcgccgaaatacggcgtcgagtgcaccctggtggacggtcgcgatctcaagaactgggaagacgcggtgcgcccgaacaccaaggtcttcttcctcgagagcccgacgaacccgacgctcgaagtgatcgacatcgccggcgttgccaggctcgccgatcagatcggcgccaaggtggtggtcgacaacgtcttcgccacgccgctgttccagaagccgctggagcttggcgcccatgtcgtcgtctattccgcgacgaagcatatcgacggccagggccgctgcctcggcggcgtggtcctctccgacaagcagtgggtagacgagaacctgcacgactatttccgtcacaccggcccggccatgtcgcccttcaacgcctggacgctgctgaagggcatcgagaccctgccgctccgcgtcaagcagcagaccgaaagcgcccgccgcgtagccgatttcctcgcggagcagccgcaggtcgcccgcgtcatctatccgggccgcaaggatcacccgcaggccgacgtcattgccaagcagatgagcggcggctcgacgctggtcgccttcgagctcaagggtggcaaggaagcagccttcgccctgcagaacgcccttgaaatcatccggatctccaacaatctcggcgattccaagagtctgatcacccatccggcgacgaccacccacaagaacctcaccgacgaagcccgcgccgaactcggcatctccgccggaacggtgcgcttctcggccggtatcgaggacagcgaagacctcatcgaggatttcgcaagggcgctgaagggcgtaaacgcctga

SEQ ID NO: 19269 - protein, 394 aa, Rhizobium meliloti
MSKNWRPATQLVHGGTLRSQYGETSEAIFLTQGFVYDSSEAAEARFKGETDGFIYARYGSPTNDMFEKRMCMLEGAEDARATASGMAAVSAAILCQVKAGDHIVAARALFGSCRWVVETLAPKYGVECTLVDGRDLKNWEDAVRPNTKVFFLESPTNPTLEVIDIAGVARLADQIGAKVVVDNVFATPLFQKPLELGAHVVVYSATKHIDGQGRCLGGVVLSDKQWVDENLHDYFRHTGPAMSPFNAWTLLKGIETLPLRVKQQTESARRVADFLAEQPQVARVIYPGRKDHPQADVIAKQMSGGSTLVAFELKGGKEAAFALQNALEIIRISNNLGDSKSLITHPATTTHKNLTDEARAELGISAGTVRFSAGIEDSEDLIEDFARALKGVNA

SEQ ID NO: 19270 - DNA, 1227 bp, Rhizobium meliloti
  CDS (1)..(1227)
atgcctcggctgatcccgaccagccacgctgatttgatgccatcaagggacctactgccgatgctcgagcgaaaatccagatctgacagagccgaaaccacggccgcagcccacggggtcgcgaccgacccggcattcggctccgtggtgccgccgctatacttgtcaagcacctacgagttcgccggtttcgacacgccgcgcgcctacgactacggccgctctggaaatccgacccgtgacttgctggcgcaagcacttgcgaagctcgagggaggtgccgacgcggttgtcacgccgagcggcatggccgcgctcgacctcctgctagggcgcttgagacgaaaccatctcgtgctggcaccgcatgattgctatggcggcacattgcgactgctgaaggcgcgtgccgatctggggcacctcacattccggcttaccgaccagagggatttcggcggattcgaggccgcattgtcggacgctccggccctcgtcctcatcgagagccccagcaatcctctgatgcgcgtcaccgacattgcccgattgtccacgctcgccaaggcggcaggctccgccgtagccgtcgacaacacgtttctgtcccccgctctccagcaacccctttctctcggagccgattacgccattcactcggcgaccaaattcctgaacggacattcggacgtcatcgccggtgcggtgatcgctgccgagccgcaggaggcgcatgatctcaagcgctgggccaacgttaccggggcagtcgcggcacctttcgatgcctggttgactttgcgcgggctgagaacgttgtttgcgcgaatgtccagccaagaacgcagtgccatgacgatcgcagagtatctcgacgcccaccctgcggtccgccacgtccactatgcgggacttccggatcacgcagaccacgaagtcgcaagacggcagcagcgcggcttcggcgccatgatgagcttcgaactcgaagggggcgttccagccgttcggcgattcctggcacatattcgctgcttcacgctggccgagtcgctcggaggggtcgaaagtctcgtggctcatccggccaccatgacccatctcgacatgggtcctgaagccagagagcgcgcgggtattcgcgacgaactgctcagactttcgatcgggctcgaacatattgacgatcttatggaggggcttgaacttggattgggcgcctgttga

SEQ ID NO: 19271 - protein, 408 aa, Rhizobium meliloti
MPRLIPTSHADLMPSRDLLPMLERKSRSDRAETTAAAHGVATDPAFGSVVPPLYLSSTYEFAGFDTPRAYDYGRSGNPTRDLLAQALAKLEGGADAVVTPSGMAALDLLLGRLRRNHLVLAPHDCYGGTLRLLKARADLGHLTFRLTDQRDFGGFEAALSDAPALVLIESPSNPLMRVTDIARLSTLAKAAGSAVAVDNTFLSPALQQPLSLGADYAIHSATKFLNGHSDVIAGAVIAAEPQEAHDLKRWANVTGAVAAPFDAWLTLRGLRTLFARMSSQERSAMTIAEYLDAHPAVRHVHYAGLPDHADHEVARRQQRGFGAMMSFELEGGVPAVRRFLAHIRCFTLAESLGGVESLVAHPATMTHLDMGPEARERAGIRDELLRLSIGLEHIDDLMEGLELGLGAC

SEQ ID NO: 19272 - DNA, 1194 bp, Rhizobium leguminosarum
  CDS (1)..(1194): n means a or g or c or t/u
atgaccatgaaccagtcgatcaacccgcacgaccttggcgcccatgcggccgctgacgatctctttacgcctgtcgatccggcggcattcaacgccgtgtctccgccgatcttccaaacgtcgctgttcacctacgacagttacgaggcgatggaggatgttttcgccggccgcacgcgcaactacatctattcgcgtggtgacaatccgacggttcgtgaattcgaactcctggtcgcccgcctcgagggcgcagaggatggacgggctttctcgagcggaacggccgccattacttcgacaattctcagtctcgttgaggccggagaccgggtcgttgcggttcgccatctctacaacgatgtctaccgccttctggtgaagctgctcggcaggctcggcgtcgcggtggactttgtcgatcccgccgaccacgacgaggtccgcaaggctctgtcgggcgccaagctgctctatcttgaaaaccccacatccttcgtcttcgagcttcaggacattgcggcgctgtcggccatggcaaaggaggccggtgttacgacaatcatcgacaattcctgggcaacgccgctctttcaaaaaccgatccagcatggcgtcgatatcgtcattcacgccgcctcgaaatatctcggcggtcacagcgatacggtggccggcgtcgtcgtcggctcgaaggaggccatcgccaggatcaattcaatatcctacccctatgtcggcgccaaactgtcaccgttcgaggcctggctgctgctgcgcggcatgcngacgctgcgtgtccgtctcaaggagcacgagcgcagcgggcttttgttggcagggcggctgaaggagcattctgcgatcgcacgcgttcgtcacccggcattccaggaacatcccggacgggcaacgctcacgggttatgccgggctgttcgccttcgacctctatcccgatatcgatgtcgcacgttttgtgaatagccttcgcgacatccgcctcggtgtcagctggggggggaccgaaacgctggtggtccccgccaaggtcgcgttgcagatccccgaccggatgacctccttcatccggttcggtgtgagcgagcagacggttcggttcgccgttggtctggaagagccggaactgttgtggagtgatttgcagcaggcgctgtacgccgcgaaacggtag

SEQ ID NO: 19273 - protein, 397 aa, Rhizobium leguminosarum
  misc_feature (263)..(263): Xaa can be Arg or Gln or Leu or Pro
MTMNQSINPHDLGAHAAADDLFTPVDPAAFNAVSPPIFQTSLFTYDSYEAMEDVFAGRTRNYIYSRGDNPTVREFELLVARLEGAEDGRAFSSGTAAITSTILSLVEAGDRVVAVRHLYNDVYRLLVKLLGRLGVAVDFVDPADHDEVRKALSGAKLLYLENPTSFVFELQDIAALSAMAKEAGVTTIIDNSWATPLFQKPIQHGVDIVIHAASKYLGGHSDTVAGVVVGSKEAIARINSISYPYVGAKLSPFEAWLLLRGMXTLRVRLKEHERSGLLLAGRLKEHSAIARVRHPAFQEHPGRATLTGYAGLFAFDLYPDIDVARFVNSLRDIRLGVSWGGTETLVVPAKVALQIPDRMTSFIRFGVSEQTVRFAVGLEEPELLWSDLQQALYAAKR

SEQ ID NO: 19274 - DNA, 1419 bp, Oryza sativa
  CDS (1)..(1419)
atggcgaagtcatcgtctctcgtgacgaaggttttggtgcagcggcggcggcgcgttcaccgttctcgccgttctcccaccaagccggagcgcgctgccgccgccgacacgttcggttccctcgcgggttgtccctcgtcgccggagtatccggtggtgccggacttggacgactgcgtcgtcgacaccgccgtggatgacgctcccgtggtggcggcggaggcggcaggccgacgcgcgtcggacgagacgctggcggtgcacgccggggagaagctcgggagcggcgccgctgagacggactcgatcgcgacgccgatcgtgagcggcacgacgcactggttcagggactcggcggacctcatcgccttccgggaaggctggcggcggagcttcgagtacgggcggtacggaaacccgacggtgaaggtgctggaggagaagatcagcgcgctggagagggcggaggcgacgctggtgacctcctccggcatgaacgccatcgtcgccacgctgctcgccctcgtcccccccggcggccacgtcgtcgtcaccgccgactgctacagcgaggcccgcgccttcatccacgacaagctatccaagatgggcatcacgtcgacgttcgtggatcttgacgacgacatggaggcgctggaatccgttcttgatgaggacgaggtgacgatgttctacgccgactcgatgacgaacccacacctgaaggtcgtcgacgtggcacgcgtggcggagctgtgccaccggaggggcgcgctggtgtgcatcgacagcacgctggcgtcgcccatcaaccagaagccgctcgccctcggagccgacgtggtcctccactccgccaccaagtacatcgccggccaccatgacgtcatcgccggctgtgtcagcggctcagaggccctcatctcgaggatacgcgcgtggcaccacgacctcggcggcgccatcagtccgaacgcggcgtacatgatcattcggggattgaagacgttggcgctgcgggtggaggcgcagaacaggacggcgctgcggatggcgcggctgctggagaagcaccccaagatcgagcgcgtctactaccctgggctggagagcagcccgtggcacggcgtcgcgacgaggcagatggccggcgccggcggcgtggtcagcttcgaggtggcgtcggacatgcgcggcgtgatgaggttcgtggacgcgctggagttgccgctcatcgcgacgtcgctcggcggctgcgagagccttgtccagcagccggccgtcatgtcctactggggtaagagtgaggaggagaaggcgaagaatgggatcaaggacaactttgtgaggttcagttttgggatcgagaagtttgaggatctcagggatgatatactccaagccctagagaagatttaa

SEQ ID NO: 19275 - protein, 472 aa, Oryza sativa
MAKSSSLVTKVLVQRRRRVHRSRRSPTKPERAAAADTFGSLAGCPSSPEYPVVPDLDDCVVDTAVDDAPVVAAEAAGRRASDETLAVHAGEKLGSGAAETDSIATPIVSGTTHWFRDSADLIAFREGWRRSFEYGRYGNPTVKVLEEKISALERAEATLVTSSGMNAIVATLLALVPPGGHVVVTADCYSEARAFIHDKLSKMGITSTFVDLDDDMEALESVLDEDEVTMFYADSMTNPHLKVVDVARVAELCHRRGALVCIDSTLASPINQKPLALGADVVLHSATKYIAGHHDVIAGCVSGSEALISRIRAWHHDLGGAISPNAAYMIIRGLKTLALRVEAQNRTALRMARLLEKHPKIERVYYPGLESSPWHGVATRQMAGAGGVVSFEVASDMRGVMRFVDALELPLIATSLGGCESLVQQPAVMSYWGKSEEEKAKNGIKDNFVRFSFGIEKFEDLRDDILQALEKI

SEQ ID NO: 19276 - DNA, 1185 bp, Thermoplasma volcanium
  CDS (1)..(1185)
atgaataaagttagaatggcagaaaagaggctctttaatggttttaatacccgggcggtacaatcgggagaactgcgagaccctaggtttggcaacgtcactacgcctatatttgagacatccacttttgtctttcctaattcagaaaaagatgcctatatcgataacacgagaaatttgccatacatatatacgaggtggggaaacccaacagtccaagcgtttgaagaaaaatatgcttcgctagaaaaggccgaacatgcactctcattctcatccggtatgggtgctataacatcggtaatccttgctttagcagaaaggggagacaagatattgtctgtttctgatctttatggacagacattctactttcttaacaaagttctcccagagtacggcatatccgttgaatacataagcacagataggctaaattcaggggaattcaagccctcggattacgatatcatttatctcgaatccataactaaccccacattaaaagttccagacataaaagcggtttctgaaaggtctaccggaaaaaaaataatagtcgatgctacatttgcatctccatacaaccagaaccctctggaccttggtgcggatgtagttatacacagtgcaaccaagtacatatcaggacacagtgacgtagtaatgggcgtattttctacaaacgataaatctatattcgataaggttgttgtaaggagaaagacttttggatcaaacccggatccgatacagtcttatctggcgcttagaggaataaaaactctcggcctaaggatggagaaacacaacaaaaacggtatggaactagcgaaataccttagaacagaacccaggataagccacgtctactatcctgacactgaaattggcaaaaaagtcctaaggggattcggaggcatgatatcttttgaactaaggccagaactagatgttcacgtattcatgaggaaccttaagatacccatggttgctgcaagcctaggtggtgtggagagcctcattactcttcctgttgaaacttcacactcgtccatgactaaagaagagagggagaggataggcataacagacaacctagtccgattctcaataggcatagaagaccatgtagacttgatcgatgatataaaacaagctttggataaggcttcagagtcttga

SEQ ID NO: 19277 - protein, 394 aa, Thermoplasma volcanium
MNKVRMAEKRLFNGFNTRAVQSGELRDPRFGNVTTPIFETSTFVFPNSEKDAYIDNTRNLPYIYTRWGNPTVQAFEEKYASLEKAEHALSFSSGMGAITSVILALAERGDKILSVSDLYGQTFYFLNKVLPEYGISVEYISTDRLNSGEFKPSDYDIIYLESITNPTLKVPDIKAVSERSTGKKIIVDATFASPYNQNPLDLGADVVIHSATKYISGHSDVVMGVFSTNDKSIFDKVVVRRKTFGSNPDPIQSYLALRGIKTLGLRMEKHNKNGMELAKYLRTEPRISHVYYPDTEIGKKVLRGFGGMISFELRPELDVHVFMRNLKIPMVAASLGGVESLITLPVETSHSSMTKEERERIGITDNLVRFSIGIEDHVDLIDDIKQALDKASES

SEQ ID NO: 19278 - DNA, 1176 bp, Rhizobium loti
  CDS (1)..(1176)
atgcactggcgctcgaagcttattcacccgaccgctcaggccccgtcagggtttcgctcgctcgtgacgccgacctatcgggcttcgaccattctgttcgagcggcaggccgatgcggcagacgattggcgtcagagcgaggtcggttatacgtacggcctgtatggaacgcctaccgtgctggaacttggagcgcgtattgcggaactggagggtgcacgccacagcttcgttgtacccggcggccaagctgctattaccttgatctatttcgccttctgcaaggctggcagtcacgcgctcgtaccagcttccgcctatgggcccaaccgcgagctcgcggacggtctgctcgcacggctcaacatcgaggtcgaagcctatgaccctctgatcggcgggggcatttcggccctcatccgtgacaacacggcgctgatctggaccgaaagcccaggctcggtgacgatggagatacaagacgtgccagccatagtggcagcggcgcatgcccggggggtgccggttgccctcgacaatacctacgcagccggtgtgctgttcgacgccttcgccaagggcgtagatgtcagcatgcaggcgctcacgaagtacgtagggggccacagcgaccttctgctcggcacggtgtcagtcgggacgcaagcggcgtacgacgcggtcggacccgtgctgaagcagctcggcgcggccgtctccccggatgatgcaagccttgccttgcgtgggctacagacgctcggcgtgcgactggagcgcctcgaatcatcgacgctgcaggtcgccaattggctggttgcccagcctggaatcgaagccgtctttcatcccgcgctcccgtcatgcccgggccacaagttttggcagcgcgacttcacaggctcggccagcgtgttctcgatcctgttccgccgtgaggttgaccctgggcaggtcgaagcctttgttgacagtttgaggttgttcaaaattggcttcagctggggcggcacaaccgcactggcgatcctctatccaaagcttgaccgactgggcaaggactatgacggccgccttgtacggctcaatattggcctggaggagccttgcgatctcattgcggatctcgagcaggctctcgggcgcatcaatcagcccggcgcggccgctgcctga

SEQ ID NO: 19279 - protein, 391 aa, Rhizobium loti
MHWRSKLIHPTAQAPSGFRSLVTPTYRASTILFERQADAADDWRQSEVGYTYGLYGTPTVLELGARIAELEGARHSFVVPGGQAAITLIYFAFCKAGSHALVPASAYGPNRELADGLLARLNIEVEAYDPLIGGGISALIRDNTALIWTESPGSVTMEIQDVPAIVAAAHARGVPVALDNTYAAGVLFDAFAKGVDVSMQALTKYVGGHSDLLLGTVSVGTQAAYDAVGPVLKQLGAAVSPDDASLALRGLQTLGVRLERLESSTLQVANWLVAQPGIEAVFHPALPSCPGHKFWQRDFTGSASVFSILFRREVDPGQVEAFVDSLRLFKIGFSWGGTTALAILYPKLDRLGKDYDGRLVRLNIGLEEPCDLIADLEQALGRINQPGAAAA

SEQ ID NO: 19280 - DNA, 1146 bp, Rhizobium loti
  CDS (1)..(1146)
atgggtatcaacacgcggttggcccattcgggcaacaacccgcacgactatttcggcttcgtcaatccacctgtcgtgcacgcctcgaccgtgctgtaccgcaatgccgccgcaatggcgggccgcagccagaaatacacctacggcacgcgcggcacgccgaccacggacgcccttgcccaggccatcgacgcgctggagggatccgccggcacgatcgcggtgccgtcgggtcttgcggcggtgaccattccgctgctcgccttcgtatcggccggcgatcacctgctgatcgtcgacagtgtctaccatccgacccgtaatttcgccgacacgatcctgaagcggctcggcgtcgaggttgagtactatgatccgcatatcggcgctggcatcgccgccttgatcaagcccaacaccaaggtcgtgttcacggaatcgccggcctccaatacgttcgaggtgcaagacatcccggcgatcgccaaggtggcgcatacggccggcgctatcgtgatgatggacaacacctgggcgacgccgctctatttccggccgctcgaccacggcgtcgacatctccatccacgcggcgacgaaatacccggcaggccattccgacgtgctgcttggcacggtctcggccaatgagagccactgggagcagctctatgagagcttctgcacgctcggctgctgcgcgggtcccgacgatgtctaccaggtgctgcgcggcctgcgcaccatgggcgtgcgcctggagcatcaccagcgtagcgcgctggccatcgcgtcgtggctcgaaggccagaagggcgtggcgcgggtgctccaccctgcccttcccagccaccctgaccacgatctgtggaagcgcgacttttgcggttcgagcggcatcttttccatcgtgcttgccggcggcggccagaaagagcagcacgctttcctcgacgcgctcaggatattcggcctcggctattcctggggcggctatgagagccttgcggtgccggtctggctcggcgaccgcgtcgttgcaaaaggcccctatgaaggcccgttgatccgcctgcagatcggcctcgaggatgtcgacgacctgaaagccgacattttgggtggtctggcggcggcgacggcctaa

SEQ ID NO: 19281 - protein, 381 aa, Rhizobium loti
MGINTRLAHSGNNPHDYFGFVNPPVVHASTVLYRNAAAMAGRSQKYTYGTRGTPTTDALAQAIDALEGSAGTIAVPSGLAAVTIPLLAFVSAGDHLLIVDSVYHPTRNFADTILKRLGVEVEYYDPHIGAGIAALIKPNTKVVFTESPASNTFEVQDIPAIAKVAHTAGAIVMMDNTWATPLYFRPLDHGVDISIHAATKYPAGHSDVLLGTVSANESHWEQLYESFCTLGCCAGPDDVYQVLRGLRTMGVRLEHHQRSALAIASWLEGQKGVARVLHPALPSHPDHDLWKRDFCGSSGIFSIVLAGGGQKEQHAFLDALRIFGLGYSWGGYESLAVPVWLGDRVVAKGPYEGPLIRLQIGLEDVDDLKADILGGLAAATA

SEQ ID NO: 19282 - DNA, 1191 bp, Rhizobium loti
  CDS (1)..(1191)
atgagcaacaagaagcgcaactggaagcctcagacagcactcgtgcatagcggaaccctgcgttcaggcttcggcgagacctccgaggcaatgtacctgacccagggctatgtctatcaaacggcgcaagccgccgaagcccgtttcaagggcgaggaacccggtttcatctattcgcgctacgccaatccgaccgtcgacatgttcgaaaagcgcatgtgcgcgctggaaggcgcggaggacgcgcgcgccacggcatcgggcatggcggccgtgacggcggcgcttctgtgcagcgtcaagaccggtgaccacatcgtagcggcgcgcgcgctgttcggctcctgccgctgggtggtcgagacgctggcgccgcgctacggcatcgaggcgacgctcgtcgacggcaccgatatcgccaactgggaaaaggtggtcaggcccaacaccaagctgttcttcctggaaagccctaccaacccgacattggaagtggtcgacatcgccgccgtggctgcgctcgccaactcgatcggcgcgcggcttgtcgtcgacaatgtcttcgccacgcccctgcagcagaagccgttgcagctcggcgcgcatatcgtcgtctattcggcaaccaagcacatcgacggccagggccgctgtctcggcggcgtgatcctgtcggacaagaagtggatcgacgagaatctgcatgactatttccgccacaccggccctagcctgtcgcccttcaacgcctggacgctgctgaagggcctggagacgctgccgctgcgcgtgcgccagcaaacggagagcgccggcaagatcgccgatttcctggccgagcagccgcagatcgcccgcgtcatctatcccggccgcgccgaccatccgcaggccgagatcgtcaagaagcagatgtcgggcggctcgacacttatctgcctcgacgtcaaaggcggcaagcaggcggccttcgccctgcagaacgcgctcgatattgtgctgatctccaacaatctcggcgacgccaagagcctgatcacccatccggcgacgaccacccacaagaatttgagcgacgaggcgcgcgccgaactcggcatcgggccgggcacgctcaggctgtcggtcggcctggaggataccgacgaccttctggaagatatcgcgcaggcgctgaaggccgccaaatag

SEQ ID NO: 19283 - protein, 396 aa, Rhizobium loti
MSNKKRNWKPQTALVHSGTLRSGFGETSEAMYLTQGYVYQTAQAAEARFKGEEPGFIYSRYANPTVDMFEKRMCALEGAEDARATASGMAAVTAALLCSVKTGDHIVAARALFGSCRWVVETLAPRYGIEATLVDGTDIANWEKVVRPNTKLFFLESPTNPTLEVVDIAAVAALANSIGARLVVDNVFATPLQQKPLQLGAHIVVYSATKHIDGQGRCLGGVILSDKKWIDENLHDYFRHTGPSLSPFNAWTLLKGLETLPLRVRQQTESAGKIADFLAEQPQIARVIYPGRADHPQAEIVKKQMSGGSTLICLDVKGGKQAAFALQNALDIVLISNNLGDAKSLITHPATTTHKNLSDEARAELGIGPGTLRLSVGLEDTDDLLEDIAQALKAAK

SEQ ID NO: 19284 - DNA, 1185 bp, Rhizobium loti
  CDS (1)..(1185)
atgaccagccacacaccaccaccatcgggcaagaatcgcctggccttctcgacacgcaccatccatggcggccagagccacgatccgctgaccggcgcggtgatggtgccgatctatgcgacctcgacctatggccagcagtcgccgggcgtgcacaaggggtttgagtacgcccgcagccagaacccgacgcgcttcgccttcgagcgcgcggtggccgatctcgaaagcggaacggcggctttcgccttcgcctccggcctggcggcgatctcgacggtgctggagttgctcgattccggcgcgcatatcgtcgccaccgacgatatctatggcgggtcgttccggctgatggagcgggtgcgcaagcgctcggcgggcctgcaggtctcgttcgtcgacttcaccgaccttgcggcggtcgaagccgcgatccggccggagacgaagctgctctgggtcgagacgccgaccaacccgctgctgcgcatcgtcgacctcgaaggcgtcgccgcgctcgccaagcgcaagggcgtcctcaccgtcgccgacaacacgttctgcagcccctatatccagcggccgctggaactcggcatcgatatcgtcgtgcactcgacaaccaaatatctcaacggccattccgacatggtcggcggcgtggctgtggtaggcgacaacaaggaattggcgacccagctgaaattcctgcagaacgccatcggcgccatatcgggcccgttcgacagtttcctggcgctgcgcggcctgaagacgctggcgctccgcatggagcggcattccgacaacgggctgaaaatcgcgcagtggctggaggcccgcaaggacgtgcgccgcgtcctctatcccggcctcgccagccatccgcagcattccatcgccgtccagcagatgcacgccttcggcggcatgatcacggccgtgctcgaccgcgatctcgccggcacaaaacgtttcctcgaacgcacgcaattgttcacgctggccgaaagcctcggcggggtggagagcctgatcgagcatccggcgctgatgacgcatgggtctattccggccgagaaacggtcggagatcggcatttcggattcgctggtaaggctgtcggcggggatcgaggatggcgatgatctgatcgcggatctggagcaggcgctggggggatga

SEQ ID NO: 19285 - protein, 394 aa, Rhizobium loti
MTSHTPPPSGKNRLAFSTRTIHGGQSHDPLTGAVMVPIYATSTYGQQSPGVHKGFEYARSQNPTRFAFERAVADLESGTAAFAFASGLAAISTVLELLDSGAHIVATDDIYGGSFRLMERVRKRSAGLQVSFVDFTDLAAVEAAIRPETKLLWVETPTNPLLRIVDLEGVAALAKRKGVLTVADNTFCSPYIQRPLELGIDIVVHSTTKYLNGHSDMVGGVAVVGDNKELATQLKFLQNAIGAISGPFDSFLALRGLKTLALRMERHSDNGLKIAQWLEARKDVRRVLYPGLASHPQHSIAVQQMHAFGGMITAVLDRDLAGTKRFLERTQLFTLAESLGGVESLIEHPALMTHGSIPAEKRSEIGISDSLVRLSAGIEDGDDLIADLEQALGG

SEQ ID NO: 19286 - DNA, 1284 bp, Rhizobium loti
  CDS (1)..(1284)
atgaccgcgccacgcccgtcgaaaacccatatcggcaaccataagctccatccggagacgctgatgctgagctatggcttcgatccgcagctttcggaaggcgcggtcaagccgccggtgttcctgacctcgaccttcgtgttcaaatcggcagaagaggggcgcgatttcttcgactacacgtccggccgcaaggaaccgccgagcggcacggcgtcgggtctcgtctattcacggttcaaccatcccaacagcgagatcgtcgaggaccggctggcgatctatgagggcacggatgcctgcatcctgttttcatccggcatgtcggcgatcgccacgacactgctcgcctatgcccgtccgggcgacgtcatactgcattcgcaaccgctctatggcggcaccgagacgctgctgacacgcacgctgtcgggcttcggcatcggcgctgtcggcttcgccgatggtgtcgacgagaaggcggtgcgcgcagccgccgatgccgcggtggcgaaggggcgcgtttcggtcatcctgatcgagacgccgtccaatccgaccaacagcctggtcgatatcgcgctgatgcggatgatcgccgacgagattggtgcgagccaagggtcagcaccgatcatcgtctgcgacaacacgctgctcggcccggtgttccagcggccgatcgaacatggcgccgatgtctccgtctattcgctgaccaaatatgtcggcggccactccgacctgatcgcgggcgcggccatgggcagcaaggcggtcaccaagccgatcaaagcgctgcgcggcgcgatcggcacgcagctcgacccgcattcctgctggatgctcggccgttcgctggagacgctgtcaatccgcatggagcgggccaacgacaatgcgcgcctggtcgcggaattcctgcgcgatcatgccaaggtcgagaaggtgcactatctgccgttcctgggcgaggatacgccggcggggcgcgcctatgtgaggcaatgcagcggcgccggctcgaccttctccttcgacatcaaaggcggagagaaggcggctttcgcgtttctcaacgccctgcagatcttcaagctggcggtaagtctcggcggcaccgagtcgctcgccagccatccggcggccatgacccattccggcattcccttcgacgtgcgccagcgcatcggcgtcctggagaccacggtcaggctgtcgatcggtgtcgagcatccggacgatctgatcgccgacctgacgcaggcgctggcggcggtctga

SEQ ID NO: 19287 - protein, 427 aa, Rhizobium loti
MTAPRPSKTHIGNHKLHPETLMLSYGFDPQLSEGAVKPPVFLTSTFVFKSAEEGRDFFDYTSGRKEPPSGTASGLVYSRFNHPNSEIVEDRLAIYEGTDACILFSSGMSAIATTLLAYARPGDVILHSQPLYGGTETLLTRTLSGFGIGAVGFADGVDEKAVRAAADAAVAKGRVSVILIETPSNPTNSLVDIALMRMIADEIGASQGSAPIIVCDNTLLGPVFQRPIEHGADVSVYSLTKYVGGHSDLIAGAAMGSKAVTKPIKALRGAIGTQLDPHSCWMLGRSLETLSIRMERANDNARLVAEFLRDHAKVEKVHYLPFLGEDTPAGRAYVRQCSGAGSTFSFDIKGGEKAAFAFLNALQIFKLAVSLGGTESLASHPAAMTHSGIPFDVRQRIGVLETTVRLSIGVEHPDDLIADLTQALAAV

SEQ ID NO: 19288 - DNA, 1188 bp, Rhizobium loti
  CDS (1)..(1188)
atgaacgagcatccgagcggtttcgatcacgattatcttgccgaggcggcgacgcttttggcgcatgacgagccgttcccgggtggcgcggtggtgccgccgatctaccagacctcgctgttcaccttcgccaactatgccgaaatggccgacacatttgccggcaaacgaaagcagccgatctattcgcgcggcgacaatccgacggtgatggagttcgaggcgcgcgtggccgcgctcgagggcgccgaggccgcgcgcggcttttccagcggcatggcggcgatcagcgccaccgtgcttgccttcgttggcgcgggcgagcgcattgtcgccgtgcgcaattgctatggcgatgcctaccgcttgttcgaacggcttctgccgcggctcaacatcaaggtcgactatgtcgacggctccgatccggacgcggtggcagcggcacttcccggcgccaagctgctctacctggaaagcccgacctcgatgatgttcgagctccaggacattgcgcatttgacccggctggcgaaagagcagggcatcgtcaccacgatcgacaattcctgggcgacgccggtgttccagaagccgatctcgcacggggtcgacctggtgctgcattcggcatcgaaatatctcggcggccacagcgacacggtcgccggcgtggtggcgggctccgccgcccacatcaagcacatcaacgagcagacctattcctatctcggcggcaagctgtcgccattcgaggcctggctgctgctgcgcggcctgcgcacgctgccgctgcggctgccgcaccacatgaagagcgggctaaccctcgccgagcggctcaaggcgcatgcccatgtcgagcgcgtcaaccatccagcctattcgaaccatcccggcaaggcgacgctggccggctatgccggtctgttctccttcgaggtgacggacgatatcgacatcccggtcttcgtcgacgcgctgaagtatttccgcatcggcgtcagctggggcgggcatgaaagcctggtcgtgccggccaaggcgtcgctggagcagacgccgggactgaattcgatggcgcgcttcggcgtcagcccccgaaccatccgcttcaatgtcggattggaaagtgtcgaagacctctgggccgacgtcgcccaggccttcgaaaaagccagaaaataa

SEQ ID NO: 19289 - protein, 395 aa, Rhizobium loti
MNEHPSGFDHDYLAEAATLLAHDEPFPGGAVVPPIYQTSLFTFANYAEMADTFAGKRKQPIYSRGDNPTVMEFEARVAALEGAEAARGFSSGMAAISATVLAFVGAGERIVAVRNCYGDAYRLFERLLPRLNIKVDYVDGSDPDAVAAALPGAKLLYLESPTSMMFELQDIAHLTRLAKEQGIVTTIDNSWATPVFQKPISHGVDLVLHSASKYLGGHSDTVAGVVAGSAAHIKHINEQTYSYLGGKLSPFEAWLLLRGLRTLPLRLPHHMKSGLTLAERLKAHAHVERVNHPAYSNHPGKATLAGYAGLFSFEVTDDIDIPVFVDALKYFRIGVSWGGHESLVVPAKASLEQTPGLNSMARFGVSPRTIRFNVGLESVEDLWADVAQAFEKARK

SEQ ID NO: 19290 - DNA, 1212 bp, Pseudomonas putida
  CDS (1)..(1212)
atgacggatcaatgggatgccgggcgactggacagtgacctcgagggtgtcggtttcgacaccctggcggtacgcgctggccaaaaccgtaccccggaaggcgagcacagcgaagcgctgttcctgacctccagctatgtgttccgcacggcagccgatgctgctgcgcgctttgccggcgaaacgccgggcaacgtctactcgcgctacaccaacccgtcggtgcgtgccttcgaggagcgcctggcggccatggaaggtgccgaacaggccgtgggtacgtccaccggcatggcggcgatcctggccgtggtcatgtcgctgtgcagcgccggtgaccatgtgctggtgtcgcagagcgtattcggctccaccatcagcctgttcgagaagtacttcaagcgctttggtgtagaagtggactacgtgccactggtcgacctcaccggttgggaaaaggccatcaaggccaacaccaagctgctgatcgtcgaatcgccctccaacccgctggccgagttggtcgatatcaccgcgctcagcgaaatcgcccatgctcagggtgccatgctggtggtggacaactgtttcagtaccccggcgttgcagcagccgctgaagctgggtgccgacattgtgttccactcggccaccaagttcatcgacggccagggccgctgcatgggcggtgtggttgccggccgtactgagcaaatgaaagaagtggtgggtttcctgcgaaccgcaggtccaaccctcagcccgttcaacgcctggatcttcaccaagggcctggaaacgctgcgcctgcgtatgcgtgcgcactgcgaaagcgctcaggccctggccgaatggctggagcagcaggacggcgtggagaaggtgcattacgccggcctgcccagccacccgcagcacgaactggccaagcgccagatgagcggttttggtgcagtggtcagctttgaagtcaaggggggcaaagagggcgcctggcgtttcatcgacgctacccgagtgatttccatcacgaccaacctgggtgacagcaaaaccaccatcgctcatccggcgaccacctcacacggtcgtctgtcgccgcaggagcgtgaagcggctggtatccgcgacagcctgatccgtgttgccgtgggtctggaagacgtggctgacctgcaggctgacctggcgcgcgggctggcggcattgtga

SEQ ID NO: 19291 - protein, 403 aa, Pseudomonas putida
MTDQWDAGRLDSDLEGVGFDTLAVRAGQNRTPEGEHSEALFLTSSYVFRTAADAAARFAGETPGNVYSRYTNPSVRAFEERLAAMEGAEQAVGTSTGMAAILAVVMSLCSAGDHVLVSQSVFGSTISLFEKYFKRFGVEVDYVPLVDLTGWEKAIKANTKLLIVESPSNPLAELVDITALSEIAHAQGAMLVVDNCFSTPALQQPLKLGADIVFHSATKFIDGQGRCMGGVVAGRTEQMKEVVGFLRTAGPTLSPFNAWIFTKGLETLRLRMRAHCESAQALAEWLEQQDGVEKVHYAGLPSHPQHELAKRQMSGFGAVVSFEVKGGKEGAWRFIDATRVISITTNLGDSKTTIAHPATTSHGRLSPQEREAAGIRDSLIRVAVGLEDVADLQADLARGLAAL

SEQ ID NO: 19292 - DNA, 1239 bp, Arabidopsis thaliana
  CDS (1)..(1239)
atgcaaatattaaaagaaaatgcaagtaaccaacgtttcgtaaccagagaatcagaggtaaataggatttgttgtgggtttaatggttttcaattaggtgaaagattacgtcgtgatatgaagacgagttcgatcacgacccttgtagtcaacacaacgacctacttcttcaaagatactaccgagctaatcgacttcaaggaaaaacggattgacttgtatgagtatgctcgttatggaaacccaacaactatggcactcgaagaaaagattagtgtacttgaaggggctgaatcaactttggtaatggcatcggggatgtatgcaagtaatgttatgcttttggctttggttcctacaaatggacatattgtggcaactaaagattgttacaaggagacaaggattttcatggagaattttcttactaaactgggaatcactgtaacttttattgactctgatgatattgcggggctccaaactcttgttaataaccatgaggtttctttgttctttaccgagtccccaacaaatccatttcttcgatgtgtagatattaagttagtttcaaaaatctgtcatagaagaggaactcttgtttgtatagacgctaccattgcaacacctatcaatcaaaagacacttgctcttggtgctgatcttgttcaccattctgctactaagtacattggaggccacaacgattttctagctggaagcatatccggttcaatggagttggtttccaagattcgcaatttgcataagcttttgggaggcacgcttaatccgaacgctgcatatttactcatacgaggcatgaagacgatgcatcttcgtgtaagacaacagaattcaaccggtatgaagatggcccaagtgttagaagcacatcccaaggtgagtcgcgtttactatctaggccttccgagtcatcccgaacatttaatagccaagcgacaaatgactggtattggtggcctgatctctttcgagattgatggagatctcaagactacaatcaagttcatcgatgctctgaagatcccttaccttgcagcatcgtttggtggatgcgagagcctcgtggaccaactcgccacagggatctgggatataccacgagaagaaaggcttaaagatggattccaagacaacctagttcgcttcagttttggtattgaagactttgaggacatcaaggctgacgttctccaagctcttgaaaccatctga

SEQ ID NO: 19293 - protein, 412 aa, Arabidopsis thaliana
MQILKENASNQRFVTRESEVNRICCGFNGFQLGERLRRDMKTSSITTLVVNTTTYFFKDTTELIDFKEKRIDLYEYARYGNPTTMALEEKISVLEGAESTLVMASGMYASNVMLLALVPTNGHIVATKDCYKETRIFMENFLTKLGITVTFIDSDDIAGLQTLVNNHEVSLFFTESPTNPFLRCVDIKLVSKICHRRGTLVCIDATIATPINQKTLALGADLVHHSATKYIGGHNDFLAGSISGSMELVSKIRNLHKLLGGTLNPNAAYLLIRGMKTMHLRVRQQNSTGMKMAQVLEAHPKVSRVYYLGLPSHPEHLIAKRQMTGIGGLISFEIDGDLKTTIKFIDALKIPYLAASFGGCESLVDQLATGIWDIPREERLKDGFQDNLVRFSFGIEDFEDIKADVLQALETI

SEQ ID NO: 19294 - DNA, 1197 bp, Pasteurella multocida
  CDS (1)..(1197)
atgtcagaaaaacaaacattatcaacacaatttattcatacaggacgtagaaaaccctttttacaggggggagtgaatcctgtgattcaacgcgcttcatcattggtttttgacagtttagcccataaaaaacaagcgaccattgggcgtgcacagggagaattattttacgggcgtcgaggaactttaacccattttgccttgcaagaagcgatggcggaattagaaggcggagaaggttgttatttgtatccttgtggtgccgcagcggtcacacaaagtattttatcttttgtccaaagcggtgatcatattttaatgacgggtgcggcttatgagccgacgcaagagttttgtaattgtgttttgaagaaaatgcaaatagacacgacttattacgatcccatgataggtgaaggcattgctgagcttgtacaagaaaatactaaagtactttttttggaggcaccaagttcactgacaatggaggtttcagatataccggcgattgttaaagccgcacgtcgtgttaatcctgatatcgtgatcatgatcgataatacatggtcagcgggtgtgttctttaaggcacttgaacaaggtattgatatctcgattcaagctggaaccaaatatttagtgggacattccgatgtgatgattggtactgcggtggcgaataaacgttgttgggcacaattacgagagcattcttatttaatgggacaaatggtagatgcggaaagtgcttatatgaccgcacgaggtattcgaacattggggattcgcttgaaacaacatgaagaaaatgcgttgaaggtggcacactggttagcggcacaacctgaagtaaaagccgtttatcatcccgcattagaaagctgtcccggacatcaattttttaagcgtgattttagtggggcaacaggcttgttctcatttgagttgaatcaaagactaaacccgcaacaattagcgaggtttatggatcattttacgttatttagcatggcatattcttggggaggatttgaatcgttgattttacattatcaaccggaagagatcatggcgatgcgtccgaatatcacacgtcagctgaacgggacattgattcgtgttcatattggcttagaagatccggttgacttaatcgctgatctagaagccgggtttgcgcgcttaaacgcgatgtga

SEQ ID NO: 19295 - protein, 398 aa, Pasteurella multocida
MSEKQTLSTQFIHTGRRKPFLQGGVNPVIQRASSLVFDSLAHKKQATIGRAQGELFYGRRGTLTHFALQEAMAELEGGEGCYLYPCGAAAVTQSILSFVQSGDHILMTGAAYEPTQEFCNCVLKKMQIDTTYYDPMIGEGIAELVQENTKVLFLEAPSSLTMEVSDIPAIVKAARRVNPDIVIMIDNTWSAGVFFKALEQGIDISIQAGTKYLVGHSDVMIGTAVANKRCWAQLREHSYLMGQMVDAESAYMTARGIRTLGIRLKQHEENALKVAHWLAAQPEVKAVYHPALESCPGHQFFKRDFSGATGLFSFELNQRLNPQQLARFMDHFTLFSMAYSWGGFESLILHYQPEEIMAMRPNITRQLNGTLIRVHIGLEDPVDLIADLEAGFARLNAM

SEQ ID NO: 19296 - DNA, 1161 bp, Streptomyces coelicolor
  CDS (1)..(1161)
atgcccatgagcgacaggcacatcagtcagcacttcgagacgctcgcgatccacgcgggcaacaccgccgatcccctgacgggcgcggtcgtcccgccgatctatcaggtgtcgacctacaagcaggacggcgtcggcggattgcgcggcggctacgagtacagccgcagcgccaacccgacccgtaccgcgctggaggagaacctcgccgccctggagggcggccgccgcggcctcgcgttcgcgtccggactggcggccgaggactgcctgttgcgtacgctgctgcgccccggcgaccacgtggtgatcccgaacgacgcgtacggcggcaccttccgcctcttcgccaaggtcgccacccggtggggtgtggagtggtccgtggccgacacgagcgacgccgccgccgtgcgggccgccctcaccccgaagaccaaggcggtgtgggtggagacgccctccaacccgctgctcggcatcaccgacatcgcgcaggtcgcccaggtcgcccgggacgccggcgcccggctcgtcgtcgacaacaccttcgccaccccgtacctccagcagccgctggccctcggcgccgacgtcgtcgtgcactcgctgaccaagtacatgggcgggcactcggacgtcgtgggcggcgcgctgatcgtgggcgaccaggagctgggcgaggagctggcgttccaccagaacgcgatgggcgcggtcgccggacccttcgactcctggctggtgctgcgcggcaccaagaccctcgccgtgcgcatggaccggcacagcgagaacgcgaccaaggtcgccgacatgctctcccggcacgcgcgcgtgacgagcgtgctgtacccggggctgcccgagcacccggggcacgaggtcgccgccaagcagatgaaggcgttcggcggcatggtgtcgttccgcgtcgagggcggcgagcaggccgccgtcgaggtgtgcaaccgcgcgaaggtcttcacgctcggcgagtccctcggcggcgtcgagtcgctgatcgagcacccgggccggatgacgcacgcctccgcggcgggctcggccctggaggtgcccgccgacctggtgcggctgtcggtcggcatcgagaacgccgacgacctgctggccgacctccagcaggcgctgggctag

SEQ ID NO: 19297 - protein, 386 aa, Streptomyces coelicolor
MPMSDRHISQHFETLAIHAGNTADPLTGAVVPPIYQVSTYKQDGVGGLRGGYEYSRSANPTRTALEENLAALEGGRRGLAFASGLAAEDCLLRTLLRPGDHVVIPNDAYGGTFRLFAKVATRWGVEWSVADTSDAAAVRAALTPKTKAVWVETPSNPLLGITDIAQVAQVARDAGARLVVDNTFATPYLQQPLALGADVVVHSLTKYMGGHSDVVGGALIVGDQELGEELAFHQNAMGAVAGPFDSWLVLRGTKTLAVRMDRHSENATKVADMLSRHARVTSVLYPGLPEHPGHEVAAKQMKAFGGMVSFRVEGGEQAAVEVCNRAKVFTLGESLGGVESLIEHPGRMTHASAAGSALEVPADLVRLSVGIENADDLLADLQQALG

SEQ ID NO: 19298 - DNA, 1143 bp, Lactobacillus reuteri
  CDS (1)..(1143)
atgaaattcaacacccaattaattcatggcggtaatagtgaggatccaacaactggtgccgtttcaacaccaatctaccgttcatcaacattccaccaacacgttcttggcggtgaacctaaatgggaatattctcgaacaggaaatccaacacgtgtatctcttgaaaaattaatcgcagagcttgaacatgggacagtcggctttgcatttgcttctggatctgctgctattcatgctactttttctctattctcgcaaggcgatcattttgtagttggtagtgatgtatatgggggaacgttccggttaatcaataaggtattaaaacgctttggctttgaatttactgttgttgatatgcaagaccttgaagcagtagaaaatgcaattcaagataataccgttgcagtttactttgaaacaccgactaatccgctcttacaaatcgctgatattaaagcaattgccgatatcgcaaagaagcatggagtaaagacaattgttgataatacctttgccactccttataatcaacaaccattaactctcggggcggatattgttgttcactccgcaaccaaatatttaggcggtcatagtgatgttgttgccggattagcagttactaacgatgatgaaattgctgaacaattagcattcctgcaaaactcaatcggtagtacgcttggtcctgacgatagttggctattacaacgggggatgaaaactctcggtgcccggatgcgagttcaccaagaaaatgcgaatgaagttattaacttcctccaaaatgatgaccacattggaaaaatttattatccaggcttaaaagatttccctggtcatgaggttgcagctaagcaaatgcggaactttggagcaatgatctcctttgaacttaaggatagtttagatgcgaagaagtttgttgaaagtctacaattgattgatcttgccgaaagtttggggggaattgaaagtttgattgaagttccagctgtcatgactcatggatctattccccgggaaatacgattagaaaacggaattaaagatgagttgattcgtctttcagtgggaattgaggaccctgaagatattattgctgacttgcaacaagcacttaaaaaattagattaa

SEQ ID NO: 19299 - protein, 380 aa, Lactobacillus reuteri
MKFNTQLIHGGNSEDPTTGAVSTPIYRSSTFHQHVLGGEPKWEYSRTGNPTRVSLEKLIAELEHGTVGFAFASGSAAIHATFSLFSQGDHFVVGSDVYGGTFRLINKVLKRFGFEFTVVDMQDLEAVENAIQDNTVAVYFETPTNPLLQIADIKAIADIAKKHGVKTIVDNTFATPYNQQPLTLGADIVVHSATKYLGGHSDVVAGLAVTNDDEIAEQLAFLQNSIGSTLGPDDSWLLQRGMKTLGARMRVHQENANEVINFLQNDDHIGKIYYPGLKDFPGHEVAAKQMRNFGAMISFELKDSLDAKKFVESLQLIDLAESLGGIESLIEVPAVMTHGSIPREIRLENGIKDELIRLSVGIEDPEDIIADLQQALKKLD

SEQ ID NO: 19300 - DNA, 1155 bp, Thermoplasma acidophilum
  CDS (1)..(1155)
atggtatcacacaggtataagggcttcaacaccaaggctgttcagtctggagagctcagggatccaagattcggaaacgtcaccacacctatattcgagacttctacattcgtatatccgaatcctgaaaaggaagcttacaccgatcacacaagagaccagccttacatatacaccagatggggaaacccaacggtacaggcatttgaggagaagtatgcagcagttgagggcgccgaatatgcactttctttctcctccggtatgggtgcaataacctctgcgatcactgggcttctccatccgggttcaagaatgctttctttgtcggatctctacgggcagacgttttatttttttaacaaggtactcggtgatcttggcataaaggtcgattacatcgataccgagaggatcaacagcctagattttgatccatcaaaatacgatgctatctacatggagtcgataacgaatccgacactcaaggtaccggacataagatccgtgtcagactatgcgaagaaatcccttgttatagttgatgcaacgtttgcatccccgtacaaccagcaccctcttgatctgggggctgacgtagtgatacacagtgccacaaaatacattggaggtcacagcgacatcgttatgggcgttgtgggtacgaacagcaaggagatattcaacagcctcgtcatccgtaggaagacctatggatcgaacccagatcccatacaggcctatcttgcgcttcgcggcttgaagactctcggcttgaggatggagaagcataacagaaatggtatggagattgcaaccttcctgaggaaaaacgattccatatcccgggtttattatccggacaccgaaatgggaaaaaaggtgctcagcgggtttggaggcatggtatcctttgagataaggcgcgatagggatgtccactcatttctgaggaaactcagcataccgatggtggccgcaagccttggcggtgttgaaagcctcataacactaccggcggagacttcgcattcctcgctgtccagagaagaaagggaacgaatgggcataagcgacaaccttgtaaggttctcaataggcatagaggatgcagaggatctgatcgcagatatccagaatgcccttggagcttga

SEQ ID NO: 19301 - protein, 384 aa, Thermoplasma acidophilum
MVSHRYKGFNTKAVQSGELRDPRFGNVTTPIFETSTFVYPNPEKEAYTDHTRDQPYIYTRWGNPTVQAFEEKYAAVEGAEYALSFSSGMGAITSAITGLLHPGSRMLSLSDLYGQTFYFFNKVLGDLGIKVDYIDTERINSLDFDPSKYDAIYMESITNPTLKVPDIRSVSDYAKKSLVIVDATFASPYNQHPLDLGADVVIHSATKYIGGHSDIVMGVVGTNSKEIFNSLVIRRKTYGSNPDPIQAYLALRGLKTLGLRMEKHNRNGMEIATFLRKNDSISRVYYPDTEMGKKVLSGFGGMVSFEIRRDRDVHSFLRKLSIPMVAASLGGVESLITLPAETSHSSLSREERERMGISDNLVRFSIGIEDAEDLIADIQNALGA

SEQ ID NO: 19302 - DNA, 1428 bp, Oryza sativa
  CDS (277)..(1428)
atgagcgccgccgccgccgccgccgccgccgccgcaatccccacctctctcggccgcctcttccacctccgccccaccccgaacccctcccggaaccttagcggcagctcagcgcaacccctcctccgcctcagctaccacccacgcctcacgctctctcgccgcatggaggcgccggcggcgatcgccgactcccacggcggcggcgacctgagcgcgtccgcggtcggcgcggaggcgctgggcgccgtcgccgctccggatttcgatgtggagatgaaggagcctagcgtggcgacgatactgacgagcttcgagaactcgttcgatgggttcgggtctatgagcacgccgctgtaccagacggccacgtttaagcagccttcagcaaccgataatggaccttatgattacactagaagtggtaaccctacacgtgatgttctccaaagccttatggctaagcttgagaaggcggatcaggcattctgcttcaccagtgggatggcagcactagctgcagtaacacacctccttaagtctggacaagaaatagttgctggagaggacatatatggtggctcagaccgtctgctctcacaagttgccccgagacatgggattgtagtaaaacgaattgatacaaccaaaattagtgaggtaacttctgcaattgggcccttgactaaactagtatggcttgaaagtcccaccaatccccgtctacaaattactgatataaagaaaatagcagagatagctcattaccatggtgctcttgttttagtagacaacagcatcatgtctcctgtgctctcccgtcctctagaacttggagcagatattgttatgcactcagcaaccaaatttatagctggacatagcgatcttatggctggaattcttgcggtgaagggtgaaagcttggctaaagagattgcatttctacaaaatgctgaaggatcaggtttggcaccatttgattgctggctttgtttgagaggaatcaaaaccatggctttgcgggtggagaagcagcaggctaatgctcagaagattgctgaatttctagcttctcatccaagagtaaagaaagtgaactatgcaggacttcctgatcatcctggacgatctctacactattcccaggcaaagggagcgggttcagttctcagtttcctaactggttcattagctctctcaaaacatgttgttgagaccacaaagtacttcaatgtaacagttagctttggaagtgtgaaatcgctcattagcctgccatgcttcatgtcacacgccagcatcccttctgcggttcgcgaggagcgcggcctgacagacgatctagtcaggatatcggttggaattgaggatgccgacgacctcatagcggatcttgatcatgctctccggtctggtccagcttag

SEQ ID NO: 19303 - protein, 383 aa, Oryza sativa
MKEPSVATILTSFENSFDGFGSMSTPLYQTATFKQPSATDNGPYDYTRSGNPTRDVLQSLMAKLEKADQAFCFTSGMAALAAVTHLLKSGQEIVAGEDIYGGSDRLLSQVAPRHGIVVKRIDTTKISEVTSAIGPLTKLVWLESPTNPRLQITDIKKIAEIAHYHGALVLVDNSIMSPVLSRPLELGADIVMHSATKFIAGHSDLMAGILAVKGESLAKEIAFLQNAEGSGLAPFDCWLCLRGIKTMALRVEKQQANAQKIAEFLASHPRVKKVNYAGLPDHPGRSLHYSQAKGAGSVLSFLTGSLALSKHVVETTKYFNVTVSFGSVKSLISLPCFMSHASIPSAVREERGLTDDLVRISVGIEDADDLIADLDHALRSGPA

SEQ ID NO: 19304 - DNA, 1428 bp, Oryza sativa; identical to SEQ ID NO: 19302
  CDS (1)..(1428)

SEQ ID NO: 19305 - protein, 475 aa, Oryza sativa
MSAAAAAAAAAAIPTSLGRLFHLRPTPNPSRNLSGSSAQPLLRLSYHPRLTLSRRMEAPAAIADSHGGGDLSASAVGAEALGAVAAPDFDVEMKEPSVATILTSFENSFDGFGSMSTPLYQTATFKQPSATDNGPYDYTRSGNPTRDVLQSLMAKLEKADQAFCFTSGMAALAAVTHLLKSGQEIVAGEDIYGGSDRLLSQVAPRHGIVVKRIDTTKISEVTSAIGPLTKLVWLESPTNPRLQITDIKKIAEIAHYHGALVLVDNSIMSPVLSRPLELGADIVMHSATKFIAGHSDLMAGILAVKGESLAKEIAFLQNAEGSGLAPFDCWLCLRGIKTMALRVEKQQANAQKIAEFLASHPRVKKVNYAGLPDHPGRSLHYSQAKGAGSVLSFLTGSLALSKHVVETTKYFNVTVSFGSVKSLISLPCFMSHASIPSAVREERGLTDDLVRISVGIEDADDLIADLDHALRSGPA

SEQ ID NO: 19306 - DNA, 1877 bp, Solanum tuberosum
  CDS (66)..(1688)
gaattcgcggccgccttaaaaggtgccgccgccggtgaaatcgcgttttcgacactctcgactcaatggccgttccaagcagtgctagggcatttccgtccttccaatgccgttccgatcccgacttctccggcggcgttccacgtcatgacctccctaacgccggcgttcgtttttcagttaaggtcaagtcgttgagtcgtggatcttcggttcacggtatgtcttctctgatccttcgcttcccgcccaacttcgtaaggcagctcagcgttaaagctcgtaggaactgcagtaacatcggtttagcacaagttgttgcggcttcctggtctaataaccacgcttctcctgactttactccggcggctaaggccgtagatgccgcctccattgctccttttgatattaccacaggtgatgaggagggggcggtggtggaagattcgcctcgtgctgatcgaaatgtacagattgaggatttgacagatgtcaaatattcttcatttttgagttctgatgggagcatcgcaattcatgccggtgaaaggttaggacgtggtattgttactgatgcaataactaccccagtggttaacacatctgcttatttcttcaagaagacttctgaccttattgacttcaaggagaaaaaacgtgcgagttttgaatatgggcgctatgggaaccccactagtattgttgcagaggaaaagataagtgcactggagggtgctgatgcaaccttgttaatggcatctggaatgtgtgctagtactgtattgttgttggcattggttcctgctggtgggcatattgtaacaacaacagactgctataggaagacccggatatttattgagacaatactgcctaaaatgggaatcacggcgacagtcattgacccagctgatattggagctctagagtctgtgctaaatcagaagaaagtgactcttttctttaccgagtctccaacaaatccattcctgagatgtgttgacattgagcttgtttcgaagctttgccatgaaaaaggagcattagtttgcatagatgggacgtttgcaactccccttaaccaaaaggtccttgctctaggggctgacctcgttgtgcactctgcaacaaaatatcttggtggccacaatgatgttcttggaggttgcatcagtggtcctgataagttagtttcagcagttcgtaccttgcatcatatcctgggtggtgctatcaatcctaatgctgcgtatttaatcatcagaggcatgaagacgttgcatctccgtgtacagcaacagaactcaactgcacaaaggatagccgaaattttagaggctcatccaaaggtgaggtgtgtctattatccaggcttgccaagtcatccagaataccatcttgcaaagagacaaatgactggttttggtggggtggtcagttttgaggttgatggggatctgctaactactgcaaaatttgttgatgctctaaaaattccttatattgctccatcgtttggaggttgtgagagcattgtggaccaaccagcaattatgtcttactgggatcttaaggagtcagagagagctaagtatgggatcatggacaacttggttcgattcagctttggagtagaagactttgaagacttgaaagctgatattcttcaggcgctggagtccatgtagggtgtcttacctgcaacctgatttcgttttcccttggatcgttttctttccactagctttgaacttctttttcatctctaattagtggagtagtcacttcccccagttgtcagaatgtattgaatggatcattgagcagctgatgcaatccaatgtcagagtgggatgttaaaaagcggccgcgaattc

SEQ ID NO: 19307 - protein, 540 aa, Solanum tuberosum
MAVPSSARAFPSFQCRSDPDFSGGVPRHDLPNAGVRFSVKVKSLSRGSSVHGMSSLILRFPPNFVRQLSVKARRNCSNIGLAQVVAASWSNNHASPDFTPAAKAVDAASIAPFDITTGDEEGAVVEDSPRADRNVQIEDLTDVKYSSFLSSDGSIAIHAGERLGRGIVTDAITTPVVNTSAYFFKKTSDLIDFKEKKRASFEYGRYGNPTSIVAEEKISALEGADATLLMASGMCASTVLLLALVPAGGHIVTTTDCYRKTRIFIETILPKMGITATVIDPADIGALESVLNQKKVTLFFTESPTNPFLRCVDIELVSKLCHEKGALVCIDGTFATPLNQKVLALGADLVVHSATKYLGGHNDVLGGCISGPDKLVSAVRTLHHILGGAINPNAAYLIIRGMKTLHLRVQQQNSTAQRIAEILEAHPKVRCVYYPGLPSHPEYHLAKRQMTGFGGVVSFEVDGDLLTTAKFVDALKIPYIAPSFGGCESIVDQPAIMSYWDLKESERAKYGIMDNLVRFSFGVEDFEDLKADILQALESM

SEQ ID NO: 19308 - DNA, 1840 bp, Solanum tuberosum
  CDS (86)..(1705)
gaattcgcggccggaaaagggcaacgcttctagccgtgggagtaattacatttttgaccttctaaactccgaaatcaacaactcaatggccgtctctagttacgctagggcatttccgtcattcgaatgtcgttcggaacctgatttctccggcagccttccacatcctaaagccggcgttcgattctccggcaagtataactccgggagtaaccgatctcaggtttatggtctgtcttctctgattttcaggtttcctcctaatttcgtgaggcagctaagcattaaggctaggaggaattgcagcaatatcggcgtggctcaagttgtggcggcttcctggtctaacaaccaagccggtcctgagttcactccggcggctaatgctgtcgattcttccgcttccgctgctgttacttcgattggtatcaccgcaggtgacgaggaggtggcggttgtggaaaatgcggattgtaatgatcaaaatgtacaaattacgggtacaggtgttaaatatgcttcatttttgaattcagatggaagcgttgctattcatgccggtgaaaggttgggacgcggtattgttactgatgccataactaccccagtggttaacacatctgcttacttcttcaacaaaacttctgaccttattgattttaaggagaaaagacgtgcaagttttgaatatggccgctatgggaaccccactactgttgttttggaggagaaaattagtgcacttgagggtgctgaatcaaccttgatagtggcatctggaatgtgtgccagtactgtaatgttcctggccttggttcctgctggtgggcatattgttactaccacagactgctacaggaagacacgtgtttttattgagacaatactgcctaaaatgggaattacggccacagtcattgatccagcagatatgggagctttggagttaacattaaatcagaagaaagtggatcttttctttaccgagtctccaacaaatccattcctgagatgtgttgacattgagctggtttcaaagctttgccgtgaaaaaggagccttggtttgcatagatgggacgtttgcaactcctcttaaccagaaggcccttgctctaggggctgaccttgttgtgcactccgctacaaaattccttggtgggcacaatgatgttcttgcaggttgcattagtggtcctgaaaaattagtttcagtaatccgaaacttgcatcatatccttggtggtgctctcaatcctaatgctgcatatcttatcatccgaggcatgaagacgctgcatcttcgtgtacagcaacaaaattcaactgcattgaggatggccgaaattttagaggctcatcccaaggtgaaacacgtctattatccaggcttgccgagtcatccggaatatcatcttgcaaagaaacaaatgactggctttggtggtgtggtcagttttgaggttgatggagacctcctaactactgcaaaatttgtggatgctctgaggattccctatattgctccatcgtttggaggttgtgagagcattgtggaccaaccagcaataatgtcttattgggatcttagccaatctgatagagcaaagtatggtatcttggataacttggttcggtttagctttggagtggaagactttgaagatgtgaaagctgatgttcttcaggctttggattccatataggctgtttcacctgcaacaattttttttcacgtggttccatcctgatttggttgttcgtacctgtgttattaccgacttccatcacgtagccaattgtttgaatgtaatgaaaggatcatcagcggcccggaattc

SEQ ID NO: 19309 - protein, 539 aa, Solanum tuberosum
MAVSSYARAFPSFECRSEPDFSGSLPHPKAGVRFSGKYNSGSNRSQVYGLSSLIFRFPPNFVRQLSIKARRNCSNIGVAQVVAASWSNNQAGPEFTPAANAVDSSASAAVTSIGITAGDEEVAVVENADCNDQNVQITGTGVKYASFLNSDGSVAIHAGERLGRGIVTDAITTPVVNTSAYFFNKTSDLIDFKEKRRASFEYGRYGNPTTVVLEEKISALEGAESTLIVASGMCASTVMFLALVPAGGHIVTTTDCYRKTRVFIETILPKMGITATVIDPADMGALELTLNQKKVDLFFTESPTNPFLRCVDIELVSKLCREKGALVCIDGTFATPLNQKALALGADLVVHSATKFLGGHNDVLAGCISGPEKLVSVIRNLHHILGGALNPNAAYLIIRGMKTLHLRVQQQNSTALRMAEILEAHPKVKHVYYPGLPSHPEYHLAKKQMTGFGGVVSFEVDGDLLTTAKFVDALRIPYIAPSFGGCESIVDQPAIMSYWDLSQSDRAKYGILDNLVRFSFGVEDFEDVKADVLQALDSI

SEQ ID NO: 19310 - DNA, 1626 bp, Solanum tuberosum
  CDS (7)..(1422)
tttgaaatggcatgttctctgtctctcaagcagcccttcagctctttgcctaccaacacaaccacccagggtaaattgcctgtaaactttccagtgacatttgggtgcatgaatgggaagggaactctaatagaacagaaattccaactgaattgctcaagagacaaagagatggatctcactgcatcagctttgattgatagtgctgctgccgaatgcatggatgagatggggactatggaactacctcctcaagttgaggctagggaagcaaaagagccaagtgtttcaacaatgttgatgaacttcagtaatgattttgatccttatggtgccttaagtacccccttgtatcaaacatctacttttaagcagccttcagcaaccgaaaatgggcaatatgattatacacggagtggaaatccaacaagggatgcattggaaaagcttcttgcagagcttgagaaagcagatcgagcattttgctttaccagtggaatggccgccttggcagctgtaactcgtctcgttaaagctggtgaggagattgttgccggggatgacatatatggtggttctgaccggctgctctcacaagttgttccaaaagccgggatcgtggtcaagcgagtggataccactaacttagatgaggttgcttctgtgattaaaccatggacaaagcttatttggctggaaagcccaaccaaccctcgtcaacaaatttgtgatattcgtaaaatagccaagatcgctcatgcacatggggctcttgtgctggtagataacagcattatgtccccagtactgtcccatcctttggagctcggagcagatattgtgatgcattcagctactaagttcatatccggtcatagtgatctcatggctggtgtacttgccgtcagaggagaaagcttggcgaaagaggtgtacttcctacaaaatgctgaaggtgcagggttagcgccattcgattgttggctttgtttaagaggaatcaaaacaatggcacttcgtgttgaaaaacaacaggagaatgcacaaaaaattgctgaatttttatcttcccatccacgagtgaaaaaggtcaactatccaggtcttcttgaccatccagggaggtctttgcacttctctcaggctacgggtgcaggatcggtgctgagtttcctgacaggttctttggcactctctaagcatgttgctgaggctaccaagtatttcagcattaccgtcagttttggaagtgtcaagtcactcataagcttgccttgcttcatgtcccatgcgagcatacctgttgaagtacgagaggctagaggtcttactgaggacctggttcgaatttctgttgggattgaagatgtcaacgacttgatagatgatttagactatgcactcaagactgggcctgcctagaagattaagcaagtttgtggaactgatgccgcttgtcgcgtcatttcattcatctcagggagtttatttgatatttacaagttggttcaaaatgaagttgattttgagtgatctgctaatcatatcatgtaataaattttgctctctttggagttcttactttgatttttaggcaaaattgaagagttgaaaaggtgatcaatt

SEQ ID NO: 19311 - protein, 471 aa, Solanum tuberosum
MACSLSLKQPFSSLPTNTTTQGKLPVNFPVTFGCMNGKGTLIEQKFQLNCSRDKEMDLTASALIDSAAAECMDEMGTMELPPQVEAREAKEPSVSTMLMNFSNDFDPYGALSTPLYQTSTFKQPSATENGQYDYTRSGNPTRDALEKLLAELEKADRAFCFTSGMAALAAVTRLVKAGEEIVAGDDIYGGSDRLLSQVVPKAGIVVKRVDTTNLDEVASVIKPWTKLIWLESPTNPRQQICDIRKIAKIAHAHGALVLVDNSIMSPVLSHPLELGADIVMHSATKFISGHSDLMAGVLAVRGESLAKEVYFLQNAEGAGLAPFDCWLCLRGIKTMALRVEKQQENAQKIAEFLSSHPRVKKVNYPGLLDHPGRSLHFSQATGAGSVLSFLTGSLALSKHVAEATKYFSITVSFGSVKSLISLPCFMSHASIPVEVREARGLTEDLVRISVGIEDVNDLIDDLDYALKTGPA

SEQ ID NO: 19312 - DNA, 1272 bp, Cephalosporium acremonium
  CDS (1)..(1272)
atgtctcctacagcggcacccgccattgacggcgccgtcgtcgagacgcctccgcgccctcctactcctgtccacaacttcggcaccctcgccgtccacgcgggctcgccgcacgatgccgccaccggtgccgttatcgagtccatytcgctgtctaccacctttgcccagaccgccgtcggcaaacccgtaggtgagtacgagtactcgcgctccgccaaccccaaccgcaccaacttcgagacggccgtcgcggccctcgaacacgcccgctacgccctcgccttctccagtggtagcgccaccaccgccaccatcctccagagccttgccgccggctcccacgttatctcagtctccgacgtttacggcggcacccaccgctacttcacccaggttgccaaggcccacggtgtcaaggtcacattcactccggaaattgaagtcgacgtcagtgagcacatcaccgaccaaacccgcctcatctggatcgagacccctagcaaccccaccctgcgtcttgtcgacatccgcgccgttgtctccgtcgcccacaagcatggtgtcctcgttgtcgtcgacaataccttcctctcaccttatgtgcagaacccgctcgacctcggcgccgacattgtcgtccacagcgtcaccaagtacattaacggccacagcgacgtcgtcatgggcgttgccgctttcaactccccggaattgaaggaccgcctcggcttcctccagaacgccattggcgccgtcccctccgccttcgacagctggctcgcccaccgcggcctcaagaccctccacctccgcgcccgcgaggcgtcgcgcaacgccgccgctgtcgccgctgccctcgaggcctcccctaatgtcatctccgtcaactaccctggccttgactcgcaccctcatcgccacatcgccctcaagcagcaccgcgacggcatgggcggcggcatgctctccttccgcattcgcggtggccacgacgccgccgagcgcttctgccagcagacccgaatcttcaccctagccgagtcccttggcggcgttgagtcgctcgtcgagttgcccagcagcatgacccatgccggtatcccccgcgaccagcgcgaggccgtcggcgtctttgacgacctggtccgcgtgagctgcggtgttgaggatgccgaggacctgaagaatgacgtgccgcgccgtggagaaggccgtggagttgtcaaagaatggtgtcaagggccaataacgccgacctacctcccctga

SEQ ID NO: 19313 - protein, 423 aa, Cephalosporium acremonium
MSPTAAPAIDGAVVETPPRPPTPVHNFGTLAVHAGSPHDAATGAVIESISLSTTFAQTAVGKPVGEYEYSRSANPNRTNFETAVAALEHARYALAFSSGSATTATILQSLAAGSHVISVSDVYGGTHRYFTQVAKAHGVKVTFTPEIEVDVSEHITDQTRLIWIETPSNPTLRLVDIRAVVSVAHKHGVLVVVDNTFLSPYVQNPLDLGADIVVHSVTKYINGHSDVVMGVAAFNSPELKDRLGFLQNAIGAVPSAFDSWLAHRGLKTLHLRAREASRNAAAVAAALEASPNVISVNYPGLDSHPHRHIALKQHRDGMGGGMLSFRIRGGHDAAERFCQQTRIFTLAESLGGVESLVELPSSMTHAGIPRDQREAVGVFDDLVRVSCGVEDAEDLKNDVPRRGEGRGVVKEWCQGPITPTYLP

SEQ ID NO: 19314 - DNA, 2046 bp, Zymomonas mobilis
  CDS (1)..(2046)
atgaattgccttatgaagcttttggtaacgccagagtggctatatcggaacctcgctaacccaaggttacatgttattgatgcggggagctatccgccagacgtcgataccaaggcttatgatgaatattgtaaggcgcatattccgggggcgctttttcttgataaccatcttttaaaagatcaaaatgcacccttaccgcgcatggtgccaagcctcgaaaaagttgaatatgaattcgggcggttgggattagatcccgacgatatgatcgttatttacgataatttatctttaccttcggctgccagagcatggtggctgtttatgttgcatgaatatcgtcatgtgatgattttggatggcggccttcgccgttggaaagccgagcgtttgcccgttgaaagcggcgcggcgatcgcgccttctccgattatattgcagctttctcgcaatgaagcgctcattcgcacccgtaatcaggtaatgcataatatcgcttcagggcatgaagtggttgtcgatgcccgtgcgcccaaagtctttagtggcgaacgtttgccaatccagcacttgcccccggtcatatcccgcatagtcttaatttgccttatgaaggaatgctggatgccaatggttgctggaaaacgccgacggaaaatcgagaaggcttttgtcagcaatcggataaatcttgagcagcctttattattcacctgtggtgcagggcgaacggctccagccttgttatttgctgcccgtcttttgggaaaaagagatgtatccctttatgatgggtcatgggaagaatggggcagcgaacctgatacacccaaagaaacggggcctgccttccgtgaatcgacccgtctgataacagcgggtcgccgtcgtgaatgggtgcgcggaaaaggtgggtcagttgttaacccacctgtctggcgcgcttcgactattctgttcgattctgttgaagatttaagagaagcctcaagccatcctgatgaccagctctattatggtcgtcgtggcaccccgacccaatgggcattgagtgaggctttgacagaattgcatcccggcgcagaagcgacgatgctgtatccatcaggtgtggccgctttatccatggctttattaagtgctttggaagccggtgatgagttattgatggttgatagttgttatgaaccaacccgcgtcttttgtgataccgttttgaaagcgcagggaatcaatgtcacttattatgatccgttaatcgggcaagacattgaacagctatttaccccgcagacacgggctatttttatggaaagccctggaagtctgacctttgaagtgcaagacatccccggtatctgtgaagttgcccaccgctattctattacgaccattcttgataatacttggacgcctttattctttcctgcgattgagcggggcgttgctctatcagggatggcctgcaccaaatatattacgggtcactctgatacgatgatgggaccagtgacagctatccctagccatattgataaattaaagcggattagcaatctaatcgggcaatatgtcagcccagatgacgccaattctgcccttaaggggttaaggactttggaagtcaggctgaaagcgcatgacaaaaatgctctcaaagtcgccaaatggttgagcgaacagccggaagtagcttgggtattacacccagccttgtcttcttgtccggggcatgaattctggcatcgggattttaaaggttcatccggtttgtttagctttgtccttgaagggggcgatgacagcgacagcacggctttgattgatagccttgaacattttggtatcggtttttcatggggcggctatgaaagtttagctttgccggttgatccgcagccaatacggacggcggccagttggcaggcggctggccctgttgtccgtttacatatcggtttggaagatcccgatgacctgattgaagatctggcttttggattgaaacgctttaaggcttcgagagatcaatccggcttttag

SEQ ID NO: 19315 - protein, 681 aa, Zymomonas mobilis
MNCLMKLLVTPEWLYRNLANPRLHVIDAGSYPPDVDTKAYDEYCKAHIPGALFLDNHLLKDQNAPLPRMVPSLEKVEYEFGRLGLDPDDMIVIYDNLSLPSAARAWWLFMLHEYRHVMILDGGLRRWKAERLPVESGAAIAPSPIILQLSRNEALIRTRNQVMHNIASGHEVVVDARAPKVFSGERLPIQHLPPVISRIVLICLMKECWMPMVAGKRRRKIEKAFVSNRINLEQPLLFTCGAGRTAPALLFAARLLGKRDVSLYDGSWEEWGSEPDTPKETGPAFRESTRLITAGRRREWVRGKGGSVVNPPVWRASTILFDSVEDLREASSHPDDQLYYGRRGTPTQWALSEALTELHPGAEATMLYPSGVAALSMALLSALEAGDELLMVDSCYEPTRVFCDTVLKAQGINVTYYDPLIGQDIEQLFTPQTRAIFMESPGSLTFEVQDIPGICEVAHRYSITTILDNTWTPLFFPAIERGVALSGMACTKYITGHSDTMMGPVTAIPSHIDKLKRISNLIGQYVSPDDANSALKGLRTLEVRLKAHDKNALKVAKWLSEQPEVAWVLHPALSSCPGHEFWHRDFKGSSGLFSFVLEGGDDSDSTALIDSLEHFGIGFSWGGYESLALPVDPQPIRTAASWQAAGPVVRLHIGLEDPDDLIEDLAFGLKRFKASRDQSGF

SEQ ID NO: 19316 - DNA, 1887 bp, Glycine max
  CDS (88)..(1698)
caggtaagagagggagtaagtgggtaaaggaaagaaaactaaagaaacaaacctaacacaacacaaatccttgaaacgacgacggaaatggccgtttcgagctcgcacatgcgtttcacctttgagtgccgctccgatcccgatttctcgccccccccgccgtccttcgacaacctccgccgccgaaacttccgctcctccgcagattccggcgcggcgtttcacggcatctcctccctcatcctccgcttccctcccaacttccagcgccagctaagcaccaaggcgcgccgcaactgcagcaacatcggcgtcgcgcaaatcgtcgccgcttcgtggtcgaacaacagcgacaactctccggccgccggggctccggcgccgcccgcggccaccgccacggacgccgctacggtgcctctccccgtcgtcgtcgccgccaacgaggacgtcgttgtctccgccgcggcagacgagaacggggctgtacagttaaacagtagttcttattcttcatttttgaaatccgatgcaagcaaaacgattcatgccgctgaaagactgggtaggggtattgagactgatggaattaccacccctgtggttaacacttctgcctacttttttaagaaaaccgctgatctcattgatttcaaggagaatcgtcaagtgagttatgaatacgggcgctatggaaacccaacgacggtggttctggaggagaagataagtgcattggagggggccgaatcaactgtgataatggcgtctgggatgtgtgctagcgtagtcctgtttatggcactggttccagctggtggacatcttgtgaccactacggattgttataggaagactagaatattcattgagacttttcttcctaagatggggatcacgaccactgtaattgatccagcagatgttggagccttggaatctgcattggagcagcacaatgtgtctctattcttcactgagtctcctaccaatccattcctgagatgtgttgatattaagctggtttcagagctttgccacaagaaggggactttgctctgtattgatggtacatttgcaactccattgaaccagaaggcccttgcccttggcgctgatctgattctgcactccttaacaaaatacatgggtggacatcatgatgtccttggtggttgcataagtggttcaattaaggtggtttcgcaaattcggactttgcaccatgttttgggtggtacacttaacccgaatgctgcatacctattcatcagaggcatgaaaacgctgcatctccgtgtacagcagcagaattcaacaggaatgaggatggccaaacttttagaggcacatcccaaggtgaagcgggtctactatccaggcttgccgagtcaccctgaacatgagcttgccaagaggcagatgactggtttcggtggtgttgtcagttttgagattgatggagatctacataccacaataaaatttattgattcattgaaaatcccatatattgcggcctcgtttggtggctgtgagagcattgtggatcaacctgctattttgtcttactgggatcttcctcagtcagaaagggccaagtacaagatttatgacaacctggttcgcttcagctttggagttgaagattttgaggatttgaaggctgatgtcctgcaagctctggaagctatatagacagttttcctgattcacccaagtttttttcttttataattgtgctatttgtttgttatcacatctggcgattcaattgaattttgatcgtctaatgttctgttggaattgtgttaagatgaatggtctctaatttggatgttatgaaacttgtgatgaattgttgaaaaaaaaaaaaaaaaaaaaaaa

SEQ ID NO: 19317 - protein, 536 aa, Glycine max
MAVSSSHMRFTFECRSDPDFSPPPPSFDNLRRRNFRSSADSGAAFHGISSLILRFPPNFQRQLSTKARRNCSNIGVAQIVAASWSNNSDNSPAAGAPAPPAATATDAATVPLPVVVAANEDVVVSAAADENGAVQLNSSSYSSFLKSDASKTIHAAERLGRGIETDGITTPVVNTSAYFFKKTADLIDFKENRQVSYEYGRYGNPTTVVLEEKISALEGAESTVIMASGMCASVVLFMALVPAGGHLVTTTDCYRKTRIFIETFLPKMGITTTVIDPADVGALESALEQHNVSLFFTESPTNPFLRCVDIKLVSELCHKKGTLLCIDGTFATPLNQKALALGADLILHSLTKYMGGHHDVLGGCISGSIKVVSQIRTLHHVLGGTLNPNAAYLFIRGMKTLHLRVQQQNSTGMRMAKLLEAHPKVKRVYYPGLPSHPEHELAKRQMTGFGGVVSFEIDGDLHTTIKFIDSLKIPYIAASFGGCESIVDQPAILSYWDLPQSERAKYKIYDNLVRFSFGVEDFEDLKADVLQALEAI

SEQ ID NO: 19318 - DNA, 2100 bp, Rhizobium etli
  CDS (221)..(1405)
gaattccagtttcgcgagccatcatgccccatccatcattttgccgccgacaaaaccaaatacggggaattgacgcaagcagctaacagcagtattcgagaattatcccgtggtgatttggccggtcggcttgcagccacgttaaacaagtggctaaaaagaccgggttgaaaccggtctgcttttgcggccggtttttttgttatgtgaaggtgatggcatgacgaagacctggcgcccggcaacccaactcgtccatggcggcacctggcgttccgaatatggcgaaacgtcggaggcaatctatctcacccagggtttcgtctatgacacgtcggagccggccgaagcccgcttcaagggcgaaacggacggcttcatctacgcccgctacggcagccccaccaatgacatgttcgaaaagcgcatgtgtgcattggaaggcgccgaagatgcccgtgccaccgcctccggcatggcggccgtcgccgccgccgttctctgccaggtgaaggcaggcgaccatatcgtcgccgcccgcgccctgttcggctcctgccgttgggtcgtggaaacgctggcgccgaaatacggcgtcgagtgcacgctggtcgacggccgggatctcgccaactgggaaaaggcgatccgcccgaataccaaggtgttcttcctggaaagcccgaccaacccgacgctcgaagtagtcgatatatcaggcgtcgccaagctcgccaatcaggtcggcgccaagctgatcgtcgacaatgtttttgcgacgccgctcttccagaagcccttggagctcggcgctcatatcgtcgtctattccgcaaccaagcatattgacggccagggcgcctgcctcggcggcgtggtgctcgccgacaaggcatggatcgacgagaacctgcacgactatttccgtcataccggcccagccatgtcgccgttcaatgcctggacgcttctgaagggcatcgagacactgccgctgcgcgtgcgccagcagaccgagaatgcagcgaagatcgccgatttcctggcggagcaaggcaaagtcgccaaggtgatctatcccggccgcaaggaccatccgcaggccgaaatcatcgccaagcagatgacgggtggctcgacgctcgtctgcttcgagctgaagggcggcaaggaggcggccttcgcgctgcagaacgcgcttgagatcatcaagatttccaacaatctcggcgacacgaagagcctgatcacccatccggcaacgaccacgcacaagaacctgacggaagaggcgcgcgccgaactcggcatctcgccgggcacggtgcggctttcggccggcatcgaggacacggacgacctgatcgaggatttcgcgcggggccttaccaaagtttcggcctgagcgactggaatagcggccggacttcgtccggagccggccgccgatccgcgggaacaagtccacccgcgctggcgttgcgaagtaaaattaacgctgacagttaggcttaacgatcgaaaacccttcgatcatcaccatttgaccgatgataaacgttccgtttcttgacgaacagggcctctttataagatacgggtaacatatcttgactatggtgcaaggcatgtatcgcgccctcacaagagatatcgaagtcgtggtcgaaccgttctatctggaggagcaatccgatccggaggacgatcgctatgtctggggttaccggatcgtcatcagcaacaattccggcgtcgccgttcgtctggtcaaccgctactggaacatcaccgaccagaacggccaggtagacgaggtgaccggccccggcgtcgtcggcgaacagccgcggctcagccccggcgatacctacgaatattcctccggctgcccgctcgacaccccgtccgcggtgatgttcggccattaccagatggaaacggatgaaggcgagcttttcgacgtcgacatccccgccttctcgctggattcaccggggctgctgcgcgtgctgaattgaggggcaagttcccactcaagagattgccgagatctgaaaaagtccctcgtcacaaggggaggggctagagctttcatgt

SEQ ID NO: 19319 - protein, 394 aa, Rhizobium etli
MTKTWRPATQLVHGGTWRSEYGETSEAIYLTQGFVYDTSEPAEARFKGETDGFIYARYGSPTNDMFEKRMCALEGAEDARATASGMAAVAAAVLCQVKAGDHIVAARALFGSCRWVVETLAPKYGVECTLVDGRDLANWEKAIRPNTKVFFLESPTNPTLEVVDISGVAKLANQVGAKLIVDNVFATPLFQKPLELGAHIVVYSATKHIDGQGACLGGVVLADKAWIDENLHDYFRHTGPAMSPFNAWTLLKGIETLPLRVRQQTENAAKIADFLAEQGKVAKVIYPGRKDHPQAEIIAKQMTGGSTLVCFELKGGKEAAFALQNALEIIKISNNLGDTKSLITHPATTTHKNLTEEARAELGISPGTVRLSAGIEDTDDLIEDFARGLTKVSA

SEQ ID NO: 19320 - DNA, 1517 bp, Nicotiana tabacum
  CDS (9)..(1346)
ggatccatatggctaaggccgtcgatgccgccgccgccgccgccgccgctattgctcctgttgataccacggtagttaacgaggacgtggcgttggtggaaaatgagacttgtaatgatcaaaatgtacagtttgacagtttgccaagtatgaaatacgcttcgtttttgaattctgatgggagtgtcgctattcatgccggtgaaagattgggacgtggcatcgttacggatgcaattactaccccagtagttaacacatctgcttatttcttcaacaagacttctgagctcattgattttaaggagaaaagacgcgcaagttttgaatatgggcgctatgggaacccaactactgttgttttagaggagaagataagcgcactggagggtgctgaatcaaccttgttaatggcatctggaatgtgcgccagtactgtaatgctgttggctttggttcctgctggaggccatattgttacaaccacagactgctataggaagacccggatctttattgaaactatacttcctaaaatggggattacggccacggtcattgacccagccgatgttggagctctggagttggctctaaatcagaagaaagtgaatcttttctttaccgagtctccaacaaatccattcctcagatgtgtagacattgagctggtttcaaagctttgtcatgaaaaaggagccttggtttgcatagatgggacttttgcaactcctcttaatcaaaaggcccttgcccttggggctgacctcgttctgcactctgcaacaaaattccttggtggacataatgatgttctcgcaggttgcattagtggtcctttaaagttagtttcagaaatacgtaacctgcatcacatcctgggtggtgctctcaatccgaatgccgcatatctgattatccgaggcatgaagacgttgcatcttcgtgtacagcaacaaaactcaactgcattgaggatggccgagattttagaggctcatcccaaggtgagacatgtctattatccaggcctgcaaagtcatccagaacatcacattgcaaagaaacaaatgacaggttttggtggtgcggtcagttttgaggttgacggagacctgcttacaaccgcaaaatttgtggatgctctgaaaattccgtatattgctccatcatttggaggttgtgagagcattgtggaccaaccagcaataatgtcttactgggatcttagccagtcagatagagccaagtatggcatcatggacaatttggttaggttcagctttggtgtggaagattttgatgacttgaaagctgatattcttcaggctttggactcaatataggctgtctctcctgcaacgcagtttgcttttcttttgctttctttctactctagcttttattctttgaacttccgtgtcatctctaattgttgagttattcggacaatcatgaaagtgtaatgaaaggatcatcaaacaggtgatcaatcaatttgatgtgttcaaaaaaaa

SEQ ID NO: 19321 - protein, 445 aa, Nicotiana tabacum
MAKAVDAAAAAAAAIAPVDTTVVNEDVALVENETCNDQNVQFDSLPSMKYASFLNSDGSVAIHAGERLGRGIVTDAITTPVVNTSAYFFNKTSELIDFKEKRRASFEYGRYGNPTTVVLEEKISALEGAESTLLMASGMCASTVMLLALVPAGGHIVTTTDCYRKTRIFIETILPKMGITATVIDPADVGALELALNQKKVNLFFTESPTNPFLRCVDIELVSKLCHEKGALVCIDGTFATPLNQKALALGADLVLHSATKFLGGHNDVLAGCISGPLKLVSEIRNLHHILGGALNPNAAYLIIRGMKTLHLRVQQQNSTALRMAEILEAHPKVRHVYYPGLQSHPEHHIAKKQMTGFGGAVSFEVDGDLLTTAKFVDALKIPYIAPSFGGCESIVDQPAIMSYWDLSQSDRAKYGIMDNLVRFSFGVEDFDDLKADILQALDSI

SEQ ID NO: 19322 - DNA, 1815 bp, Mus musculus
  CDS (34)..(1230)
agccaaagcaacacctcgcactcctgccccagcatgcagaaggacgcctctttgagcggcttcctgcctagtttccagcatttcgccactcaggccatccacgtgggacaagagcctgagcaatggaattctcgtgccgtggtgctgcccatttcgttggccaccacatttaagcaggacttcccgggccagtcctcgggttttgaatacagccgctctggaaatccaacaaggaattgcttggaaaaagcagtggctgcgttggatggggcaaagcacagtttggcctttgcatcgggtcttgctgccaccattacgattacccatcttttaaaagcaggagatgaaatcatttgcatggatgaagtgtatggaggcaccaacaggtacttcaggagggtggcatctgaatttggactgaagatttcttttgtagattgttccaaaaccaaattgctagaggcagcgattacaccacaaaccaagcttgtttggatcgaaacacccacaaacccaactttgaagttggctgacattggagcctgcgcacaaattgtccacaaacgtggagacatcattttggttgtagataacaccttcatgtctgcatatttccagagacctttggctctgggtgctgatatttgtatgtgttctgccacaaaatacatgaatggccacagcgatgttgtcatgggtttagtgtctgttaattctgatgacctcaatagtcggcttcgtttcctgcagaattcactaggagcagttccttctccttttgattgttacctctgctgccgaggcctgaagacactgcaggtccggatggagaaacatttcaagaatgggatggcggtggctcgtttcctggagaccaatccccgggtagaaaaggttgtttatcctgggctaccctctcaccctcagcatgagctggccaaacgccagtgctcgggctgcccagggatggtcagtttctacatcaagggtgctctgcagcatgctaaggccttcctcaaaaatctaaagctgtttactctggcagagagcctgggaggatatgagagtctggctgagcttccagcaatcatgacccatgcctctgtgcctgagaaggacagagctaccctcgggatcaatgacacactgatacgactttctgtgggcctagaggatgaacaggaccttcttgaagacctggatcgagctttgaaggcagcgcacccttaaaagttcgagtcaaagctgtcattccagtgctgccatcaggagcagcatccaaggggccaaatcttcggaataactggacagatcattacggagcatacgcagaactgcactgaatattttaaggccctaatgagtttacagctgtaaccttccatggatcttcccttaagaactgtcttctgtttatcttctaactaacaggttgttctgttagtatcatttcggtaattttgctatatttgtgtccaaggaagtaagagttgttctgttttgggatcatgttgtcttttttctttcttcagtagcttatgatatattttaatcatgtttacaatgttacaatttagtattgatgttttatgaagttaaattattaaatgaatggtcttaaatccactgtggtggtttttttttgaaaaattatataattaccataagccaaaaatcaaatatttggaatacctactgtgaaattcaagagattaaaggttgtacttgatacttgttatttttcttaaataaatctagttatcaagttatttttcttaaataaatctagttatcaaatgtaaaaaaaaaaaaaaa

SEQ ID NO: 19323 - protein, 398 aa, Mus musculus
MQKDASLSGFLPSFQHFATQAIHVGQEPEQWNSRAVVLPISLATTFKQDFPGQSSGFEYSRSGNPTRNCLEKAVAALDGAKHSLAFASGLAATITITHLLKAGDEIICMDEVYGGTNRYFRRVASEFGLKISFVDCSKTKLLEAAITPQTKLVWIETPTNPTLKLADIGACAQIVHKRGDIILVVDNTFMSAYFQRPLALGADICMCSATKYMNGHSDVVMGLVSVNSDDLNSRLRFLQNSLGAVPSPFDCYLCCRGLKTLQVRMEKHFKNGMAVARFLETNPRVEKVVYPGLPSHPQHELAKRQCSGCPGMVSFYIKGALQHAKAFLKNLKLFTLAESLGGYESLAELPAIMTHASVPEKDRATLGINDTLIRLSVGLEDEQDLLEDLDRALKAAHP

SEQ ID NO: 19324 - DNA, 2234 bp, Arabidopsis thaliana
  CDS (68)..(1759)
gcacctctaaaccacaaacaaaaagagagagaagagaacgagagaatcattgagaaacgaaacaacaatggccgtctcatcattccagtgccctaccatcttctcctcctcctcaatctccggctttcaatgccgttctgatccagatctcgtcggttctcccgtcggtggatcatctcgccgtcgtgtccatgcctccgccgggatttcttcctcattcaccggggacgctggattatcctccaggatcttaagatttcctcctaatttcgtccgtcagctgagcattaaagcccgtagaaactgtagcaacatcggtgttgcacagatcgtggcggctaagtggtccaacaacccatcctccgcgttaccttcggcggcggcggctgctgctacctcgtctgcatctgcggtttcttccgccgcatctgcagccgcagcctcgtccgccgccgccgcccctgtggctgccgcgcctcccgtcgtgctgaaaagcgtcgatgaggaggttgtggtggccgaggaggggatcagggagaagataggtagtgtacagctgacggattccaaacattctttcttgagctccgatgggagcctcactgttcatgccggtgaaagattaggccgtggtatagtgacggatgctatcactactcctgtagtcaacacatctgcctacttcttcaagaaaactgctgagcttattgacttcaaggagaaaaggagtgtgagtttcgagtatggtcgttatggtaaccctacgactgtggtacttgaagataagataagtgcacttgaaggggctgaatcaactttggttatggcatctgggatgtgtgcaagcactgttatgcttttggcattggttcctgctggtggacacattgtcactactactgattgctacaggaagactaggatcttcatggagaattttcttcccaagttggggatcactgtcactgtgattgatcctgctgatatcgcagggcttgaagctgcagtgaatgagttcaaggtatctctgttcttcactgagtccccgacaaacccattccttagatgtgtcgacattgagctagtttcaaaaatatgccacaagaggggaactctggtttgcattgatggcacctttgcaacacctctgaatcagaaagcccttgctcttggtgctgatcttgtcgtgcactctgctacaaagtacattggaggacacaatgatgttcttgctggatgcatctgtggttcactgaagttggtttcagaaattcgcaatctgcatcatgtgttgggaggaacacttaacccaaacgctgcgtacctaatcatccgaggcatgaagacattgcatcttcgtgtacagcaacagaattcgaccgcttttagaatggccgaaattttagaggcacatcctaaggtgagtcatgtgtactatccaggccttccaagtcatcccgaacatgaactcgccaagcgacaaatgactggttttggaggtgtggtcagtttcgagattgatggagacattgaaacgacaatcaagtttgtggattctctaaagattccttacattgcaccatccttcggtggctgcgaaagcattgttgaccaacctgctatcatgtcctactgggatctgccgcaagaggagagactaaagtatggaatcaaagataacttggttcgtttcagctttggagttgaagactttgaagatgtcaaagctgacattcttcaagctctcgaagccatctgaaaatgacacatcacacaaaaacgctgtcgtttctttgtcctttatttatctctctttgctgttttcagtcaccgtaataatgatgtctttgaactattgttccgcgacatttacgttccgaaataatcgtgtactattatgatgtttgttgtgctatataataaattctgtttagttcgttttgcgtcttaaagaggttaaattagataactggtcccatgtgaacgaccattgtggccattgctttgtggtaagaactccttgtgcttggaacctcaaggtcacggcttcgaacaatggtcatgaccctctagcttctgcttcttcttctctttgtttcaacaacatataaggcattcataaatgcctcgtctttttttgttttctttcctttcaatacgtagttcgatttcgatttcgatttgtagatctcagcaaaatccatgtcttgagagaatgattaatgggccttttt

SEQ ID NO: 19325 - protein, 563 aa, Arabidopsis thaliana
MAVSSFQCPTIFSSSSISGFQCRSDPDLVGSPVGGSSRRRVHASAGISSSFTGDAGLSSRILRFPPNFVRQLSIKARRNCSNIGVAQIVAAKWSNNPSSALPSAAAAAATSSASAVSSAASAAAASSAAAAPVAAAPPVVLKSVDEEVVVAEEGIREKIGSVQLTDSKHSFLSSDGSLTVHAGERLGRGIVTDAITTPVVNTSAYFFKKTAELIDFKEKRSVSFEYGRYGNPTTVVLEDKISALEGAESTLVMASGMCASTVMLLALVPAGGHIVTTTDCYRKTRIFMENFLPKLGITVTVIDPADIAGLEAAVNEFKVSLFFTESPTNPFLRCVDIELVSKICHKRGTLVCIDGTFATPLNQKALALGADLVVHSATKYIGGHNDVLAGCICGSLKLVSEIRNLHHVLGGTLNPNAAYLIIRGMKTLHLRVQQQNSTAFRMAEILEAHPKVSHVYYPGLPSHPEHELAKRQMTGFGGVVSFEIDGDIETTIKFVDSLKIPYIAPSFGGCESIVDQPAIMSYWDLPQEERLKYGIKDNLVRFSFGVEDFEDVKADILQALEAI

SEQ ID NO: 19326 - DNA, 1188 bp, Salmonella typhimurium
  CDS (1)..(1188)
atgacggataaacagttggataccaaactggtaaacgcaggacgcagcaaaaaatacacgcttggctcagtgaatagtgtgattcaacgcgcttcttcactggtgtttgacaccgtcgaggccaaaaaacacgctacccgcaatctcgccaacggcgaattattttacggacgccggggaacgctgacccacttttcgctccaggaagccatgtgtgaactggaaggcggcgccggatgcgcgctcttcccgtgcggcgcggcggcggtcgccaacaccattctggcattcgttgagcagggcgaccacatcctgatgaccaacacagcttatgaacccagccaggatttctgcagcaaaattctcggcaaactgggcgtgacgacaagctggttcgacccgctcatcggcgctgatatcacgcaacatattcagccgaacacgaaagtcgtatttctggaatcccccggttctattaccatggaagtacatgatattccgagcattgttagtgcggtcagacgcgtcgcgccagaagccgtcatcatgattgataatacctgggcggctggcgttctgttcaaagctctggaattcgatattgatatctctatccaggcgggcactaagtatctgattggtcattctgatgcgatggtcgggactgccgttgcaaatgcgcgctgctgggaacaattgcgggaaaacgcctatctgatggggcaaatgctcgacgccgacacggcttatatgaccagccgcggtctgcgcacactcggtgtccgactgcgccagcatcaagaaagcagcctcaaaatcgccgcatggctggcgaaccatcctcaggtcgcgcgcgttaatcatccggccctgccgggtagcaaaggtcatgcgttctggaaacgagactttacaggtagcagcggcctgttctcctttgtgctcaataaaaagctgaccgaggcagaattatcagcctatctggataacttttcgctgttcagtatggcctactcctggggaggctacgaatcgctgattattgctaatcagccggaacagatcgccgcgattcgtcccgcaggcggcgtagattttaccggtacgctggttcgggtgcatattggtttagagagtgttgatgatttgatcgctgatttagccgccggcttcgccagaattgtgtaa

SEQ ID NO: 19327 - protein, 395 aa, Salmonella typhimurium
MTDKQLDTKLVNAGRSKKYTLGSVNSVIQRASSLVFDTVEAKKHATRNLANGELFYGRRGTLTHFSLQEAMCELEGGAGCALFPCGAAAVANTILAFVEQGDHILMTNTAYEPSQDFCSKILGKLGVTTSWFDPLIGADITQHIQPNTKVVFLESPGSITMEVHDIPSIVSAVRRVAPEAVIMIDNTWAAGVLFKALEFDIDISIQAGTKYLIGHSDAMVGTAVANARCWEQLRENAYLMGQMLDADTAYMTSRGLRTLGVRLRQHQESSLKIAAWLANHPQVARVNHPALPGSKGHAFWKRDFTGSSGLFSFVLNKKLTEAELSAYLDNFSLFSMAYSWGGYESLIIANQPEQIAAIRPAGGVDFTGTLVRVHIGLESVDDLIADLAAGFARIV

SEQ ID NO: 19328 - DNA, 1466 bp, Xenopus tropicalis
  CDS (38)..(1234)
cgctcacacgagtacttattgctgctactgctgatcaatggacggcttccaggaggggttcaagcacttcgccactgaggccatacacgcgggacaggaacccgaacaatggaagtctatggcagtcgtaccccccataaccctctccaccacattcaagcagttcggaccaggggaacatgcggggtatgaatatagtcgcagtggaaacccaacaaggaattctctggaaaaagcagttgctgctcttgatggtgccaagtactgtttatcctatgcttctggtctggctgccacaatgaatattgcccatcttctgaaagctggagaccaaatcatctgtactaaagatgtatatggaggcacaaacagatattttagaagagtagcatcggaaatgggattgaaagtggcttttgttgattgctcagacctaaaaagcttagaagctgctatcgctgcaaacaccaagcttgtatggatagaaaccccaacaaatccaactttaaccgtgatcgatatcaagggatgcgctgatattattcacaaacataaagatattattctagcagtggataacactttcctgtctgcctattttcagcgtcccttggctctaggtgcagacatctgtatgtattctgcaaccaaatacatgaatggccatagcgatgttgttatggggttggtgtctgttaactgtgacaagctgtatgaaaaactaaaattccttcagaatgcaataggagctgttccatcaccctttgattgttatctttgcaatcggggtttgaagacccttcatctgcgaatgcagcaacactttcagaatgctttagctgtagcaaagtttttggaagcagatcctcgtgtagacaaagttctttacccaggactgccgtctcacccacaatatgaactcactaaacgacagtgcactggtgtgtctggcatgattacattttatattaaaggaaatcttgaacatgcaacaacatttcttaagagcctaaaggtctttgctttggctgagagtcttgggggttatgaaagtttggctgagcatcctgctatcatgactcatgctgcagttccagaagaggacagagcagcgctgaatatcagtgatactttaatccgcctttctataggcttagaagatgtagaagatataattggagacttagatcaagctttaaggagtgcacatcctgatattaaaaatgaaaactaaagtgaacagcggatcagtgaaattccatttctttttaatcatggttttacatttttcttcatctatcactttcaaggtgaaacataatccgggaacacaatacatatacaacattgatttgtaaagcacagtattcttgtactagtcatttattcatgcaattatcagttttttttaattcagagatacacatatataaaatgaagatgaaaatgaaaaaaaaaaaaaaaaa

SEQ ID NO: 19329 - protein, 398 aa, Xenopus tropicalis
MDGFQEGFKHFATEAIHAGQEPEQWKSMAVVPPITLSTTFKQFGPGEHAGYEYSRSGNPTRNSLEKAVAALDGAKYCLSYASGLAATMNIAHLLKAGDQIICTKDVYGGTNRYFRRVASEMGLKVAFVDCSDLKSLEAAIAANTKLVWIETPTNPTLTVIDIKGCADIIHKHKDIILAVDNTFLSAYFQRPLALGADICMYSATKYMNGHSDVVMGLVSVNCDKLYEKLKFLQNAIGAVPSPFDCYLCNRGLKTLHLRMQQHFQNALAVAKFLEADPRVDKVLYPGLPSHPQYELTKRQCTGVSGMITFYIKGNLEHATTFLKSLKVFALAESLGGYESLAEHPAIMTHAAVPEEDRAALNISDTLIRLSIGLEDVEDIIGDLDQALRSAHPDIKNEN

SEQ ID NO: 19330 - DNA, 1524 bp, Brachydanio rerio
  CDS (66)..(1268)
tgcgatctcagggatccggtatatcacccttcaccgtcatatcaggagcactcatgtcttcagagatgcagaacgacagctcagccggcttcctgcccatctacaagtcattcgctacagatgcgatccacgttggttcagagcccgagcagtggagctctatggccgtagtgcctcctatttcactgtccaccacctttaaacagcacggccccggaaaacatgcggggttcgagtacagcaggagtggaaatcctacaagaaactgtcttgaaaaagcagtcgctgctttggatggtgcaaaatactgtctggctgttgcctctggattggcggcaactttgaccatcacacatctttttaaaagtggagatggaattttgtgcatgaatgatgtatatggaggaaccaaccgatatttcagaaaagtagcttcagaagttgggcttgatatatcttttgcagacctcacaaagctggaggagttaaaagcagggctaaaaccaaatacaaagatggtttggattgaaacacccacaaacccaacaatgaaggttgttgacatccaggcctgtgcagatattgtccataagcacaacaaggacacaatcgttgttgtggacaatactttcatgtcagcctacttccagcgcccccttgcacttggagcagacatctgcatgtactctgcaacaaaatacatgaatggacacagcgatgtcgtcatgggcctgatttctctcagccgtgatgacctctatgagcgactgaaatttttgcagaattctcttggtgctgtgccgtctccatttgactgttacatgtgcaatcggggtctgaagacgctgcacctgaggatgaagcagcactttaagaatgcactggctgcggcacagtttctagaggccgacccgagggtggacagagtcatcttcccaggtcttccgtctcatcctcaacatgagctaacaaagagacagtgcacgggctgtcctgggatgatcacattttacatcaaagggaaactggagcatgcttcaaccttcctcagcaatctaaagttgtttgcacttgctgaaagtcttgggggttatgagagtctagcagaacacccagcgattatgactcatgcttcggtgtgcgaggaagagaggaagaagctgggcatcagtgatacactcattcgtctttcagtgggtctggaggacgaggaagatattattgcagatctggaccaagctcttagtgctgcacatccaaagaagtaaaagaccaatgaggaacagcagtgatgccacacgtggatgagatgaggacacttttatgtggcacattagtgatttactttgtatattacgcttacttgaaaaacatcagttgcatttgtcagggaacaactgtcctctagaaaacttgtttgccatgttttaatataaaggagatttggtgcaaaaaaaaaaaaaaaaaaaaaaaaaaaaaaaaaaaaaaaaaaaaaaaaaaaaaaaaaaaaaaaaaaaaaaaaaa

SEQ ID NO: 19331 - protein, 400 aa, Brachydanio rerio
MQNDSSAGFLPIYKSFATDAIHVGSEPEQWSSMAVVPPISLSTTFKQHGPGKHAGFEYSRSGNPTRNCLEKAVAALDGAKYCLAVASGLAATLTITHLFKSGDGILCMNDVYGGTNRYFRKVASEVGLDISFADLTKLEELKAGLKPNTKMVWIETPTNPTMKVVDIQACADIVHKHNKDTIVVVDNTFMSAYFQRPLALGADICMYSATKYMNGHSDVVMGLISLSRDDLYERLKFLQNSLGAVPSPFDCYMCNRGLKTLHLRMKQHFKNALAAAQFLEADPRVDRVIFPGLPSHPQHELTKRQCTGCPGMITFYIKGKLEHASTFLSNLKLFALAESLGGYESLAEHPAIMTHASVCEEERKKLGISDTLIRLSVGLEDEEDIIADLDQALSAAHPKK

SEQ ID NO: 19332 - DNA, 23 bp, Primer
atggcggacaaaaagcttgatac

SEQ ID NO: 19333 - DNA, 23 bp, Primer
ttatacaattcgcgcaaaaccgg

SEQ ID NO: 19334 - DNA, 1570 bp, Saccharomyces cerevisiae
  CDS (360)..(1376)
tattgtactctctagtagaaaatcaaaactattgacacaacaacaatcaaatgaaaacaaaccattctattacggtaagtagtgaagactcacaatgcaatctttcaatgagcatcacttactttaagtagcaatattcctaatcacttattacgaaatttgattttactaaagttcggggatacctcagtggcaaatcgttactcaagttgcacgtaacgtagaatctacaatgaaataattgtgaagccaacagctaagcaatctatagtgtaacgttggctttctgtacaactgctactgattgagggcatttttcgaatttaaaaaagaaagaaagaaaggaaaatcaaattacaatgtctctacaacacgagaaagttaccattgcaccactagttttgctatctgctttggatcattatgagcgtacgcagacaaaagaaaacaaaagatgcgttggtgtcatcttaggtgatgctaacagttccactatcagagtcactaattcctttgccttaccgtttgaagaagatgagaaaaactctgacgtgtggtttttagaccataattatattgaaaacatgaatgaaatgtgtaaaaagattaatgccaaggaaaaactcattggatggtatcatagtggtcctaaattaagggcttctgacctcaagattaatgagctgtttaaaaaatatactcagaataatccgctattattaattgttgatgtcaaacaacaaggtgttggtttaccaacagatgcatatgtcgcgattgagcaagttaaggatgatggtacgtctacagaaaagacgtttcttcatttgccttgtactattgaggccgaagaagctgaagaaattggtgtagaacacttattgagagacgtacgtgatcaagcagcaggtggcttatctatccggttgaccaaccaattaaaatctttgaaaggattacaaagcaaactaaaagacgttgtcgagtacttagacaaagtcattaataaggaattaccgataaaccacactatattgggcaagctacaagatgttttcaaccttttaccaaatctgggaacacctgatgatgacgaaatagatgtggagaatcatgacagaattaatatttcaaataacttacaaaaggctttaactgtgaaaactaatgatgaattaatggttatatatataagcaatttggttaggtcaattatcgcgtttgatgatttgattgaaaacaaaattcaaaataaaaaaattcaagaacaaagagtaaaggacaaacaatcaaaagtctctgatgacagtgagagtgagagtggtgacaaagaagcaactgcgccattgatccaacgaaagaacaagaaaaattaattcaaaaattaacataacataatatatgaaatagatgtgtaaaacgctatgtattaatacaacatgttaatttgcttaagcataattatgttctgttgaatttcaaatataaatgcataatatcgcctctattctcgtccacttacttacttggtctctattaaagagactgaaggaatatacataagtttata

SEQ ID NO: 19335 - protein, 338 aa, Saccharomyces cerevisiae
MSLQHEKVTIAPLVLLSALDHYERTQTKENKRCVGVILGDANSSTIRVTNSFALPFEEDEKNSDVWFLDHNYIENMNEMCKKINAKEKLIGWYHSGPKLRASDLKINELFKKYTQNNPLLLIVDVKQQGVGLPTDAYVAIEQVKDDGTSTEKTFLHLPCTIEAEEAEEIGVEHLLRDVRDQAAGGLSIRLTNQLKSLKGLQSKLKDVVEYLDKVINKELPINHTILGKLQDVFNLLPNLGTPDDDEIDVENHDRINISNNLQKALTVKTNDELMVIYISNLVRSIIAFDDLIENKIQNKKIQEQRVKDKQSKVSDDSESESGDKEATAPLIQRKNKKN

SEQ ID NO: 19336 - DNA, 1599 bp, Mus musculus (house mouse)
  CDS (131)..(1096)
gaagtcgactgtgcagcggcggtcaaaccggaaggggaggtgctggggcctggaggagcggcctgtgtcgctgcggttgctggtgtttgcgggttgcagggagccgggccggtggtcgggctgtgtcgcgatgccggagctggcggtgcagaaggtggtggttcaccccctggtgctgctcagtgtggtggatcatttcaaccgaattggcaaggttggaaaccagaagcgggtagttggtgtgcttttgggatcatggcaaaagaaagtacttgatgtatccaacagttttgcagtaccttttgatgaagatgacaaagatgattctgtctggtttttagaccatgattatttggaaaacatgtatgggatgttcaagaaggtcaatgccagagaaaggatagttgggtggtaccacacaggccccaaactgcacaagaatgatatcgccatcaatgaactcatgaagagatactgccccaactcagtattggtcattatcgacgtgaagccaaaggacctaggacttcccaccgaagcctacatctcagtggaggaagttcatgacgatgggacgccaacgtcaaaaacttttgagcatgtgactagcgagattggagcagaggaggcggaggaagtcggagtggagcacttactaagagacatcaaggacactacagtggggactctctcccagcggatcacaaaccaggtccatggcttgaagggactgaactccaagctcctggatatcaggagctacctggagaaggtagccagcggcaagctgcccatcaaccaccagatcatataccagctgcaggacgtcttcaacctgctgccggacgccagcctgcaggagtttgtcaaggccttctacctgaagaccaatgaccagatggtggtggtgtacctggcctcgctgatccgctctgtggtcgccttgcataacctcatcaacaacaagattgccaaccgggatgccgagaagaaggagggacaggaaaaggaggagagcaagaaggagagaaaagacgacaaagagaaggagaagagcgacgcagcgaagaaagaagagaaaaaggagaaaaagtaaatggtgtagcttttttaattagtaaattaaaatcttataaccataactccgtgtgccactaggagggtcctttgtcacattcagtgcttgtggacaagcgctctgccctggtcacccttgctgtggcattgtggagatgagtggacaaaaggacggatctcagccctacgatacagcttcagttgcatgagttgggggtgtggtggctcaggtgtccgacttcatgaggagaacaacctagccttgggcactcttccttttatccttgaaagggattttttttcctatcttacaagatccatgggatctgttggttgtaattttcataattgctaaatggaattcatggatcccatacaatgccgcccaacacttgagcttggacccttgtgaacttttgagaccacaccaccttttggacctgtaactagcattcttagggcttggggtccaaggccatgtattgtttaccttcaaagatacaattaaatggcttggttttt

SEQ ID NO: 19337 - protein, 321 aa, Mus musculus (house mouse)
MPELAVQKVVVHPLVLLSVVDHFNRIGKVGNQKRVVGVLLGSWQKKVLDVSNSFAVPFDEDDKDDSVWFLDHDYLENMYGMFKKVNARERIVGWYHTGPKLHKNDIAINELMKRYCPNSVLVIIDVKPKDLGLPTEAYISVEEVHDDGTPTSKTFEHVTSEIGAEEAEEVGVEHLLRDIKDTTVGTLSQRITNQVHGLKGLNSKLLDIRSYLEKVASGKLPINHQIIYQLQDVFNLLPDASLQEFVKAFYLKTNDQMVVVYLASLIRSVVALHNLINNKIANRDAEKKEGQEKEESKKERKDDKEKEKSDAAKKEEKKEKK

SEQ ID NO: 19338 - DNA, 1602 bp, Homo sapiens (man)
  CDS (84)..(1058)
ggaaaaagggtaccggtgaccgctactgctgccggtgtttgcgtgtggcagggagccagtcctggcgagcggggtgtgtcgcgatgccggagctggcagtgcagaaggtggtggtccaccccctggtgctgctcagtgtggtggatcatttcaaccgaatcgtcaaggttggaaaccagaagcgtgtagttggtgtgcttttggggtcatggcaaaagaaagtacttgatgtatcgaacagttttgcagttccttttgatgaagatgacaaagacgattctgtatggtttttagaccatgattatttggaaaacatgtatggaatgtttaagaaagtcaatgccagggaaagaatagttggctggtaccacacaggccctaaactacacaagaatgacattgccatcaacgaactcatgaaaagatactgtcctaattccgtattggtcatcattgatgtgaagccgaaggacctagggctgcctacagaagcgtacatttcagtggaagaagaccaagatgatggaactccaacctcgaaaacatttgaacacgtgaccagtgaaattggagcagaggaagctgaggaagttggagttgaacacttgttacgagatatcaaagacacgacggtgggcactctgtcccagcggatcacaaaccaggtccatggtttgaagggactgaactccaagcttctggatatcaggagctacctggaaaaagtcggcacaggcaagctgcccatcaaccaccagatcatctaccagctgcaggacgtcttcaacctgctgccagatgtcagcctgcaggagttcgtcaaggccttttacctgaagaccaatgaccagatggtggtagtgtacttggcctcgctgatccgttccgtggtcgccctgcacaacctcatcaacaacaagattgccaaccgggatgcagagaagaaagaagggcaggagaaagaagagagcaaaaaggataggaaagaggacaaggagaaagataaagataaggaaaagagtgatgtaaagaaagaggagaaaaaggagaaaaagtaaaacatgtattaaatagcttttttactttgtaaattaaaatcttacaaactaaatcagtgtgctgctagagggttctttttcacttgacatgcttattagaaagctgacccaacaagagctctctgcctccggtcactcttgctgtggtgctacgtggaagtgaatggagactgatctcaaatctgaactgcagctttccctcctgtgagttggggaaatgatagtcaactcagccttcagattgtatgagaaaaatgaagagaagccaccaaatattttggtactcttcattcatttatctctaaaaccaggagttgaattttcctcatcttgaaagactcttggggtctgtttctggtattttacaaaattgctaagtggaatgcatgaattgcattatgttctctggtaacacgtagagttcagacccttctgaactctgttgataataccacaccatgttctggacccatagctctggcatcctcaggggttgtgatccagctccatatattgtttaccttcaaagatacaattaaataac

SEQ ID NO: 19339 - protein, 324 aa, Homo sapiens (man) [sequence omitted]

SEQ ID NO: 19340 - DNA, 885 bp, Caenorhabditis elegans
  CDS (1)..(885)
atggcttcgaatttaactgtcaatgtccacccgggagtctacatgaatgttgtcgacactcatatgagacgtaccaagagttctgcgaaaaatacaggacaggaaaagtgcatgggaacacttatgggatactatgagaaaggatcgattcaggtcacaaattgtttcgcgatccctttcaatgagagcaacgacgatttggaaatcgatgatcaattcaatcaacaaatgatctctgcattaaagaaaacttctccaaatgagcaaccagttggatggttccttacaacatctgacattacttcttcgtgtctcatctatcacgactactatgtacgtgtcatcactgaagcatcggctcgtcgtgaatctccaccaattgtcgttttgacaattgacacgactttctctggagatatgtcaaagcgtatgccagttcgtgcctatcttcgctcaaaagccggaattcctggagctgctggaccacactgtgctattttcaacccacttcgtgtcgaattagctgcattcccgggagaactggttgctatgcaacttatcgaaaaagctttggattccagaagaagagaggcaactcttgaaagtggattggagcaattggagacgagcacagctcagatgattgagtggttggagagaatgttgcattacgtggaagatgttaacaagaacggtgagaagccaggagatgctcaaatcggtcgtcaactcatggatattgtcactgcctcgtcaaacaatatgcagccagagaagctcgatactcttgtcaagaatactcttcgtgactacgtgatggtttcgtaccttgccaaattgactcaaactcaacttcaagttcacgaacgtcttgtgtcggcctaa

SEQ ID NO: 19341 - protein, 294 aa, Caenorhabditis elegans
MASNLTVNVHPGVYMNVVDTHMRRTKSSAKNTGQEKCMGTLMGYYEKGSIQVTNCFAIPFNESNDDLEIDDQFNQQMISALKKTSPNEQPVGWFLTTSDITSSCLIYHDYYVRVITEASARRESPPIVVLTIDTTFSGDMSKRMPVRAYLRSKAGIPGAAGPHCAIFNPLRVELAAFPGELVAMQLIEKALDSRRREATLESGLEQLETSTAQMIEWLERMLHYVEDVNKNGEKPGDAQIGRQLMDIVTASSNNMQPEKLDTLVKNTLRDYVMVSYLAKLTQTQLQVHERLVSA

SEQ ID NO: 19342 - DNA, 1089 bp, Caenorhabditis elegans
  CDS (1)..(1089)
atggctccaactaacaaagacggagatgtggcgactgtcaaagctgtagatgttctcaaacaaaaggctggagcccatcattgccttggaaatgttcatgcaaaccttcccgttaataaggtgaccgtccatccattggttcttctgagtgttgttgatcatttcaatcgtgtcagcaaaactcaaagcgtgaagcgtgttgttggagtccttttggggtccatgaaaaaggacaaaactctggatattggaaacagttttgctgttccgtttgatgaagatgacaaggataaaagtacatggttcctcgacatggactatttggagagcatgtatggaatgttctacaaggttgccgccaaggaaaaaatcgtcggatggtatcatacgggtccaaaacttcacaagaacgatattgctatcaacgagcaattgaaacgattctgcccgaacccggttcttgtaattatcgatgctgagccaaagaacatcggattgccaacagaggcttacatcgaagttcaggaagttcacgatgatggaactccaccaatcaaaaccttcgagcatgtgccttcagatatcggagccgaagaagctgaggaagttggagtcgagcatcttttgagagatatcaaggaccaaactgctggaactctttcacagcgtatcaccgatcaacttatgggcttgagaggactgcaatcacagcttgaatccattgagaagtatcttcatgatattgtgcgcggaactcttccagtcaaccatcatgtcatttactatgttcaagaagttctcaatctcctgcctgacgtcactcatccagactacattgtttcacagaatgtgcaaactaatgatcagctcatgtgtgtgtatatgggatctcttgtacgatcggtggtcgctttgcacaacttaattgataacaagatctctctccagaaggctgaaaaggagcaggaaactggcgaagctgagaaaaagaaggatgaaaaggataagaaagacaaaaaggatgaaaagaaggatgagaaaaaggaaaaggacagtaaatcatcaacccctaatactccaaagaagtga

SEQ ID NO: 19343 - protein, 362 aa, Caenorhabditis elegans
MAPTNKDGDVATVKAVDVLKQKAGAHHCLGNVHANLPVNKVTVHPLVLLSVVDHFNRVSKTQSVKRVVGVLLGSMKKDKTLDIGNSFAVPFDEDDKDKSTWFLDMDYLESMYGMFYKVAAKEKIVGWYHTGPKLHKNDIAINEQLKRFCPNPVLVIIDAEPKNIGLPTEAYIEVQEVHDDGTPPIKTFEHVPSDIGAEEAEEVGVEHLLRDIKDQTAGTLSQRITDQLMGLRGLQSQLESIEKYLHDIVRGTLPVNHHVIYYVQEVLNLLPDVTHPDYIVSQNVQTNDQLMCVYMGSLVRSVVALHNLIDNKISLQKAEKEQETGEAEKKKDEKDKKDKKDEKKDEKKEKDSKSSTPNTPKK

SEQ ID NO: 19344 - DNA, 909 bp, Schizosaccharomyces pombe
  CDS (1)..(909)
atggctttggggactaagcacgtactccatctcacaaaaccgtcttccaggtcaagtcctttgaacattgtcattgaaccagcagtgcttttttctatccttgaccattcaacccggaaaagtgaaaataatcaacgtgttatcggtacacttttgggaacacgttctgaagatggccgagaaattgagattaaaagttgttttgcagttcctcataatgagagcagtgagcaggtagaagttgaaatggaatatcatcgtgcgatgtaccatttacacctcaaggctaaccctcgtgaagttgtcgttggttggtatgctacttctcctgatttagatgctttcagtgcactgattcaaaatttatatgcttctcctgctgaacccggaactgctccactaggaacgtatcctcatccctgtgttcaccttactgtcaacacagatgttagcagtccccttgccatcaagacttacgtttcttcaccagtaggtattacagagcgccttgctgacagctgtgcattcgtccctaccccttttaccattcgtgatgacgaggcagtccgttctggtttgaaagctgtagctgctcctaagaatgacccatctagacttgctagcctattcacagatctccagcaacttcgaagatcaaccttggagcttttatctatgattgaaagagtttccgattatgtgcaaaacgtaattgatggttcttcgcctgctaatgttgctgtcggtagatatttgatgaagtgctttagtttaattccttgcgtagaaggccaagattttgaaaaaattttttcatcacatcttcaagatgttttggttgtagtttatctcgcaaataccttacgtactcaagtggatattgcttcccgtcttaatttgcttccctaa

SEQ ID NO: 19345 - protein, 302 aa, Schizosaccharomyces pombe
MALGTKHVLHLTKPSSRSSPLNIVIEPAVLFSILDHSTRKSENNQRVIGTLLGTRSEDGREIEIKSCFAVPHNESSEQVEVEMEYHRAMYHLHLKANPREVVVGWYATSPDLDAFSALIQNLYASPAEPGTAPLGTYPHPCVHLTVNTDVSSPLAIKTYVSSPVGITERLADSCAFVPTPFTIRDDEAVRSGLKAVAAPKNDPSRLASLFTDLQQLRRSTLELLSMIERVSDYVQNVIDGSSPANVAVGRYLMKCFSLIPCVEGQDFEKIFSSHLQDVLVVVYLANTLRTQVDIASRLNLLP

SEQ ID NO: 19346 - DNA, 975 bp, Schizosaccharomyces pombe
  CDS (1)..(975)
atgcctcctgcagtgagctctgaaacctctacaatcgtcccacagcaagttattgtgcatccattagtacttctgtcagcagtagattcttataatcgatctgccaagggaaccaaaagacgggtcgttggtattctattgggtcaaaataatggcgacgttgtaaacgtggccaatagttatgctataccatttgaggaagatgaaaagaatgcatcggtttggtttttggaccataattttatggaatcaatgaatgaaatgtttaaaaaaatcaatgcaaatgaaaaattagttggctggtatcatactggaccacaactccgaccctctgatttggaaatcaacaacttacttaaaaaatacatacccaatcccgttcttgtcattatcgatgtaaagcccaaatcagtgggtcttccgactaatgcctactttgccattgatgaaattgaagacgacggctctaagtccagcagaacttttgttcatctaccctccagtatagaggcagaggaagcagaggaaattggtgttgaacacttgttacgtgatactcgtgatgcatccgttggtactttagcgacaagagttacccagcaggcacaatctttacaaggccttgggcagcgtctcactgaaatcgcagattacttaaggaaagtcgtggatgggcaactacctataaatcatgctatccttgccgagcttcagagtgtgtttaatcttttgcctaacatttttagcggtcctgtggtttcagaacaggccttggaatcagaggcacaacgtgctttcaatgtgaattccaatgatcagttgatgtccatttatatttccagcatcgtgagggccgtgattgctcttcatgatcttttggattctttggctgctagtaaagctatggaacagcaggacataaagccaactgttcaaaatggagaagtttcggctaatgccgaacaaaaggcttaa

SEQ ID NO: 19347 - protein, 324 aa, Schizosaccharomyces pombe
MPPAVSSETSTIVPQQVIVHPLVLLSAVDSYNRSAKGTKRRVVGILLGQNNGDVVNVANSYAIPFEEDEKNASVWFLDHNFMESMNEMFKKINANEKLVGWYHTGPQLRPSDLEINNLLKKYIPNPVLVIIDVKPKSVGLPTNAYFAIDEIEDDGSKSSRTFVHLPSSIEAEEAEEIGVEHLLRDTRDASVGTLATRVTQQAQSLQGLGQRLTEIADYLRKVVDGQLPINHAILAELQSVFNLLPNIFSGPVVSEQALESEAQRAFNVNSNDQLMSIYISSIVRAVIALHDLLDSLAASKAMEQQDIKPTVQNGEVSANAEQKA

SEQ ID NO: 19348 - DNA, 1110 bp, Neurospora crassa
  CDS (1)..(1110)
atggctgtcgatcaggagtctttcgtccatctctcgcgcccccttgcgcccaatgtgcttggcttcggtgtcagcaatgccccgcttaccgtcaacatccagcctcaggctgtcttctccatcatcgaccatgccgtcagacgtgacgaccgcgacacccagtcgacacgggtgattggtgccctcgtgggtgtccgcagcgaggacggcagcgaggtcgaagtccgctccaccttcgccatcccccacaccgagaacgaggaccaggttgaggtggacgtcgagtaccagaagaacatgttggccctgacgctcaaggccaacccccgcgagaccctgctgggttggtacaccacctcgcacgagctcaacagcttcagcgccctgatccagaacttcttcgcctcccccgagaccggcaccttcccccacccggccgtccacctgaccatcggcaccgaggctggcgcgaccatcgacaccaagacgtacatctccgctcctgtggccgtcagccccgagcgcgccgccgagtcgtgcctcttcatcgaggtaccccacaagctcctcttcaccgacgctgagcgcggcgccctgggctctgtcgccgccgctgccgacgccgagtcgcgctccgcccccgtcgtctccgacattgagaacctcgcccaggccctcgagaccgtctccgacctgcttgagcgcgtttccggcttcgtcggcgaggtgctcgacgaggagcgcgacggcaaccacgcgctcggccagtacctcatgaatgccctttccctcgctcccaaggtgtccaatttggccatcgagaacgacttcaacaaccacatccaggacgtccttatggtctcgtaccttgccaacacgatccgcacccagatcgagttgtcccagcgcctggccactgccaagctcgacgagggcaaggagggcggtgagaagaaggatggtgagggcgctgagggcgacaagaagaccgacggccagcgtggccaaaggggccagggcggcaagcgtggcggtcgcagcggtggtgctggtggccgcggtggccgcgagcagagggagcccagggaacccagggaagctgccgagtaa

SEQ ID NO: 19349 - protein, 369 aa, Neurospora crassa
MAVDQESFVHLSRPLAPNVLGFGVSNAPLTVNIQPQAVFSIIDHAVRRDDRDTQSTRVIGALVGVRSEDGSEVEVRSTFAIPHTENEDQVEVDVEYQKNMLALTLKANPRETLLGWYTTSHELNSFSALIQNFFASPETGTFPHPAVHLTIGTEAGATIDTKTYISAPVAVSPERAAESCLFIEVPHKLLFTDAERGALGSVAAAADAESRSAPVVSDIENLAQALETVSDLLERVSGFVGEVLDEERDGNHALGQYLMNALSLAPKVSNLAIENDFNNHIQDVLMVSYLANTIRTQIELSQRLATAKLDEGKEGGEKKDGEGAEGDKKTDGQRGQRGQGGKRGGRSGGAGGRGGREQREPREPREAAE

SEQ ID NO: 19350 - DNA, 1029 bp, Trichoderma reesei
  CDS (1)..(1029)
atgccgaccaccaccgcggaaacgctctcgctggtgaccagaaacgtctccgtcgctccgctcgtcctcctctccgccgtcgaccactacaaccgaacagtcaccagcaagacaaagaggcgggtggtcggagttctcctcggtcagaatgacggcaagaacgtgagggtgtccaacagcttcgcagttccctttgaggaggacgaaaaggacccttcagtatggttcctggaccacaactacgtcgagtcgatgaacgacatgttcaagaaggtgaatgcgcgggagaagctggtggggtggtaccatacgggacccaagttgcgagcctctgatctcgagatcaacgagttgttcaagcgctacacgcccaacccgctgctggtcattatcgatgtccagccaaaggagtcgggcgtgcccaccgatgcgtattttgcggttgaggagatcaaagatgatggaacgacgacttcccggacgtttgtccacacaccgtccatcatcgaggccgaggaagcagaggaaatcggagtcgagcatctgctgcgagacatccgcgacgtcgctgtcggcaccttgtccacgcgcgtcactaaccagctgcaatcgctccaagggctgcatcttcggctacgagacattggagcctacctccagaaggtcctcgacggccaactgcccgtcaaccacgcgatcctcggcaacctacaagacgtcttcaaccttctccccaacctctccacgccagaagacgacagcagaacaggaggccacgaactatcacacgccatgagcatcaagaccaacgaccagctgatggccatctacctcagcagcctgatacgcgccatcaccgcattccacgacttgatagagaacaagatccagaaccgacagcagcaggacgagaaggagccgaagaaggacgaggcgaaggacaaggacgagaagaaggacgcgggcgccaccaacgcaaacggagagtccaaggagagcagcgataaagaaaagtctaaaaagaagtaa

SEQ ID NO: 19351 - protein, 342 aa, Trichoderma reesei
MPTTTAETLSLVTRNVSVAPLVLLSAVDHYNRTVTSKTKRRVVGVLLGQNDGKNVRVSNSFAVPFEEDEKDPSVWFLDHNYVESMNDMFKKVNAREKLVGWYHTGPKLRASDLEINELFKRYTPNPLLVIIDVQPKESGVPTDAYFAVEEIKDDGTTTSRTFVHTPSIIEAEEAEEIGVEHLLRDIRDVAVGTLSTRVTNQLQSLQGLHLRLRDIGAYLQKVLDGQLPVNHAILGNLQDVFNLLPNLSTPEDDSRTGGHELSHAMSIKTNDQLMAIYLSSLIRAITAFHDLIENKIQNRQQQDEKEPKKDEAKDKDEKKDAGATNANGESKESSDKEKSKKK

SEQ ID NO: 19352 - DNA, 1160 bp, Mus musculus
  CDS (49)..(1023)
atttggctccgaggccaagaattcggatccaaggcgggcgcggggaaaatggcggcggcagctgcggcgggggcgaatgggagcggaggcagcagcggcatggaagtggatgcagcagtccccagcgtgatggcctccggagtgactgggagtgtttccgtcgctcttcatccccttgtcatccttaacatctcagaccattggatccgcatgcgctcccaggaggggcggcctatgcaggtgattggggctctgatcgggaagcaggaggggcgaaatatcgaagtgatgaactcctttgagctgctgtcccacaccgtggaagagaagattatcattgacaaagaatattattacaccaaggaggagcagtttaaacaggttttcaaggagctggagtttctgggttggtataccacaggggggccacctgacccctcagacatccacgtccataagcaggtgtgtgagataattgagagtccgctctttctgaagttgaaccctatgaccaagcacacagatcttcctgtcagcgtttttgagtctgtcatcgatataatcaatggagaggccacaatgctgtttgctgagctcacttacactctggccactgaggaagctgaacggatcggtgtagaccacgtggcccggatgacagcaacaggcagtggggagaactccactgtggctgaacacctgatagctcagcatagtgccatcaagatgctgcacagccgtgtgaagctcattttagaatatgtcaaggcctctgaagcaggagaggttcccttcaaccatgagatcctgcgggaggcctatgccctatgtcactgtctcccagttctcagcactgacaagttcaagacagacttttatgatcaatgcaatgacgtggggctcatggcctacctcggcaccatcaccaaaacgtgcaacacaatgaaccagtttgtgaacaagttcaacgtcctctacgaccgacaaggcattggccggcgaatgcggggactgtttttctgatgatggttctggaagggatggtgtgtggggctcagacagctgttccatggacctgagtaccacattccctttagagaaactcattaataaaagagcagccccttaaaaaaaaaaaaaaaaaaaaaaaaaaaaaaaaa

SEQ ID NO: 19353 - protein, 324 aa, Mus musculus
MAAAAAAGANGSGGSSGMEVDAAVPSVMASGVTGSVSVALHPLVILNISDHWIRMRSQEGRPMQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 19354 - DNA, 990 bp, Candida glabrata
  CDS (1)..(990)
atgtccttacatcacgataatgtcacaattgcgccattggtgctattgtcagtgctggaccactacgagcgtaccaatacccctgaaggtaagagatgtgttggtgtcatactcggcgattcgcaaacgaacacaataagggtaactaattcatttgctttgccatttgaagaagatgagaaaaactctgatgtttggtttttagatcacaattatattgagagtatgaatgagatgtgtaaaaagattaatgccaaggaaaaattaattggttggtaccacagtgggccaaaactaagggcttcagacttgaaaataaatgaactgttcaagaaatatacacaaggcaatccattgcttttaattgtggatgttaagcagcaggatgttggtctaccaacagatgcatatatggctgttgaacaagtgaaagacgatggtacttctactgaaaaaactttcttacatttgccatgtacagttgaagcggaagaagcggaagaaattggtgttgagcatctgttgagagatgttcgtgatcaagcggccggtggattgtctattagattgaccaaccagttgaagtctttgaaaggtttacaaaaaaaattaaatgacattgtgatatacttgaataaagtcattaacaatgagctacctgttaaccatactattttagggaaacttcaggatgtttttaatctgttgccaaatcttgggtataacgaagaaactgacgtctctgcaactagtaatgatatggtcactgccagtaataacttgcaaagggcattgacagttaaaactaacgacgaactgatggtgatatatatcactaaccttgtaagagcgattattgcatttgatgatctgatcgagaataaaatgcaaaacaagaaactgcaggaggagagaaataaggaattacaagctgatataaacaaagtggagtctgaaacggctgaaactgaaaaagtagccacagattga

SEQ ID NO: 19355 - protein, 329 aa, Candida glabrata
MSLHHDNVTIAPLVLLSVLDHYERTNTPEGKRCVGVILGDSQTNTIRVTNSFALPFEEDEKNSDVWFLDHNYIESMNEMCKKINAKEKLIGWYHSGPKLRASDLKINELFKKYTQGNPLLLIVDVKQQDVGLPTDAYMAVEQVKDDGTSTEKTFLHLPCTVEAEEAEEIGVEHLLRDVRDQAAGGLSIRLTNQLKSLKGLQKKLNDIVIYLNKVINNELPVNHTILGKLQDVFNLLPNLGYNEETDVSATSNDMVTASNNLQRALTVKTNDELMVIYITNLVRAIIAFDDLIENKMQNKKLQEERNKELQADINKVESETAETEKVATD

SEQ ID NO: 19356 - DNA, 1408 bp, Oryza sativa
  CDS (94)..(1083)
aaaaccctcccctctctctctcgcctcaccaccgccgtcgtcgtcgccgccgccgcaaccctcgccgccggcgctaggctcgcgactccgacgatgtcggcgccatccgaccccgccgtggccacccacccgcaggcgggcgccgccgcggcggcgtcctccagcagcggcctcaccttcaagctccaccccctcgtcatcgtgaacgtctccgaccaccacacccgcgtgaaggcccaggcggcgtgctccggcgacggggcctcgtctgcggcggcgggggggcagccgccgagggtgttcgggtgcgtgatcggggtgcagcgcgggcggacggtggagatcttcaacagcttcgagctcgtcctcgaccctgtctccgggaccctcgaccgcgccttcctcgagaaaaagcaggagctctataagaaggttttccccgacttctatgtgctgggttggtactccactggaagcgatgtgcgggacactgatatgcaaatccacaaggctctgatggacattaacgaaagtcccgtttatcttcttttgaatcctgcaatcaacctctcccagaaggatctccctgtaacaatttatgagagtgagttgcatgttatcgatgggagtccgcagctcatctttgtcagagctaattatacaattgagactgtagaggcagagaggatatctgttgatcatgttgcccatctcaaaccatctgatggtggctctgcggcgactcaattggctgctcatctgacaggaatacacagtgccatcaagatgctcaatagcagggtccgtgttatccatcaatatcttgtttccatgcagaaaggtgatatgccactggacaattcgctgcttaggcaagtctcaagcctagtaagaaggctaccagcaatggagtcagaaaaattccaagatgacttcctaatggaatacaatgacaccctcctcatgacttaccttgctatgttcactaactgttcaagcacaatgaatgagctggtcgagaagtttaacgcgacatacgagaggtcgactgccaggagaggaggccgaggtgctttcatgtagattttcccccttctgcatctgcagctggttctctgctgagattttggaaatagttacccatatggccaggaagtttttgcgtataatctgttaggaactatatctggcagccatcaagtttcttccaaactcatgctccctcgttcaggattgacacggcaaacatgttgatattcttgattctgtgcctagatcgttgtttattcctcattcgccaagattgacatgtaaagtttatccccatcacccccatggtagttacactatttgactccctaaatggatatggatgcaggtttcctgagttatgcttgtaaatttcttt

SEQ ID NO: 19357 - protein, 329 aa, Oryza sativa
MSAPSDPAVATHPQAGAAAAASSSSGLTFKLHPLVIVNVSDHHTRVKAQAACSGDGASSAAAGGQPPRVFGCVIGVQRGRTVEIFNSFELVLDPVSGTLDRAFLEKKQELYKKVFPDFYVLGWYSTGSDVRDTDMQIHKALMDINESPVYLLLNPAINLSQKDLPVTIYESELHVIDGSPQLIFVRANYTIETVEAERISVDHVAHLKPSDGGSAATQLAAHLTGIHSAIKMLNSRVRVIHQYLVSMQKGDMPLDNSLLRQVSSLVRRLPAMESEKFQDDFLMEYNDTLLMTYLAMFTNCSSTMNELVEKFNATYERSTARRGGRGAFM

SEQ ID NO: 19358 - DNA, 981 bp, Ashbya gossypii
  CDS (1)..(981)
atgtcggttaattatgagcaagtaaatgttgcgcccctggttctgttgtcagtgttggatcattacaagcgcatgaataccccagacaacaagcggtgcgttggggtgctcttgggcgacaattcagggtcgacgatcaaggtcaccaactcatttgcattgccatttgaggaggatgagaagaaccctgacgtgtggttcctggaccacaactacatagaaaacatgaacgacatgtgcaagaagatcaacgcgaaggaaaagatgattggctggtaccacagtggcccgaagttgaggtcgtccgacttgaagatcaatgggctatttaaaaaatacacacaggggaactcgctgttactaattgtggacgtaaaacaacagggcgtcggattgcccacggacgcgtacatggcgatagaagaagtcaaggacgacggctcctcgacggagcgcacttttgtgcatctgcccacggcaattgaggccgaggaggctgaggagattggggtggagcacctgctgcgcgatgtgcgcgaccaggctgcaggtaacctgtccctaaggctgaccaaccagctgaagtccctgcaggggctgcagcgcaagctgcgggacatcgtagcctacctcgacaaggtcaacagcggccaactccccgcgaaccacattatcctgggcaagctacaggacgtcttcaacctcttgccaaacctaggctcccccgatgaagaagcccctgccacaaagaaggacgatgttcttgcctcctccaacactctgcagaaggctctgactgtgaagaccaacgacgagctgatggtcatatatattagcaatctgatgagggccatcattgcctttgacaacttgattgagaacaaaatcaagaacaaaaagctacaagaggccaagcgcgatcccgagcctgaagaggccaccaaggaggaaattcaacagcaggaatcggccaaggcttag

SEQ ID NO: 19359 - protein, 326 aa, Ashbya gossypii
MSVNYEQVNVAPLVLLSVLDHYKRMNTPDNKRCVGVLLGDNSGSTIKVTNSFALPFEEDEKNPDVWFLDHNYIENMNDMCKKINAKEKMIGWYHSGPKLRSSDLKINGLFKKYTQGNSLLLIVDVKQQGVGLPTDAYMAIEEVKDDGSSTERTFVHLPTAIEAEEAEEIGVEHLLRDVRDQAAGNLSLRLTNQLKSLQGLQRKLRDIVAYLDKVNSGQLPANHIILGKLQDVFNLLPNLGSPDEEAPATKKDDVLASSNTLQKALTVKTNDELMVIYISNLMRAIIAFDNLIENKIKNKKLQEAKRDPEPEEATKEEIQQQESAKA

SEQ ID NO: 19360 - DNA, 1107 bp, Oryza sativa
  CDS (70)..(924)
gtcttgtctccttccttccgccgccgccgaagcagaagaggaagaagagagaagaaagaagcattggcgatggctgcggcggagggccccgttctcctcttcccctctacctcgtcgacgtccgcccgggtggaggcggtcgtcgtgttcaacatctgcgacagctacgtgcgccgccccgaccaggcggagcgcgtcatcggcaccctcctcggctccgtcctccccgacggcaccgtccatgtccgcaactcctacgtcgtcccccacaacgagtcccccgaccaggttgctctcgacatcgagtaccaccacaacatgtatgcgtcgcaccacaaggtcaaccccaaggaagtcattgttggatggttctcgactggcttcggtgtttctgggggaagtacgcttatccatgatttttactcaagagaagtacagagccccattcatctcactgttgacactgggttcacaaggggcgatgcttcaatcaaagcctatatctcatccaacctgtctcttggagataggcaccttgctgcgcagttccaagagattccccttgatctgaggatgcttgaagcaggaaaagttggatttgacatcctgaaatctacaattgtggagaagctccccaatgatctggaaggaatggaatcctccatggaaaagctgtatgtccttattgacgagatctacaaatatgttgatgatgtcgtggaggggcgtgtagcaccggacaataaaattgggagattcatctctgatgctgttgcttcaatgccaaaattgtcaccagctgcttttgacaagcttttcaatgacaggattcaggataatcttgcactggtgtacctgtcaagcatcacaaggacacagattagcatagccgagaagttgaacaccgccgcccaaatcctgtaatttccatgtagttggagcatctgggagtctgacttaaaatgctgttttgtttgtttttcattcgcacgactgaaaaattgggatatgatggcagagtatgcatttttgtacttgttatctgaggcctaaagaaaagaaaccatcatgtttcagatgataatgtttgtgttggaggttgggtgc

SEQ ID NO: 19361 - protein, 284 aa, Oryza sativa
MAAAEGPVLLFPSTSSTSARVEAVVVFNICDSYVRRPDQAERVIGTLLGSVLPDGTVHVRNSYVVPHNESPDQVALDIEYHHNMYASHHKVNPKEVIVGWFSTGFGVSGGSTLIHDFYSREVQSPIHLTVDTGFTRGDASIKAYISSNLSLGDRHLAAQFQEIPLDLRMLEAGKVGFDILKSTIVEKLPNDLEGMESSMEKLYVLIDEIYKYVDDVVEGRVAPDNKIGRFISDAVASMPKLSPAAFDKLFNDRIQDNLALVYLSSITRTQISIAEKLNTAAQIL

SEQ ID NO: 19362 - DNA, 1692 bp, Homo sapiens
  CDS (243)..(1226): n means a or g or c or t/u
nnnncgcggccgcgttcgactacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggtacggctgcgagaagacgacagaagggggcggggggccgaggctggcgggcgcggggaaaatggcggcggcggcggcggcggctgcagctacgaacgggaccggaggaagcagcgggatggaggtggatgcagcagtagtccccagcgtgatggcctgcggagtgactgggagtgtttccgtcgctctccatccccttgtcattctcaacatctcagaccactggatccgcatgcgctcccaggaggggcggcctgtgcaggtgattggggctctgattggcaagcaggagggccgaaatatcgaggtgatgaactcctttgagctgctgtcccacaccgtggaagagaagattatcattgacaaggaatattattacaccaaggaggagcagtttaaacaggtgttcaaggagctggagtttctgggttggtataccacaggggggccacctgacccctcggacatccacgtccataagcaggtgtgtgagatcatcgagagccccctctttctgaagttgaaccctatgaccaagcacacagatcttcctgtcagcgtttttgagtctgtcattgatataatcaatggagaggccacaatgctgtttgctgagctgacctacactctggccacagaggaagcggaacgcattggtgtagaccacgtagcccgaatgacagcaacaggcagtggagagaactccactgtggctgaacacctgatagcacagcacagcgccatcaagatgctgcacagccgcgtcaagctcatcttggagtacgtcaaggcctctgaagcgggagaggtcccctttaatcatgagatcctgcgggaggcctatgctctgtgtcactgtctcccggtgctcagcacagacaagttcaagacagatttttatgatcaatgcaacgacgtggggctcatggcctacctcggcaccatcaccaaaacgtgcaacaccatgaaccagtttgtgaacaagttcaatgtcctctacgaccgacaaggcatcggcaggagaatgcgcgggctctttttctgatgagggtacttgaagggctgatggacaggggtcaggcaactatcccaaaggggagggcactacacttccttgagagaaaccgctgtcattaataaaaggggagcagcccctgagcacccctgctggtggctctgtcctctgttaggcaccacactggttggtcaacttggatgttcatcgaggctcattctggccttgctcagaagcccttctgatgctcttcagtgagggaggcactaccatttgaagtgaccccatgtcagtcacatggactggtctttagcaaagtccaaggctgcctggttccaccttagtggtctctgttctacactttaatgtcaccctcttacatcatcttaacctagccaaccaaacttattaactgttaattggctactaaaaaaagaaatcacaaaaaaaacaaaaaccgggggctataaggggggggagaaagagggtaaaannn

SEQ ID NO: 19363 - protein, 327 aa, Homo sapiens
MAAAAAAAAATNGTGGSSGMEVDAAVVPSVMACGVTGSVSVALHPLVILNISDHWIRMRSQEGRPVQVIGALIGKQEGRNIEVMNSFELLSHTVEEKIIIDKEYYYTKEEQFKQVFKELEFLGWYTTGGPPDPSDIHVHKQVCEIIESPLFLKLNPMTKHTDLPVSVFESVIDIINGEATMLFAELTYTLATEEAERIGVDHVARMTATGSGENSTVAEHLIAQHSAIKMLHSRVKLILEYVKASEAGEVPFNHEILREAYALCHCLPVLSTDKFKTDFYDQCNDVGLMAYLGTITKTCNTMNQFVNKFNVLYDRQGIGRRMRGLFF

SEQ ID NO: 19364 - DNA, 861 bp, Giardia lamblia ATCC 50803
  CDS (1)..(861)
atggctcagcttgaggtccaggtcagcccaacagtcatcttatccgtcgcagatcaccgtcggcgaatacttgcagatggtggaccggaaaaccgccgagtgttgggctgtttaattggcacctgttcagagggaacggtgcgggtaacaacgagctttcccgttccattttctgaagctcgcgggcaggatggcgtattttatatagacatgctgtaccagaagaagatgctgtctctctaccaacgcgtctaccacttcgagggtgtggtgggttggtacacaagtgggactgccattcaggttgcagatatggtcatccacgagcacctagggtttaagaatgatcacacaaaggttctactgtgtgtcgattgcactgagctcagttcggacatcgatgtttacagaccgtgcattcgtgcatacgccttcgctacagtcaatggggtgatatctgcacaccttattgcatcaaaggtcatggtttcagacgttgagcgggtcgttttgagcggggactctgccacagataactccgtctctactggagcaataacgtctcacacaggaagttccacctttcctatgcagattaggcaatattcggccgctcttcagattcttgaagaggaaattcgccacattatttctcaccttgaggaaagagaagcagatgtggacccggaaatcttggtccttgtgcaggagacaattaaccttctcttgggtatagatgtgacagagcttattggaagtgagcacagagccatggcctgtggctatgtcgtcagcgacctcgtgcagactgtccttgctgtccaaaaggtaatcggatcactgaagccagtcacttcgtaa

SEQ ID NO: 19365 - protein, 286 aa, Giardia lamblia ATCC 50803
MAQLEVQVSPTVILSVADHRRRILADGGPENRRVLGCLIGTCSEGTVRVTTSFPVPFSEARGQDGVFYIDMLYQKKMLSLYQRVYHFEGVVGWYTSGTAIQVADMVIHEHLGFKNDHTKVLLCVDCTELSSDIDVYRPCIRAYAFATVNGVISAHLIASKVMVSDVERVVLSGDSATDNSVSTGAITSHTGSSTFPMQIRQYSAALQILEEEIRHIISHLEEREADVDPEILVLVQETINLLLGIDVTELIGSEHRAMACGYVVSDLVQTVLAVQKVIGSLKPVTS

SEQ ID NO: 19366 - DNA, 909 bp, Plasmodium yoelii yoelii
  CDS (1)..(909)
atgagtagtatgctgaaagataaaacacctcagtattttgatatacaaccacatacaaatataaaatgtattgtacatccttctgtaatatttacaattttagattcatatttaagaagagatgaagatcaaactcatgtgattggaacattgatgggatctattattgatactaatttggttgaaatatctgattgctttgttgataagcattcgttaaatgagggcggttttttgcaaataataaaagatcatcatgaaaccatgtatgaattaaaacaaaaaattcgtccaagagatcaagttgttgggtggttttgttcaggatcagaattatcagaattatcatgtgcggttcatggatggtttaaagaacataattctatttctaaattttatccacattctccattaaatgaacctatacatttattagtagatgcatcattagaaagtgggttcttaaatgttaaagcatatgtacaattacctattaatttagttaaagaatattttgttcattttcatgaaattcaaattgaattattaccatgcaatattgaaagagctgatgttgccaaaataactgaaaaaataacaaaaggtggagataaagaaaaattattaaataatgaaattgatgaaaattcattaaaaaaattattaattatgttaaaaaattgtaaatcatatgtacaagatattgttgataaaaaaaaaaaaggaaatgtagctataggaagatatttacataaagttttttcaaatgatccttttatatcagtagaaaaatttgattctataaatgaaagtattttacaagataatttaatgatttcatatttatcaaatttagcacacttacaatttttaattgctgaaaaattaaatacctcttctatgcaataa

SEQ ID NO: 19367 - protein, 302 aa, Plasmodium yoelii yoelii
MSSMLKDKTPQYFDIQPHTNIKCIVHPSVIFTILDSYLRRDEDQTHVIGTLMGSIIDTNLVEISDCFVDKHSLNEGGFLQIIKDHHETMYELKQKIRPRDQVVGWFCSGSELSELSCAVHGWFKEHNSISKFYPHSPLNEPIHLLVDASLESGFLNVKAYVQLPINLVKEYFVHFHEIQIELLPCNIERADVAKITEKITKGGDKEKLLNNEIDENSLKKLLIMLKNCKSYVQDIVDKKKKGNVAIGRYLHKVFSNDPFISVEKFDSINESILQDNLMISYLSNLAHLQFLIAEKLNTSSMQ

SEQ ID NO: 19368 - DNA, 963 bp, Plasmodium falciparum
  CDS (1)..(963)
atgagtattaatcgatataattataaaacaatgaatagtttattgaaggataaaatccctcaacattttgacatcttacctcatacgacgataaaatgtattattcatccttctgttatttttaccattttagatgcatatttaagaagagatgaagatcaaacgcatgtgataggaacattaatgggttcagtgattgatacgaacctggttgaaatttcggattgttttgtcgataagcattcattaaatgaaggaggttttttacaaataattaaagatcaccatgaaacgatgtatgagttgaaacaaaaaatacgtccaagagatcaagttgttggatggttttgttcaggttctgaattatctgaactttcatgtgctgtacatggatggttcaaagaacacaattctatatcaaaattttatccacatacccctttgaatgaacctatacatttattagttgatgctagtttagaaagtggttttttaaatattaaagcatatgttcaattacccatatccttagtgaaggattattttgtacatttccatgaaatacaaacagaattattaccatgtaatgttgaaagagctgatgtttcattagttaaaggaaatatacatgcacataaggataaccatacaaataatttagaacataatcataataataaccaaatagatatgaatgaattatcattaaaaaagttattaattatgttaaaacaatgtaaatcatatgttcaagatgttattgatcaaaaaaaaaaaggaaatattagtgttggaagatatttacataaagtattatctaacgatactttcttaaccttagaaaagtttgattcaattaacgaaagtgttttacaagataatctaatgatttcctacttatcaaatttggcaaatttacaattcttaattgcggaaaagttgaactcatcatctttacaatga

SEQ ID NO: 19369 - protein, 320 aa, Plasmodium falciparum
MSINRYNYKTMNSLLKDKIPQHFDILPHTTIKCIIHPSVIFTILDAYLRRDEDQTHVIGTLMGSVIDTNLVEISDCFVDKHSLNEGGFLQIIKDHHETMYELKQKIRPRDQVVGWFCSGSELSELSCAVHGWFKEHNSISKFYPHTPLNEPIHLLVDASLESGFLNIKAYVQLPISLVKDYFVHFHEIQTELLPCNVERADVSLVKGNIHAHKDNHTNNLEHNHNNNQIDMNELSLKKLLIMLKQCKSYVQDVIDQKKKGNISVGRYLHKVLSNDTFLTLEKFDSINESVLQDNLMISYLSNLANLQFLIAEKLNSSSLQ

SEQ ID NO: 19370 - DNA, 1017 bp, Plasmodium falciparum
  CDS (1)..(1017)
atggataatgatatttttgaaaaaaacagaaatgtacttgaaagaatatatttaaacaaacatgtagttgtacatccaatagttttactatcagttgttgatcactataatcgtattgcaagtaatacaaaaaagagagtcttgggaacaattcttggagaaaaaattgatggtgtagtacatattaccaacagctatgcacttccttttgaagaagatataaaagatatcaacattttttatattgatgataattataatgaaaatctttttaatatgataagaaaaattaatacaagagaaaaaattgtcggatggtatactacaggatccaatattaaaccaaatgatatttttattaatgaaatcttttataaatatcatcacgcacctatattcctacttgtaaatgttcatacagatcaaagcatatttccagttaatgcatacgtagctattgaaaaagctatacatgaaaataaattcagaaaaacattcatacatataccagttaaaataggagcttttgaggctgaagaagtaggtgttgaatttttactaaaagaattaaagagcgtctccacttcaaccttagccacaaaagtaggtgataagttatcgtccttaaaaagtttgatagcaaaattatacgaaatatcagcttatttgaatgatatattaaatgggaatattgaaatgaatataaaaatattatacaatttacaaaatgtgtttagtcttttaccggatattgaaaacgtcgatttagtacaggcatttatggttaagaataatgacttaatgttaaatatatatataggtagtataacacgatctgttattgctcttcacaatttaatcaataataaaattgagaataaattgaattcggaaaaaaaaaaatctttagaaaatgatatagaaaaggacaaaataaaagataaggaaaaagaaaaggaaaaggaaaaagataaggaaaaagaaaatgataaggcaaaaaaggacaagaaaaattaa

SEQ ID NO: 19371 - protein, 338 aa, Plasmodium falciparum
MDNDIFEKNRNVLERIYLNKHVVVHPIVLLSVVDHYNRIASNTKKRVLGTILGEKIDGVVHITNSYALPFEEDIKDINIFYIDDNYNENLFNMIRKINTREKIVGWYTTGSNIKPNDIFINEIFYKYHHAPIFLLVNVHTDQSIFPVNAYVAIEKAIHENKFRKTFIHIPVKIGAFEAEEVGVEFLLKELKSVSTSTLATKVGDKLSSLKSLIAKLYEISAYLNDILNGNIEMNIKILYNLQNVFSLLPDIENVDLVQAFMVKNNDLMLNIYIGSITRSVIALHNLINNKIENKLNSEKKKSLENDIEKDKIKDKEKEKEKEKDKEKENDKAKKDKKN

SEQ ID NO: 19372 - DNA, 1053 bp, Homo sapiens
  CDS (1)..(1053)
atggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggaactgtcgacaaacactcagtggaggtcaccaattgcttttcagtgccgcacaatgagtcagaagatgaagtggctgttgacatggaatttgctaagaatatgtatgaactgcataaaaaagtttctccaaatgagctcatcctgggctggtacgctacgggccatgacatcacagagcactctgtgctgatccatgagtactacagccgagaggcccccaaccccatccacctcactgtggacacaagtctccagaacggccgcatgagcatcaaagcctacgtcagcactttaatgggagtccctgggaggaccatgggagtgatgttcacgcctctgacagtgaaatacgcgtactacgacactgaacgcatcggagttgacctgatcatgaagacctgctttagccccaacagagtgattggactctcaagtgacttgcagcaagtaggaggggcatcagctcgcatccaggatgccctgagtacagtgttgcaatatgcagaggatgtactgtctggaaaggtgtcagctgacaatactgtgggccgcttcctgatgagcctggttaaccaagtaccgaaaatagttcccgatgactttgagaccatgctcaacagcaacatcaatgaccttttgatggtgacctacctggccaacctcacacagtcacagattgcactcaatgaaaaacttgtaaacctgtga

SEQ ID NO: 19373 - protein, 350 aa, Homo sapiens
MATPAVPVSAPPATPTPVPAAAPASVPAPTPAPAAAPVPAAAPASSSDPAAPGQTPASAQAPAQTPAPALPGPALPGPFPGGRVVRLHPVILASIVDSYERRNEGAARVIGTLLGTVDKHSVEVTNCFSVPHNESEDEVAVDMEFAKNMYELHKKVSPNELILGWYATGHDITEHSVLIHEYYSREAPNPIHLTVDTSLQNGRMSIKAYVSTLMGVPGRTMGVMFTPLTVKYAYYDTERIGVDLIMKTCFSPNRVIGLSSDLQQVGGASARIQDALSTVLQYAEDVLSGKVSADNTVGRFLMSLVNQVPKIVPDDFETMLNSNINDLLMVTYLANLTQSQIALNEKLVNL

SEQ ID NO: 19374 - DNA, 777 bp, Encephalitozoon cuniculi
  CDS (1)..(777)
atgagcgaggtcatagtccatccattggtactactttccgcagttgaccactacaaaagaaagggaactaagagagttgctggcatattgcttggggacgacgatggggagattcacatcacagagagctttgcctgcatatttgaagaggacgaagatggatggttcatggacacctcgtacataagaagcatgtttgatctgttctacaaggtcaatcataagcttaaggtgatgggatggtaccacacaggccccaggatgtatgaaaacgaccttgacataacgagatcgctgggcagcttcgtggaaagcccgttccttgccatcatcaatgttcacctcggagaaaacgatcttcctgtccagacattcaagctggatgaacaggacgagtttgtacatgttggatgcagtatagaggccgaggaggccgaggaggttggagtcgagcatctgataagagacatcagagaagaggcaagtggatcgattgcagcccggatcaacggaataaaagaatcattggcggtctacagaggggttcttggtgagataagatcctatctcaatgatgtaataagtggagacattcatctgaaccaggagatcatcaatctctgccaagaaatcatcaattcgactccaaagctagaaagacctcttgacgagaatctttctgattgctatgtctctgtgcttgccaagactgtggttgcattgaatgaccttagaaagaataggcttgagagtgggattgagacgagtgcatcgtaa

SEQ ID NO: 19375 - protein, 258 aa, Encephalitozoon cuniculi
MSEVIVHPLVLLSAVDHYKRKGTKRVAGILLGDDDGEIHITESFACIFEEDEDGWFMDTSYIRSMFDLFYKVNHKLKVMGWYHTGPRMYENDLDITRSLGSFVESPFLAIINVHLGENDLPVQTFKLDEQDEFVHVGCSIEAEEAEEVGVEHLIRDIREEASGSIAARINGIKESLAVYRGVLGEIRSYLNDVISGDIHLNQEIINLCQEIINSTPKLERPLDENLSDCYVSVLAKTVVALNDLRKNRLESGIETSAS

SEQ ID NO: 19376 - DNA, 1467 bp, Arabidopsis thaliana
  CDS (238)..(1191)
aagatttatattcaaattataaatatatactaaaacgctaaaaaattaagtacatgctataatcttttccattatttttctaacaaaagaaagttatatatgggctaaacttagaaggaaagcccaagaggccaagactatataaagattcatgacccgagtttaagatccgatttcagaatttgggactaaaggaggacaacgacaagcgccgggaaaaaatcgagagcgacaacaatggcgccttcttcgtcgagcggtctcacgttcaagctacatcctctggtgatgcttaacatatccgatcacttcactagggttaaaactcagcttaatcctcccgccgcttcttgcgccaccgggaatggctccaacaacgccgacgcgatgttactgcaaaaccctagggtttatggctgcgtcatcggtctccagagaggtcgtacggttgagatcttcaacagtttcgagctgatattcgatcctgctcttgatactctcgacagatccttcctcgagaagaagcaagaactctataagaaggtgttccctgacttctacgtattgggatggtattctacgggaagtgacgctaccgaatctgatatgcatatccacaaagctctgatggacattaatgaatctcctgtgtatgttcttttaaatcctgctatcaatcatgcacagaaggatcttcctgtgactatctacgaaagcgaatttcatgtcattgatggaattcctcagtcgattttcgtgcataccagctacacaattgagacagttgaagctgaaagaatatctgttgatcatgttgcacatcttaagccatctgatggaggctcagctgcgactcagttggctgctcatcttactggaatacatagtgccatcaagatgcttaatagcagaatcagagtgctataccagcatattgtcgctatgcagaaaggtgataaaccttgtgagaactcagttctgagacaagtatctagtctgctcagaagtttgcctgccgcagaatcagagaagttcaatgaaaatttcttgatggagtacaacgacaaattgctgatgtcttacctagcaatgatcacgaattgtaccagcaacatgaacgaggtggttgacaaattcaacactgcatacgacaaacacagccgaagaggtggtaggactgcgttcatgtaaagattagtttcaatgtaaaaaaaccttttctttcttttggtggtctggtccctaagtgaaaatttagaactcttttaaggcatttcacttttcggaaccaaacaaacagctaggaagcttttcttctgtttaagctttgtctagacagaagctaagtttaggcctaactaaattttgcgacaagactgtaaaaacaaaacagcttttaccttctctcaatttttcatttattcaaaaatttgagcaatcagtgaacaaagagatttgtttcatatc

SEQ ID NO: 19377 - protein, 317 aa, Arabidopsis thaliana
MAPSSSSGLTFKLHPLVMLNISDHFTRVKTQLNPPAASCATGNGSNNADAMLLQNPRVYGCVIGLQRGRTVEIFNSFELIFDPALDTLDRSFLEKKQELYKKVFPDFYVLGWYSTGSDATESDMHIHKALMDINESPVYVLLNPAINHAQKDLPVTIYESEFHVIDGIPQSIFVHTSYTIETVEAERISVDHVAHLKPSDGGSAATQLAAHLTGIHSAIKMLNSRIRVLYQHIVAMQKGDKPCENSVLRQVSSLLRSLPAAESEKFNENFLMEYNDKLLMSYLAMITNCTSNMNEVVDKFNTAYDKHSRRGGRTAFM

SEQ ID NO: 19378 - DNA, 1308 bp, Oryza sativa
  CDS (127)..(1059)
agagagaggccgcgccgccgcagatctgtggccgcgttagggtttcttcgccggaatcgagcgaggaagtaggagggagaggaggaggaggaggagggcgacgagtaggaggcggcggcggcggagatggacgtggtgaaggcggcgcacgtctcggggcggacgctggagaaggtggtggtgcacccgctggtgctgctcagcatcgtcgaccactacaaccgcgtcgcccgcgacacccgcaagcgcgtcgtcggcgtgctcctcggcacctcctcccgcggttccgtcgatgtcaccaactcctacgccgtgccgtttgaagaggatgacaaggatccgaggatctggttcctcgatcataattaccacgaatcgatgttttccatgttcaagaggatcaacgccaaggagcatgttgttggctggtacagcaccggtccaaaactcagggagaacgacttggatatacacgcactattcaataactatgttcctaaccctgtcctggtgattattgatgttcaacccaaggagttaggaatacccaccaaagcatactatgctgtggaggaggttaaagagaatgctactcaaaaaagtcaaaaggtgtttgttcatgttccttcagaaatagctgcccacgaggttgaggaaatcggagttgagcatcttctgagggatgtcaaggacacaacaataagcacgcttgcgacagaggtaaccagcaagcttgcagccttgaaaggactggacgcaaggctcagggagatccgtgggtacttagatcttgtaattgaagggaagctcccactgaatcatgagattttgtaccacttgcaggatgtgtttaatctgctccccaatctcaatgtaaacgagcttattaaagcctttgcagttaaaacaaacgatatgatgttggtcatatacttgtcttctcttatccggagtgtcatcgcactccataacttgatcaataacaagatgctaaacaaggagcatgagaaagccgaggattcgaagccaaccgccatacctagtgctgctgggagctgaatgtgctttatttgccttagattttggacccagtggaagccaaaagaattgtgacatgttagcatgatggcgtttgaaccaattgtctttgaccttggttttacactttcgatgtttatttcatgtacgataaggtcaacggcaaactttacattctgtgagcttaggtcatactacctcttgagctttcatcttgatcttatatacaatgtttcatggggtgcaaaaaaaaaaaaaaaaaaaaaaaaa

SEQ ID NO: 19379 - protein, 310 aa, Oryza sativa
MDVVKAAHVSGRTLEKVVVHPLVLLSIVDHYNRVARDTRKRVVGVLLGTSSRGSVDVTNSYAVPFEEDDKDPRIWFLDHNYHESMFSMFKRINAKEHVVGWYSTGPKLRENDLDIHALFNNYVPNPVLVIIDVQPKELGIPTKAYYAVEEVKENATQKSQKVFVHVPSEIAAHEVEEIGVEHLLRDVKDTTISTLATEVTSKLAALKGLDARLREIRGYLDLVIEGKLPLNHEILYHLQDVFNLLPNLNVNELIKAFAVKTNDMMLVIYLSSLIRSVIALHNLINNKMLNKEHEKAEDSKPTAIPSAAGS

SEQ ID NO: 19380 - DNA, 1160 bp, Arabidopsis thaliana
  CDS (48)..(929)
aaatctccactctctcgcgccttttaccccttctcagaatcttaaccatggcggcgacgagcgagcacaccatcttgcaatttgtgtctccgtcatcaacggcgtccgctacaacctctgtactcacggcgaggatccaccctctcgttatctttaacgtctgtgattgcttcgtgagacgtcctgactcagctgaacgagtcatcggaactctcctcggatctatcttacctgacggaaccgtcgatatccgcaattcatacgccgtccctcacaatgaatcatccgatcaggttgctgtggatattgattaccaccacaatatgttagcttcacaccttaaggtgaattcaaaggaaactattgtcggctggtattcaactggtgctggggttaatggcggtagttcgctgattcatgatttctatgctagagaagtacccaacccaattcacctaactgtggatactgggtttactaatggtgagggtactatcaaagcttttgtctcttcaaacctctcactcggtgatcgacaactcgttgcacattttcaagagattcctgttgatctccgcatggttgatgctgagagagtcggattcgatgtacttaaggcaacatctgttgacaaactcccaaatgacttggaaggaatggagttaacaatggagaggctgttaactctaatcaacgatgtctacaaatatgttgacagtgtcgtgggaggtcaaatagctccagacaacaacattggacgattcattgcagatgcagtagcctcccttcccaagttacctccacaagtcttcgataacctcgtgaataatagtctccaggaccaattgcttctgttgtacctatcaagcataacaaggacacagttgagtctagcggagaagctaaacacagctgctcaaatgctataataagcttggaaacacaaggttttgctaaaaatggggaatgctgcttttttggtttcgaattttcttttaacaagtttatgtaagaatcagcttcttgttgtagtgttcctaaattgcaagtttaagaaagacaaaatgctctgtttcgtgaattaaggtctttaaaagggatttttagttggtgtgcctaattttaaacaatatacatataaatgagctttgttctttttt

SEQ ID NO: 19381 - protein, 293 aa, Arabidopsis thaliana
MAATSEHTILQFVSPSSTASATTSVLTARIHPLVIFNVCDCFVRRPDSAERVIGTLLGSILPDGTVDIRNSYAVPHNESSDQVAVDIDYHHNMLASHLKVNSKETIVGWYSTGAGVNGGSSLIHDFYAREVPNPIHLTVDTGFTNGEGTIKAFVSSNLSLGDRQLVAHFQEIPVDLRMVDAERVGFDVLKATSVDKLPNDLEGMELTMERLLTLINDVYKYVDSVVGGQIAPDNNIGRFIADAVASLPKLPPQVFDNLVNNSLQDQLLLLYLSSITRTQLSLAEKLNTAAQML

SEQ ID NO: 19382 - DNA, 1595 bp, Trypanosoma brucei
  CDS (236)..(1381)
ttaaacagtttctgtactatattgtaggagccagagagacgcattaaaaaaaaaaagaaggaaggaagggagcgaggggaaaatagtgatcagaagttaggttagtgagggaacaaaaggagagcggtggacttgcactgttctttttgtgaggactgtgtttcacttttagtcgtcgtagtcgtcatcgttgttgttgttatttggtttcccatatactatactcttatagctaatggccaatgatgaccccaaggaaccgcaaactgcggtagtcaatcctgaagtggatcaacaggacacatccgtcaatggggacgacggcgacgcggaacgtgatggtggaaaagatgttccggtatttactcctgcgggggcacgagtagaggttcacccacttgttttgctctcacttgtcgaccactacgcccgtgttaacgcaaaagtgtcacaaaagcgacgtgtcgctgggcttcttctcggccgtcacctcagccaccctggtggaatacaagtgcttgacattaacaacagtttcgctgttccgtttgatgaggaccctcagaatcctgatgtctggtttctcgatacaaactatgcagaggaaatgttcctaatgtttcgtcgcgtacaccccaaggtgcggattgttgggtggtattctgcaggtccctcgtgcgcggtgcagccgaatgacatgctcttgcacctccttattgcagatcgcttctcgctgaatccggtgtactgcattgtgaatacagatcctaacaacaaaggtgtgcccgtgctggcttatacgacggtgcatggccgagacggggcgcgatcgttggagtttcgcaacatccccacacatctcggcgcggaagaggcggaggaaatcggtattgaacatctcttgcgggatcttaccgactccaccatcacaacactttccgcccaggtccaggagcgtgagctttcacttggccacctcggtcgtgttctgcagtcaattgaggagtatcttaatgacgttgcagagggtaccatgcccatctcagaggatgttttgagtgtcttgcaggaagttatcagcctgcagccgcacatttatcacttgaagacatcaactgacatggtgcggcatgcaaatgatcaggcgattgcaatgttcatcgccgccattgggcgatgtgtctgcactctctacgacgttattgctaaccgacggcgcatagctcgcgaaatacaggaagtgagagcgcggcgggagcggtcactaaaggaaaagttaggaaacgaacagcacaaggcgaaggaggccgccacggaggaaagtagaaaagaaggtgctgcgaaaaataagaataacggtggaacttcagaagggaagtaactgaatatggatgaaggctgggtaatgcacgcaggtggtgtgggtcatgggttcgcgtttcctttacgcgctgtgcattttggctgcacttcgctgcaacatgggcggtttcctcatatcttttttttcctttcgtgcttggctactctgtgccaaatccgtaccctctgtcttcattctgtttcttcaaggtataaaaaaaaaaaaaaaaaaa

SEQ ID NO: 19383 - protein, 381 aa, Trypanosoma brucei
MANDDPKEPQTAVVNPEVDQQDTSVNGDDGDAERDGGKDVPVFTPAGARVEVHPLVLLSLVDHYARVNAKVSQKRRVAGLLLGRHLSHPGGIQVLDINNSFAVPFDEDPQNPDVWFLDTNYAEEMFLMFRRVHPKVRIVGWYSAGPSCAVQPNDMLLHLLIADRFSLNPVYCIVNTDPNNKGVPVLAYTTVHGRDGARSLEFRNIPTHLGAEEAEEIGIEHLLRDLTDSTITTLSAQVQERELSLGHLGRVLQSIEEYLNDVAEGTMPISEDVLSVLQEVISLQPHIYHLKTSTDMVRHANDQAIAMFIAAIGRCVCTLYDVIANRRRIAREIQEVRARRERSLKEKLGNEQHKAKEAATEESRKEGAAKNKNNGGTSEGK

SEQ ID NO: 19384 - DNA, 1059 bp, Neurospora crassa
  CDS (1)..(1059)
atgcccgccactactgcggaaacgctctccctggtgaaccgcagcgtctcggttgcgccgctggttctgctctcagttgtcgaccactacaaccgtacccaagccaacaagtccaagagcaagcgtgtcgtcggcgtgctattaggccagaatgatggaaagaatgttcgcgtgtccaacagtttcgcggttcccttcgaggaggacgacaaggacccctcagtctggttccttgaccacaactacgtcgagtccatgaacgacatgttcaagaaggtcaatgcgcgcgagaagctaataggctggtaccattccggccccaagctacgggcttccgatctcgacatcaacgagctgttcaagcgctacactcccaacccgcttctggttattgtcgatgtccagcccaaggagacgggcgttcctacagatgcctattttgccgttgacgagatcaaggatgacggcaccactacatccaagacttttgtccacactccctccatcatcgaggccgaagaggccgaggaaatcggcgtcgagcacctccttcgcgacatccgtgacgtagccgtcggcacactatccactcgcatcaccaaccagatgcgctcgctgcaaggcctccaccaccgcctccgcgacatccaagcatatctccaaaaggtccttgacggccagctgcccgtaaaccacgccatcctcggcaacctccaggacgtcttcaacttgctccccaacctctcgacgcccaagtccggtccaggcgctactggaaccaacgccgacagcgagctcaaccacgccatgagcatcaagaccaacgaccagctcatggccatctacctcagcagtctgatccgcgccatcactgcgttccacgacctgatcgagaacaagatccagaacaggcagcagcaggaggagaacgacgccaagaagaaggagggagaaaacggcgagaaaaaggagggcgccgacaagaaggagggtagcccggcggcggcaaatggtgaaagcaaggagaaggagaacagtccgaaagagaagaagaaataa

SEQ ID NO: 19385 - protein, 352 aa, Neurospora crassa
MPATTAETLSLVNRSVSVAPLVLLSVVDHYNRTQANKSKSKRVVGVLLGQNDGKNVRVSNSFAVPFEEDDKDPSVWFLDHNYVESMNDMFKKVNAREKLIGWYHSGPKLRASDLDINELFKRYTPNPLLVIVDVQPKETGVPTDAYFAVDEIKDDGTTTSKTFVHTPSIIEAEEAEEIGVEHLLRDIRDVAVGTLSTRITNQMRSLQGLHHRLRDIQAYLQKVLDGQLPVNHAILGNLQDVFNLLPNLSTPKSGPGATGTNADSELNHAMSIKTNDQLMAIYLSSLIRAITAFHDLIENKIQNRQQQEENDAKKKEGENGEKKEGADKKEGSPAAANGESKEKENSPKEKKK

SEQ ID NO: 19386 - DNA, 1216 bp, Arabidopsis thaliana
  CDS (30)..(983)
gaattcatcaaaggagagagagatcgacaatggcaccttcgtcatcaagcggtttaaccttcaagctacatcctttggtaatcgtcaacatatcggatcactacactagggtcaaaactcagctcaatcctcctgcttcaatctgcgcaagcggccatggctcaaacaacggcgaagcaatgttccagcaaaaccctagggtttacggatgtgtgatcggtgtccagagaggtcgtactgttgagatattcaacagtttcgagcttttatatgatccttctactcaaacccttgatagatctttcctcgagaagaagcaagagctctataagaaggtgttccctgatttctatattctgggatggtactctacgggaagtgatgctgaggaatctgatatgcatatccataaagctttgatggatatcaatgaatctcctgtttatgtgcttttaaaccctgctatcaatcacacacagaaggatcttccagtgactatttatgaaagtgaattgcatgtcattgatggaatcccgcagctaattttcgctcatacaagctacacaatcgagacagttgaagctgaacggatatcagttgatcatgttgcacatcttaaaccatctgacggaggctcagcagcaacccagttggctgctcatcttactggtatacatagtgccatcaagatgcttaatagcagaatcagagtgctttaccaaaatcttgctgcaatgcagaaaggtgataaatcttgtgacaactcagttctgagacaagtatctagcctgctaagaagattgcctgccatggaatcagagagatttcaagataatttcttgatggagtacaacgacaaattactaataacttacctagcgatgattacaaattgttccagcaacatgaacgagatggtcgacaaattcaacaccgcatatgacagaaacactcgaagaggtggaagaactgcattcatgtaaaagatcctttccagcgattctagttctaaagatcttctcttggttcctgaaaccatttttaacattgcctctgtgagaatctataactcagacggcaagactttatcctcttcattgtttctatatctataagaacatctgcttatctatcaaagctcttgtttgatcttgaacaagtttctattgttagtaaaaagattttaaggtttgattctatcagtctctctagttac

SEQ ID NO: 19387 - protein, 317 aa, Arabidopsis thaliana
MAPSSSSGLTFKLHPLVIVNISDHYTRVKTQLNPPASICASGHGSNNGEAMFQQNPRVYGCVIGVQRGRTVEIFNSFELLYDPSTQTLDRSFLEKKQELYKKVFPDFYILGWYSTGSDAEESDMHIHKALMDINESPVYVLLNPAINHTQKDLPVTIYESELHVIDGIPQLIFAHTSYTIETVEAERISVDHVAHLKPSDGGSAATQLAAHLTGIHSAIKMLNSRIRVLYQNLAAMQKGDKSCDNSVLRQVSSLLRRLPAMESERFQDNFLMEYNDKLLITYLAMITNCSSNMNEMVDKFNTAYDRNTRRGGRTAFM

SEQ ID NO: 19388 - DNA, 1281 bp, Caenorhabditis elegans
  CDS (1)..(1281)
atggcattgaacgcaccaagcgggagctgtagctcgaaggtgcttttgcatcctttggttattatgcaaatgtccgaacactactccagaacaaaggtccaacagggtcctactgtgaaaaaagtgttcggagcaattctcggacggcagaatggacgacaagtcgaggcgatcaattcatttgttctgaaaatggagacagaagaaatggctgagccggttacttttagcacggagcatctccttcaaagagcagatcaatatctggaagtgtttcccgagctccaagttatcggtctttattgtgctggggaggatgataatctgactcccgaagagaaacctcttctctcaaaactcaccaatgcggttcgcaattcagagaaagccggacaaatcgacgcgacacttttccttaaactcaactctatcactgctggaaccactcgtaaacttccacttttcgcgtttgaagcagacgtgactgatcaggagaagcataagccaattgaatggattttagtgtcggaagaaagtgaacgtgtcggtgttaatcatatcgctaagttatcaacgaaacatggaaaagacgggaaatcagttggaaagaaacacgcggaggctcaagatgcagcaatgagcatgcttcagaatcgggttgatctaatcgttgcctatctcgaaaaagtgcaagacggaacacttcaaccgaattttgaaattttgaaggaagctaacttgcttgctcaaaagctcaaaaccattgatcgatatgctgctgagttcactgatagtttcgaaaaggaagagaaaacaatgaccgtattctctctgatgccaagattgacaactcttctcggaaatatgcaaaatgtgtggaacaagttgtcagctcaaagagccgatcttctcgccgacgatggattccatggaaaatcgacaagccgttgggctcatccggttcgattcaaatcacaacatctcggtcgtccgcagcaggcagatgatgacgattattttgatgatgaagatttggagaacgatatgagtggaccacggagaaaaattcatgctgctgattctccagctggatcgagaagacgacgtgttccgccaagagcaatgaacttcctcggtcggaattctggtatgcaagccgccacggacgaaatggaattgtcaggtcaagaggaaaatatgggaagcaactatattccagacgttccaagaccatctgcaacagcacacaacgagtcggacgagtcgagtcaagcttcataa

SEQ ID NO: 19389 - protein, 426 aa, Caenorhabditis elegans
MALNAPSGSCSSKVLLHPLVIMQMSEHYSRTKVQQGPTVKKVFGAILGRQNGRQVEAINSFVLKMETEEMAEPVTFSTEHLLQRADQYLEVFPELQVIGLYCAGEDDNLTPEEKPLLSKLTNAVRNSEKAGQIDATLFLKLNSITAGTTRKLPLFAFEADVTDQEKHKPIEWILVSEESERVGVNHIAKLSTKHGKDGKSVGKKHAEAQDAAMSMLQNRVDLIVAYLEKVQDGTLQPNFEILKEANLLAQKLKTIDRYAAEFTDSFEKEEKTMTVFSLMPRLTTLLGNMQNVWNKLSAQRADLLADDGFHGKSTSRWAHPVRFKSQHLGRPQQADDDDYFDDEDLENDMSGPRRKIHAADSPAGSRRRRVPPRAMNFLGRNSGMQAATDEMELSGQEENMGSNYIPDVPRPSATAHNESDESSQAS

SEQ ID NO: 19390 - DNA, 1239 bp, Homo sapiens
  CDS (40)..(1086)
ccatgactatctttattcacactcttctctgagcctgaaatgctccactcctcctttccaacctcccaccctcacccctaccccattccctcctcacgccccctgccccctgccccgtgttcatgccctgtgctggctctgcctccacacctgcctgctgcctcccacagagcccgcaaggcaggaacccagaccctggcctcagcacaagctccagtgcagaccccagcacccactctgcctggtcctgctcttccagggcccttccctggtggccgtgtggtcaggctgcacccagtccttttggcctccactgtggacagctatgagagacgcaacaagggtgctgcccgagttatcgggaccctgttgggaactgtcaacaaacactctgtggaggtcaccaattgcttttcagtgtcatacaatgagtcagatgaagtggttgttgacatggaatttgctaagaacatgtatgaactgcataaaaaagtttctccaaatgagctcatcttggggtggtacgctgccggccatgacatcacagagcactctgtgctgatccatgagtactacagccgagaggcccccaaccccatccacctcactgtggacacaagtctccagaacggccatatgagcatcaaagcctatgtcagcactttaatgggtgtccctgggaggaccgtgggagtgttcacacctttgacagtgaaatatgcatactatgacactgaatgcatcagagttgacctgatcatgaagacctgctttagccccaacagagtggttggactctcaagtgacctgcagcaagtaggaggggcatcagctcacatccaggatgccctgagcatagtgttgcaatatgcagaggatatactatctgcaaaggtgtcagctgacaatacaatcaggaaggtgggccacttcctgatgagcctggttaaccaagtaccgaaaatagttcccgatgactttgagaccatgctccacagcaacatcaatgacctgttgatggtggcctacctggccaacctcacacagtcacagattgccctcaatgaaaaacgtgtaaacctgtgaagccaccccaagcagtacgcttgctggtctaagtcttaaccccaggactcagaagtgaaggaaaaatgggttttttgtggtcttgagtcacactgagacagtcaactgtgtgtgactctaataaacgtagcctaccttttgtaaattaaagaa

SEQ ID NO: 19391 - protein, 348 aa, Homo sapiens
MLHSSFPTSHPHPYPIPSSRPLPPAPCSCPVLALPPHLPAASHRARKAGTQTLASAQAPVQTPAPTLPGPALPGPFPGGRVVRLHPVLLASTVDSYERRNKGAARVIGTLLGTVNKHSVEVTNCFSVSYNESDEVVVDMEFAKNMYELHKKVSPNELILGWYAAGHDITEHSVLIHEYYSREAPNPIHLTVDTSLQNGHMSIKAYVSTLMGVPGRTVGVFTPLTVKYAYYDTECIRVDLIMKTCFSPNRVVGLSSDLQQVGGASAHIQDALSIVLQYAEDILSAKVSADNTIRKVGHFLMSLVNQVPKIVPDDFETMLHSNINDLLMVAYLANLTQSQIALNEKRVNL

SEQ ID NO: 19392 - DNA, 1417 bp, Arabidopsis thaliana
  CDS (100)..(1032)
aagttccgtcggagataaaacggaatcaaaagttgaggttttgatcattcccggagaaagaaatttagaattactcaagcgaatttgattaacccaacaatggatgttataaagacgcaacaaatatcggcaaggacaatcgagaaagtgatcgttcacccacttgtcttgcttagtatcgtcgaccattacaatcgtgtagccaaggacacgagcaagcgcgtcgtcggcgttttgctcggaagtagctctcgtggtactgttgacgtcaccaacagctacgcagtgccttttgaggaggatgacaaagacacaagcatatggtttcttgatcacaactaccacgagtcgatgtttcacatgttcaagagaattaatgctaaggagcatattgtgggttggtacagcacaggtcctaaacttcgagagaatgatttggatgttcacgctttattcaatggctacgttccaaatccagtgttggtcattattgatgtccaacctaaagaacttggaatccccacaaaagcatactatgcggttgaggaggtgaaagagaatgctacccagaaaagccaacaggtttttgtacacgtgcctacagaaattgcagctcatgaagttgaggaaattggtgtggaacatttgctcagggatgtaaaagacacaaccatcagtaccttggcaactgaggtcactgcgaaacttactgctctgaagggattggatgcacgacttcgggagatccggacttaccttgaccttgtaatcgaaggaaaactcccattaaaccatgaaatcttataccatcttcaggacgtattcaacttgcttcctaacttgaacgtcaacgagttggttaaagcctttgcagtaaaaacaaatgacatgatgctcgtaatctacctttcttcgcttatccgaagtgtaatcgccctccacagtttgatcaacaacaagttgttgaataaggaacatgaaaaagcagaggactcaaagcctgttgacatacccttaatcactgagagttaaatgcagccaaatttcgagctttgggaagatatttaatcggatgttactctgtcatttgctgcatgtgaagagggtctgtaggggaacaaaacgggtttggtctcgttccgatgatcttctattactgttgtttctacaatggttgttattagtatgtcgtttctgtctccaaagattcttttttcatcgatttttatttctagtttccctaattctgatcttcaaggcaatcaagtcatagaagataacacttaccatagtttaaaatttagaaaatcactaaattagattcgtatacatcggatgtgtagagatctagtccggggttataaaaatgttatcaaaacaaagtgtgtgaacgtgtgttcacattgatagaggaata

SEQ ID NO: 19393 - protein, 310 aa, Arabidopsis thaliana
MDVIKTQQISARTIEKVIVHPLVLLSIVDHYNRVAKDTSKRVVGVLLGSSSRGTVDVTNSYAVPFEEDDKDTSIWFLDHNYHESMFHMFKRINAKEHIVGWYSTGPKLRENDLDVHALFNGYVPNPVLVIIDVQPKELGIPTKAYYAVEEVKENATQKSQQVFVHVPTEIAAHEVEEIGVEHLLRDVKDTTISTLATEVTAKLTALKGLDARLREIRTYLDLVIEGKLPLNHEILYHLQDVFNLLPNLNVNELVKAFAVKTNDMMLVIYLSSLIRSVIALHSLINNKLLNKEHEKAEDSKPVDIPLITES

SEQ ID NO: 19394 - DNA, 983 bp, Drosophila melanogaster
  CDS (123)..(983)
attttggcacgtgcccttttaagttatatttacattttacaacactggatcgaggggaggcacaagcgcagccaagtttgctttgctaagtttcttttccaacttaattttttttgtaactcatgatgtctaggaattttagcatgcgagctaaggtgtatctaaagccgttggtgtttttccaaattattgacgcatacgatcgccgaccaaaaggtgacaatcaggttatgggcactttgctgggtcgcaacaaggagggccacatcgagatcacaaactgttttactgtgccgcacaaggagcattcggagaacaaacgcattgatctggatatggcatatgcctccgaggtcctagagctaaatatgttcgcctatccgaacgagcgtgtgctgggctggttctgcactgggaaatcggtgtcccgctccgcgtccctgatccacgactattatgtcagagaatgctgcgaaggacagccactgcacctgctagtggatgcagccctgaagaaccagcgactctcgacccgactgtactgtgctgtggagatgggagtgcctggtggcaccaaaggactgatgttctcattagttccactggagattagcaacgaaaattccgatttggtggctctgcgttgcatagaaaagcaatcgcagcaacaggcaagcaagcaaatggagcgcttcgtcccagagttggctcaagtggtggatgccactagggatatgcaacatcgccttgacttggtgctgcgctacatcaacgatgtcttggccaggaagaaaaaacctgacaacgtagtcgggagatccctttacgccgctctcactgccgtgccgcttttggactcggacaaatttcgcgtcatgtttaatactaacttgagggatatgctcatggccatcactctttccacaatgataaaaacacagctggagatcagcgagaaactgtcttgcatgcaggatcagtga

SEQ ID NO: 19395 - protein, 286 aa, Drosophila melanogaster
MMSRNFSMRAKVYLKPLVFFQIIDAYDRRPKGDNQVMGTLLGRNKEGHIEITNCFTVPHKEHSENKRIDLDMAYASEVLELNMFAYPNERVLGWFCTGKSVSRSASLIHDYYVRECCEGQPLHLLVDAALKNQRLSTRLYCAVEMGVPGGTKGLMFSLVPLEISNENSDLVALRCIEKQSQQQASKQMERFVPELAQVVDATRDMQHRLDLVLRYINDVLARKKKPDNVVGRSLYAALTAVPLLDSDKFRVMFNTNLRDMLMAITLSTMIKTQLEISEKLSCMQDQ

SEQ ID NO: 19396 - DNA, 1213 bp, Drosophila melanogaster
  CDS (118)..(1143)
agtactgagagaccaccaataacgataacgacagcttataccggagcttgtcaaacaaaaagaagtaaaattaagtttataccgcaaactacgtgtaaataaaggccccccgacagcatggagcaaatggaagtggacgttgacatgtcggccaagcccagcacatcgtcctccgccgccgccgggagcagtatggcagtggataagactgcggatcaaaacccacagccgcagggaaacataatggctgcagcgggcaccagtggttctgtgaccatatcgctgcatccgctggtcataatgaacatctccgagcactggacacgctttcgtgcacagcacggtgagccgcgacaggtgtacggagcactgattggcaagcagaagggccgcaacattgagattatgaactcgttcgaactgaagacggacgttattggcgatgaaacagtgatcaacaaggactactacaacaagaaggaacaacagtacaagcaggtgttcagtgatctcgacttcataggctggtacacaaccggcgacaatcccactgccgatgacattaagatccaaagacagatagccgccatcaacgagtgccccatcatgctacagctgaatccgctctcccgcagcgtcgaccaccttcccctgaagctattcgagtccctaatcgatctggtggacggcgaggccaccatgctgttcgtgcccctcacctacacactggccaccgaggaggcggagcgcattggtgtggatcatgtggcgcgcatgacctcgaacgagtccggcgagaagagcgtggtggcggagcatttggtggcccaggacagtgccattaagatgctaaatacacgcatcaagatcgtgctgcagtacatacgcgatgtggaggccggaaagctgcgggccaaccaagagattctgcgagaagcctacgctctctgccaccgactgcccgtcatgcaggtgcccgccttccaggaggaattctacacgcagtgcaacgatgtgggactgattagctacctgggcacgctgaccaagggctgcaatgatatgcaccactttgtgaacaagtttaatatgctgtacgaccgccagggatccgcgcgccgcatgcgaggtctctactattgatatatgcaaacaatctattaaagcttcggagataaatacacataatcgtacgatgaaaaaaaaaaaaaaa

SEQ ID NO: 19397 - protein, 341 aa, Drosophila melanogaster
MEQMEVDVDMSAKPSTSSSAAAGSSMAVDKTADQNPQPQGNIMAAAGTSGSVTISLHPLVIMNISEHWTRFRAQHGEPRQVYGALIGKQKGRNIEIMNSFELKTDVIGDETVINKDYYNKKEQQYKQVFSDLDFIGWYTTGDNPTADDIKIQRQIAAINECPIMLQLNPLSRSVDHLPLKLFESLIDLVDGEATMLFVPLTYTLATEEAERIGVDHVARMTSNESGEKSVVAEHLVAQDSAIKMLNTRIKIVLQYIRDVEAGKLRANQEILREAYALCHRLPVMQVPAFQEEFYTQCNDVGLISYLGTLTKGCNDMHHFVNKFNMLYDRQGSARRMRGLYY

SEQ ID NO: 19398 - DNA, 843 bp, Drosophila melanogaster
  CDS (1)..(843)
atgtcggctctcaatctgaccgtgcgcgtgcacccggtggtgcttttccaggtggtggacgccttcgagcggcggaacgcggactcgcaccgcgtcatcggcaccctgctcggctctgtggacaaaggtgtggtggaggttaccaactgtttctgtgtgccgcacaaggagcacgatgaccaggtggaggcagagctgagctacgccctggacatgtacgacctcaaccgcaaggtgaactccaacgagagcgtggtaggctggtgggccaccggcaacgacgttaccaaccacagctcggtgatccacgagtattacgcccgcgaatgcaacaacccggttcacctcaccgtggacacttcgctgcagggcggacgtatgggtctgcgtgcttatgtctgcattcaactaggagttcccggcggcaagagcggctgcatgttcacgcccattcctgtcgagctgaccagctacgagccggagacatttgggctcaagctgcttcagaagaccgtaggcgtttcgcccgctcaccgtcccaagaccgttccgccaatgctggacctggcccaaatctcggaggcctccacgaagctgcagtccctgctggatcttattctcaagtacgttgacgacgtgatcgctcacaaggtaacccccgacaacgccgtcggacgccagctgctagaccttatccactccgtgccgcacatgacccacgagcagttcactcagatgttcaacgccaacgtacgcaaccttctgctggtcatcacgctctcccagctcatcaaaacccagctgcagcttaacgaaaagctcaccttcctgcccaccgcctag

SEQ ID NO: 19399 - protein, 280 aa, Drosophila melanogaster
MSALNLTVRVHPVVLFQVVDAFERRNADSHRVIGTLLGSVDKGVVEVTNCFCVPHKEHDDQVEAELSYALDMYDLNRKVNSNESVVGWWATGNDVTNHSSVIHEYYARECNNPVHLTVDTSLQGGRMGLRAYVCIQLGVPGGKSGCMFTPIPVELTSYEPETFGLKLLQKTVGVSPAHRPKTVPPMLDLAQISEASTKLQSLLDLILKYVDDVIAHKVTPDNAVGRQLLDLIHSVPHMTHEQFTQMFNANVRNLLLVITLSQLIKTQLQLNEKLTFLPTA

SEQ ID NO: 19400 - DNA, 1490 bp, Drosophila melanogaster
  CDS (220)..(1236)
gccttgaaataaattcagaaagcgaggcgtcggccacactgtaaatcgtttctgcttgtcattttggcctgagttttttgccgcaaattgcaggtaatttagcgaaaaacaggagtcgcaggaagccaaacccgtcgaaaacaaatcagtccggtacctatcaatcggcgcagaggtcatagtaagcccccgaaccgaaaacccagaaaaagcacaaacatgccgtcgcaggaggtgagcgtaaacaaagtgatagtgcatccattggttctgctgtccgtggtggatcacttcaaccggatgggaaagattggcaaccagaagcgcgtagtgggagtccttctgggctgctggcgatccaagggagtgctcgatgtgtccaacagcttcgcagtgcccttcgacgaggatgacaaggacaagtcggtgtggttcctggaccacgactacctggagaatatgtacggcatgttcaaaaaggtgaacgccagggaacgggttgtgggatggtatcacacaggtcccaagctccaccaaaacgacatagccatcaacgagctggtccggcgctattgtcccaactccgtgctggtcatcatcgacgccaagcccaaggatttgggcctgcccacagaggcgtacatatcggtggaggaagtccatgacgacggctctccgaccagcaaaactttcgagcatgtgcccagcgagattggcgccgaggaggcggaggaggtgggcgtggagcatctgctgcgtgacatcaaggacacaaccgtgggcagcctgtcgcaaaagatcaccaaccagctcatgggtctgaaaggcctgaatgcccagctgcgggacataaagcagtatctgcagcgcgtcggcgacagcaagatgccaatcaaccaccagattgtctaccagctgcaggacatcttcaacctgctgcccgatataaccaatgaccagttcacgggcacaatgtatgtgaagaccaacgaccaaatgctagtcgtctacctggcctccatggtgcgctcgatcattgccctgcacaacctgatcaacaacaagctggccaaccgcgacgccgaggagggcaagagcgacagcaaggaggccaaggagaagaataaggatagcaaggataaggacaacaaggagaccaaggacaaggacggcaagaaggcggaggagaaggccgacaagggcaaggacgaaggcggcaagggttcgcgcaaataggagcggaagaaaaagcgcaaaccccgtcgcaaacgaaagaagcagcgggcgcaggactagctgctgcttcttctgttctccaggaagtggaactcatctgcagaccatacggcgagggtgtgcagtggcctcagaaatcaagcattgctaccattcatcgttcattttccacacgaaattaagctccctcttattatttcgcgtaactaactaatggcaagtttatgtaattaaaaattaaataatttaaatac

SEQ ID NO: 19401 - protein, 338 aa, Drosophila melanogaster
MPSQEVSVNKVIVHPLVLLSVVDHFNRMGKIGNQKRVVGVLLGCWRSKGVLDVSNSFAVPFDEDDKDKSVWFLDHDYLENMYGMFKKVNARERVVGWYHTGPKLHQNDIAINELVRRYCPNSVLVIIDAKPKDLGLPTEAYISVEEVHDDGSPTSKTFEHVPSEIGAEEAEEVGVEHLLRDIKDTTVGSLSQKITNQLMGLKGLNAQLRDIKQYLQRVGDSKMPINHQIVYQLQDIFNLLPDITNDQFTGTMYVKTNDQMLVVYLASMVRSIIALHNLINNKLANRDAEEGKSDSKEAKEKNKDSKDKDNKETKDKDGKKAEEKADKGKDEGGKGSRK

SEQ ID NO: 19402 - DNA, 1252 bp, Mus musculus
  CDS (17)..(1102)
tctctttctcggcaagatggcttctccggccgtaccggctaatgtccctcctgccactgcagccgcagccccggcgccggtcgtcaccgcagccccggcttcagccccgaccccatccacgccagctccgacaccggctgcgactcccgctgcgtccccggcgcccgtctcgtctgatcctgctgtagctgcgcctgcagccccgggccagaccccagcctccgcgccagccccagcgcagacgccggcgccttcgcagcccgggcccgccctcccggggcctttcccgggcggccgcgtggtcaggctacaccccgtcattttggcctcgatcgtggacagctacgaacgccgcaacgagggagctgcccgagttattggaaccctgttgggaactgttgacaagcactcggtagaagtcaccaactgcttttcggtgccacacaatgagtcagaagatgaagtggctgttgacatggaatttgctaagaatatgtatgaattacataaaaaagtctccccaaatgagctcatcctaggctggtatgccacaggccatgacatcacagaacactcagtgctgatccatgagtactacagcagggagtccccgaaccccattcacctcacggtggacacaggtctccagcatgggcgcatgagcatcaaggcctatgtcagcactttaatgggtgtccctgggaggaccatgggagtgatgttcacacctctcacagtgaagtacgcgtattatgacactgaacgcattggagttgacctcatcatgaagacgtgttttagccccaaccgggtgattggactctcaagtgacttacaacaagtgggaggggcctcagctcgcatccaggatgctctaagcactgtattacagtatgctgaggatgtgctgtctgggaaagtgtctgctgacaacacggtgggccgcttcttgatgagccttgtcaaccaagtacccaagatagttcctgatgactttgagaccatgctcaacagcaacatcaatgacctgctgatggtgacctacctggccaatctcacccagtcacagattgccctcaacgagaaacttgtaaacctgtgaatgagccccaagaggcacttgtgctggtcgaggttttcaccacagggctgagaccgaagtggaggcaaagggtttctttgtggtcttgagtcacggtgactcagtcagctgcttggactccaaataaacatagcttaccttttgtaaacg

SEQ ID NO: 19403 - protein, 361 aa, Mus musculus
MASPAVPANVPPATAAAAPAPVVTAAPASAPTPSTPAPTPAATPAASPAPVSSDPAVAAPAAPGQTPASAPAPAQTPAPSQPGPALPGPFPGGRVVRLHPVILASIVDSYERRNEGAARVIGTLLGTVDKHSVEVTNCFSVPHNESEDEVAVDMEFAKNMYELHKKVSPNELILGWYATGHDITEHSVLIHEYYSRESPNPIHLTVDTGLQHGRMSIKAYVSTLMGVPGRTMGVMFTPLTVKYAYYDTERIGVDLIMKTCFSPNRVIGLSSDLQQVGGASARIQDALSTVLQYAEDVLSGKVSADNTVGRFLMSLVNQVPKIVPDDFETMLNSNINDLLMVTYLANLTQSQIALNEKLVNL

SEQ ID NO: 19404 - DNA, 1372 bp, Arabidopsis thaliana
  CDS (130)..(1056)
gcaaagtggtttttcctggagaagaagcaaactctcaagctccgtcgggaaaaaaaggaaaaccagatcggaaagttcacgtttttcaaatcttctccggagaaatcagattacttgattcttcaaacaatggatgtgattaagacgcaacagatttcagcaaggacgatcgagaaagtggttgttcatccactagtcttgcttagtatcgtcgaccattacaatcgcgtcgctaaggattcaagcaagcgtgtcgtcggtgttcttctggggagcagctctcgtggtgttgttgatgtcaccaacagctatgcagtgccctttgaggaggatgacaaagacccaagcatctggtttcttgatcacaactaccatgagtcaatgttccacatgttcaagagaattaatgccaaggagcatgttgtaggttggtacagcacaggccctaaacttcgagagaatgatttggatgttcacgcgttgttcaatggctatgttccaaatccagtcctggtcattattgatgtccagcctaaagaacttggaatccctaccaaagcatactatgcagtggaggaggttaaggagaatgctactcagaaaagccagaaagttttcgttcatgtgtctacagaaattgctgctcatgaagttgaggaaatcggcgtggagcatttgctcagggatgtgaaagacacaacaatcagtaccctcgcgactgaggtcactgcaaaacttactgctttgaaggggttggatgcacgtcttcgggagatccggagttatcttgaccttgtaatcgaaggaaagctccctctaaaccatgagattttataccatctacaggacgttttcaacttgcttcctaacctgaatgtgaacgagttggtcaaggccttctccgtgaaaacaaatgacatgatgctcgttatctatctatcatccctcattcggagtgtaattgcgctccacaacttgatcaacaacaagttactgaacaaggaacatgaaaaagcagaggactcaaagcctgtggccatacctgccaccagctagatcaggttttctcgtgacttactgtagtcatcattgcccgcgatgaaggcagctattgtgtgttctcttccccaaaacaaagggtcaagtcagggtgggggaacgaacgagtttagtttgatatcgacattgttgaattctctcagttgttctgattcagaatgtatcaaagagtcttttttcattttatctttcaagttcgttaggcttaggcctcttttgagggggttttgaatacaaaagttcacgtcaatgtgtcgaaatctccacagagatggtcttatcctattgaaattaagattttttttttcacatt

SEQ ID NO: 19405 - protein, 308 aa, Arabidopsis thaliana
MDVIKTQQISARTIEKVVVHPLVLLSIVDHYNRVAKDSSKRVVGVLLGSSSRGVVDVTNSYAVPFEEDDKDPSIWFLDHNYHESMFHMFKRINAKEHVVGWYSTGPKLRENDLDVHALFNGYVPNPVLVIIDVQPKELGIPTKAYYAVEEVKENATQKSQKVFVHVSTEIAAHEVEEIGVEHLLRDVKDTTISTLATEVTAKLTALKGLDARLREIRSYLDLVIEGKLPLNHEILYHLQDVFNLLPNLNVNELVKAFSVKTNDMMLVIYLSSLIRSVIALHNLINNKLLNKEHEKAEDSKPVAIPATS

SEQ ID NO: 19406 - DNA, 1356 bp, Drosophila melanogaster
  CDS (112)..(1128)
acaggagtcgcaggaagccaaacccgtcgaaaacaaatcagtccggtacctatcaatcggcgcagaggtcatagtaagcccccgaaccgaaaacccagaaaaagcacaaacatgccgtcgcaggaggtgagcgtaaacaaagtgatagtgcatccattggttctgctgtccgtggtggatcacttcaaccggatgggaaagattggcaaccagaagcgcgtagtgggagtccttctgggctgctggcgatccaagggagtgctcgatgtgtccaacacgttcgcagtgcccttcgacgtggatgacaaggacaagtcggtgtggttcctggaccacgactacctggagaatatgtacggcatgttcaaaaaggtgaacgccagggaacgggttgtgggatggtatcacacaggtcccaagctccaccaaaacgacatagccatcaacgagctggtccggcgctattgtcccactccgtgctggtcatcatcgacgccaagcccaaggatttgggcctgcccacagaggcgtacatatcggtggaggaaagtccatgacgacggctctccgaccagcaaaactttcgagcatgtgcccagcgagattgggcccgaggaggcggaggaggtgggcgtggagcatctgctgcgtgacatcaaggacacaaccgtgggcagcctgtcgcaaaagatcaccaaccagctcatgggtctgaaaggcctgaatgcccagctgcgggacataaagcagtatctgcagcgcgtcggcgacagcaagatgccaatcaaccaccagattgtctaccagctgcaggacatcttcaacctgctgcccgatataaccaatgaccagttcacgggcacaatgtatgtgaagaccaacgaccaaatgctagtcgtctacctggcctccatggtgcgctcgatcattgccctgcacaacctgatcaacaacaagctggccaaccgcgacgccgaggagggcaagagcgacagcaaggaggccaaggagaagaataaggatagcaaggataaggacaacaaggagaccaaggacaaggacggcaagaaggcggaggagaaggccgacaagggcaaggacgaaggcggcaagggttcgcgcaaataggagcggaagaaaaagcgcaagccccgtcgcaagcgaaagaagcagcggccgcaggactagctgctgcttcttctgttctccaggaagtggaactcatctgcagaccatacggcgagggtgtgcagtggcctcagaaatcaagcattgctaccattcatcgttcattttccacacgaaattaagctccctcttattatttcgcgtaactaactaatggcaagtttatgt

SEQ ID NO: 19407 - protein, 338 aa, Drosophila melanogaster
MPSQEVSVNKVIVHPLVLLSVVDHFNRMGKIGNQKRVVGVLLGCWRSKGVLDVSNTFAVPFDVDDKDKSVWFLDHDYLENMYGMFKKVNARERVVGWYHTGPKLHQNDIAINELVRRYCPTPCWSSSTPSPRIWACPQRRTYRWRKVHDDGSPTSKTFEHVPSEIGPEEAEEVGVEHLLRDIKDTTVGSLSQKITNQLMGLKGLNAQLRDIKQYLQRVGDSKMPINHQIVYQLQDIFNLLPDITNDQFTGTMYVKTNDQMLVVYLASMVRSIIALHNLINNKLANRDAEEGKSDSKEAKEKNKDSKDKDNKETKDKDGKKAEEKADKGKDEGGKGSRK

SEQ ID NO: 19408 - DNA, 1529 bp, Brachydanio rerio
  CDS (68)..(1051)
aaactggcgtgctgaacaacagaaaagcactatttatcctcaaaagtttcggatttattgagtgaaaatgccggacttggcggtagaaagggttgtcgttcatcctttggtgctactgagtgtcgtggaccattttaacaggattggtaaagttggcagtcagaagagagttgttggtgttctgctgggctcgtggcagaagaaagtgcttgatgtttccaacagctttgctgtgcctttcgatgaggatgacaaggatgattcagtttggttcttggaccacgactacctggagaatatgtacggcatgttcaagaaagtcaacgcaagggagagaatagttggatggtaccacacgggcccaaagctgcacaagaatgatattgccattaatgaactcatgaaacagtactgttctaattcggttttagtaattattgatgtgaaacccaaagacctgggtttgccgactgaagcgtacatctcagtggaggaagtgcatgatgatggaactcccacatctaagacatttgaacatgtgaccagtgagattggggcagaagaggcggaggaagtgggtgtggagcatttactgcgcgatatcaaggacacgacggttggcactttgtcgcagcgcatcaccaatcaggtgcatggtctgaagggcctcaactccaaacttctggatatcaagagttacctggagaaagttgcaaccggcaaactacccatcaaccaccagatcatctaccagctccaggacgtgttcaacctgctgcccgacgtcaacctgcaggagttcgtcaaggccttctatctcaaaaccaacgatcagatgctggtggtttacctggcctcgctcatccgctccgtagtggcgctccacaatctcatcaataacaaaatcgccaaccgcgacgctgagaagaaggaaggccaggagaaagacgacagcaagaaagagaagaaggatgagaaggataaagacaaggacaaagacaaggaaaaggacgcttcagccaagaaagaagacaaaaaggataagaaataaactggcatgaatttaggcttacacaaacttggctgaataacgaggaagtctgcgtttgtttgcttctcttgtttaaaacaaaaaatctatctaaatcagccgttgtgtctgtctttttgatataaaggactcgttttctgttttgcgatttattcagatctccctctgatggttgatgtttctgttttgaccaaggttgatgtattcaacattataatcaccatattagaccatcaagacaggtgttaaagcaaagtccaactgcagccgcgtcattgtatttacactgatgagatttttttttattattattataaaaaccaatgtcaaacaaactcatgcagcttagcctgttttatttcgttcactacatgcaaagtgtacagttaacaaagcacatctgcaaaacatgtctagttttcagcaaaatcagaaataaaaagatcggctttataataaaaaaaaaaaaaaaaaaaaa

SEQ ID NO: 19409 - protein, 327 aa, Brachydanio rerio
MPDLAVERVVVHPLVLLSVVDHFNRIGKVGSQKRVVGVLLGSWQKKVLDVSNSFAVPFDEDDKDDSVWFLDHDYLENMYGMFKKVNARERIVGWYHTGPKLHKNDIAINELMKQYCSNSVLVIIDVKPKDLGLPTEAYISVEEVHDDGTPTSKTFEHVTSEIGAEEAEEVGVEHLLRDIKDTTVGTLSQRITNQVHGLKGLNSKLLDIKSYLEKVATGKLPINHQIIYQLQDVFNLLPDVNLQEFVKAFYLKTNDQMLVVYLASLIRSVVALHNLINNKIANRDAEKKEGQEKDDSKKEKKDEKDKDKDKDKEKDASAKKEDKKDKK

SEQ ID NO: 19410 - DNA, 957 bp, Xenopus laevis
  CDS (1)..(957)
atggcggctgctgcttcgaacggcaacggcatggaggtggatgtggccgctctccccagtgtgatggctcagggggtcactggcagtgtgacagtcgctctccatcccctcgtcatattaaacatctctgatcactggattcgcatgagatcccaagaggggcgaccgatgcaggttatcggagcccttatcgggaagcaggagggcaggaacatcgaggtgatgaactcgtttgagctcctctctcagattaatgatgaaaagatcaccattaataaagagtattattacaccaaggaagaacaatttaagcaggtgttcaaggacatggagttcctaggttggtataccacaggaggaaccccggatccatcagacattcacgtgcacaagcaggtctgtgagattatcgagtctcccctatttctgaagctaaatcccatgaccaaacacacagatcttccagtcagtgtctatgagtcagtgattgacatcgtaaacggggaggccaccatgctgctagcagaactctcctacacgttggccacagaagaagcagagagaatcggagtggatcacgtggccaggatgacggcgacaggaagtggagagaactcaacagtggcggagcatctcatagctcagcacagcgcaatcaagatgttacacagtcgtgtccggctcattttggaatatgttcgggcagccgaggggggagaggtgccgtttaatcacgagattttgcgagaagcctccgctctgtgtcactgcctccctgtcctcagcactgacaagttcaagacagacttctatgatcaatgtaatgacgtgggtttgatgtcttacctgggcaccatcactaagacgtgcaacaccatgaaccagtttgttaacaaattcaacatcctttacgaccgtcaggggattggacggcgcatgcggggtctcttcttctag

SEQ ID NO: 19411 - protein, 318 aa, Xenopus laevis
MAAAASNGNGMEVDVAALPSVMAQGVTGSVTVALHPLVILNISDHWIRMRSQEGRPMQVIGALIGKQEGRNIEVMNSFELLSQINDEKITINKEYYYTKEEQFKQVFKDMEFLGWYTTGGTPDPSDIHVHKQVCEIIESPLFLKLNPMTKHTDLPVSVYESVIDIVNGEATMLLAELSYTLATEEAERIGVDHVARMTATGSGENSTVAEHLIAQHSAIKMLHSRVRLILEYVRAAEGGEVPFNHEILREASALCHCLPVLSTDKFKTDFYDQCNDVGLMSYLGTITKTCNTMNQFVNKFNILYDRQGIGRRMRGLFF

SEQ ID NO: 19412 - DNA, 25 bp, Primer
atgtctctacaacacgagaaagtta

SEQ ID NO: 19413 - DNA, 27 bp, Primer
ttaatttttcttgttctttcgttggat

SEQ ID NO: 19414 - DNA, 1932 bp, Saccharomyces cerevisiae
  CDS (469)..(1725)
caagacggaaagattgaaagagtagatagatgtacattttatttaaatattagttagtcgttattgtaactggtaatcagagcaagaagtttttctgtactttgttctctgcaggcaactaagttacgggccgacaaaggcttatgatgtgcgttttttattcaattgatagattcagtcagcattgacgtaatgggaaggctagaaaaagagaagactgaatttggaaacttattcctcaaagcagaccagtacttccaccgcatttctgtacttaaccaagcacgacagtggtctatcaggcttggatctttcactacacttccgccaaagttttttttttttcctgtttatcccagatcacgtttgttccattaaggaggtttactatcatctcatttccatttacacatacacttacatatacataaggaaacgcagaggcatacagtttgaacagtcacataaatgtcaggaacattcaatgatataagaagaaggaagaaggaagaaggaagccctacagccggtattaccgaaaggcatgagaataagtctttgtcaagcatcgataaaagagaacagactctcaaaccacaactagagtcatgctgtccattggcgaccccttttgaaagaaggttacaaactctggctgtagcatggcacacttcttcatttgtactcttctccatatttacgttatttgcaatctcgacaccagcactgtgggttcttgctattccatatatgatttatttttttttcgataggtctcctgcaactggcgaagtggtaaatcgatactctcttcgatttcgttcattgcccatttggaagtggtattgtgattatttccctataagtttgattaaaactgtcaatttaaaaccaacttttacgctttcaaaaaataagagagttaacgaaaaaaattacaagattagattgtggccaactaagtattccattaatctcaaaagcaactctactattgactatcgcaaccaggaatgtacagggccaacgtacttatttggttaccatccacacggcataggagcacttggtgcgtttggagcgtttgcaacagaaggttgtaactattccaagattttcccaggtattcctatttctctgatgacactggtcacacaatttcatatcccattgtatagagactacttattggcgttaggtatttcttcagtatctcggaaaaacgctttaaggactctaagcaaaaatcagtcgatctgcattgttgttggtggcgctagggaatctttattaagttcaacaaatggtacacaactgattttaaacaaaagaaagggttttattaaactggccattcaaacggggaatattaacctagtgcctgtgtttgcatttggagaggtggactgttataatgttctgagcacaaaaaaagattcagtcctgggtaaaatgcaactatggttcaaagaaaactttggttttaccattcccattttctacgcaagaggattattcaattacgatttcggtttgttgccatttagagcgcctatcaatgttgttgttggaaggcctatatacgttgaaaagaaaataacaaatccgccagatgatgttgttaatcatttccatgatttgtatattgcggagttgaaaagactatattacgaaaatagagaaaaatatggggtaccggatgcagaattgaagatagttgggtaataatgaattcattggaaaacacaaaatatgttagaataaataaggattttttagtgtttgggctgtatatcttaagtaagagtattaacttacaggaatactggagttctcgttgaatattagtgattgttttacgtaaatttcatttatttaaagcttttacattagaagttgtttgaatgtaagtttaggaaagcactacatagc

SEQ ID NO: 19415 - protein, 418 aa, Saccharomyces cerevisiae
MSGTFNDIRRRKKEEGSPTAGITERHENKSLSSIDKREQTLKPQLESCCPLATPFERRLQTLAVAWHTSSFVLFSIFTLFAISTPALWVLAIPYMIYFFFDRSPATGEVVNRYSLRFRSLPIWKWYCDYFPISLIKTVNLKPTFTLSKNKRVNEKNYKIRLWPTKYSINLKSNSTIDYRNQECTGPTYLFGYHPHGIGALGAFGAFATEGCNYSKIFPGIPISLMTLVTQFHIPLYRDYLLALGISSVSRKNALRTLSKNQSICIVVGGARESLLSSTNGTQLILNKRKGFIKLAIQTGNINLVPVFAFGEVDCYNVLSTKKDSVLGKMQLWFKENFGFTIPIFYARGLFNYDFGLLPFRAPINVVVGRPIYVEKKITNPPDDVVNHFHDLYIAELKRLYYENREKYGVPDAELKIVG

SEQ ID NO: 19416 - DNA, 1020 bp, Caenorhabditis elegans
  CDS (1)..(1020)
atgccacatctactaggagttgagtgggctccgctcaatattccgttggctcggcgtcttcaaactttgggagcacttcatttcttcttcatcactctcttcacaccagtactcgttctcaccgttccattctacatgttatataccgtactctggcctttgatctttctgtatgggctttggatgatttacgattggaattcaccaaagaagggagcctatatgagcaattggttccagagacaaagaattcattcgtggtatgccaactattttccagtcaaattgcacacaacatctgacatgccagaagaacataactatttgattgggtaccatccgcatggaataatttcaatggccgcattcatcaactttgcaacaaatggaactggaattctcgatactcttccacgaattcgtttccatttgtgcacacttgttggtcaattctggactccgtggagacgtgagtggggattgttgcacggaatgatagactgcagtcgagaaagcatcaagcacgttttggagcatgaaaagaaaggaaaagcagttgtattggtggttggtggagctgaagaagcacttgatgcacatccaggatgccatattttgactttgaaaaaaaggaaaggattcgtgaaaattgccctgcaaactggagctcaactggttccatgctattcattcggtgaaaatgatattttcaatcaagccgaaaatccaaagggatcaacaattcgacagttccaaacgataatgaaaagagtcttgggattctcccctccagcattctatgggagaggagtattcaactatacatttggtcttcttccattcagaaaacctatcaacactgttctcggcgctccaatttcagtgacaaagacagtgaatccaactcaagaacaaatcgacacacttcatcagacatacatggaccgtcttcatgagcttttcgaggagcacaagacaaaatacgatgtctctccaactacacaacttgttatcaattaa

SEQ ID NO: 19417 - protein, 339 aa, Caenorhabditis elegans
MPHLLGVEWAPLNIPLARRLQTLGALHFFFITLFTPVLVLTVPFYMLYTVLWPLIFLYGLWMIYDWNSPKKGAYMSNWFQRQRIHSWYANYFPVKLHTTSDMPEEHNYLIGYHPHGIISMAAFINFATNGTGILDTLPRIRFHLCTLVGQFWTPWRREWGLLHGMIDCSRESIKHVLEHEKKGKAVVLVVGGAEEALDAHPGCHILTLKKRKGFVKIALQTGAQLVPCYSFGENDIFNQAENPKGSTIRQFQTIMKRVLGFSPPAFYGRGVFNYTFGLLPFRKPINTVLGAPISVTKTVNPTQEQIDTLHQTYMDRLHELFEEHKTKYDVSPTTQLVIN

SEQ ID NO: 19418 - DNA, 1038 bp, Caenorhabditis elegans
  CDS (1)..(1038)
atgctaaactaccaaattcacaaaaagctcaccgacatcaagtgggtgaacatcttctccccatgggatcgccagcgtgcctacttcgccttggtcgtctggttcgggctcatctacccattctgctgcctgtgccaggtggctccgtttgtgctctttttcaccggccagtggattattttgggtctctacgcagtttggtacctttacgatcgagaatctccgagaagaggaggatatcgggataattggttcagaaatttgtcgctgcacaagtggttcgccgagtattttcctgttaaacttcacaaaactgcggagttggatccaaaccaaaattatttattcggatatcatcctcatggaattctcggtgtcggagcgtggtcttgttttggatttgatgcgtgcaatgtgaagcaagtgttcaaaggcatccgcttcaacatctgcaccttgcccggcaacttcaccgcaatgttccgccgcgagatcctcctcagcatcggtatgatcgagagctccaaagaatccatcgagcacgtgctcaactccgaggaaaagggccgtgccgttgtaattgtcgtgggtggagccgctgaagctcttgaagctcacccagggaagcatactctaacactggcaaatcgcaaaggtttcgtgagagaagccgtgaagaccggagctcatctggtgccagtttatgcgtttggagagaatgacatatataagcaaattgacaacccggaaggctcgaaattacggaaaattcaagaatggggaaagaagaaaatgggaatttcactgccactaatctacggaagaggatattttcaaatggctcttgggcttcttccaatgagccgagctgtgaatgtagttgtcggagcgcctattcaagtggaaaaagagctcgatccttctaaggaagtcattgatgaaattcatggagtttatatggaaaagctcgccgagttatttgaagagcacaaggcaaagttcggagtttccaaggacactcggctcgtttttcagtga

SEQ ID NO: 19419 - protein, 345 aa, Caenorhabditis elegans
MLNYQIHKKLTDIKWVNIFSPWDRQRAYFALVVWFGLIYPFCCLCQVAPFVLFFTGQWIILGLYAVWYLYDRESPRRGGYRDNWFRNLSLHKWFAEYFPVKLHKTAELDPNQNYLFGYHPHGILGVGAWSCFGFDACNVKQVFKGIRFNICTLPGNFTAMFRREILLSIGMIESSKESIEHVLNSEEKGRAVVIVVGGAAEALEAHPGKHTLTLANRKGFVREAVKTGAHLVPVYAFGENDIYKQIDNPEGSKLRKIQEWGKKKMGISLPLIYGRGYFQMALGLLPMSRAVNVVVGAPIQVEKELDPSKEVIDEIHGVYMEKLAELFEEHKAKFGVSKDTRLVFQ

SEQ ID NO: 19420 - DNA, 1080 bp, Caenorhabditis elegans
  CDS (1)..(1080)
atgagactccggctgagctcgatatctggaaaggcgaagcttcccgataaagaaatatgctcatcagtttcgagaatattggcaccattgcttgttccatggaagcgacgactcgagactcttgccgtgatgggtttcattttcatgtgggtaatcctaccaatcatggacctctgggttccattccacgtcttgttcaatactcgatggtggttccttgttccactctacgctgtctggttctactatgattttgatacaccgaaaaaagcttcaagaagatggaattgggccagaagacacgtagcctggaagtactttgccagctacttcccattgagattgatcaagactgctgaccttccggcggatcgtaattacatcattggctctcatcctcatggaatgttctcggttggtggttttactgcaatgagcaccaacgcgaccggatttgaagacaagttcccgggaataaaatctcacatcatgacgctaaatgggcaattttatttcccatttcgtcgagaattcggaataatgctcggtggaatcgaagtttcgaaagaatcacttgaatacactctaactaaatgtggaaaaggacgagcatgcgcaattgtcattggcggagcctcggaggctcttgaagctcatcccaataaaaatacattgacgttgatcaatcgacgtggtttctgcaaatatgctctgaagtttggagcagacctcgtaccaatgtacaatttcggagagaatgatttatacgagcagtatgaaaacccgaagggatctagattgcgagaagttcaggagaaaatcaaggacatgttcggattgtgtcccccattgctccgcggtcgatcgttgttcaaccaataccttatcggattgctgccgttccgaaaaccagttacaacagtcatgggaaggccaattcgagtcacccaaaccgacgagccaaccgttgagcagattgatgagctgcatgcaaaatattgtgatgctctctacaatctgttcgaggagtacaagcatcttcactccattcctcccgacactcatctcatcttccagtga

SEQ ID NO: 19421 - protein, 359 aa, Caenorhabditis elegans
MRLRLSSISGKAKLPDKEICSSVSRILAPLLVPWKRRLETLAVMGFIFMWVILPIMDLWVPFHVLFNTRWWFLVPLYAVWFYYDFDTPKKASRRWNWARRHVAWKYFASYFPLRLIKTADLPADRNYIIGSHPHGMFSVGGFTAMSTNATGFEDKFPGIKSHIMTLNGQFYFPFRREFGIMLGGIEVSKESLEYTLTKCGKGRACAIVIGGASEALEAHPNKNTLTLINRRGFCKYALKFGADLVPMYNFGENDLYEQYENPKGSRLREVQEKIKDMFGLCPPLLRGRSLFNQYLIGLLPFRKPVTTVMGRPIRVTQTDEPTVEQIDELHAKYCDALYNLFEEYKHLHSIPPDTHLIFQ

SEQ ID NO: 19422 - DNA, 1305 bp, Candida glabrata
  CDS (1)..(1305)
atgtttggtaacgcatttcacttacgtaataggatccataaaaggtccagttcctctgatagactcgatcaagatgagtccagtgatgatggggataatgcccctaatattgtggaacagaagaccaaggatattaagttagtgaagccgctaaagaggccaagattgagcaattgctgctcacccacaacacccatggctaataggttacagacaatggcggttgcttggcatatttcctcatttgtgctgtttagcattttctccctgttgattatttccaatccattcacatggatagttgtaattccttatctcatttatttcttcaatgacaggtctccagctaatggggatgtagtctaccgatactcaccttgggtacgttctttaaagatttggaaatactattgtgattatttccctattgaactggttaagacggttgatttggaacctacgtttacaccatgtaatgaagaagaggagaaggaaaacaaaaagcttcaagaatattatactttacgtctctggccatcagactacgagataagattgttcaagaagaacaccgtgtattcgcacggctataagcgcacggggccaaagtatatcttcggatatcatccacatggtattggtgctttaggatcgtttggtgcttttgcaacagaaggacgtggctggtctaataaatttccgggcattccggtatctctattgactttagttacacaattccatattcctttctatcgtgattatctgctttcggttgggatatcatcagtttccaggaagaatgctttgaaagttcttgataataaccaatcgatatgtattgttgttggtggggctagagaatctttaataagcattcctggtacatctggattaattctaaataaaaggaaggggtttattaagttagctattcaagccggtaatgttagtcttgtcccagtgtatacttttggcgaaaatgactgttataatatattagctacagatgagacatccatcattaggaaattacagctctgggttaaggaaaattttggatttactataccaattttctacgcaagaggattattcaactatgattttgggctattgccattcagagcacctttacatgtggttgttggtaggcccatacatgtcaaagaacagcaagaaaatcctgaacaaagccttgttgaccactaccatgaactgtatgtggaagaattaaaaagaatatatttagaaaacagagacaggtatggctatggtgcagcagactttgaaatattgggataa

SEQ ID NO: 19423 - protein, 434 aa, Candida glabrata
MFGNAFHLRNRIHKRSSSSDRLDQDESSDDGDNAPNIVEQKTKDIKLVKPLKRPRLSNCCSPTTPMANRLQTMAVAWHISSFVLFSIFSLLIISNPFTWIVVIPYLIYFFNDRSPANGDVVYRYSPWVRSLKIWKYYCDYFPIELVKTVDLEPTFTPCNEEEEKENKKLQEYYTLRLWPSDYEIRLFKKNTVYSHGYKRTGPKYIFGYHPHGIGALGSFGAFATEGRGWSNKFPGIPVSLLTLVTQFHIPFYRDYLLSVGISSVSRKNALKVLDNNQSICIVVGGARESLISIPGTSGLILNKRKGFIKLAIQAGNVSLVPVYTFGENDCYNILATDETSIIRKLQLWVKENFGFTIPIFYARGLFNYDFGLLPFRAPLHVVVGRPIHVKEQQENPEQSLVDHYHELYVEELKRIYLENRDRYGYGAADFEILG

SEQ ID NO: 19424 - DNA, 1716 bp, Homo sapiens
  CDS (101)..(1114)
cacagtaagagattatagcaaagcatctataatcaactcagcttaagaagttttgaccttctggttaggcttcttgccacaacagaacagcaccataaccatggctttcttctcccgactgaatctccaggagggcctccaaaccttctttgttttgcaatggatcccagtctatatatttttaggagctattcccattctccttataccctactttctgttattcagtaagttctggcccttggctgtgctctccttagcctggctcacctatgattggaacacccacagtcaaggtggcaggcgttcagcttgggtacgaaactggaccctatggaagtatttccgaaattacttcccagtaaagctggtgaagactcatgatctttctcccaaacacaactacatcattgccaatcacccccatggcattctctcttttggtgtcttcatcaactttgccactgaggccactggcattgctcggattttcccatccatcactccctttgtagggaccttagaaaggatattttggatcccaattgtgcgagaatatgtgatgtcaatgggtgtgtgccctgtgagtagctcagccttgaagtacttgctgacccagaaaggctcaggcaatgccgtggttattgtggtgggtggagctgctgaagctctcttgtgccgaccaggagcctccactctcttcctcaagcagcgtaaaggttttgtgaagatggcactgcaaacaggggcataccttgtcccttcatattcctttggtgagaacgaagttttcaatcaggagaccttccctgagggcacgtggttaaggttgttccaaaaaaccttccaggacacattcaaaaaaatcctgggactaaatttctgtaccttccatggccggggcttcactcgcggatcctggggcttcctgcctttcaatcggcccattaccactgttgttggggaaccccttccaattcccaggattaagaggccaaaccagaagacagtagacaagtatcacgcactctacatcagtgccctgcgcaagctctttgaccaacacaaagttgaatatggcctccctgagacccaagagctgacaattacataacaggagccacattccccattgatcaacccccaaagccatgagggatccaagtagagccacagaaaaagaagaattccaggagagggaaagatcgtaaggatgagagaggagaccatccaagccagaaattatttaataaatcagagttctagcaatagagtcctctcccaagtggctgaggcaggcttaggggaaagaaccagaggggcaggggaggactggggagggctggctagccagaggagttggctgtatcacccctggttattttagggcaacaacccagttggggagtcttatgaatcattccagccaactctctgatcacaaagaatactgtgcccctttctcctaaaccttagttcaccatcactacgtaggtttagacttagaagctttatttggaacagggatagtttgtttcctcttggtcctttccttacaacttgggaactgccacaaggtaaaccagggacctgaactgtagctgcctggtccaagcagacaggattccgtcagttgtgatagagttctagattggcaatgcagttacattgtttcttctttgaaaataaagttctagacatataaaaaaaaaaaaa

SEQ ID NO: 19425 - protein, 337 aa, Homo sapiens
MAFFSRLNLQEGLQTFFVLQWIPVYIFLGAIPILLIPYFLLFSKFWPLAVLSLAWLTYDWNTHSQGGRRSAWVRNWTLWKYFRNYFPVKLVKTHDLSPKHNYIIANHPHGILSFGVFINFATEATGIARIFPSITPFVGTLERIFWIPIVREYVMSMGVCPVSSSALKYLLTQKGSGNAVVIVVGGAAEALLCRPGASTLFLKQRKGFVKMALQTGAYLVPSYSFGENEVFNQETFPEGTWLRLFQKTFQDTFKKILGLNFCTFHGRGFTRGSWGFLPFNRPITTVVGEPLPIPRIKRPNQKTVDKYHALYISALRKLFDQHKVEYGLPETQELTIT

SEQ ID NO: 19426 - DNA, 1118 bp, Bos taurus
  CDS (1)..(1008)
atgaaggtcgagtttgcgccactcaacatcccgctggcgcggcggctgcagacggctgcggtgctgcattggttgctgtccttcctgctgttcgcacaggtatgcctcggaattatcgtgttcctgatcatatacaactactggttcctctaccttccttacttgacatggctttactttgactggcaaaccccagagcaaggaggcagaagatctgaatgggtcagaaactgggccatttggaggtactttaaggactattttccaattcatctcatcaaaacctgggatttggatccgagtcacaactacatatttgggtttcacccccatggagtgcttgtggttggagcctttggaaacttctgtacaaattattcggccttcaaggagctgtttcccggctttacctcctatcttcacgtgctgccgtattggttccggtgtccgctcttccgggaatatctgatgagcagtgggccagtctcagtttccaagaaaagtgtgtgccacgtgttaagcaaagagggaggtggaaacatctcagtcattgtgctcgggggtgcagaggaatcactggatgcccatcctggaaagttcactctgttcatccgccagcggaagggattcgtgaaaattgctttgacccatggtgcttatttggtgccagtgttttcttttggtgaaaatgaactatttaaacaagttagcaatcccgaaggatcatggcttcgaaatgtgcaggagaaactacagaagatcatgggatttgctttgccactgttccacgccagaggaatttttcaatacaattttggcctaatcccctataggaagcccattcacactgttgttggccgcccaatccctgttcgtcagaccctgaacccaacctcagagcagattgaggagttgcatcagacctacatggaggagctgagaaaattatttgaagaacacaaagggaagtatggtattccagaaaatgaaactctcatttttagataactgttgtcttagaagtcatgcaagagagcgagagaacatcccactgaaagaaaagatattctaaataaatttttttctttgacaatggaatcaaatttgcaactgtaaaa

SEQ ID NO: 19427 - protein, 335 aa, Bos taurus
MKVEFAPLNIPLARRLQTAAVLHWLLSFLLFAQVCLGIIVFLIIYNYWFLYLPYLTWLYFDWQTPEQGGRRSEWVRNWAIWRYFKDYFPIHLIKTWDLDPSHNYIFGFHPHGVLVVGAFGNFCTNYSAFKELFPGFTSYLHVLPYWFRCPLFREYLMSSGPVSVSKKSVCHVLSKEGGGNISVIVLGGAEESLDAHPGKFTLFIRQRKGFVKIALTHGAYLVPVFSFGENELFKQVSNPEGSWLRNVQEKLQKIMGFALPLFHARGIFQYNFGLIPYRKPIHTVVGRPIPVRQTLNPTSEQIEELHQTYMEELRKLFEEHKGKYGIPENETLIFR

SEQ ID NO: 19428 - DNA, 1433 bp, Bos taurus
  CDS (199)..(1284)
ggccgtggccgtggccaaggctccgctttccgccggtgctccggcccgtctggcggcccgtccctccgcaccctcggccgtagcggtccccgcgctcccctgctcggcgcgaagccctggccccggcggccggggcatgggccaggggcgcggggtctggcggcttcccgcggggccccgacctgtactggcttcgtcatgaagaccctcatagccgcctactccggggtcctgcgaggcactggctccagcatcctctctgccctccaggacctgttttctgtcacttggctcaatagggccaaggtagagaagcagctccaagtcatctcggtgctacaatgggtcctgtctttcctcgtgctgggagtggcctgcagcgtcatcctcatgtacacattctgcaccgattgctggctcattgccgtgctctacttcacctggctggtgtttgactggaacacacccaagaaaggtggcaggaggtcacagtgggtccgaaactgggctgtgtggcgctactttcgagactactttcccattcagctggtgaagacacacaacttactgaccagcaggaactacatctttgggtaccatccccatggcatcatgggcctgggtgccttctgcaacttcagcacagaggccacagaagtaagcaagaagttccctggcataaggccctacctggccacgctggccggcaacttccggatgccagtgctgcgggagtacctgatgtctggaggcatctgcccagtgaaccgggacaccatagactacttgctttcaaagaatgggagtggcaatgccatcatcatcgtggtggggggcgcggctgaatccctgagctccatgcccggcaagaatgcagtcaccctgcgcaatcgcaagggctttgtgaaactggccctgcgccatggagccgacctggttcccacctactcctttggggagaatgaggtgtacaagcaggtgatctttgaggagggctcctggggccggtgggtgcagaagaagttccagaagtacattggctttgccccatgcatcttccatggtcgaggcctcttctcctctgacacctgggggctggtgccctactccaagcccatcaccactgtcgtgggcgagcccattaccatccccaggctggagcgcccgacgcagcaggacatcgacctgtaccacgccatgtacgtgcaagccctggtgaagctcttcgaccagcataagaccaagttcggcctcccggagaccgaggtcctggaggtgaactgagcctgtctgcaggggccagcttctgggaggaaccatctgcaaatcgttttctaccaagttctcaagtgctttttgttctgtaaatttggaagcatcatgggtgtctgtgggttatttaaaagaaattataataattttgttaaaccgtt

SEQ ID NO: 19429 - protein, 361 aa, Bos taurus
MKTLIAAYSGVLRGTGSSILSALQDLFSVTWLNRAKVEKQLQVISVLQWVLSFLVLGVACSVILMYTFCTDCWLIAVLYFTWLVFDWNTPKKGGRRSQWVRNWAVWRYFRDYFPIQLVKTHNLLTSRNYIFGYHPHGIMGLGAFCNFSTEATEVSKKFPGIRPYLATLAGNFRMPVLREYLMSGGICPVNRDTIDYLLSKNGSGNAIIIVVGGAAESLSSMPGKNAVTLRNRKGFVKLALRHGADLVPTYSFGENEVYKQVIFEEGSWGRWVQKKFQKYIGFAPCIFHGRGLFSSDTWGLVPYSKPITTVVGEPITIPRLERPTQQDIDLYHAMYVQALVKLFDQHKTKFGLPETEVLEVN

SEQ ID NO: 19430 - DNA, 1386 bp, Ashbya gossypii
  CDS (1)..(1386)
atgcaggacagcatggatgacagcttgagggaggctgagggcagacaggacgactcggaggtcagcagcgggacgacactcggaagcagcaccccggaggacagcggggtgacggcgaagctgcgcaagaagtaccagatggcgtcggcactgctgcggcgggagctggaggagctgagcgtgtacgacgcgaagacggcgggggtaagcggccgcagcagcggcagcggcagcggcgggctggcgctgctgggcgggcgattccacgtggcgccgctgcggatccccgcgcggcggcggctgcagacgctggtggtggcgtggcacacgagctcgttcatctacatgacggtgctggtgctgtttctggcggcgaacccgctgatgtggtggttcatggtgccgtatatggtgtactacgtgtggaaccggtcgccggcgaacggcggagtggtgcggcggtactcgccgcggctgcggtcgctggcgctgtggcggtactactgcgagtactacccgatctcactgcacaagagcgaggacctggcgccgacgttcgtgccggacccgcggggggcggagccgcgcgagtggaagctgcggctgtggctgtggccgacgcgcgtggagctgctgaacttgacgctccagtggacgcgcgcgcggccgcaggttgcgacagggccgcgctacatcttcgggtaccacccgcacggcgtgggcgcactgggcgccttcggcgcgatcgcgaccgagggctgcaactggagcaaggtcttcgcgggcatcccggcctgcctgtgcacgctggtgaaccagttccagatccccatctaccgcgactacctgctgggcctcgggtgcacctccgtggcccgcaagaacgtgctcaaggtgctcgagcagaactactcggtctgcatcgtcgtgggcggcgcccaggaagccctgctcagccgtgtgggctccaccgagctcgtgctgaacaagcgcaagggcttcatcaagctcgcgctggagacgggcaacgtcaacctggtgcctatctacgccttcggcgagacagactgcttcaacgtgctcgacacgggcaacgagagctacctacgcaagttccagctgtggatcaagaagacctacggcttcaccatcccgttcttttttgcgcgcggtgtcttcaactatgacttcggcttcctgcccttcaggaatccgatcaacgtcgtcgtgggcaagcctgtgtacgtagacaagcgcagaacgaaccccaccatggaggaaatcgaccactaccacgacctgtacgtgcaggagctgcgcaatgtgttcgacaagaacaaacacaagttcggctacgccgggaaggaacttaaaatagtagagtag

SEQ ID NO: 19431 - protein, 461 aa, Ashbya gossypii
MQDSMDDSLREAEGRQDDSEVSSGTTLGSSTPEDSGVTAKLRKKYQMASALLRRELEELSVYDAKTAGVSGRSSGSGSGGLALLGGRFHVAPLRIPARRRLQTLVVAWHTSSFIYMTVLVLFLAANPLMWWFMVPYMVYYVWNRSPANGGVVRRYSPRLRSLALWRYYCEYYPISLHKSEDLAPTFVPDPRGAEPREWKLRLWLWPTRVELLNLTLQWTRARPQVATGPRYIFGYHPHGVGALGAFGAIATEGCNWSKVFAGIPACLCTLVNQFQIPIYRDYLLGLGCTSVARKNVLKVLEQNYSVCIVVGGAQEALLSRVGSTELVLNKRKGFIKLALETGNVNLVPIYAFGETDCFNVLDTGNESYLRKFQLWIKKTYGFTIPFFFARGVFNYDFGFLPFRNPINVVVGKPVYVDKRRTNPTMEEIDHYHDLYVQELRNVFDKNKHKFGYAGKELKIVE

SEQ ID NO: 19432 - DNA, 1850 bp, Anopheles gambiae str
  CDS (537)..(1598)
cgcatgaggagaaaagttggccactcagttattatacgcgacaagctcccagtataagcgtcattgttagatcgcattctacaatgacaaacggacccgacatcattagtcatgtttggccggtggtcagaagaaagcacagagggtggaagaaaagctgattcattgggtgaggacgttagtctgcgggcgtgtttttatcgtctcagtttgcatcatgccccagtgaaagtgataccgacacgacatttggtgaagccattcggttcaagattaagggacaggctaaaccagtacaagtgagtattcgttgattcattcgtaaaccgaacgttgtttgctcagcaagaagcaatgactgataagtgataacgtaattgcatcatcggcatcaatgctgataagatctcgagctgcgggaaggaaaacgcatcaagtggtacatcgtttgtggtgtgatagattttggggagggcgagtcgtagtggtggaacatcccccggtaccggttctagacgcgctcaccaaaacctaagatgggtaaaatcgaatgggccccactgaatgtgccgatgaggcggcggatcgaaaccctgtccactgccctgtggatgtggctgatactgttcggcgagctgggcatgctgatatcgtacttcctgctgctgatctatggtaacttgtttattaaatcgctgtgcgtcatctacggatacttcatctacactgatcgaaaagtgactttgaacgggggccgtggacagggtgtaacatggtggcgagagctgttctggtggaagctctaccagagctacttcccggcgaagctgcacaaaacggttgatctcgaccctaaccggaactacctgtttgccgccttcccgcacggcgtgcttggcctcggtgccttcatcaactttgccaccaatgcgaccggctttcacgacaagtttcccaaaatccgttcccgcccggtgacgctaaacttccactttgtgataccgttcttccgcgagctgctgctcagctggggcctcgtgtcggccaacccgaacagcatcctgagcctgctgaaggcgccgaacaaaccggaccacccgctgaacgacgacggctacacggccaacgcggtcgtgatagtggtgggcggtgcggccgaatcgctgcactgccggccgaacaactacacgctggtgctgcgcaagcggaagggcttctgcaagctggcgatcaaggcgggcaccccgctggtgccggtgatgacgttcggcgaggtcgacctgttcgatcagccgccgaatccgcccggctcgcggttgcgccggttccaggagtttgtgaaaaacacgaccggcatcgcgccggccgccttcgtcgggcggggcttcttccagtacagctacgggttgatcccgcgccggaagccactgaacacagtcgtcggtgctccggtggaggtgacgcaaatagacaacccgacgcaggaacaggtggatgaggtgcacgagcggttctgccgcgcgctggacaatctgttcgaaacgaacaaatcgcgcttcattgccgactacaagaatgtgaagcttgtcatggagtaataggtaaaatgcagatacttcccgtacttcccgccatctttacacacaaacgatcggtgtatagcggtgggaaaacggggcaaaatcacgcacaagagacacagaaacacactatcatcacgatatcctacgcaacccgtggaaattgtgttataattcgcatcgtaaggattgagactgtaccaaaaaaaaaaaaaaaacgaacgatcaaaaccaactcttttcatacctaagatccaaccattgtgcggt

SEQ ID NO: 19433 - protein, 353 aa, Anopheles gambiae str
MGKIEWAPLNVPMRRRIETLSTALWMWLILFGELGMLISYFLLLIYGNLFIKSLCVIYGYFIYTDRKVTLNGGRGQGVTWWRELFWWKLYQSYFPAKLHKTVDLDPNRNYLFAAFPHGVLGLGAFINFATNATGFHDKFPKIRSRPVTLNFHFVIPFFRELLLSWGLVSANPNSILSLLKAPNKPDHPLNDDGYTANAVVIVVGGAAESLHCRPNNYTLVLRKRKGFCKLAIKAGTPLVPVMTFGEVDLFDQPPNPPGSRLRRFQEFVKNTTGIAPAAFVGRGFFQYSYGLIPRRKPLNTVVGAPVEVTQIDNPTQEQVDEVHERFCRALDNLFETNKSRFIADYKNVKLVME

SEQ ID NO: 19434 - DNA, 1830 bp, Neurospora crassa
  CDS (1)..(1830)
atggcagacgcctctggaccccttcctccgcggagcggttccctgtccagaaagaagtccggcaagaaaaacaaaaagaacaaccagaaagcggctcacagtgagataccggtgctaaaaggggtcgataaacacgcagctcagacctcagcctctgctgatcaggcctccggcaccccggcgaatcagaaggagaaacagctacacaccaagacttctatacccgacctgaaaccttcaacaactagtgttgattctaccgccactgccagcgccagcgcatcgttgggatcattgaacactaaagcctcccacgaaaagccggccaagatgtcaaacaaggacaagagagcggtgacggatgagtccgccgatttttcgatctcagacccagcaactaccaatccggctacgccttcctccacccaagtcgatggggtcctcgagacggacactccgcggacagaagtttcgcaaacggcaggaacggcgccgagtaccggtattgattatgctgatgctctcaaggatgccttgaaggagagtggaacgaaggagggaacagaggaaagagttgaagatctcccgcaggagggtgcccgcgaggaaccagccgagaaggctgccaagaagaccgtactcccaattcatgacaacacagctcgagaggagcccagcaatgcggaccacgatgtcagacgagagaaacaagccttgtacgacgaatacccttcattgtattttgagggcagcgacaatgagctggcacaaatggagcgggatagagccaacgcataccaggctgccggcatcagatttgcgccatttaacatacctttacagcgaagactccagaccctggcggttctgctacactcgctgattattgccactaccgtatccttctttttcttcctgtgcgccatccctttactctggccattggttatcccatatcttcttcatatgctgcttagcaaagcagcatccgatggaaagttgcgcttccgctcagaaagattccggcactcccgaatctggcacttctttgcagactacttcccggctaagctgcacaagacgcacgatcttcccgccgataggaagtacatctttggttatcacccccacggcatcatctcacatggcgcttacgccgcttttgccaccgaagccctcggtttctctgagaaattccccggaattaccaacagcctgcttaccctggacagtaacttccgcattccgatttaccgcgactatatccttagcatgggcctccgctccgtttcgaaggagtcaatcaccaatatcctcagccgcggcggtactgacggtcacggcgcgggccgtgctgttaccattgttattggtggtgctcgagaatcactggaggctcaacctggtacactccgtctcgtgctcggcgagcgcaagggcttcgtcaaggtggccatgcgcactggcgctgacatcgtccccgtgctcgcatttggcgagaacgatctctacgatcaggtcagtcccaagagccatccgtacttgcataggctccagatgtttgtgctccgaaccctcaagttcactctgccgtttttgcatggaagaggcattttcaactacgatgtgggcctgatgccataccgccggccgttgaacattgttgtcggcaagccgatccgggttacaaagagggccgagagcgacctggagacaagcgagattgaccagctacacggcctttatgtaaaggagctggaaaagatgtgggagcgctacaaggacgggtttgccccagaacggattgaggaaatgcagatactgaaatag

SEQ ID NO: 19435 - protein, 609 aa, Neurospora crassa
MADASGPLPPRSGSLSRKKSGKKNKKNNQKAAHSEIPVLKGVDKHAAQTSASADQASGTPANQKEKQLHTKTSIPDLKPSTTSVDSTATASASASLGSLNTKASHEKPAKMSNKDKRAVTDESADFSISDPATTNPATPSSTQVDGVLETDTPRTEVSQTAGTAPSTGIDYADALKDALKESGTKEGTEERVEDLPQEGAREEPAEKAAKKTVLPIHDNTAREEPSNADHDVRREKQALYDEYPSLYFEGSDNELAQMERDRANAYQAAGIRFAPFNIPLQRRLQTLAVLLHSLIIATTVSFFFFLCAIPLLWPLVIPYLLHMLLSKAASDGKLRFRSERFRHSRIWHFFADYFPAKLHKTHDLPADRKYIFGYHPHGIISHGAYAAFATEALGFSEKFPGITNSLLTLDSNFRIPIYRDYILSMGLRSVSKESITNILSRGGTDGHGAGRAVTIVIGGARESLEAQPGTLRLVLGERKGFVKVAMRTGADIVPVLAFGENDLYDQVSPKSHPYLHRLQMFVLRTLKFTLPFLHGRGIFNYDVGLMPYRRPLNIVVGKPIRVTKRAESDLETSEIDQLHGLYVKELEKMWERYKDGFAPERIEEMQILK

SEQ ID NO: 19436 - DNA, 1839 bp, Mus musculus
  CDS (51)..(1055)
aagaggtaatccgcaaagcccgtgtgtagagcctcctgagccagctcagcatggtggagttcgcccccctgttggtaccatgggagcgcaggttacagaccttcgcggtccttcagtgggtcttctccttcctggccttggcccagctctgcatcgtcatcttcgtaggcctcctattcacaaggttctggctcttctctgtcctgtatgccacctggtggtacctggactgggacaagccgcggcagggaggccggcccatccagttcttcagacgcttggccatatggaagtacatgaaggattatttccctgtctctttggtcaagacagctgagctggacccttcccggaactacatcgcgggcttccacccccatggagtcctagcagctggagcctttcttaacctgtgcactgaaagcacgggctttacctcgcttttcccgggcatccgctcctatctgatgatgctgactgtgtggttccgggcccccttcttccgagattacatcatgtctggggggctggtctcatcagaaaaggtgagtgccgatcacattctgtccaggaagggcggcgggaacttgcttgccatcatcgttgggggcgcacaggaggcactggacgccaggcctggagcctacaggctgctgctgaagaatcgcaagggcttcatcaggctcgccctgatgcatggggcagctcttgtgccaatcttctcctttggagaaaacaacctgttcaaccaggttgagaacacccctggtacctggctgcgctggatccagaaccggctacagaagatcatgggcatctccctccctctcttccacggcagaggtgtcttccagtacagctttggcctcatgcccttccgccagcccatcaccaccatagtggggaagcccatcgaggtgcagatgacaccacagccctcaagggaggaggtggaccggcttcatcagcgctatatcaaggagctctgcaagctctttgaggagcacaaactcaagttcaacgtccctgaggaccagcatctggagttctgctaagtgtctccagccggaagacagctgcatctgagcgcctgcaggagtgtgggattagggggacttccacagccaccagacactcctacaaacctagccacaactgccaagatggaagagggggcagctcctaatcctgggatttgaacctgtagccaaagctctgaggtctccctgtccttggcctgtctgcacatctgtagaatgggggaaaagcagtcagagagaaattcctgaggtctcttcccacagttgtaatgtcattcaaacatgaccaaaggacaaacagggagaaagagaacaaaactgttcttcatctacccttgagggacagtgcaagagaagccagcaccccaggcctccctgtgcatggtccctgatgctgcttcttccctctgaggcagagacggggagccaagtctgccctggcacctactctatgtttcttcagattctgggtcctctgagctatgataccaaaggagcccagaaggcagataaggagggcaggggtcactgactatgaccgagggtaggtctccttcccatatcctgagcctcagtttccccagccttaatgacctgggagcgccacactgctcaccacagaggctccaccagagagcctcttactcatgctttctagtgaactccagcctctgtcttggcactgaagggcagcactgtacatgttacctcaataaatgaaaggagtctgtcttaaaaaaaaaaaaaaaaaaaaaaaaaaaaaaaaaaaaaaaaaaaaaaaaaaaaaaaaaaaaaaaag

SEQ ID NO: 19437 - protein, 334 aa, Mus musculus
MVEFAPLLVPWERRLQTFAVLQWVFSFLALAQLCIVIFVGLLFTRFWLFSVLYATWWYLDWDKPRQGGRPIQFFRRLAIWKYMKDYFPVSLVKTAELDPSRNYIAGFHPHGVLAAGAFLNLCTESTGFTSLFPGIRSYLMMLTVWFRAPFFRDYIMSGGLVSSEKVSADHILSRKGGGNLLAIIVGGAQEALDARPGAYRLLLKNRKGFIRLALMHGAALVPIFSFGENNLFNQVENTPGTWLRWIQNRLQKIMGISLPLFHGRGVFQYSFGLMPFRQPITTIVGKPIEVQMTPQPSREEVDRLHQRYIKELCKLFEEHKLKFNVPEDQHLEFC

SEQ ID NO: 19438 - DNA, 1074 bp, Homo sapiens
  CDS (70)..(1074)
aaaacctgtgggtgcctcagaccacagcagagctcacagaacctgcgggagccaggctgacccgccagcatggtagagttcgcgcccttgtttatgccgtgggagcgcaggctgcagacacttgctgtcctacagtttgtcttctccttcttggcactggccgagatctgcactgtgggcttcatagccctcctgtttacaagattctggctcctcactgtcctgtatgcggcctggtggtatctggaccgagacaagccacggcaggggggccggcacatccaggccatcaggtgctggactatatggaagtacatgaaggactatttccccatctcgctggtcaagactgctgagctggacccctctcggaactacattgcgggcttccacccccatggagtcctggcagtcggagcctttgccaacctgtgcactgagagcacaggcttctcttcgatcttccccggtatccgcccccatctgatgatgctgaccttgtggttccgggcccccttcttcagagattacatcatgtctgcagggttggtcacatcagaaaaggagagtgctgctcacattctgaacaggaagggtggcggaaacttgctgggcatcattgtagggggtgcccaggaggccctggatgccaggcctggatccttcacgctgttactgcggaaccgaaagggcttcgtcaggctcgccctgacacacggggcacccctggtgccaatcttctccttcggggagaatgacctatttgaccagattcccaactcttctggctcctggttacgctatatccagaatcggttgcagaagatcatgggcatctccctcccactctttcatggccgtggtgtcttccagtacagctttggtttaataccctaccgccggcccatcaccactgtggtggggaagcccatcgaggtacagaagacgctgcatccctcggaggaggaggtgaaccagctgcaccagcgttatatcaaagagctgtgcaacctcttcgaggcccacaaacttaagttcaacatccctgctgaccagcacttggagttctgctga

SEQ ID NO: 19439 - protein, 334 aa, Homo sapiens
MVEFAPLFMPWERRLQTLAVLQFVFSFLALAEICTVGFIALLFTRFWLLTVLYAAWWYLDRDKPRQGGRHIQAIRCWTIWKYMKDYFPISLVKTAELDPSRNYIAGFHPHGVLAVGAFANLCTESTGFSSIFPGIRPHLMMLTLWFRAPFFRDYIMSAGLVTSEKESAAHILNRKGGGNLLGIIVGGAQEALDARPGSFTLLLRNRKGFVRLALTHGAPLVPIFSFGENDLFDQIPNSSGSWLRYIQNRLQKIMGISLPLFHGRGVFQYSFGLIPYRRPITTVVGKPIEVQKTLHPSEEEVNQLHQRYIKELCNLFEAHKLKFNIPADQHLEFC

SEQ ID NO: 19440 - DNA, 1263 bp, Homo sapiens
  CDS (171)..(1196)
cccactcacacacctmmskawmrsrmgyyrmyccacgcgtccgtttgcgacttagccaggcccccaaagctgggctcctgtagggagaaagtctgcccaggtccacatccaagccttcatcgtttgtcctccgggttctgggatcctgctggaagaggggagcttctgcaatgggagttgccacaaccctgcagcccccaaccacttccaaaaccttgcagaagcagcatctagaagcagtgggcgcctaccaatatgtgctcactttcctcttcatgggccctttcttctcccttcttgtctttgtcctcctcttcacgtcactctggcccttctctgttttttacttggtgtggctctatgtggactgggacacacccaaccaaggtggaaggcgttcggagtggataaggaaccgggcaatttggagacaactaagggattattatcctgtcaagctggtgaaaacagcagagctgcccccggatcggaactacgtgctgggcgcccaccctcatgggatcatgtgtacaggcttcctctgtaatttctccaccgagagcaatggcttctcccagctcttcccggggctccggccctggttagccgtgctggctggcctcttctacctcccggtctatcgcgactacatcatgtcctttggactctgtccggtgagccgccagagcctggacttcatcctgtcccagccccagctcgggcaggccgtggtcatcatggtggggggtgcgcacgaggccctgtattcagtccccggggagcactgccttacgctccagaagcgcaaaggcttcgtgcgcctggcgctgaggcacggggcgtccctggtgcccgtgtactcctttggggagaatgacatctttagacttaaggcttttgccacaggctcctggcagcattggtgccagctcaccttcaagaagctcatgggcttctctccttgcatcttctggggtcgcggtctcttctcagccacctcctggggcctgctgccctttgctgtgcccatcaccactgtggtgggccgccccatccccgtcccccagcgcctccaccccaccgaggaggaagtcaatcactatcacgccctctacatgacggccctggagcagctcttcgaggagcacaaggaaagctgtggggtccccgcttccacctgcctcaccttcatctaggcctggccgcggcctttcgctgagcccctgagcccaaggcactgagacctccacccactgtggactc

SEQ ID NO: 19441 - protein, 341 aa, Homo sapiens
MGVATTLQPPTTSKTLQKQHLEAVGAYQYVLTFLFMGPFFSLLVFVLLFTSLWPFSVFYLVWLYVDWDTPNQGGRRSEWIRNRAIWRQLRDYYPVKLVKTAELPPDRNYVLGAHPHGIMCTGFLCNFSTESNGFSQLFPGLRPWLAVLAGLFYLPVYRDYIMSFGLCPVSRQSLDFILSQPQLGQAVVIMVGGAHEALYSVPGEHCLTLQKRKGFVRLALRHGASLVPVYSFGENDIFRLKAFATGSWQHWCQLTFKKLMGFSPCIFWGRGLFSATSWGLLPFAVPITTVVGRPIPVPQRLHPTEEEVNHYHALYMTALEQLFEEHKESCGVPASTCLTFI

SEQ ID NO: 19442 - DNA, 906 bp, Mus musculus
  CDS (1)..(906)
atgatggtcgagttcgcgccactcaacaccccgctggcacggtgcctacagaccgctgcggtgctgcagtgggtcctgtccttcctcctgctcgtgcaggtgtgcattggaattatggtgatgctggtcctgtacaactattggttcctttacatcccatatctggtctggttttactatgactggagaaccccagagcaaggaggcagaagatggaactgggtccaaagctggcctgtgtggaagtattttaaggagtattttccaatctgtcttgtcaaaacgcaggatttggatccgggtcacaattatatatttgggtttcaccctcatggaatattcgtgcctggagcctttggaaatttttgtacaaaatactcggacttcaagaagctatttcctggctttacatcgtatctccacgtggccaagatctggttctgtttcccgttgttccgagaatatctgatgagtaacgggccggtttcagtgtctaaggagagtttgtctcatgtgctgagcaaggatggaggtggcaatgtctcaatcattgtcctcggaggtgcaaaggaggcgctggaggctcacccaggaacattcaccctgtgcatccgccagcgcaaagggtttgttaagatggccttgacccatggtgccagtttggttccagtattttcctttggtgaaaatgatctatataagcaaattaacaaccccaaaggctcctggctacgaactatacaagacgcaatgtatgattcaatgggagtagccttgccactgatatatgccagaggaattttccagcactactttggcataatgccctatcggaagctgatctacactgttggcttattgggactggaaattccagcaataaattggctgatcctcactctatga

SEQ ID NO: 19443 - protein, 301 aa, Mus musculus
MMVEFAPLNTPLARCLQTAAVLQWVLSFLLLVQVCIGIMVMLVLYNYWFLYIPYLVWFYYDWRTPEQGGRRWNWVQSWPVWKYFKEYFPICLVKTQDLDPGHNYIFGFHPHGIFVPGAFGNFCTKYSDFKKLFPGFTSYLHVAKIWFCFPLFREYLMSNGPVSVSKESLSHVLSKDGGGNVSIIVLGGAKEALEAHPGTFTLCIRQRKGFVKMALTHGASLVPVFSFGENDLYKQINNPKGSWLRTIQDAMYDSMGVALPLIYARGIFQHYFGIMPYRKLIYTVGLLGLEIPAINWLILTL

SEQ ID NO: 19444 - DNA, 1167 bp, Homo sapiens
  CDS (1)..(1167)
atgaagaccctcatagccgcctactccggggtcctgcgcggcgagcgtcaggccgaggctgaccggagccagcgctctcacggaggacctgcgctgtcgcgcgaggggtctgggagatggggcactggatccagcatcctctccgccctccaggacctcttctctgtcacctggctcaataggtccaaggtggaaaagcagctacaggtcatctcagtgctccagtgggtcctgtccttccttgtactgggagtggcctgcagtgccatcctcatgtacatattctgcactgattgctggctcatcgctgtgctctacttcacttggctggtgtttgactggaacacacccaagaaaggtggcaggaggtcacagtgggtccgaaactgggctgtgtggcgctactttcgagactactttcccatccagctggtgaagacacacaacctgctgaccaccaggaactatatctttggataccacccccatggtatcatgggcctgggtgccttctgcaacttcagcacagaggccacagaagtgagcaagaagttcccaggcatacggccttacctggctacactggcaggcaacttccgaatgcctgtgttgagggagtacctgatgtctggaggtatctgccctgtcagccgggacaccatagactatttgctttcaaagaatgggagtggcaatgctatcatcatcgtggtcgggggtgcggctgagtctctgagctccatgcctggcaagaatgcagtcaccctgcggaaccgcaagggctttgtgaaactggccctgcgtcatggagctgacctggttcccatctactcctttggagagaatgaagtgtacaagcaggtgatcttcgaggagggctcctggggccgatgggtccagaagaagttccagaaatacattggtttcgccccatgcatcttccatggtcgaggcctcttctcctccgacacctgggggctggtgccctactccaagcccatcaccactgttgtgggagagcccatcaccatccccaagctggagcacccaacccagcaagacatcgacctgtaccacaccatgtacatggaggccctggtgaagctcttcgacaagcacaagaccaagttcggcctcccggagactgaggtcctggaggtgaactga

SEQ ID NO: 19445 - protein, 388 aa, Homo sapiens
MKTLIAAYSGVLRGERQAEADRSQRSHGGPALSREGSGRWGTGSSILSALQDLFSVTWLNRSKVEKQLQVISVLQWVLSFLVLGVACSAILMYIFCTDCWLIAVLYFTWLVFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVSRDTIDYLLSKNGSGNAIIIVVGGAAESLSSMPGKNAVTLRNRKGFVKLALRHGADLVPIYSFGENEVYKQVIFEEGSWGRWVQKKFQKYIGFAPCIFHGRGLFSSDTWGLVPYSKPITTVVGEPITIPKLEHPTQQDIDLYHTMYMEALVKLFDKHKTKFGLPETEVLEVN

SEQ ID NO: 19446 - DNA, 1133 bp, Umbelopsis ramanniana
  CDS (40)..(1089)
cgcgattcgacaccggtgatcactgaacataaacaaccaatggaacaagtccaagtcactgcattgctcgaccacattcccaaagtccattgggcaccgctccgtgggatccctttgaagcgtcgcttacaaacgtcggctatcgtcacatggctggctttgcttcctatctgtctcattatatacctgtacctattcaccattcccttattatggcccatcctcattatgtatacgatatggctgtttttcgacaaagcccctgaaaacggaggcagacgaatttcgctggtgaggaaattgccgctgtggaagcattttgccaattatttcccagtcactttgatcaaggaaggagacctcgaccccaagggaaactacatcatgtcatatcatccgcatggaataatatccatggcggcttttgccaattttgcgactgaggcgactgggttttccgagcaatatccgggtattgttccttcattactgacgctagcatccaattttcggttgccattgtaccgagatttcatgatgtcactaggcatgtgctcggtatcgcgacactcctgtgaagctatccttcgttcggggcccggtcgatccattgtgattgttacaggcggagcttcagaatcccttagcgcacgaccaggcaccaacgacctcaccctcaagaaacgattgggtttcatccgactagccattcgaaatggtgccagtttagtgcctatcttttcgtttggagagaacgacatctacgagcaatatgataacaaaaagggcagtttgatatggcggtaccaaaaatggttccaaaaaattacaggattcacggttcctttggctcatgcccgtggcattttcaactacaatgctgggtttataccattccgacatccgatagtgacagttgttggcaaacctattgctgtccccctcttggctgaaggcgaaaccgaacctagcgaggagcaaatgcatcaagttcaagcacagtacattgaaagtttgcaggctatttatgataaatacaaagatatttatgctaaggatagaataaaagatatgaccatgattgcataataaacctccccggcaatgcctatttcgacatctgccacgcacgc

SEQ ID NO: 19447 - protein, 349 aa, Umbelopsis ramanniana
MEQVQVTALLDHIPKVHWAPLRGIPLKRRLQTSAIVTWLALLPICLIIYLYLFTIPLLWPILIMYTIWLFFDKAPENGGRRISLVRKLPLWKHFANYFPVTLIKEGDLDPKGNYIMSYHPHGIISMAAFANFATEATGFSEQYPGIVPSLLTLASNFRLPLYRDFMMSLGMCSVSRHSCEAILRSGPGRSIVIVTGGASESLSARPGTNDLTLKKRLGFIRLAIRNGASLVPIFSFGENDIYEQYDNKKGSLIWRYQKWFQKITGFTVPLAHARGIFNYNAGFIPFRHPIVTVVGKPIAVPLLAEGETEPSEEQMHQVQAQYIESLQAIYDKYKDIYAKDRIKDMTMIA

SEQ ID NO: 19448 - DNA, 1280 bp, Umbelopsis ramanniana
  CDS (26)..(1093): n means a or g or c or t/u
tgcaaagtcacactttcagtcagccatggccagcaaggatcaacatttacagcagaaggtcaagcatacgctagaagctatcccatcccctcgctatgctccattgcgagtgccattaagacggagattacaaacattggcagttttattatggtgttccatgatgtcaatatgcatgttcatattcttctttttatgctccattcctgttctcctttggttccccattatcctttatttgacctggatcttggtgtgggataaggcgccagagaacggtggaagacctattcgctggctgcggaatgctgcttggtggaagctgtttgcagggtattttcccgcacatgtcatcaaggaagccgatttagatccatccaagaactacatctttggttatcacccccatggaatcatatccatgggctcgttctgtacttttagtaccaatgctactggctttgatgacttgttcccaggcatccggccatcgcttttgacattaacatctaattttaatatcccactttatcgtgattatttgatggcgtgcggactttgctccgtctccaaaacatcctgtcaaaatattttaaccaaaggtggtccgggccgttccattgccattgtcgtgggaggtgcttccgagtctctcaatgctagacccggtgtcatggaccttgtgttgaagagacgctttggttttatcaagattgctgttcaaaccggtgcaagtctagtgcccactatcagttttggtgaaaatgagctgtacgaacagattgaaagcaatgaaaactcaaagttgcatagatggcaaaagaagattcaacatgcccttggttttactatgccgctctttcatggacgcggtgtattcaattatgactttggtttgctcccccatcgccatcctatctacacgattgttggaaagcccatccccgtccctagcatcaagtatggacagacaaaggatgagattataagagaactacatgactcgtacatgcatgccgtgcaggatctctatgatcgttacaaggatatctatgcaaaggatcgggtaaaagaactagaattcgtcgaatagttgggttgttaccatttaacgttttcttcaaatttttcattgattataccgcttcatcccgacctggttttttattgaatgggtttctcatctccagttcaattcccactcctgcatgtatctattatcatcatcctttctaataatgaaaaccttttgaacgtttcataannaanagaaananana

SEQ ID NO: 19449 - protein, 355 aa, Umbelopsis ramanniana
MASKDQHLQQKVKHTLEAIPSPRYAPLRVPLRRRLQTLAVLLWCSMMSICMFIFFFLCSIPVLLWFPIILYLTWILVWDKAPENGGRPIRWLRNAAWWKLFAGYFPAHVIKEADLDPSKNYIFGYHPHGIISMGSFCTFSTNATGFDDLFPGIRPSLLTLTSNFNIPLYRDYLMACGLCSVSKTSCQNILTKGGPGRSIAIVVGGASESLNARPGVMDLVLKRRFGFIKIAVQTGASLVPTISFGENELYEQIESNENSKLHRWQKKIQHALGFTMPLFHGRGVFNYDFGLLPHRHPIYTIVGKPIPVPSIKYGQTKDEIIRELHDSYMHAVQDLYDRYKDIYAKDRVKELEFVE

SEQ ID NO: 19450 - DNA, 1152 bp, Mus musculus
  CDS (73)..(1080)
gagctggagcctcggcctcccagtcggtagcagtaccacaaatcctgcgaaaggcatcctccgggtgaaaccatgatggtcgagttcgcgccactcaacaccccgctggcacggtgcctacagaccgctgcggtgctgcagtgggtcctgtccttcctcctgctcgtgcaggtgtgcattggaattatggtgatgctggtcctgtacaactattggttcctttacatcccatatctggtctggttttactatgactggagaaccccagagcaaggaggcagaagatggaactgggtccaaagctggcctgtgtggaagtatttttttctgtattttccaatctgtcttgtcaaaacgcaagatttggatccgggtcacaattatatatttggatttcaccctcatggaatattcgtgcctggagcctttggaaatttttgtacaaaatactcagacttcaagaagctatttcctggctttacatcgtatctccacgtggccaagatctggttctgtttcccgttgttccgagaatatctgatgagtaacgggccggtttcagtgtctaaggagagtttgtctcatgtgctgagcaaggatggaggtggcaatgtctcaatcattgtcctcggaggtgcaaaggaggcgctggaggctcacccaggaacattcaccctgtgcatccgccagcgcaaagggtttgttaagatggccttgacccatggtgccagtttggttccagtattttcttttggtgaaaatgatctatataagcaaattaacaaccccaaaggctcctggctacgaactatacaagacgcaatgtatgattcaatgggagtagccttgccactgatatatgccagaggaattttccagcactactttggcataatgccctatcggaagctgatctacactgttgttggccgccccatccctgttcagcagactctgaacccgacctcagagcagattgaagagctgcatcagacatacctagaggagctaaagaaactgttcaatgaacacaaagggaaatatgggattccggagcacgaaactctggtatttaaataacctccttcctccaaggcataagaaaggaaggcaagaaagcatcgttgagaaaataaataaataattcttctg

SEQ ID NO: 19451 - protein, 335 aa, Mus musculus
MMVEFAPLNTPLARCLQTAAVLQWVLSFLLLVQVCIGIMVMLVLYNYWFLYIPYLVWFYYDWRTPEQGGRRWNWVQSWPVWKYFFLYFPICLVKTQDLDPGHNYIFGFHPHGIFVPGAFGNFCTKYSDFKKLFPGFTSYLHVAKIWFCFPLFREYLMSNGPVSVSKESLSHVLSKDGGGNVSIIVLGGAKEALEAHPGTFTLCIRQRKGFVKMALTHGASLVPVFSFGENDLYKQINNPKGSWLRTIQDAMYDSMGVALPLIYARGIFQHYFGIMPYRKLIYTVVGRPIPVQQTLNPTSEQIEELHQTYLEELKKLFNEHKGKYGIPEHETLVFK

SEQ ID NO: 19452 - DNA, 2263 bp, Mus musculus
  CDS (202)..(1368)
ccgcgcttcgctggctttctgctcatctagggtggcagcggctacctacctcagctctcgccctgctgccgccacggcctgggcgctgtccctcagctcccggagctcagcgcgaagccctggccccggcggccggggcatgggtcaggggcgcggcgtgaggcggctttctgcacggccgtgacgtgcattggcttcagcatgaagaccctcatcgccgcctactccggggtcctgcggggtgagcgtcgggcggaagctgcccgcagcgaaaacaagaataaaggatctgccctgtcacgcgaggggtctgggcgatggggcactggctccagcatcctctcagccctccaagacatcttctctgtcacctggctcaacagatctaaggtggaaaaacagctgcaggtcatctcagtactacaatgggtcctatccttcctggtgctaggagtggcctgcagtgtcatcctcatgtacaccttctgcacagactgctggctgatagctgtgctctacttcacctggctggcatttgactggaacacgcccaagaaaggtggcaggagatcgcagtgggtgcgaaactgggccgtgtggcgctacttccgagactactttcccatccagctggtgaagacacacaacctgctgaccaccaggaactatatctttggataccacccccatggcatcatgggcctgggtgccttctgtaacttcagcacagaggctactgaagtcagcaagaagtttcctggcataaggccctatttggctacgttggctggtaacttccggatgcctgtgcttcgcgagtacctgatgtctggaggcatctgccctgtcaaccgagacaccatagactacttgctctccaagaatgggagtggcaatgctatcatcatcgtggtgggaggtgcagctgagtccctgagctccatgcctggcaagaacgcagtcaccctgaagaaccgcaaaggctttgtgaagctggccctgcgccatggagctgatctggttcccacttattcctttggagagaatgaggtatacaagcaggtgatctttgaggagggttcctggggccgatgggtccagaagaagttccagaagtatattggtttcgccccctgcatcttccatggccgaggcctcttctcctctgacacctgggggctggtgccctactccaagcccatcaccaccgtcgtgggggagcccatcactgtccccaagctggagcacccgacccagaaagacatcgacctgtaccatgccatgtacatggaggccctggtgaagctctttgacaatcacaagaccaaatttggccttccagagactgaggtgctggaggtgaactgacccagcccgcgcgtgccagctcctgggagggacgactgcagatccttttctaccgagttctcgagtgcattttgttctgtaaatttggaagcgtcatgggtgtctgtgggttatttaaaagaaattataatttgttaaaccattgcaatgttagatgttttttaagaagggaagagtcagtattttaagctcacttctagtgtgtcctgctcaaggtggaggctgatatttatgggccttggtggtttcttacccaccccttctagcgttccccagacgacagacacttggccctggctagctgggcaagggcagtccttagtgactccagggattcttgagaggcagaggccatgtcccacccgtggctgcaggtcgggttcctcgtaccaaggggaggctgagggcacagctggccccacttggggagggtagataacatctggactgcccggcttgggtctctgctcctcaccctagccctcttctccaatctgagcctaccctggcctcctgtctcctggctagggacacggctgtcccacaggtgccgtcttgggttatctcgctgctgttggctggtttcactctggaggttggcaccatggacacagctcagcgttgctctggcgcatatcctcctgagccacaccccaagtctggtgtgaggaagggcttctcttctcttcacagaggtgcctggcttcttgtgcagcacactgggtccaggacaggaggacccccccaaaccaagcctcacgtgtgtgcctttatgaggcgttgggagaaagctaccctcctgtgtattctgttttctccatgagattgttgtgccatgtcacacttttgtatattcctagactaataaatggaaacaagaaaaaaaaaaaaaaaa

SEQ ID NO: 19453 - protein, 388 aa, Mus musculus
MKTLIAAYSGVLRGERRAEAARSENKNKGSALSREGSGRWGTGSSILSALQDIFSVTWLNRSKVEKQLQVISVLQWVLSFLVLGVACSVILMYTFCTDCWLIAVLYFTWLAFDWNTPKKGGRRSQWVRNWAVWRYFRDYFPIQLVKTHNLLTTRNYIFGYHPHGIMGLGAFCNFSTEATEVSKKFPGIRPYLATLAGNFRMPVLREYLMSGGICPVNRDTIDYLLSKNGSGNAIIIVVGGAAESLSSMPGKNAVTLKNRKGFVKLALRHGADLVPTYSFGENEVYKQVIFEEGSWGRWVQKKFQKYIGFAPCIFHGRGLFSSDTWGLVPYSKPITTVVGEPITVPKLEHPTQKDIDLYHAMYMEALVKLFDNHKTKFGLPETEVLEVN

SEQ ID NO: 19454 - DNA, 1023 bp, Caenorhabditis elegans
  CDS (1)..(1023)
atgccgcaatttctcggaatagaatgggtggatctattctcatcaattcaacgtaaaaagacatacttgggagttgtctatcactttatgctcacttacccacttgcacttttcgtcaccattttgccatttttcttgcttttcactttccaatggcacattttggctctctacgcttgctggtacttctacgatatggattctccgaggagaggtggatattccagtgattgggtcagaaaatggcgtgtcaacgactggttcgcccaatacttcccaatcaacttgcacaaaactgccgaactctccacggacaagaactatctggttggaatccatcctcatggtatcatctccatggctgcatggtctaattttgccaccaatggaacgggaatctatgagaaattccctggaattcgctggaatttgtgcactttagcacttcagttcagaatggccatccgtcgtgagcttctccttctcaccggcctaatcgactgctccagagaatccattgaatatgtgcttgacaaatgtggccagaagggacgtgcagtggtattggtgattggaggagccgaagaagctttagatgctcatccaggctaccacacactcactttggcatcaagaaagggatttgttcgggaggctttgattactggtgcctacttggtcccggtgtattcttttggagagaatgacgtttttgaacagatggagaatccagttggctcacggctccgcaacttccaagaatggtgcaaaagcattttcggcatctcatatccaattttccatggtcgtggcttcttccaactaactttcggatatcttccattccgtaaaccaatcgataccgtagtcggagccccaattcccgttgaaaaagtggaaaatccgacgaaagagcaaatcgacgagcttcacaccatttattgtcaaaagttgacggagctgttcgatgagcacaaggaaaaatatggagtggagaaggacgtgccgttggtgctccggtag

SEQ ID NO: 19455 - protein, 340 aa, Caenorhabditis elegans
MPQFLGIEWVDLFSSIQRKKTYLGVVYHFMLTYPLALFVTILPFFLLFTFQWHILALYACWYFYDMDSPRRGGYSSDWVRKWRVNDWFAQYFPINLHKTAELSTDKNYLVGIHPHGIISMAAWSNFATNGTGIYEKFPGIRWNLCTLALQFRMAIRRELLLLTGLIDCSRESIEYVLDKCGQKGRAVVLVIGGAEEALDAHPGYHTLTLASRKGFVREALITGAYLVPVYSFGENDVFEQMENPVGSRLRNFQEWCKSIFGISYPIFHGRGFFQLTFGYLPFRKPIDTVVGAPIPVEKVENPTKEQIDELHTIYCQKLTELFDEHKEKYGVEKDVPLVLR

SEQ ID NO: 19456 - DNA, 1269 bp, Drosophila melanogaster
  CDS (122)..(1180)
agttaaatgttgtacgctcgcatcgtcggttctgctgctcaaacgcgataacgatccattactcgccggaggaccgtgctaccaagtagttcaactttccgagttcgagagctctgacatcatgaaaatcgagtgggctcccaaaggagttcccatggaacggcgtcgccagacgtttgccatggccttcctaatcctatcctttatgatactctcctttggatcctatttcttcgttgctgccgtgctgttctatggaagccttttgtggcgcaccattatggtcatctatttggtctacgtctacgcgaatcacaagagaacccactccattatggatggcaatggctggaaaattaaccgcaacaattggctgtttcggcattatcgggactactttcccgtacagctggtcaagaccgcagagctgccgccgaataagaactacattttggccagttttccgcacggaattttggggactggcatttccattaatatgggtctagacatctccaagtggctgcaactgttcccacaggtgaggcccaaggtggccactttggatcaaaacttcctgacgcccatcgtgcgtggtctcctgagatcttggggcctggtgtcggtttccaaggaggccttagtatatctgctaaccaaatcaaacgatcccaagcacaaggacaatcgtgatgggttcacctccaacgcggtggctattctggtgggtggtgcccaggaggcactagactcgcaccctggcaaatatatattgacactgaagaaccgcaagggattcgttaaaatggccattaggacagggtcttcgattgttcccacgttttcctttggcgaggtggacattctggatcaggttgccaatccaccgaactctcgggttcgtcgctttcaagactttgtaaagaggataacggggatatctccgctgattcccgttggccggggcatcttcaactactcctttggctttctgcccaaccgtcgacgcattgtccaagttgttggcgctcccatcgacgtggttcagagcgatcaaccagacgcagcctatgtggataagatacacaaacaggttattgacgacctggagaagatgttcgccaagtacaaggatcagtacataccgaactccaagcaggacaagctgattatacactagtcgagaagttattgtctaaacaatgtgatcaaatgagtgctttataagcatttaatataaaaattacgaattttatcaggcaaataaaa

SEQ ID NO: 19457 - protein, 352 aa, Drosophila melanogaster
MKIEWAPKGVPMERRRQTFAMAFLILSFMILSFGSYFFVAAVLFYGSLLWRTIMVIYLVYVYANHKRTHSIMDGNGWKINRNNWLFRHYRDYFPVQLVKTAELPPNKNYILASFPHGILGTGISINMGLDISKWLQLFPQVRPKVATLDQNFLTPIVRGLLRSWGLVSVSKEALVYLLTKSNDPKHKDNRDGFTSNAVAILVGGAQEALDSHPGKYILTLKNRKGFVKMAIRTGSSIVPTFSFGEVDILDQVANPPNSRVRRFQDFVKRITGISPLIPVGRGIFNYSFGFLPNRRRIVQVVGAPIDVVQSDQPDAAYVDKIHKQVIDDLEKMFAKYKDQYIPNSKQDKLIIH

SEQ ID NO: 19458 - DNA, 1280 bp, Drosophila melanogaster
  CDS (140)..(1198)
ccgagagccgataaggataagtataagtctagtacagggcaatttgaccatcgctggcttccatatcattcagtcgtgggagaaccgccgaaagagcagctggtggagtttttttgggcatttttgtaacacagcagacatgaaaatcgagtgggcaccactgcgggttcctctggaacgccgactgcagatactggtcacggcctttttcacctccatgctgctgatactattgtcagtttccttccttttggtagctggatcactgatctacggaggtcttttggtgcgtagtctgatggtaacttacttggcctacgtctttgtgcaccacaagaaaacccaatccgttgtggatggcaatggctggatgataacacgcaccaaccttttgcatcgccactatcgtgattactttcccgtggagctggtgaaaacagccgaactgccagctactaagaactacatcttggccagctttccccacggaattctgggcacaggcattggcattaacatgggcttggaaatctccaagtggctggagctattcccccaagtgcgtcccaaactgggcactctggatcagcatttccatgttccgttcatgcgtgaggtcctccgctgctggggtctggtgtcagtgtccaaagaggcgctgatccgtatgctcagcaagtcaaatgatcccaagcacaaggataatcgggatggtttcacctccaatgcggtggccattctggttggcggtgcccaggaagccatggactctcatcctgggcagtacattttaaccttgaagaataggaaaggcttcgtgcgaatggccattagaacgggctcatcgattgttccttcattttcctttggagaggtggacattttcgatcaggtggcaaatccccccaactcgctgctccgacggtttcaggactttgtcaagaagctcaccggagtctctccgctgattcctgtgggccgcggattcttcaactacacctttggcttcctcccattccgacgacgcattgtccaagttgttggtgctcccatcgatgttgttaagaacgagcacccagactcggagtatgtggataaagtgcatggacaggtcattgagtcgctggagaagttattcgatcagtacaaagacaagtacttggagaattcgaagagtgccactctagttgtacactagttttaaatcatgttgatacaaaatattcctatgtattgaaatagaaacgagctttttaattgaaaaaaaaaaaaaaaaaaaa

SEQ ID NO: 19459 - protein, 352 aa, Drosophila melanogaster
MKIEWAPLRVPLERRLQILVTAFFTSMLLILLSVSFLLVAGSLIYGGLLVRSLMVTYLAYVFVHHKKTQSVVDGNGWMITRTNLLHRHYRDYFPVELVKTAELPATKNYILASFPHGILGTGIGINMGLEISKWLELFPQVRPKLGTLDQHFHVPFMREVLRCWGLVSVSKEALIRMLSKSNDPKHKDNRDGFTSNAVAILVGGAQEAMDSHPGQYILTLKNRKGFVRMAIRTGSSIVPSFSFGEVDIFDQVANPPNSLLRRFQDFVKKLTGVSPLIPVGRGFFNYTFGFLPFRRRIVQVVGAPIDVVKNEHPDSEYVDKVHGQVIESLEKLFDQYKDKYLENSKSATLVVH

SEQ ID NO: 19460 - DNA, 1086 bp, Xenopus laevis
  CDS (1)..(1086)
atgaagacaatcattgctgcctattctggggtcttacgcggcactgggtccagtctcctgtcagcagtacatgacctgccctctatcccttggctgtccaaatcaagtgtggtgagacaccttcagatcatctctgttctacaatgggttctcagcttcctcattttaggtgtggcgtgcactgcagtccttgtgtacatcttctgcactgacctctggctgattgcagctttgtattttacatggatggtgcttgactggaatacaccatataaaggtggcagacgatcctcgtgggtaaggaactgggcagtctggcgctacttccgagactattttccagtaaagctggtaaaaacacacaacctcctgccaagcagaaactatatctttggctatcacccccatggaataatgtgccttggagccttttgtaacttcggtacagaagccaccggggtgtccaagaagtttcctgggatcaagtgtcacctggccacgttggcgggaaatttcagaatgcctgtactgagggaatacttgatgtctggaggtatatgccctgtgaaccgggacaccattaactacattctgtccaagaatggaactggcaacgctgttgttattgcggttgggggagctgccgaatctcttaactgcagacctgggaagaacactgtaacactattgcacagaaaaggatttgtgaaagttgcactgcagcatggagctgatcttgttcccatctactcgtttggtgaaaatgaaacttacaagcaggttgtctttgaggagggatcttggggaagatggatacagcaaaagtttcagaaatatgttggctttgctccatgtctcttccatgggtgcagcttcttctcctctaacagctgggggttggttccttatgccaatcctataacaactgttgttggagagccaatcacagttcccaagattgagcaacctacccagaaagacgtggagctctatcacagcatgtacttgtcatccctgcatcgactttttgacaagtacaaaaccaaactcgggctcccagattcagaaaccctggaattcatctga

SEQ ID NO: 19461 - protein, 361 aa, Xenopus laevis
MKTIIAAYSGVLRGTGSSLLSAVHDLPSIPWLSKSSVVRHLQIISVLQWVLSFLILGVACTAVLVYIFCTDLWLIAALYFTWMVLDWNTPYKGGRRSSWVRNWAVWRYFRDYFPVKLVKTHNLLPSRNYIFGYHPHGIMCLGAFCNFGTEATGVSKKFPGIKCHLATLAGNFRMPVLREYLMSGGICPVNRDTINYILSKNGTGNAVVIAVGGAAESLNCRPGKNTVTLLHRKGFVKVALQHGADLVPIYSFGENETYKQVVFEEGSWGRWIQQKFQKYVGFAPCLFHGCSFFSSNSWGLVPYANPITTVVGEPITVPKIEQPTQKDVELYHSMYLSSLHRLFDKYKTKLGLPDSETLEFI

SEQ ID NO: 19462 - DNA, 1918 bp, Xenopus tropicalis
  CDS (48)..(1133)
ggagctgggatcggtacctggctgcggtgaggcactggcctggcaacatgaagactatcattgctgcttactcgggggtcttacgcggcactgggtccagtctcctatcagcggtacatgaccttccaaatatcccctggctgtccaaatcaagtgtggtgagacatcttcagatcatctctgtcctacaatgggttctcagcttcctcatattgggtgtggcgtgcactgcagtactggtgtacatcttctgcactgacctctggctgattgcagctttgtatctgacatggatggtgcttgactggaatacaccatataaaggtggcaggcgatcctcatgggtacggaactgggcagtctggcgctacttcagagactattttccaataaagttggtaaaaacgcacaacctcctgccaagcagaaactatatcttcgggtatcacccccatggaataatgtgccttggagcattttgtaactttggaacagaagccactggtgtgtccaaaaagtttcctggaattaagtgtcacctggccacattagctggaaacttcagaatgcctgtactgagggaatatttaatgtccggaggtatatgccccgtggcccgggataccattgactacattctgtccaagaacggaactggaaatgctgtggttattgcagttgggggagccgcagaatcccttaactgcagacctgggaaaaacactgtaacgctcaagcagagaaaaggatttgtgaaagttgcactgcagcatggagctgatcttgttcctgtctactcatttggcgaaaatgaagcttacaagcaggtcgtctttgaggaggggtcttggggaagatggatacagaagaagtttcagaaatatgttggttttgccccatgtctcttccatgggtgcagcttcttctcctctaacagctgggggttggttccgtatgccaatccaataacaactgttgttggagaaccaatcaccgttcccaagatcgaacaacccacccagaaagatgttgaactttatcacgccatgtacgtgacatccctgcagcggctttttgacaagtacaaaactaagcttggtctccacgattcagaaatgctggaaattgtctgaatttgtaccctttgcattctgttatgtgctttctgtgacatgtaccctgactgtaataggggagagaactatatttttgacaatttgttgctagcaatcacacctgtatgaggtggaattctgaggtatgttcatttgctgaaaccagctgctgtatcgagtctagtactttaggctatgctctctacagaactggttttcatgatgacggaagttgttgtgatgggtctgccacctgccttctgtacagatatagtcttggggatcttgctaaaccatgtttctgccgccacatttgtgacctgctaaaagtaaaaagtacacatgtagatttgtttatggcccagtctatagtagaacatatctcctacgtgtgagtcttctgaaagctttaacttactttgctccatccaaatgcagttgcgcagccagagattcagataaaggcctcgccatttctacacttcacccaatatacaatgtacataatctcactattcctccaactgtctggaaataaagtaatattagggtgaagacgtacagagctgatcatttactgataattgcctctgcaaaaaaagacagttatcagtattgtctatggcagagtagttcctggcatttagtagctgctactaagtagctctgtatgtcttcacccttatcctgctgtcacaacttggttccttgtccagttacaagctgttcccagtctgggcttttgtaaaaaaaaaaaaaaataaacaacaatgaaaaaaaaaataaaaaaaaaaaaaaaaaaa

SEQ ID NO: 19463 - protein, 361 aa, Xenopus tropicalis
MKTIIAAYSGVLRGTGSSLLSAVHDLPNIPWLSKSSVVRHLQIISVLQWVLSFLILGVACTAVLVYIFCTDLWLIAALYLTWMVLDWNTPYKGGRRSSWVRNWAVWRYFRDYFPIKLVKTHNLLPSRNYIFGYHPHGIMCLGAFCNFGTEATGVSKKFPGIKCHLATLAGNFRMPVLREYLMSGGICPVARDTIDYILSKNGTGNAVVIAVGGAAESLNCRPGKNTVTLKQRKGFVKVALQHGADLVPVYSFGENEAYKQVVFEEGSWGRWIQKKFQKYVGFAPCLFHGCSFFSSNSWGLVPYANPITTVVGEPITVPKIEQPTQKDVELYHAMYVTSLQRLFDKYKTKLGLHDSEMLEIV

SEQ ID NO: 19464 - DNA, 26 bp, Primer
atgtcaggaacattcaatgatataag

SEQ ID NO: 19465 - DNA, 25 bp, Primer
ttacccaactatcttcaattctgca

SEQ ID NO: 19466 - DNA, 1605 bp, Saccharomyces cerevisiae
  CDS (1)..(1605)
atgagctctgacgaagaagatttcaacgacatctacggcgatgataagcctaccactactgaagaagtcaaaaaagaagaagaacaaaataaggctggcagtggtacctcgcaattagatcaactagccgcactacaagcattatcttctagcttgaacaaactaaataatccaaatagtaacaacagtagtagtaataatagtaaccaagacacatcttctagtaagcaagatggcactgcgaatgacaaggaaggttccaatgaagacactaagaatgaaaaaaaacaagaaagcgctacatcagcaaatgccaatgccaacgctagttctgcaggaccttctggcttaccttgggaacaacttcaacaaaccatgtcacaattccagcaaccatcttctcaatcaccacctcaacagcaagtaactcaaaccaaagaggaacgttcgaaagcggatttgtctaaagaaagttgcaagatgttcattggtggtctgaattgggacactacggaagataatcttcgcgaatattttggtaagtatggtaccgtcactgatttgaaaatcatgaaagaccctgcaacaggtagatctagagggttcggtttcttatcttttgaaaaaccttctagtgttgatgaagtggtaaagacacaacatatcctcgatggtaaagttatcgacccaaaaagagctatcccaagagacgagcaagataaaaccggtaaaatctttgttggtggtattggtcctgatgtgagaccaaaggaatttgaagaatttttttctcagtggggtacgattatcgatgcgcaactgatgttagataaggataccggtcaatcaagaggttttggttttgtgacgtatgactccgctgacgccgttgacagagtttgtcagaataaattcatcgatttcaaagatcgcaagatcgaaatcaagagagctgagccaagacatatgcaacaaaaatcatcaaacaatggtggtaacaatggtggaaacaacatgaatcgtcgtggcggtaacttcggtaaccaaggcgatttcaaccaaatgtatcaaaaccctatgatgggcggttacaacccaatgatgaatccgcaagcaatgacagattactatcaaaagatgcaagaatattaccaacaaatgcaaaagcaaactggtatggattatactcaaatgtaccaacaacaaatgcagcaaatggcaatgatgatgccagggtttgccatgccacctaatgcaatgactttaaaccaaccacagcaagattcaaatgccactcaaggttccccagcaccttctgattccgataataataaatccaatgacgtccaaactattggtaatacatcaaacactgactctggttcaccgccattgaatttacctaatggtccaaagggcccatcacaatacaatgatgaccacaatagcggttatggctacaaccgtgatcgcggtgatcgtgatcgtaacgatcgtgaccgcgattacaatcaccgtagtggtggaaaccatagaagaaacggccgtggtggtcgcggtggatacaatagacgtaataatggctaccatccatataataggtaa

SEQ ID NO: 19467 - protein, 534 aa, Saccharomyces cerevisiae
MSSDEEDFNDIYGDDKPTTTEEVKKEEEQNKAGSGTSQLDQLAALQALSSSLNKLNNPNSNNSSSNNSNQDTSSSKQDGTANDKEGSNEDTKNEKKQESATSANANANASSAGPSGLPWEQLQQTMSQFQQPSSQSPPQQQVTQTKEERSKADLSKESCKMFIGGLNWDTTEDNLREYFGKYGTVTDLKIMKDPATGRSRGFGFLSFEKPSSVDEVVKTQHILDGKVIDPKRAIPRDEQDKTGKIFVGGIGPDVRPKEFEEFFSQWGTIIDAQLMLDKDTGQSRGFGFVTYDSADAVDRVCQNKFIDFKDRKIEIKRAEPRHMQQKSSNNGGNNGGNNMNRRGGNFGNQGDFNQMYQNPMMGGYNPMMNPQAMTDYYQKMQEYYQQMQKQTGMDYTQMYQQQMQQMAMMMPGFAMPPNAMTLNQPQQDSNATQGSPAPSDSDNNKSNDVQTIGNTSNTDSGSPPLNLPNGPKGPSQYNDDHNSGYGYNRDRGDRDRNDRDRDYNHRSGGNHRRNGRGGRGGYNRRNNGYHPYNR

SEQ ID NO: 19468 - DNA, 1098 bp, Drosophila melanogaster
  CDS (1)..(1098)
atggtgaactcgaaccagaaccagaacggcaactccaatggccatgatgatgactttcctcaggactccatcaccgagccggagcatatgcgcaagctgttcatcggtggcttggactaccgtaccaccgacgagaacctaaaggctcacttcgagaaatggggcaacatcgtggacgtggtggtcatgaaggatccgcgcacaaagcgttcccgcggattcggattcatcacctattcccactcgagcatgattgatgaggcccaaaagtcgcgtccccacaagatcgacggtcgagtggtggagcccaagcgcgccgttccccgtcaggacattgattccccgaatgccggagccaccgtaaagaaactctttgttggcgccctcaaggacgaccatgatgagcagagcatccgcgactacttccagcactttggcaacatcgtcgacatcaacatagtcattgacaaggagactggcaagaaacgcggattcgccttcgtcgagttcgacgactacgatcccgtggacaaagttgtgttgcaaaagcagcatcagctgaatggcaaaatggtggacgtaaagaaggccttgcccaagcagaatgaccaacagggaggtggcggaggacgcggtggtccgggtggtcgtgccggtggaaaccgcggaaacatgggcggtggaaactacggcaaccagaatggtggcggcaactggaacaacggtggcaacaactggggcaacaaccgcgggggtaacgacaactggggcaacaacagcttcggtggtggcggcggcggcggtggtggttatggcggtggcaacaacagctggggcaataacaatccgtgggacaatggcaatggaggcggcaactttggaggcggcggcaacaattggaacaatggtggcaatgattttggaggctaccagcagaactatggcggcggtccgcagcgaggtggcggcaacttcaacaacaatcgcatgcagccctaccaaggaggtggtggattcaaagcaggcggtggcaatcaaggcaactatggcggaaacaatcagggcttcaataacggtggcaacaaccgcagatattga

SEQ ID NO: 19469 - protein, 365 aa, Drosophila melanogaster
MVNSNQNQNGNSNGHDDDFPQDSITEPEHMRKLFIGGLDYRTTDENLKAHFEKWGNIVDVVVMKDPRTKRSRGFGFITYSHSSMIDEAQKSRPHKIDGRVVEPKRAVPRQDIDSPNAGATVKKLFVGALKDDHDEQSIRDYFQHFGNIVDINIVIDKETGKKRGFAFVEFDDYDPVDKVVLQKQHQLNGKMVDVKKALPKQNDQQGGGGGRGGPGGRAGGNRGNMGGGNYGNQNGGGNWNNGGNNWGNNRGGNDNWGNNSFGGGGGGGGGYGGGNNSWGNNNPWDNGNGGGNFGGGGNNWNNGGNDFGGYQQNYGGGPQRGGGNFNNNRMQPYQGGGGFKAGGGNQGNYGGNNQGFNNGGNNRRY

SEQ ID NO: 19470 - DNA, 1298 bp, Xenopus laevis (African clawed frog)
  CDS (10)..(1107)
ggagtcaccatgcacaagtccgaggcacccaacgagccagagcaacttcgcaagctgttcattggaggcttgagttttgaaaccacagatgaaagtctccgcgagcactttgagcaatggggcacccttacagactgtgtggttatgagggatccaaactcaaaacgttcccgtggctttggatttgttacatacttatctacagatgaagtagatgctgccatgactgctcgcccacataaagtggatgggcgagtggttgaacctaaaagggctgtctctagagaggattcctctaggcctggtgcacacctcaccgtaaagaaaatctttgtaggtggtatcaaggaggacacagaagaagatcatttacgagaatatttcgagcaatatggcaaaattgaagttatagagataatgactgaccgaggcagtggcaagaaaagaggctttgcatttgtcacatttgaagatcatgattccgttgacaagattgtcatccagaaatatcacaccgtcaacaaccacaattctcaagtgcggaaggcactctccaaacaggaaatggcaagtgtttctggcagtcagagagaacgtggtggctctggaaactatggaagccgtggtgggtttggtaatgataactttggtggtcgtggtggcaactttggtggcaacagaggaggagggggtggatttggtaatcgaggttatggtggagacggctacaatggtgatggccaattatggtggcagccctccctactcgggtggaaccgaggctatggtgctggccaaggaggtggatatggtgctggccaaggaggtggatatggtggtggtggccaaggaggtggatatggtggaaatggaggatacgatggttataatggcggaggcagtggcttcagtggctctggtggtaactttggtagcagtgggggatataacgactttggcaactacaacagtcagtcatcatccaactttggcccaatgaaaggtggaaattatggtggtggcagaaattctggaccatatggaggtggctatggcggagggtctgctagcagcagtagcggatatggcggtgggaggaggttttaatttttccacaggggaatatccatctacatgattaaacgaaacgtggaccttggtttgtgaagcagtgttcagatacaggttttaaggttaactgatgtgacggatctgaccaacttcaaatttcacagctactgtgtagctctgttttgtttttttgttcttttccaaaataaagtttttatgattctcta

SEQ ID NO: 19471 - protein, 365 aa, Xenopus laevis (African clawed frog)
MHKSEAPNEPEQLRKLFIGGLSFETTDESLREHFEQWGTLTDCVVMRDPNSKRSRGFGFVTYLSTDEVDAAMTARPHKVDGRVVEPKRAVSREDSSRPGAHLTVKKIFVGGIKEDTEEDHLREYFEQYGKIEVIEIMTDRGSGKKRGFAFVTFEDHDSVDKIVIQKYHTVNNHNSQVRKALSKQEMASVSGSQRERGGSGNYGSRGGFGNDNFGGRGGNFGGNRGGGGGFGNRGYGGDGYNGDGQLWWQPSLLGWNRGYGAGQGGGYGAGQGGGYGGGGQGGGYGGNGGYDGYNGGGSGFSGSGGNFGSSGGYNDFGNYNSQSSSNFGPMKGGNYGGGRNSGPYGGGYGGGSASSSSGYGGGRRF

SEQ ID NO: 19472 - DNA, 1245 bp, Saccharomyces cerevisiae
  CDS (1)..(1245)
atggctaagactactaaagtaaaaggtaacaagaaggaagttaaggcttccaaacaagccaaagaagaaaaagctaaggccgtctcttcctcttcctccgaatcttcatcctcatcttcatcttcatctgaatctgaatctgagtctgagtctgaatctgaatcttcatcttcatcttcatcctctgattctgaatcctcttcttcatcgtcttctgacagcgaaagtgaagctgaaaccaagaaggaagaatccaaggattcctcttcctcttcctctgactcttcttccgacgaagaagaagaagaagaaaaagaagaaaccaagaaggaagaatcaaaagaatcttctagctctgattcatcctcatcttcatcttctgatagcgaaagcgaaaaggaagagtctaacgataagaaacgtaaatctgaggacgccgaagaagaagaagacgaagagtcttccaacaagaagcaaaaaaatgaagaaaccgaagaaccagctactattttcgttggtagactatcgtggtctattgatgacgaatggttgaagaaggaattcgaacacatcggtggtgtcattggtgccagagttatttatgaaagaggtaccgatagatctcgtggttatggttacgttgattttgaaaacaaatcttatgctgaaaaggccattcaagaaatgcaaggtaaggaaattgatggtagaccaatcaactgtgatatgtccacaagcaagccagctggtaacaacgatcgtgccaagaaattcggtgataccccatctgaaccatctgacactttgttcttgggtaacttatctttcaatgctgacagagacgctattttcgaattattcgctaaacacggtgaagttgtttccgtccgtatcccaacacatccagaaactgaacaaccaaaaggtttcggttatgttcaattctccaacatggaggacgccaagaaggctctagacgctttacaaggtgaatacattgacaacagaccagttagattagacttctcttctccaagaccaaacaacgatggtggtcgtggcggtagccgtggttttggtggtcgtggcggtggtcgtggcggtaaccgtggattcggtggtcgtggtggcgctcgcggtggccgtggcggtttcagaccatctggttctggtgctaatactgctccattgggcagatcaagaaataccgcttctttcgctggttcaaagaaaacatttgattaa

SEQ ID NO: 19473 - protein, 414 aa, Saccharomyces cerevisiae
MAKTTKVKGNKKEVKASKQAKEEKAKAVSSSSSESSSSSSSSSESESESESESESSSSSSSSDSESSSSSSSDSESEAETKKEESKDSSSSSSDSSSDEEEEEEKEETKKEESKESSSSDSSSSSSSDSESEKEESNDKKRKSEDAEEEEDEESSNKKQKNEETEEPATIFVGRLSWSIDDEWLKKEFEHIGGVIGARVIYERGTDRSRGYGYVDFENKSYAEKAIQEMQGKEIDGRPINCDMSTSKPAGNNDRAKKFGDTPSEPSDTLFLGNLSFNADRDAIFELFAKHGEVVSVRIPTHPETEQPKGFGYVQFSNMEDAKKALDALQGEYIDNRPVRLDFSSPRPNNDGGRGGSRGFGGRGGGRGGNRGFGGRGGARGGRGGFRPSGSGANTAPLGRSRNTASFAGSKKTFD

SEQ ID NO: 19474 - DNA, 1769 bp, Mus musculus (house mouse)
  CDS (105)..(1067)
gagagggcgaaggtaggctggcagatacgttcgtcagcttgctcctttctgcccgtggacgccgccgaagaagcatcgttaaagtctctcttcaccctgccgtcatgtctaagtcagagtctcctaaagagcccgaacagctgaggaagctcttcattggagggttgagctttgaaacaactgatgagagcctgaggagccattttgagcaatggggaacgctcacggactgtgtggtaatgagagatccaaacaccaagcgctctaggggctttgggtttgtcacatatgccactgtggaggaggtggatgcagctatgaatgcaaggccacacaaggtggatggaagagttgtggaaccaaagagagctgtctccagagaagattctcaaagaccaggtgcccacttaactgtgaaaaagatatttgttggtggcattaaagaagacactgaagaacatcacctaagagattattttgaacagtatggaaaaattgaagtgattgaaatcatgactgaccgaggcagtggcaagaaaaggggctttgcctttgtaacctttgacgaccatgactccgtggataagattgtcattcagaaataccatactgtgaatggccacaactgtgaagttagaaaagccctgtcaaagcaagagatggctagtgcttcatccagccaaagaggtcgaagtggttctggaaactttggtggtggtcgtggaggtggtttcggtgggaatgacaacttcggtcgtggaggaaacttcagtggtcgtggtggctttggtggcagccgtggtggtggtggatatggtggcagtggggatggctataatggatttggcaatgatggaagcaattttggaggtggtggaagctacaatgattttgggaattacaacaatcagtcttcaaattttggacccatgaagggaggaaattttggaggcagaagctctggcccctatggcggtggaggccaatactttgcaaaaccacgaaaccaaggtggctatggcggttccagcagcagcagtagctatggcagtggcagaagattttaattaggaaacaaagcttagcaggagaggagagccagagaagtgacagggaagctacaggttacaacagatttgtgaactcagccaagcacagtggtggcagggcctagctgctacaaagaagacatgttttagacaaatactcatgtgtatgggcaaaaaactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgtgtaatcaataaacgatttaattctcttgaa

SEQ ID NO: 19475 - protein, 320 aa, Mus musculus (house mouse)
MSKSESPKEPEQLRKLFIGGLSFETTDESLRSHFEQWGTLTDCVVMRDPNTKRSRGFGFVTYATVEEVDAAMNARPHKVDGRVVEPKRAVSREDSQRPGAHLTVKKIFVGGIKEDTEEHHLRDYFEQYGKIEVIEIMTDRGSGKKRGFAFVTFDDHDSVDKIVIQKYHTVNGHNCEVRKALSKQEMASASSSQRGRSGSGNFGGGRGGGFGGNDNFGRGGNFSGRGGFGGSRGGGGYGGSGDGYNGFGNDGSNFGGGGSYNDFGNYNNQSSNFGPMKGGNFGGRSSGPYGGGGQYFAKPRNQGGYGGSSSSSSYGSGRRF

SEQ ID NO: 19476 - DNA, 864 bp, Homo sapiens (man)
  CDS (1)..(864)
atgtcggaggagcagttcggcggggacggggcggcggcagcggcaacggcggcggtaggcgctgcggcgggcgagcaggagggagccatggtggcggcgacacagggggcagcggcggcgcgggaagcggacgcgggaccgggggcggaaccgcgtctggaggcaccgaagggcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggggaattccggaattcctcagaggcaggagaaggcttggagctacccccaaactcaatccactgttggcagctgagcgtgtag

SEQ ID NO: 19477 - protein, 287 aa, Homo sapiens (man)
MSEEQFGGDGAAAAATAAVGAAAGEQEGAMVAATQGAAAAREADAGPGAEPRLEAPKGSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGEFRNSSEAGEGLELPPNSIHCWQLSV

SEQ ID NO: 19478 - DNA, 1835 bp, Drosophila melanogaster
  CDS (95)..(1132)
ggcgagtgtgtataaaaatctccggctctgcgtaaaaaacgaatatcgtgctgcctagcccccgaaattagtagatcaatcgaaaacacacaaaatggccgagaacaagcaagtggatacagaaataaacggcgaggatttcaccaaggacgtgactgccgacggtccgggatctgaaaatggtgatgcgggcgccgccggctcgaccaacggcagttcggacaaccaatcggccgcatccggccagcgggacgacgacaggaaactgtttgtcggtggtctgagctgggaaacgactgagaaggaactccgcgatcacttcggcaaatatggcgagatcgagagcatcaatgtcaagacagatccccagaccggtcggtcccgaggattcgccttcatcgtgtttacaaacaccgaggccattgacaaagtcagcgccgcggatgagcacataatcaacagcaagaaggtcgatcccaagaaggccaaggccaggcacggcaagatctttgtcggcggcctcaccacagagatcagcgatgaggagattaagacctactttggacagttcggcaatatcgtcgaggtggagatgccattcgacaagcaaaagtcgcagcgcaaaggattctgcttcatcaccttcgattcggaacaggtggtgacggatttgctgaagacgcccaagcagaagatcgccggcaaggaggtcgatgttaagcgtgcgacgcccaagccggagaaccagatgatgggcggtatgcgtggtggaccacgcggtggtatgcgcggcggacgcggtggctacggaggacgaggtggctacaacaaccagtgggacggacagggatcatacggcggctatggcggcggctacggcggatatggtgccggtggttatggcgactactatgccggcggctactataatggatatgactacggttatgacggctacggttacggcggcggctttgagggtaacggctacggcggaggaggcggtggtggcaatatgggcggcggtcgcggtggaccccgcggcggcggcggccccaaaggcggtggcggttttaacggtggcaagcagcgcggaggcggtggacgccagcagcggcatcagccctactaaaaagtgggcagggggcgtgggcattgggtatctcgcattctccggataactgcaaactatttgaattttacctagtttagtttgttatgcattactacaagaagcaacacacatctctgcaacaacaccatctgggtaaccgcatatatacatacgccgttgtatatatctgtatgaaagaaatgaggaaaaaaggaaatgaatagactggctggctgggagcaataatatcaacatcagcaaccttaacacacctttacacacttgatgtgtagcaccattccaacaacagcatcatacgcagctaaaaaacatcatttatacaatacaaggcaaaccacaaagcaaaacaagaaaaaaaaaaacaacacaaatagatacacacacatagttaggcatacacatgtaatttttcagcaagtggctaatttttcatagccacacgctcattaagccgacaaaccaaccaaccaaacaaccaaccaaccgcccaccaaacaacccttcaacccgtgcaaaaccacaagacaacattgcagggaaacgtggcaaacaacatttgccaaactaactgctgtgcaatgctcacgttgtctgtgtgtcgaaactaatttgtttttctaatgtagtcccatacattatgcgaggtaattgtttaacgcgtcagtagagcacaggatgtcggagagataggaaagatagg

SEQ ID NO: 19479 - protein, 345 aa, Drosophila melanogaster
MAENKQVDTEINGEDFTKDVTADGPGSENGDAGAAGSTNGSSDNQSAASGQRDDDRKLFVGGLSWETTEKELRDHFGKYGEIESINVKTDPQTGRSRGFAFIVFTNTEAIDKVSAADEHIINSKKVDPKKAKARHGKIFVGGLTTEISDEEIKTYFGQFGNIVEVEMPFDKQKSQRKGFCFITFDSEQVVTDLLKTPKQKIAGKEVDVKRATPKPENQMMGGMRGGPRGGMRGGRGGYGGRGGYNNQWDGQGSYGGYGGGYGGYGAGGYGDYYAGGYYNGYDYGYDGYGYGGGFEGNGYGGGGGGGNMGGGRGGPRGGGGPKGGGGFNGGKQRGGGGRQQRHQPY

SEQ ID NO: 19480 - DNA, 1739 bp, Arabidopsis thaliana (mouse-ear cress)
  CDS (199)..(1413)
attttccaaagtctgtttatttttttaatctctctctcttctctctcacccaatttcacaaacccgaaaccctaattttctcgggacactgaaatttttacagcttctttcctcttcttcaccggggagatttgtcggtactaaatctagggtttttgggtatcaccggagggttgaagagagagaaaaaaactcacaatggaatcagatcagggaaagctatttatcggcgggatttcatgggataccgacgagaatcttctgagagagtacttcagcaatttcggcgaggttttgcaggtcactgttatgcgagagaaagctactggtcgtcctagaggattcggattcgtcgcattctcggatcctgctgttattgatagggttcttcaggacaagcaccatattgataatagagatgttgatgtgaagagagcaatgtctagagaggagcagagtcctgctgggagatcagggacttttaatgcttctaggaattttgatagtggagctaacgtgaggactaagaagatattcgtgggaggtttgcctcctgcattaacatcagatgaatttcgggcttactttgagacttatggtcctgtgagtgatgcagtcattatgattgatcagactacacagcgtcctcgaggatttgggtttgtttcttttgattctgaagattcggttgaccttgttttacataagactttccacgatttgaatggtaaacaagtcgaagttaaaagagctcttcctaaagatgctaaccctggaatagccagtggtggtggtcgtggcagtggtggagctggagggtttccgggctatggtggttctggtggaagtggctatgagggtcgtgtggattctaatagatacatgcagccgcaaaacactggaagtggttatcctccttatggtggttctgggtatggtactggttatggttatggaagcaatggtgtaggttatgggggttttggtgggtatggcaatccagctggtgcgccttatgggaatcctagtgtccctggagctgggtttggaagtggtccaagaagttcatggggcgctcaagcaccatcgggttatgggaatgtgggatatggaaatgcagctccgtggggtggttctggtggtcctggttcagcagtaatgggtcaagctggtgcatctgcaggttatggcagtcaaggttatggctatggtggaaatgattcctcttacgggactccatctgcctatggtgcagtaggggggcgatctgggaatatgcctaacaaccatggtggcggtggctatgcggatgctttagatggctctggaggctatgggaatcaccaagggaacaacgggcaagctggttatggtggaggttatggaagtggtaggcaagctcaacaacagtgattgaagaagaaatactactagaatgtggttttatcgctgaccttgaaacctcctgctttccgccttaaccatgtcacgtctttggcggttagaccaggaggtggacctacgctggattatctcttttgttagtttctcaataagttgttttcaggcaattccggatactatttcctatcaagttgtagtttttaagtttgcgtgcttatttatatttgtcgctttggaatggttttctttctctgttatcctctagtgtttgtgtttaacgatacatcctccagattatcattattcatctcccttttggttcattcatttttgtt

SEQ ID NO: 19481 - protein, 404 aa, Arabidopsis thaliana (mouse-ear cress)
MESDQGKLFIGGISWDTDENLLREYFSNFGEVLQVTVMREKATGRPRGFGFVAFSDPAVIDRVLQDKHHIDNRDVDVKRAMSREEQSPAGRSGTFNASRNFDSGANVRTKKIFVGGLPPALTSDEFRAYFETYGPVSDAVIMIDQTTQRPRGFGFVSFDSEDSVDLVLHKTFHDLNGKQVEVKRALPKDANPGIASGGGRGSGGAGGFPGYGGSGGSGYEGRVDSNRYMQPQNTGSGYPPYGGSGYGTGYGYGSNGVGYGGFGGYGNPAGAPYGNPSVPGAGFGSGPRSSWGAQAPSGYGNVGYGNAAPWGGSGGPGSAVMGQAGASAGYGSQGYGYGGNDSSYGTPSAYGAVGGRSGNMPNNHGGGGYADALDGSGGYGNHQGNNGQAGYGGGYGSGRQAQQQ

SEQ ID NO: 19482 - DNA, 1158 bp, Drosophila melanogaster
  CDS (1)..(1158)
atggaggaagacgagaggggcaaactttttgtgggcggtctatcctgggagacgacgcaggagaacctgtcgcgctacttctgccgcttcggggacatcattgactgtgtggtgatgaagaacaacgagagcggcaggtcgcgcggctttggcttcgttaccttcgccgatcccaccaacgtcaaccacgtgctgcagaacggaccgcacacgctcgacggtcgcaccatcgaccccaagccgtgcaatccgcgcactctgcagaaaccgaagaagggcggcggctacaaggtcttcctgggtggcctgccctcgaacgtcaccgagaccgatctgcggaccttctttaaccgctacggcaaggtcaccgaggtggttatcatgtacgaccaggagaagaagaagtcccgcggcttcggctttctctccttcgaggaggagtcctccgttgagcacgtgaccaacgagcggtacatcaatctgaatggcaagcaggtcgaaatcaagaaggccgagcctcgtgatggatctggcggccaaaactccaacaacagtaccgtgggaggcgcctatggcaagcttggtaacgagtgcagccactggggaccgcaccatgctcccatcaacatgatgcagggccagaatggccagatgggtggaccgccgctgaatatgcccattggagcgccgaatatgatgcctggctatcagggttggggcacctcgccgcagcagcaacaatacggctacggcaacagtggcccaggatcgtaccagggatggggagctccttcgggaccatcgggcggcggcagctggaactcgtggaacatgccacctaactctgccggacccactggggcaccaggagccggagcgggcaccgccactgacatgtactcgcgtgctcaagcctgggcgacgggcggtccctcgaccactggaccagtgggcggcatgccccggaccggacccggtaattcggcctccaagtctggctctgagtacgactacggcggctatggatccgggtacgactacgactacagcaactatgtgaagcaggagggcgcctcgaactacggagcagggccgcgatcagcgtacggcaacgacagctccacgcagccaccctatgcaacctcgcaggctgtctaa

SEQ ID NO: 19483 - protein, 385 aa, Drosophila melanogaster
MEEDERGKLFVGGLSWETTQENLSRYFCRFGDIIDCVVMKNNESGRSRGFGFVTFADPTNVNHVLQNGPHTLDGRTIDPKPCNPRTLQKPKKGGGYKVFLGGLPSNVTETDLRTFFNRYGKVTEVVIMYDQEKKKSRGFGFLSFEEESSVEHVTNERYINLNGKQVEIKKAEPRDGSGGQNSNNSTVGGAYGKLGNECSHWGPHHAPINMMQGQNGQMGGPPLNMPIGAPNMMPGYQGWGTSPQQQQYGYGNSGPGSYQGWGAPSGPSGGGSWNSWNMPPNSAGPTGAPGAGAGTATDMYSRAQAWATGGPSTTGPVGGMPRTGPGNSASKSGSEYDYGGYGSGYDYDYSNYVKQEGASNYGAGPRSAYGNDSSTQPPYATSQAV

SEQ ID NO: 19484 - DNA, 2576 bp, Gallus gallus (chicken)
  CDS (101)..(2185)
ggcccgctccgttccccgccgccaccccccagggacgcgcattcccaccccccgaggcagttcggccgccgccccagcgccgccagacaccgccgccatcatggtgaagctcgccaagactcccaagaatcaaatgaaacagaaaaaaatggcgcctccccccaaaaaggtcgaggaaagcgaagaggaagagtcctccgacttagaggaaagcagcggggaagaggtgatggtccctccaaagaaacaacaaaaagcagcagttacaccagccaagaaggctgctacccctgcaaagaaggctgctactcctgcaaaaaaggcagtgacaccagccaagaaggctgtggctactccagctaaaaaggctgttgctccatcccccaaaaaggctgctgtcgtaggcaaaggggcaaaaaatggcaagaatgccaaaaaggaagagagcgaggaggaagatgaagacgatgaagatgatgaggaagatgaggatgaagaagaggagtctgatgaggaagaggaaccagcagtgcctgtgaagcctgcagccaaaaagtccgcagcagctgtaccagccaaaaagcctgcagttgtgccagcaaagcaagaatctgaggaggaggaggaggaagatgatgaagaggaggacgaggaagatgacgagtctgaagatgaggccatggacacaactcctgctcctgtgaagaaacctactccagcaaaggctacaccagctaaagccaaggcggagtctgaagatgaggaagatgaggaggatgaggatgaagatgaggaggatgaagatgatgaagaggaagatgaggaagaaagtgaggatgaaaaacctgtcaaggaagcacctggaaaaaggaaaaaagaaatggccaataagagtgcaccagaggccaagaaaaagaaaacagaaacacctgcttcagctttctcactcttcgtgaaaaacttgacccccaccaaggactatgaagaactgaggactgccatcaaagaattctttggcaagaaaaatctccaagtctcagaagtcagaatcggttcttccaagcggtttggctatgtggacttcttatctgctgaagatatggataaagctcttcaactgaatggaaagaagctgatgggtttggaaatcaaactggaaaaagcaaagagcaaagaaagtcttaaagaaaataagaaagagagagatgccagaacactgtttgtgaagaatctgccctaccgtgtaactgaagatgaaatgaaaaatgtatttgaaaacgctttagaagtccgactagtacttaacaaggaagggagcagcaaagggatggcctacattgaattcaaaacagaagctgaggcagaaaaagcactggaggagaagcaaggcacagaggttgacggtcgtgccatggtcattgactacaccggtgagaagagccaacaagaaagtcagaaaggaggtggagagagggagtcaaagactctgattgtgaacaacctgtcatatgctgcctcagaagaaactctccaggaactgtttaaaaaagcgacttccatcaagatgccacagaacaaccagggcaggcctaaagggtatgcatttgtagaatttcccacagccgaggatgccaaagaggcattgaattcctgtaacaacacagaaattgaaggcagagcaatcaggctggaattcagttcaccatcgtggcagaaagggaacatgaatgcaagaggaggatttaaccaacaaagcaaaacattgtttgtcagaggcctttctgaggacacaacggaggagacgctaagagaatcatttgaaggctctataagtgctagaatagtcacagatagagacactggatcttctaaagggtttggttttgtggacttcagctccccagaagatgccaaagcagctaaagaagctatggaggatggagagatagacggaaacaaagtgacccttgattttgccaaaccaaagggtgaatttcagcgtggcggcggatttggtggtggatttggtggtcgtggtggcagaggaggcagaggaggaggaagaggtggatttggtggcagaggtggtggcagagggtttggaggtagaggaggtggcttccgaggaggcagaggaggaggtggagatcacaagccacaagggaagaagatcaagtttgaataaacttcccttttcctttcccttctcttgatctctgagactatctgaaaggactccaggggtttttattctccttttatcttggtggagccttcggaggacattccaaggtgcaaaggagtactgtgagccacttggaagaaagaattttcatttcaaggaagaaaagcaagctattttgtctgcttgcttattcaagtgaactttttaacagaaatgagcgatagctgtgggaatttaccctttgtctgtgagttgtcttgaatttataatgttttacccatgtacaaaaatatttttttcctataaacttctgtagcatttttttgctgtaaaaatgcagaatgttttatcatttgtgcttcagcaccctgtcttggacagattaaaggac

SEQ ID NO: 19485 - protein, 694 aa, Gallus gallus (chicken)
MVKLAKTPKNQMKQKKMAPPPKKVEESEEEESSDLEESSGEEVMVPPKKQQKAAVTPAKKAATPAKKAATPAKKAVTPAKKAVATPAKKAVAPSPKKAAVVGKGAKNGKNAKKEESEEEDEDDEDDEEDEDEEEESDEEEEPAVPVKPAAKKSAAAVPAKKPAVVPAKQESEEEEEEDDEEEDEEDDESEDEAMDTTPAPVKKPTPAKATPAKAKAESEDEEDEEDEDEDEEDEDDEEEDEEESEDEKPVKEAPGKRKKEMANKSAPEAKKKKTETPASAFSLFVKNLTPTKDYEELRTAIKEFFGKKNLQVSEVRIGSSKRFGYVDFLSAEDMDKALQLNGKKLMGLEIKLEKAKSKESLKENKKERDARTLFVKNLPYRVTEDEMKNVFENALEVRLVLNKEGSSKGMAYIEFKTEAEAEKALEEKQGTEVDGRAMVIDYTGEKSQQESQKGGGERESKTLIVNNLSYAASEETLQELFKKATSIKMPQNNQGRPKGYAFVEFPTAEDAKEALNSCNNTEIEGRAIRLEFSSPSWQKGNMNARGGFNQQSKTLFVRGLSEDTTEETLRESFEGSISARIVTDRDTGSSKGFGFVDFSSPEDAKAAKEAMEDGEIDGNKVTLDFAKPKGEFQRGGGFGGGFGGRGGRGGRGGGRGGFGGRGGGRGFGGRGGGFRGGRGGGGDHKPQGKKIKFE

SEQ ID NO: 19486 - DNA, 1221 bp, Arabidopsis thaliana (mouse-ear cress)
  CDS (1)..(1221)
atggattcggatcaaggaaagctttttgtcggtggtatttcatgggaaactgatgaagataagctgagagaacatttcaccaactatggagaggtttctcaggctattgtgatgagagacaagctcacaggtcgacctaggggttttgggataaggaaaaacagatgtatatattttctgttgcgttatgttctcgatttgggtaaagttgatgtgaagagagccatgtcaagagaggagcagcaagtctctggaagaactgggaatcttaatacatctagaagttctggaggtgatgcttacaataaaaccaagaagatctttgttggaggcttgccacctactttgactgatgaagagtttcgccagtactttgaagtttatggccctgtgactgatgttgcaatcatgtatgaccaggctaccaaccgtcctcgtgggtttggatttgtttccttcgactctgaagatgcggtagacagtgttttgcacaagactttccatgatttgagcggtaaacaagttgaagtaaagcgtgctcttcctaaagatgccaatcctggaggtggtggacgatcaatgggtggtggtggctctggtggttaccagggttatggtggcaatgaaagcagttatgatggacgtatggattccaataggtttttgcagcatcaaagtgttggaaatggtttaccatcttatggttcttctggttatggcgctggctatggaaatggtagtaatggtgccgggtatggtgcctatggaggttacactggttctgctggaggttatggcgctggtgctactgctggatatggagcaacgaacattccaggtgctggctatggaagtagtactggagttgctccgagaaactcatgggacactccagcttctagtggttatgggaacccaggctatgggagtggtgctgctcatagtggatatggagttcctggtgcagctcctcctacgcagtcaccatctggctatagtaaccaaggctacggttatggagggtacagtggaagtgattctggttatggaaatcaagctgcatatggtgtggttggagggcgtcctagtggtggcggttcaaacaaccctggtagtggtggctacatgggaggtggttatggtgatggatcttggcgatctgacccgtcacaaggttatggtggtgggtacaatgatggtcagggtcgacaaggccagtag

SEQ ID NO: 19487 - protein, 406 aa, Arabidopsis thaliana (mouse-ear cress)
MDSDQGKLFVGGISWETDEDKLREHFTNYGEVSQAIVMRDKLTGRPRGFGIRKNRCIYFLLRYVLDLGKVDVKRAMSREEQQVSGRTGNLNTSRSSGGDAYNKTKKIFVGGLPPTLTDEEFRQYFEVYGPVTDVAIMYDQATNRPRGFGFVSFDSEDAVDSVLHKTFHDLSGKQVEVKRALPKDANPGGGGRSMGGGGSGGYQGYGGNESSYDGRMDSNRFLQHQSVGNGLPSYGSSGYGAGYGNGSNGAGYGAYGGYTGSAGGYGAGATAGYGATNIPGAGYGSSTGVAPRNSWDTPASSGYGNPGYGSGAAHSGYGVPGAAPPTQSPSGYSNQGYGYGGYSGSDSGYGNQAAYGVVGGRPSGGGSNNPGSGGYMGGGYGDGSWRSDPSQGYGGGYNDGQGRQGQ

SEQ ID NO: 19488 - DNA, 1245 bp, Homo sapiens (man)
  CDS (1)..(1245)
atgtctgaatatattcgggtaaccgaagatgagaacgatgagcccattgaaataccatcggaagacgatgggacggtgctgctctccacggttacagcccagtttccaggggcgtgtgggcttcgctacaggaatccagtgtctcagtgtatgagaggtgtccggctggtagaaggaattctgcatgccccagatgctggctggggaaatctggtgtatgttgtcaactatccaaaagataacaaaagaaaaatggatgagacagatgcttcatcagcagtgaaagtgaaaagagcagtccagaaaacatccgatttaatagtgttgggtctcccatggaaaacaaccgaacaggacctgaaagagtattttagtacctttggagaagttcttatggtgcaggtcaagaaagatcttaagactggtcattcaaaggggtttggctttgttcgttttacggaatatgaaacacaagtgaaagtaatgtcacagcgacatatgatagatggacgatggtgtgactgcaaacttcctaattctaagcaaagccaagatgagcctttgagaagcagaaaagtgtttgtggggcgctgtacagaggacatgactgaggatgagctgcgggagttcttctctcagtacggggatgtgatggatgtcttcatccccaagccattcagggcctttgcctttgttacatttgcagatgatcagattgcgcagtctctttgtggagaggacttgatcattaaaggaatcagcgttcatatatccaatgccgaacctaagcacaatagcaatagacagttagaaagaagtggaagatttggtggtaatccaggtggctttgggaatcagggtggatttggtaatagcagagggggtggagctggtttgggaaacaatcaaggtagtaatatgggtggtgggatgaactttggtgcgttcagcattaatccagccatgatggctgccgcccaggcagcactacagagcagttggggtatgatgggcatgttagccagccagcagaaccagtcaggcccatcgggtaataaccaaaaccaaggcaacatgcagagggagccaaaccaggccttcggttctggaaataactcttatagtggctctaattctggtgcagcaattggttggggatcagcatccaatgcagggtcgggcagtggttttaatggaggctttggctcaagcatggattctaagtcttctggctggggaatgtag

SEQ ID NO: 19489 - protein, 414 aa, Homo sapiens (man)
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKEYFSTFGEVLMVQVKKDLKTGHSKGFGFVRFTEYETQVKVMSQRHMIDGRWCDCKLPNSKQSQDEPLRSRKVFVGRCTEDMTEDELREFFSQYGDVMDVFIPKPFRAFAFVTFADDQIAQSLCGEDLIIKGISVHISNAEPKHNSNRQLERSGRFGGNPGGFGNQGGFGNSRGGGAGLGNNQGSNMGGGMNFGAFSINPAMMAAAQAALQSSWGMMGMLASQQNQSGPSGNNQNQGNMQREPNQAFGSGNNSYSGSNSGAAIGWGSASNAGSGSGFNGGFGSSMDSKSSGWGM

SEQ ID NO: 19490 - DNA, 1322 bp, Mus musculus (house mouse)
  CDS (143)..(952)
cccaatgcattggcggccggccgggtgcgcgtctctcggggtcgggggtgccgggtgcccgtcccccgcctccctccgcgcgccgggtttcgccgccggcgtcgggcacgccggactacgccgcgacgagcaggagggagccatggtggcggcggcgcgcagggcggcggcggcggcgggaagcgggagcggcggcgggctctgcggcggaggcaccgaaggaggcagcgccgaggcagagggagccaagatcgacgccagtaagaacgaggaggatgaaggccattcaaactcctccccacgacacactgaagcagcggcggcacagcgggaagaatggaaaatgtttataggaggccttagctgggacaccacaaagaaagatctgaaggactacttttccaaatttggtgaagttgtagactgcactctgaagttagatcctatcacagggcgatcaaggggttttggctttgtgctatttaaagagtcggagagtgtagataaggtcatggatcagaaagaacataaattgaatgggaaagtcattgatcctaaaagggccaaagccatgaaaacaaaagagcctgtcaaaaaaatttttgttggtggcctttctccagacacacctgaagaaaaaataagagagtactttggtggttttggtgaggttgaatccatagagctccctatggacaagaagaccaataagaggcgtgggttctgttttattacctttaaggaagaggagccagtgaagaagataatggaaaagaaataccacaatgttggtcttagtaaatgtgaaataaaagtagccatgtcaaaggaacagtatcagcagcagcagcagtggggatctagaggagggtttgcagcagagctcgcgaagaggtggagatcagcagagtggttatgggaaagtatccaggcgaggtggacatcaaaatagctacaaaccatactaaattattccatttgcaacttatccccaacaggtggtgaagcagtattttccaatttgaagattcatttgaaggtggctcctgtcgactaatagcagttcaaactaaattttttctatcaagttcctgaatggaagtatgacgttgggtccctctgaagtttaattctgagttctcattaaaagaatttgctttcattgttttatttcttaattcgtatgcttcagtatcaatttgtgttttatgcccccccccccccccagtattgtagagcaagtcttgtgttaaaaaaagcccagtgtgacagtgtcatgatgtagtagtgtcttactggttttttaataaatccttttgtat

SEQ ID NO: 19491 - protein, 269 aa, Mus musculus (house mouse)
MVAAARRAAAAAGSGSGGGLCGGGTEGGSAEAEGAKIDASKNEEDEGHSNSSPRHTEAAAAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDKKTNKRRGFCFITFKEEEPVKKIMEKKYHNVGLSKCEIKVAMSKEQYQQQQQWGSRGGFAAELAKRWRSAEWLWESIQARWTSK

SEQ ID NO: 19492 - DNA, 1023 bp, Xenopus laevis (African clawed frog)
  CDS (1)..(1023)
atggagacagaagcgccccagcccggactgtcgcccccggactccgcgcacgatccctgcaaaatgttcattgggggactgagctggcagacaacacaagagggcctgcgggagtactttagtcattttggggatgtaaaagagtgtcttgtcatgagagatccattgaccaaaagatcaaggggttttggattcgtaactttcatggaccaagcaggagtggacaaagttttggctcaatcacgacatgagctggactcaaagacgattgacccaaaagtagcatttcctcggagagctcaacccaagatggtaacacggacaaagaagatttttgtagggggcttgtcagtgaatacaacagttgaagatgtgaaacaatattttgagcagtttgggaaggtggatgatgccatgttaatgtttgataaaacaacaaacaggcacagagggttcgggtttgtgacttttgaaggagaggatattgtggagaaagtttgtgatatacacttccatgagatcaacaataaaatggttgagtgtaagaaggcccagcccaaggaagtgatgtcaccaacagggtctgtgagaggccgatctcgggtcatgccatatggaatggatgccttcatgttgggcataggcatgctaggatacccgggatttcaggctgctacatatgccagtcgcagctacacaggcattgcacctggatatacttatcagttcccagagtttcgtgtagagagaacccctctcccgggcgccccagtcctcccagaactcacagctatccccctgactgcatatggtcccgtagcagcagctgctgcagcagtggtgagaggggggtttcttggaacaagcagcccagggccaatggcagaactttatggagcagccaatcaagaatcagcagttagcagctatatcagtgccgcaagcccagcacccagcacaggctttggacacagtcttgggggccctctgattgccactgcttttaccaacggctaccactga

SEQ ID NO: 19493 - protein, 340 aa, Xenopus laevis (African clawed frog)
METEAPQPGLSPPDSAHDPCKMFIGGLSWQTTQEGLREYFSHFGDVKECLVMRDPLTKRSRGFGFVTFMDQAGVDKVLAQSRHELDSKTIDPKVAFPRRAQPKMVTRTKKIFVGGLSVNTTVEDVKQYFEQFGKVDDAMLMFDKTTNRHRGFGFVTFEGEDIVEKVCDIHFHEINNKMVECKKAQPKEVMSPTGSVRGRSRVMPYGMDAFMLGIGMLGYPGFQAATYASRSYTGIAPGYTYQFPEFRVERTPLPGAPVLPELTAIPLTAYGPVAAAAAAVVRGGFLGTSSPGPMAELYGAANQESAVSSYISAASPAPSTGFGHSLGGPLIATAFTNGYH

SEQ ID NO: 19494 - DNA, 1409 bp, Xenopus laevis (African clawed frog)
  CDS (151)..(1251)
catggtggtctctggattaggaacaagcagaatctatatcatacattaaacaaacaaaaacatttaataaataaaaccatcccgaactgtctgttgagaaattgaggagaaatatcgaagtccggcaagactcaatttaatcccataagaatggtgatgataattagcaccatggaacctcaggtgtcgaatggcccaacttccaatacaagcaatggcccctccagtaacagcaggaactgtccttctcccatgcagacaggcgcagcgacagatgacagcaaaacaaacctcatagtcaactacttgccgcaaaatatgacgcaggaggaattcaggagtctatttggcagcatcggagagatagaatcctgtaaactagtgcgggataaaattacagggcagagccttggttatggatttgttaactacattgatccaaaggatgcagaaaaagccattaacacattaaatggactccgactacaaaccaaaaccatcaaggtttcctatgcccgccccagctctgcatcaatccgtgatgctaacttgtatgtaagcggccttccaaaaaccatgacacagaaagagctggagcagttattttcacagtatggacgcatcatcacctcaagaatcttagtcgatcaagttacaggtgtgtccaggggagttgggtttattcgttttgacaagagaatagaagcagaggaagccataaagggattgaatggacagaagccaagtggagccgcagaaccaattactgtgaaatttgccaacaaccccagtcagaaaacaagccaggcattactttcccaactctaccaatcccccaacagacgttatcctggcccccttcatcatcaggctcagagattcaggctggacaatttgcttaatatggcctatggcgttaagaggttttctcctatcaccatcgatggaatgacaagcctggtgggaatgaacatccctgggcacacgggtactggttggtgcatctttgtttacaacctctctcctgactccgatgaaagtgttctgtggcagctttttggcccatttggggctgtcaacaatgtgaaagtcatccgtgactttaacaccaacaagtgcaagggatttggctttgtcacaatgaccaattatgatgaagctgcaatggccattgccagccttaatggatatcgcctgggtgacagagttttgcaagtttcctttaaaaccaacaaaacccacaagtcttgaatttctagcctatacacatcaccctaatcttatgaacaaaatgaagatgaaaaaaacaaactctcaatggcttataaccaaccatggactttataagccggtgttgcctaagtattaccattggatatcctgtgataaaccggaaaggattttataat

SEQ ID NO: 19495 - protein, 366 aa, Xenopus laevis (African clawed frog)
MVMIISTMEPQVSNGPTSNTSNGPSSNSRNCPSPMQTGAATDDSKTNLIVNYLPQNMTQEEFRSLFGSIGEIESCKLVRDKITGQSLGYGFVNYIDPKDAEKAINTLNGLRLQTKTIKVSYARPSSASIRDANLYVSGLPKTMTQKELEQLFSQYGRIITSRILVDQVTGVSRGVGFIRFDKRIEAEEAIKGLNGQKPSGAAEPITVKFANNPSQKTSQALLSQLYQSPNRRYPGPLHHQAQRFRLDNLLNMAYGVKRFSPITIDGMTSLVGMNIPGHTGTGWCIFVYNLSPDSDESVLWQLFGPFGAVNNVKVIRDFNTNKCKGFGFVTMTNYDEAAMAIASLNGYRLGDRVLQVSFKTNKTHKS

SEQ ID NO: 19496 - DNA, 1595 bp, Mus musculus (house mouse)
  CDS (194)..(1051)
ccgcgcgggacggagttaaggtcttctttatcggcagtgtacggcggcggccgagcggagcgatagtcagtggctgcggacgagccctcgggggtgcgagcgtgaccgcggccaagcccgcgcgtcgccttctgcggcgagtagggcctcgcggcgtcatcggcggcgagtagccgctgcggcctggccgaccatgtcggacgcggctgaggagcagcccatggagacgacgggcgccaccgagaacggacacgaggccgcccccgaaggcgaggccccggtcgagcccagcgcggctgccgcggcccccgcggcctcggccgggtctgggggcgggaccacgaccgcaccgagcgggaaccagaacggcgcggagggcgaccagatcaacgccagcaagaacgaggaggacgcgggaaaaatgttcgttggtggtctgagctgggataccagcaaaaaagacttaaaggattattttactaagtttggagaggttgttgactgtacaataaaaatggatcccaacactggacgatcaagagggtttgggtttattctcttcaaagattcttctagtgtggaaaaggtcttagatcagaaggagcacaggctggatggtcgtgtcattgaccctaaaaaggctatggctatgaagaaggaccctgtgaagaaaatctttgtgggaggtctaaaccctgaagccacagaggaaaagatcagagaatacttcggccagtttggggagattgaggccattgagcttccaatagatcccaagttgaacaaaagacggggttttgtttttattacatttaaagaggaagatcctgtgaagaaagttctggagaagaaatttcatactgtcagtggaagcaagtgtgaaatcaaggttgcccagcccaaagaggtgtatcagcaacagcagtatggctctgggggcagaggaaatcgcaatcgagggaaccgaggcagtggtggaggtcagggtagtacaaattacggaaagagccagcgacgtggtggtcatcagaataactacaagccatactgagaggcagcaggagcggccgagtgacgaccgcacacgctttgtttggacgcggagtgaacacaattatgtaccaaatttaacttggcaaacttttatggcctgtcccatgtgcatcttatttaaaatttcccccagaaatcactctcctgtttactattccagagctctagttgtaggcagcgtgtggcgtctcagaggccagagcggcactagggggctgattttattaccaggttaccctgttctagatcaggagggtctatttcctgttgccgctctgcagcctggacctgtggaccctggttgtaaagagtaaaactgtatcttaggaaaccagtgtcacctttttcaccttttaattttatattatttgtgtcatacatttccagtaatggaagtgttaattttactgtactttttggtaccttttgggaatctaatgtattgtaaggtattttacacgtgtcctgattttgccacgacctggatattgaagctatccaagcttttgaaataaaaatgaaaaacaaaaaaaaaaaaaaaa

SEQ ID NO: 19497 - protein, 285 aa, Mus musculus (house mouse)
MSDAAEEQPMETTGATENGHEAAPEGEAPVEPSAAAAAPAASAGSGGGTTTAPSGNQNGAEGDQINASKNEEDAGKMFVGGLSWDTSKKDLKDYFTKFGEVVDCTIKMDPNTGRSRGFGFILFKDSSSVEKVLDQKEHRLDGRVIDPKKAMAMKKDPVKKIFVGGLNPEATEEKIREYFGQFGEIEAIELPIDPKLNKRRGFVFITFKEEDPVKKVLEKKFHTVSGSKCEIKVAQPKEVYQQQQYGSGGRGNRNRGNRGSGGGQGSTNYGKSQRRGGHQNNYKPY

SEQ ID NO: 19498 - DNA, 1029 bp, Schistocerca americana (American bird grasshopper)
  CDS (1)..(1029)
atggtgaatatggatcgtgagaatgatcacggtgagccagagcatgttagaaaactatttattggtggattggactatagaacaactgacgagtccctaaagcaacattttgaacaatggggtgaaatagttgatgtggtggttatgaaggaccctaaaacgaagaggtcgagagggtttgggttcataacttactccagagcacatatggtggatgatgctcagaatgctcgcccacacaaagttgatggtcgtgttgtggagccgaaaagagctgttcctcgcacggagattggtaggccagaagcgggagcgactgtgaaaaagctatttgttggtggaattaaggaagagatggaagaaaacgatctgcgcgattatttcaaacagtatggcactgtcgtctctgctgcaatcgtcgttgacaaggagactcgcaagaagcgtggcttcgctttcgtagaatttgacgattatgatccagttgacaaaatatgtttgagtcgcaatcaccagatccgtgggaagcatatagatgtcaaaaaagccttacccaaaggtgatgctccaggaggccgtggaggtggaggcagaggtggggttggtggtggcgcaggtggtggctggggcggaggacgtggtgactggggtggaagtgctggtggcggtggaggtggtggctggggaggtgctgatccatgggagaatggccgtggtggtggcggtgaccgatggggaggtggtggtggcggtatgggtggtggagataggtggggtgggggtggtggaatgggagggggtgacaggtacggtggtggcggtggacgcagtggtggatggtccaatgatggttacaatagtggaccacagtctgacggattcggtggcggctacaagcaaagctatggaggaggtgcagttcgtggttctagtggttatggtggaagccggtctgctccatactctgatagaggatctcgaggtggtggaggtggcggttacggttccggtggtggccgcaggtattaa

SEQ ID NO: 19499 - protein, 342 aa, Schistocerca americana (American bird grasshopper)
MVNMDRENDHGEPEHVRKLFIGGLDYRTTDESLKQHFEQWGEIVDVVVMKDPKTKRSRGFGFITYSRAHMVDDAQNARPHKVDGRVVEPKRAVPRTEIGRPEAGATVKKLFVGGIKEEMEENDLRDYFKQYGTVVSAAIVVDKETRKKRGFAFVEFDDYDPVDKICLSRNHQIRGKHIDVKKALPKGDAPGGRGGGGRGGVGGGAGGGWGGGRGDWGGSAGGGGGGGWGGADPWENGRGGGGDRWGGGGGGMGGGDRWGGGGGMGGGDRYGGGGGRSGGWSNDGYNSGPQSDGFGGGYKQSYGGGAVRGSSGYGGSRSAPYSDRGSRGGGGGGYGSGGGRRY

SEQ ID NO: 19500 - DNA, 855 bp, Homo sapiens (man)
  CDS (1)..(855)
atgtcggaagcgggcgaggagcagcccatggagacgacgggcgccaccgagaacggacatgaggccgtccccgaagcgagtcgcggccggggctggacgggcgccgcggcggggctggaggcgcgaccgccgcgcccccgagcgggaatcagaacggcgccgagggaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtcaagaaaatcttcgttgggggtctgaatcctgaaagtcccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagggtagtacaaactacggcaagagccagcgacgtggtggccatcagaataactacaagccatactga

SEQ ID NO: 19501 - protein, 284 aa, Homo sapiens (man)
MSEAGEEQPMETTGATENGHEAVPEASRGRGWTGAAAGLEARPPRPRAGIRTAPRDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPESPTEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGQGSTNYGKSQRRGGHQNNYKPY

SEQ ID NO: 19502 - DNA, 1155 bp, Nicotiana sylvestris (wood tobacco)
  CDS (37)..(858)
ctcgtgccgtttttttgcttcaaaaccttatcttcaatggcttcctcagcttcttccctccatttcctttcccttacacctcaaacacttcctctaccaaaacctacttctcaaacaacttccctttccttcttttcccttcctccttcttctctcaacctttctttatcttcttcttcatcttgtttttcttctcgttttgttcgtaaggttaccctttctgattttgaccaaattgaggatgttgaagatggtgatgatggtgtagaagaagaacgtaatttctctcctgaccttaaaatctttgtcggtaacttgcctttcagtgctgatagtgctgctcttgctgagctttttgagcgtgctggtaatgttgagatggttgaggttatctatgacaagcttacaggaagaagcagaggttttggttttgtgacaatgtcctcaaaagaggaagttgaagctgcctgtcaacaatttaatggatatgaactcgacgggagggcattgagggtgaattctgggccaccaccagagaagagggagaattcttctttccgtggaggcagcaggggtgggggaagttttgatagctccaatagagtctatgtaggaaacctcgcatggggtgttgaccaagacgcacttgagaccttattcagtgagcaaggtaaggttgtggatgccaaagtagtctatgatagggatagcggtagatcaaggggcttcggattcgtaacatacagttccgctgaggaggtcaacaatgcaattgaaagcttggacggagttgaccttaacggaagggccatccgtgtaagccctgctgaagctcggccacccaggcgtcaattctgaaggttgtaaccaacatctttttgatcgagaaaacggttgggggtccaggagatgacgatagttgcaacaatgatgagttagtaaatctgcaacttctaccccaaacttgcgcggacaaatgactctctccttctggactaactagggttctcaagtaaattagctttcgtaatgtatgttctgaaattgcctcgggaaaaattcttgatcttgtaatatgctatccatcacttgttgaaggacacgacagttaaaaagtttgatactctttgaaatgtatgttagcgagaagcattc

SEQ ID NO: 19503 - protein, 273 aa, Nicotiana sylvestris (wood tobacco)
MASSASSLHFLSLTPQTLPLPKPTSQTTSLSFFSLPPSSLNLSLSSSSSCFSSRFVRKVTLSDFDQIEDVEDGDDGVEEERNFSPDLKIFVGNLPFSADSAALAELFERAGNVEMVEVIYDKLTGRSRGFGFVTMSSKEEVEAACQQFNGYELDGRALRVNSGPPPEKRENSSFRGGSRGGGSFDSSNRVYVGNLAWGVDQDALETLFSEQGKVVDAKVVYDRDSGRSRGFGFVTYSSAEEVNNAIESLDGVDLNGRAIRVSPAEARPPRRQF

SEQ ID NO: 19504 - DNA, 1251 bp, Zea mays (maize)
  CDS (124)..(1035)
cgcacccagtctcggcgcctcaccccccaaaatcctctcgcggtcgcggatcgctcttccctccccctcttatctctttctcttctcccattccttccttccactcccccgcccagcgccaccatggcctcctccgtcgcggtgtccctccgcgccctcgctgccgccccgctccccaagtccagccccgccacttcctgccccttcttcgtgctccttgcgccggcgctgccccgacgcctgctccgcctccgctccgcacgccgcctgccgctcgccccgctcgccgcctccgattccgccttcgagtcctccgtcggagttaactacgcggagcccgacgactcggagaaggataaggaggtggagttgttcggatcgggtgacgacgagggggcgggtgagttggtggatgaccattccgtagaggtctcagccgctgtcgaggacgaggtggaggaggaggtcggggagtacgttgagccgcccgaggaggccaaggtctacgtcggaaacctgccctacgacgtcgacagcgagcgcctcgctcagctcttcgaccaggccggcgtcgtcgaggtcgcagaggtcatttacaacagagaaacagatcaaagtcgtgggtttgggtttgtcactatgagcactgttgaggaggctgagaaggctgtggagatgttccatcgctatgatgtcaatggaaggcttctgactgtaaataaagcagctcctagaggctctcgtgtggacagacctcccagacaatctgggccttctctcagaatttatgttggcaacctgccttggcaagtggatgattctagattggtggagttgttcagcgagcatggtaaagtagttgatgccagagttgtctatgaccgagaaactgggcgttcacggggatttggttttgttactatggcatcgcaggacgaattggatgatgctattgctgcccttgatggacagagtttggatggccgtgccttgcgggtgaatgttgcagaggagcggccacggcgaggtttctaatgaggttgtatcgggtggactgcacgtcttgttccatgggttgggagcatcatagcatgttctgatactggtttagaccttccattctctttccttgtgttgctgagcttctatcatcgtgtcttattgtgaagagggaactcttcactaatattttgttatgtacttgttgtgttcaaaagttcttgtactgtaggctactgttatgatgcgcct

SEQ ID NO: 19505 - protein, 303 aa, Zea mays (maize)
MASSVAVSLRALAAAPLPKSSPATSCPFFVLLAPALPRRLLRLRSARRLPLAPLAASDSAFESSVGVNYAEPDDSEKDKEVELFGSGDDEGAGELVDDHSVEVSAAVEDEVEEEVGEYVEPPEEAKVYVGNLPYDVDSERLAQLFDQAGVVEVAEVIYNRETDQSRGFGFVTMSTVEEAEKAVEMFHRYDVNGRLLTVNKAAPRGSRVDRPPRQSGPSLRIYVGNLPWQVDDSRLVELFSEHGKVVDARVVYDRETGRSRGFGFVTMASQDELDDAIAALDGQSLDGRALRVNVAEERPRRGF

SEQ ID NO: 19506 - DNA, 1246 bp, Nicotiana plumbaginifolia (curled-leaved tobacco)
  CDS (46)..(885)
gcgagaaagaaaaagcctatcttttgcttcaaaaccttatcttcaatggcttcctcagcttcttccctccatttcctttcccttacacctcaaacacttcttctaccaaaacccacttctcaaacaacttccctttctttcttttcccttcctccttcttctctaaacctttctttgtcttctccttcatcttgtttttcttctcgttttgttcgtaaggttacccttcctgattttgaccaaattgaggatgttgaagatggtgatgagggtgtagaagaagaacgtaatttctctcctgaccttaaaatctttgttggtaacttgctttttagtgctgatagtgctgctcttgctgagctttttgagcgtgctggtaatgttgagatggttgaggttatctatgacaagcttacaggaagaagcagaggttttggttttgtgacaatgtcctcaaaagaggaagttgaagctgcctgtcaacaatttaatggatatgaacttgacgggagggcactgagggtgaattctgggccaccaccagagaagagggagaattcttctttcagggagaattcttctttccgtggaggcagcaggggtgggggaagttttgatagctccaatagagtctatgtaggaaacctcgcatggggtgttgaccaagacgcacttgagaccttattcagtgagcaaggtaaggttgtggatgccaaagtagtctatgatagggatagcggtagatcaaggggcttcggattcgtaacatacagttccgctgaggaggtcaacaatgcaattgaaagccttgacggagttgaccttaatggaagggccatccgtgtaagccctgctgaagctcggccacccaggcgtcaattctgaaggttgtaaccaacatctttttgatcgagaaaacgcttgggggtccaggagatgacgatagttgcaacaatgatgagttagtaaatctgcaacttctaccccaaacttgcgcggacaaatttctctctgcttctggactaactagagttctcaagtaaattagctttcgtaatgtatgttctgaaattgccttgggaaaaattcttgatgtaatatgctatccatcacttgttgaaggacacgacagttaaaaagtttgatactctttgaaatgtatgttagcgagaagcattcttgttgtacaatgaatttgcaggaattgtgcctatgcctctacaaacaattatggtccttaaaattt

SEQ ID NO: 19507 - protein, 279 aa, Nicotiana plumbaginifolia (curled-leaved tobacco)
MASSASSLHFLSLTPQTLLLPKPTSQTTSLSFFSLPPSSLNLSLSSPSSCFSSRFVRKVTLPDFDQIEDVEDGDEGVEEERNFSPDLKIFVGNLLFSADSAALAELFERAGNVEMVEVIYDKLTGRSRGFGFVTMSSKEEVEAACQQFNGYELDGRALRVNSGPPPEKRENSSFRENSSFRGGSRGGGSFDSSNRVYVGNLAWGVDQDALETLFSEQGKVVDAKVVYDRDSGRSRGFGFVTYSSAEEVNNAIESLDGVDLNGRAIRVSPAEARPPRRQF

SEQ ID NO: 19508 - DNA, 1254 bp, Arabidopsis thaliana (mouse-ear cress)
  CDS (72)..(1061)
aaaacccttcccttcctcttcttttctcttctccttccacttccacttcttctatctctcacaattcagcaatggcttcttctatagttacctctagcttgaagcctttagccatggccgattcttcctcttctaccattttctcccatccttccatctcctctaccatctcttcctccagaattcgcagctccagtgtttccctccttaccggacgcattaacctgcccctctctttctctcgcgtctctctatctcttaaaaccaaaacccaccttaaaaaatccccctttgtctccttcgttgcccagacttcggattgggctgaagaaggtggagaaggaagcgtcgctgttgaggagaccgagaacagtttagagtcacaagatgtgagcgaaggagatgagagcgaaggagatgcgagcgaaggagatgtgagcgaaggagatgagagcgaaggagatgtgagcgaaggagctgtgagcgaaagagctgagttcccggagccatcggaagaagccaagcttttcgtcggaaatttggcttatgatgttaatagccaagctttggctatgctctttgagcaagccggtactgttgaaatcgccgaggttatatacaatagggaaactgaccagagtcgtgggtttggatttgtgacaatgagttctgtggacgaagctgagacagctgtggagaagttcaaccgttatgatcttaacggacgtctactaactgtaaacaaggcagctccaagaggatcacgtccagaacgtgcgcctcgggtatatgaacctgcattcagagtatatgtagggaatctaccatgggatgtggacaatggccgtctagaacagcttttcagtgagcatggtaaagttgtggaagctagggtggtttacgaccgtgagacaggtcgttcacgtggattcgggtttgtcacaatgtctgacgtggatgaactcaacgaagccatctctgccctcgatggacagaacttggagggtagagcaatcagagtgaatgtagcggaagagcgtcctccaaggcgtggatattaaagctgagatctagctgtgccctctctctctccctatcttgcattttgtttagacgagattcttacactcttcaacgattgtttttggctgaactctgaatgtgaaagttaagctgcttctaaagtaatttgtatcgcttgtttttgatgatctcttattcatagtttaattcctaattgttggagtttcattc

SEQ ID NO: 19509 - protein, 329 aa, Arabidopsis thaliana (mouse-ear cress)
MASSIVTSSLKPLAMADSSSSTIFSHPSISSTISSSRIRSSSVSLLTGRINLPLSFSRVSLSLKTKTHLKKSPFVSFVAQTSDWAEEGGEGSVAVEETENSLESQDVSEGDESEGDASEGDVSEGDESEGDVSEGAVSERAEFPEPSEEAKLFVGNLAYDVNSQALAMLFEQAGTVEIAEVIYNRETDQSRGFGFVTMSSVDEAETAVEKFNRYDLNGRLLTVNKAAPRGSRPERAPRVYEPAFRVYVGNLPWDVDNGRLEQLFSEHGKVVEARVVYDRETGRSRGFGFVTMSDVDELNEAISALDGQNLEGRAIRVNVAEERPPRRGY

SEQ ID NO: 19510 - DNA, 1751 bp, Drosophila melanogaster
  CDS (131)..(1546)
ggtgtatcgaatcaatgattcgcttcctgacagcacaattttcacttcgcttcaaccgttcgacgtgcaaactggtcgttttcgtttcttaatttcggttaaatttagtgataattaatttgctaacacaatggtgaaggatgagcccctatcggacgagtccgccgatgtgattgtgcttgcagatcgcgaggaagatgacatatgcgagctggagcacttgcgtaagctcttcatcggcgggctggccccgtacaccaccgaggagaacctgaagttgttctacggccagtggggcaaggtggtcgatgttgtggtgatgcgcgatgctgccaccaagagatctcgcggcttcggcttcatcacctacacaaagtctctcatggtcgacagggcccaggagaaccgtccgcacatcatcgacggcaaaactgtggaagccaagcgtgctctgccccgtcccgaacgcgaatcgcgcgagaccaatatatccgtgaagaagctgttcgtaggcggtcttaaggataaccacgatgaggaatgccttcgtgaatacttcctccaattcgggaatgtagtctccgttaaattgcttactgacaaaaccactggcaagcgtcgcggcttcgccttcgtcgagttcgacgactacgatgcagtggataaggctatccttaaaaagcaacatgcgattaagtacgttcacgtggacgtcaagaagtccatttataacctggacaagaaggagaaacagcagccaggtgggctggccaacgccatcaagccgtcgctcaatcagcagcagcaacagcagggtggcggacagcagccacctaatggcaatatgcaggcacctagctttcgaccaccagtgccgccacaacaggccatgggcccctaccaacaacagccaccaccggcgcctatgtctgctccaccaccaaacttcaactactggggaccacctccgccggctatgccgccctactaccagcagccaccgccgcagcagatgaacggctggggtccatatccgccgccgcaacaaaatggctggaatgcaccaccaccgccaccaccgggtgcccagcagtggcacgccaaccagtggggttgtcctccaccagtgcaacaggtgccgccggttggagcagtgccaccacccatgggtcacaatggaccaccgccgacggctccaggtaactggaacatgccgcccccagtgccgggtgcagctcctccatcccaccagcagcagtcttcgcaacagccaacaccacaaccaaatttcggcactggctatcagcaaaactacggaggcggaccatccaagcacaacaatatgaatgcaaaccgcatgaatccttactcggcaggtccgcccaacagctaccacactcctcaaccaccagcatatacgggctacaacgctggaccactgccgcctaatggaagcgttccgccgccaactggggccaaggctgttggcgtatccaatggctccgtggccactggaggcagtgccaacagcaaatatcgccgctagattggatgctctttgggcggctaaagctcaagaatcaagacactctttagtaagctcgttcataagctaggccacactcgcttagagttactaagcaggaaacttaacgcattgtctctctatcataggacaactaactacgattttactgtacacttaagctataccattgattaccctacgattgacctaagctatggcagac

SEQ ID NO: 19511 - protein, 471 aa, Drosophila melanogaster
MVKDEPLSDESADVIVLADREEDDICELEHLRKLFIGGLAPYTTEENLKLFYGQWGKVVDVVVMRDAATKRSRGFGFITYTKSLMVDRAQENRPHIIDGKTVEAKRALPRPERESRETNISVKKLFVGGLKDNHDEECLREYFLQFGNVVSVKLLTDKTTGKRRGFAFVEFDDYDAVDKAILKKQHAIKYVHVDVKKSIYNLDKKEKQQPGGLANAIKPSLNQQQQQQGGGQQPPNGNMQAPSFRPPVPPQQAMGPYQQQPPPAPMSAPPPNFNYWGPPPPAMPPYYQQPPPQQMNGWGPYPPPQQNGWNAPPPPPPGAQQWHANQWGCPPPVQQVPPVGAVPPPMGHNGPPPTAPGNWNMPPPVPGAAPPSHQQQSSQQPTPQPNFGTGYQQNYGGGPSKHNNMNANRMNPYSAGPPNSYHTPQPPAYTGYNAGPLPPNGSVPPPTGAKAVGVSNGSVATGGSANSKYRR

SEQ ID NO: 19512 - DNA, 1491 bp, Caenorhabditis elegans
  CDS (140)..(1180)
tgatcaacacctctgtcactctttgtgagtaatagcgttcgataggtagttacaccgtgaaactagcctgtctatttcctacttcataagctaagaactacttgttagcacaatccgatcgactactaagaactagatcatgacggacgtggaaatcaaggctgagaatggaagcggagatgcctcgctcgagccagagaaccttcgaaagattttcgttggaggactcacgtcaaacaccaccgatgacctgatgcgagagttctactcacaattcggagaaatcactgatatcatcgtcatgagagatccaactaccaagagatcccgcggattcggatttgtcaccttctctggcaaaactgaagtcgatgctgccatgaaacaacgcccgcacatcatcgacggaaagaccgtggacccgaagcgtgccgtgccacgtgatgataagaaccgctccgagtcgaatgtctccaccaaacgcctgtacgtcagcggagttcgtgaggatcacaccgaggacatgctcaccgagtatttcacaaagtatggaaccgtcaccaaatccgagattattctcgacaaagccacccaaaagccaagaggcttcggattcgtcaccttcgatgatcatgactctgtggatcaatgcgttcttcaaaaatcccatatggtcaacggacacagatgtgacgtgcgcaaaggactctccaaggacgagatgagcaaggctcagatgaaccgcgatcgtgaaacccgtggcggaagatctcgcgatggacagcgtggcggttacaatggcggtggtggtggcggcggcggctggggaggaccagctcaacgcggcggtccaggagcatatggtggaccaggaggtggcggccaaggaggatatggcggagattacggcggtggctggggacagcaaggaggcggcggtcaaggcggatggggaggcccacaacagcagcaaggaggtggtggctggggacagcaaggcggcggcggtcaaggcggatggggaggaccacagcaacagcagcaaggaggctggggaggtcctcaacaaggaggcggcggcggtggctggggaggccaaggccagcagcaaggcggctggggaggtcaatccggtgctcagcagtgggctcatgctcaaggaggaaacagaaactattaaattaattccttaagcccctctaagtgtccaacgtgtctgagcttcccgtgctctctcctctgtatcgatcttctcaaccatttttgctctgctatctcatcaaaatcttctgtactttttcttgttgcctttctccagaaagtttcgtttattattcaattttttaccctgtcttttttatataatttatttctaaattcgcacagttgacatccattcaactagagaatgaatgcagagtttgacaccaaattggcttaattttcaagctgtttttaaccaaaataataaaaaagtctcaactttacaaa

SEQ ID NO: 19513 - protein, 346 aa, Caenorhabditis elegans
MTDVEIKAENGSGDASLEPENLRKIFVGGLTSNTTDDLMREFYSQFGEITDIIVMRDPTTKRSRGFGFVTFSGKTEVDAAMKQRPHIIDGKTVDPKRAVPRDDKNRSESNVSTKRLYVSGVREDHTEDMLTEYFTKYGTVTKSEIILDKATQKPRGFGFVTFDDHDSVDQCVLQKSHMVNGHRCDVRKGLSKDEMSKAQMNRDRETRGGRSRDGQRGGYNGGGGGGGGWGGPAQRGGPGAYGGPGGGGQGGYGGDYGGGWGQQGGGGQGGWGGPQQQQGGGGWGQQGGGGQGGWGGPQQQQQGGWGGPQQGGGGGGWGGQGQQQGGWGGQSGAQQWAHAQGGNRNY

SEQ ID NO: 19514 - DNA, 1625 bp, Xenopus laevis (African clawed frog)
  CDS (92)..(1132)
agtttcggagcggcagatagagaatcagcgaggccgagtatttatttatttatttatttatcgtgttatctaggttccagttgcagcagacatggagagggaaaaggaacagttccgtaagctattcattggcggcctcagctttgaaacaacagaggagagtctacggaattactatgagcagtggggaacgcttacagactgtgtggtcatgagagatcctgcaagtaaaaggtccagaggctttggctttgtaacattttcttgcatgaatgaagttgatgcagctatggcaacacgtccgcatactattgatggcagagtagttgagcctaaacgagctgtggcaagagaggaatctgcaaaacctggtgcccacgtcactgttaagaaattgtttgtcggtggcattaaggaagacacagaagagcatcaccttagagagtactttgaggaatatggcaaaattgacagcattgaaatcattacagacaaacagtctggaaagaagagaggctttgcctttgtgaccttcgatgatcacgacccagttgataagatagttctgcaaaagtatcacacaataaatggccacaacgcagaagtaagaaaagccttatctaaacaagaaatgcaagatgttcagaacactcgaaataatagaggcggcaactttggcttcggagactccagaggtggtggaaactttggttcaggaccaggaggcaacttcagaggaggatctgatggttatggaggtggccgtggttatggtgataatggctataatggatatggtggtggtcaaggcggtggcaactatggaggtggacccagttatggaggaggacgaggaggaggctatggaggtggtgctggctatggcaaccaaggaggtggatatggaggaggctatgacaactatggcggaggaaactatggtggtggtggaaactacaatgactttggtaactataatcagcagtcttccaattatggaccaatgaagagcggtggaaactttggtggaaacaggagtatgggaggaggaccatatggaggaggaaactatggtcctggaaacgctagtggtggaaatggtggaggatatggaggaagaaatcgttattaaatttaaaaccttttttaatccctcttgggcttcactgtataaataggagaggatgagagcccagaggtgtaacgcagctgcaggttatcgaattaacaatgttaaggagacttatctcagtcatgcataatacatgcagtgatatgacagaaagacaccagagcagatgcagagagccattttgtgaatggattggaatatatttaagtacattaccttacgatggaggaaggactgtaaattatatgcctttgagtcagtttcataggtttttaactgttgtagtggtcattgtaaagagtgcagcagcattccttttgataatgttatatttttaagtttcaggtcacttgagactttttttgttttgttttttcctcggtttgaaaattagccaggatcatggtgtaatatgagcctttttatttaaaaatttttcagtgtgtatagttaagctgttgtacactttcatttaataaaataattcaaacgg

SEQ ID NO: 19515 - protein, 346 aa, Xenopus laevis (African clawed frog)
MEREKEQFRKLFIGGLSFETTEESLRNYYEQWGTLTDCVVMRDPASKRSRGFGFVTFSCMNEVDAAMATRPHTIDGRVVEPKRAVAREESAKPGAHVTVKKLFVGGIKEDTEEHHLREYFEEYGKIDSIEIITDKQSGKKRGFAFVTFDDHDPVDKIVLQKYHTINGHNAEVRKALSKQEMQDVQNTRNNRGGNFGFGDSRGGGNFGSGPGGNFRGGSDGYGGGRGYGDNGYNGYGGGQGGGNYGGGPSYGGGRGGGYGGGAGYGNQGGGYGGGYDNYGGGNYGGGGNYNDFGNYNQQSSNYGPMKSGGNFGGNRSMGGGPYGGGNYGPGNASGGNGGGYGGRNRY

SEQ ID NO: 19516 - DNA, 1652 bp, Xenopus laevis (African clawed frog)
  CDS (41)..(1198)
gcgggaagaagcagcacctttagcgttagagcggcgtgctatgcctcgtggtggaatggatgaccactggccttcctcagatgatcagggacacgaaccaaaggaacctgaacagctaagaaagctgtttattggtggcttgagctttgagacaacagatgacagcttgagggagcattttgaacaatgggggaagctcacagactgtgttgtaatgagagatccacagacaaagcgttccaggggctttgggtttgttacctactcatgtgtagaggaagtagatgcttctatgtctgcaagaccgcacaaagttgatggccgtgttgttgaacctaaaagggcagtttccagagaagattctgcaagacctggtgcacatctaacagtaaagaagatctttgtgggtggaatcaaagaagatacagaagaataccatttgcgtgactactttgagggctatggcaagattgaaactattgaagttatggaagaccgacaaagtggaaagaagagaggatttgcatttgttacttttgatgatcatgatacagttgacaaaattgttgttcagaaataccacacaatcaatttacacaattgtgaagtaaagaaggctctttccaaacaagagatgcaaaccgccagcgcccaaagaggtcgaggaggtggaggaagtaatttcatgggccgaggaggaaactatgggggtggtgatggaggtggtggtggaaactttggccgaggaggtggatttggtaacagagggggctatgggggtggtggaggccgaggaggtggttatggcggcggtggagatggctacaatggatttggtggagatgggggtaattatggaggtggacctggctatggtggcagaggctatggaggtagcccaggctatggaaaccaaggtggaggatacggtggtggtggtggtggaggaggagcaggaggaggaggatatgatggctacaatgaaggcggaaactttggcggtggaaattataatgactttggaagctatggaggacagcaacagtcaaattatggtcctatgaaagctggcaactttagtggaaggagcactggtggaagtggcggcagcagcagtggtccctatggtggcggatatggatccggtggcggcggaggaggaggtggtggtgggagttatggtggcagaaggttttaaggctcccaaaagaaaaggctacagttcttagcaagagagcgaggagttgtcaggaaagctgcaggttactttgagacagtcgtccatgcattagaggaactgtaaaatctaccacaggagcagcgatgatccataggcagaaaagttactgcagcttatacaggaggcatttcttgttcaggactgtcatagcctcagtttgctaaaagtgcagctgattaatgcaatgtagtgatgatttagatgtacattcctgaggtcgtttttttttctagttcgtctcccatattccccccattacatcaggtataactgccctgtaaattgtgttagtgataccaggaataaagaattaaggactttttaacttttaaaattgtgtagttcagtgttttctcacttgtcagggcgtaaagcattgctcaacaaaataaacatgcttttttttattcct

SEQ ID NO: 19517 - protein, 385 aa, Xenopus laevis (African clawed frog)
MPRGGMDDHWPSSDDQGHEPKEPEQLRKLFIGGLSFETTDDSLREHFEQWGKLTDCVVMRDPQTKRSRGFGFVTYSCVEEVDASMSARPHKVDGRVVEPKRAVSREDSARPGAHLTVKKIFVGGIKEDTEEYHLRDYFEGYGKIETIEVMEDRQSGKKRGFAFVTFDDHDTVDKIVVQKYHTINLHNCEVKKALSKQEMQTASAQRGRGGGGSNFMGRGGNYGGGDGGGGGNFGRGGGFGNRGGYGGGGGRGGGYGGGGDGYNGFGGDGGNYGGGPGYGGRGYGGSPGYGNQGGGYGGGGGGGGAGGGGYDGYNEGGNFGGGNYNDFGSYGGQQQSNYGPMKAGNFSGRSTGGSGGSSSGPYGGGYGSGGGGGGGGGGSYGGRRF

SEQ ID NO: 19518 - DNA, 1250 bp, Gallus gallus (chicken)
  CDS (23)..(880)
ggcacgagccggcgccacccaaatggacacgaagcggctgagagctccggggagcagcagcaggccgacaccggcggggccccggcggcttcggcgggcgcggcgacagggccggcagcgacatcgggaacggcggcggcggcgggagccggcctgcggcgggcacggcgggggtggccgccagccagaacggggccgaaggcgaccagatcaacgccagcaacaacgaggaggacgcgggaaaatgtttgttggtggcctcagttgggatacaagcaaaaaagacttgaaagactacttcaccaagtttggtgaggtaactgactgtacgataaagatggaccctaacacgggaagatccagaggctttggatttagactcttcaaagaacctgggagtgttgaaaaggttctggaacagaaagaacacaggctagatggacgactaattgaccccaagaaggccatggcaatgaaaaaggatccagtgaagaaaatatttgttggtggacttaaccccgaagccacagaagagaaaatcagggaatactttggcgagtttggagagattgaagcaattgaacttccaatggatccaaagaccaacaaaaggagggggtttgtgttcatctctttcaaggaagaagatccagtgaagaaagttttggagaagaaattccataacgtcagtggaagcaagtgcgagataaaggtagcacagccaaaagaagtataccagcagcaacagttcagtagtggtggaggaagaggtagctatggaggaagaggcagaggtggaagaggcggtggtcaaggcagtgcaaattatgggaagacaccaaggcgtggtggccatcagaataactacaagccatattgatcaaacttattcaggttaaactgaaactgatcaaacttattcaggttaaactgaaactgattttgagggtctgcttaaagctgcagctctgcatctagggactgcctcttggagttaactatggactctgcattactccagttgtacagaaagagatgcatgctttagggaaccagtgtcagctttccacctttttattttgtattgtttttgtgtcatacatttcctgtaatggaagtgttaattttactgtactttttggtacctttttggaatctaatgtattgtaaggtattttacatgtgttctgattcaccatgacatggatattgaagctatcctagcttttgaaataaaaaaggcgtaatct

SEQ ID NO: 19519 - protein, 285 aa, Gallus gallus (chicken)
MDTKRLRAPGSSSRPTPAGPRRLRRARRQGRQRHRERRRRREPACGGHGGGGRQPERGRRRPDQRQQQRGGRGKMFVGGLSWDTSKKDLKDYFTKFGEVTDCTIKMDPNTGRSRGFGFRLFKEPGSVEKVLEQKEHRLDGRLIDPKKAMAMKKDPVKKIFVGGLNPEATEEKIREYFGEFGEIEAIELPMDPKTNKRRGFVFISFKEEDPVKKVLEKKFHNVSGSKCEIKVAQPKEVYQQQQFSSGGGRGSYGGRGRGGRGGGQGSANYGKTPRRGGHQNNYKPY

SEQ ID NO: 19520 - DNA, 2034 bp, Schizosaccharomyces pombe
  CDS (191)..(1693)
aagcttctatattagtagtttaacgaatacgtctagaaaatttgctatactagtatacggcttcaggtacatatatcatcggtaaaaatttttttggctatatatagcagcttgtcgcgccgtaccagcagtcaaactaaaaaactcccaaattcttttaaacgggcttttggtataggttgtgaatataatggcaaaaaaggataaaacctccgttaagaaatcagtgaaggagactgcatcaaagaagggtgccattgagaaaccttccaagtccaagaagattactaaggaggctgctaaagagattgcaaagcaaagctctaaaaccgatgtctcccctaaaaaatctaaaaaggaggctaagcgtgcttctagtcccgaaccttcaaagaaatcagtaaaaaagcaaaagaaatctaagaagaaggaagaaagctcctcagaatccgagtctgaatctagctcatcagaatccgagtcttcctcttcagaatccgaatctagttcttcagagtccgaatcatcttcatctgaatcctcttcgtctgagtctgaagaagaagtgattgtgaaaactgaagagaagaaggagagttccagcgaatcatcttcctcctctgagtctgaagaggaagaagaggctgttgtaaaaattgaagaaaagaaggagagctctagtgactcttcttccgagtcttcctcatctgaatctgaatccgaatcttcctcatctgaatctgaggaagaagaagaggtggtcgagaagactgaagagaagaaagaaggctccagcgagtcttcttctgactccgaatcctcgtcagattcctcctcagaatctggagacagcgactcttcctctgattctgaatccgaatccagctctgaagacgagaagaaacgtaaagccgagcctgcttctgaagaaagacctgctaagattaccaagccttctcaagattctaacgagacttgcactgttttcgtcggtcgtctttcttggaacgtagatgatcagtggttagggcaggaatttgaagagtacggtacaattgttggtgcacgtgttattatggatggccaaagcggtcgctcaaagggttacggctacgttgattttgagacccctgaggctgctaaggctgctgttgccgctaatggtaccaaggaaattgatggtcgtatggtcaacttagatctccctaatcctcgcccagccaaccctcaaccatatgctcaacaacgtgcgggtaattttggagaccaattatctgaacctagtgataccgtatttgttggaaatttgtcttttaacgcaactgaagatgatctcagtacggcttttggcggttgcggtgacattcaatccattcgtttgcccacagatcctcagtcaggacgtcttaagggtttcggttatgttactttctctgatattgactctgccaagaaatgtgtggaaatgaacggtcattttattgctggtcgcccatgtcgtttggacttttcaactcctcgtactggtggaggtagccgtggtggtcgcggtggatttggcggtcgtggtggattcggtggccgtggtggatttggtggcggacgtggtcgcggtagaggtggtgctcgctctggaaaccccaaccgtggctcggttgctccattttctgggaacaaagtcacttttgactagtatactggcttttaactatattgagttcatttttatgggttaaatgtaaataccttagcaaattaatatatgagtttgggtttttgggaaactttttggcataaagggttttaataaatgttgggctgtggatttgatttaattgggttgaagtattcaaatacaaatgacttgtttgggtttgttatggaatgaatttgggtttggtttggttttattgactttataaagataataaatatgggcccgttggttttacaatttcaaagcagtgatggttggcgttgttctacggtttagttcatgtattcacctttcctttatacgttccatagactagt

SEQ ID NO: 19521 - protein, 500 aa, Schizosaccharomyces pombe
MAKKDKTSVKKSVKETASKKGAIEKPSKSKKITKEAAKEIAKQSSKTDVSPKKSKKEAKRASSPEPSKKSVKKQKKSKKKEESSSESESESSSSESESSSSESESSSSESESSSSESSSSESEEEVIVKTEEKKESSSESSSSSESEEEEEAVVKIEEKKESSSDSSSESSSSESESESSSSESEEEEEVVEKTEEKKEGSSESSSDSESSSDSSSESGDSDSSSDSESESSSEDEKKRKAEPASEERPAKITKPSQDSNETCTVFVGRLSWNVDDQWLGQEFEEYGTIVGARVIMDGQSGRSKGYGYVDFETPEAAKAAVAANGTKEIDGRMVNLDLPNPRPANPQPYAQQRAGNFGDQLSEPSDTVFVGNLSFNATEDDLSTAFGGCGDIQSIRLPTDPQSGRLKGFGYVTFSDIDSAKKCVEMNGHFIAGRPCRLDFSTPRTGGGSRGGRGGFGGRGGFGGRGGFGGGRGRGRGGARSGNPNRGSVAPFSGNKVTFD

SEQ ID NO: 19522 - DNA, 1714 bp, Gallus gallus (chicken)
  CDS (29)..(937)
gaattcccgcctctgcggccggggcagcatgtccgaagcggagcagcagttggcggccgccgccggcgccacccagaatggacacgaagcggctgagagctccggggagcagcagcaggccgacaccggcggggccccggcggcttcggcgggcgcggcgacagcggcggcagcgacagcgggaacggcggcggcggcgggagccggccctgcggcggggacggcgggggtggccgccagccagaacggggccgaaggcgaccagatcaacgccagcaagaacgaggaggacgcggggaaaatgtttgttggtggcctcagttgggatacaagcaaaaaagacttgaaagactacttcaccaagtttggtgaggtaactgactgtacgataaagatggaccctaacacgggaagatccagaggctttggatttatactcttcaaagaacctgggagtgttgaaaaggttctggaacagaaagaacacaggctagatggacgactaattgaccccaagaaggccatggcaatgaaaaaggatccagtgaagaaaatatttgttggtggacttaaccccgaagccacagaagagaaaatcagggaatactttggcgagtttggagagattgaagcaattgaacttccaatggatccaaagaccaacaaaaggagggggtttgtgttcatcactttcaaggaagaagatccagtgaagaaagttttggagaagaaattccataacgtcagtggaagcaagtgcgagataaaggtagcacagccaaaagaagtataccagcagcaacagttcagtagtggtggaggaagaggtagctatggaggaagaggcagaggtggaagaggcggtggtcaaggcagtgcaaattatgggaagacaccaaggcgtggtggccatcagaataactacaagccatattgatcaaacttattcaggcctggcagtggtcacagttgatgcctacaagcactggatattccacaagttgaagacggaatactgacttgtttacctgaagataataggacttcgggggtatttcctcagagaaaatataaattttaatataatttcataagctttggaggttagcttgtcttgtagcttcagtgatatcaaacttctttgagtaggagctagatagaaagctgtttagtttttgccagcatatgtaaaacaagacttttctatctgcattgtagattgtttgtggacacttgcagattcttgtgctttctgcagtcattctggggactgaactctcattgatatcgatagaggttccatgaacaggacatctgcaggataccaagtgtagaagcccacggtgtggtttggagtagtgaactgctttagtttggagatgactgggggagatgggaagagcaactgtacactaagggaacaattacagatcttcttcccagtgacatcaatgagagatttgccttcgaccttccagagaagaattagctttaatttgggacagcaaaggggtttttcaaaagcattaaaagccagtgggagctctttcagcagctcctttcgcctttaaaaaccctcacaccaaaagtggtagctaacgtcatgaaatggaagtaaataaaatgcattttcattgcaaaaaaaaaaaaaaaaaaaaaaaaaaaaaaaaaaaaaaaaaaaaaaaaaaaaaaaaaaaaaaaaaaaaaggaattc

SEQ ID NO: 19523 - protein, 302 aa, Gallus gallus (chicken)
MSEAEQQLAAAAGATQNGHEAAESSGEQQQADTGGAPAASAGAATAAAATAGTAAAAGAGPAAGTAGVAASQNGAEGDQINASKNEEDAGKMFVGGLSWDTSKKDLKDYFTKFGEVTDCTIKMDPNTGRSRGFGFILFKEPGSVEKVLEQKEHRLDGRLIDPKKAMAMKKDPVKKIFVGGLNPEATEEKIREYFGEFGEIEAIELPMDPKTNKRRGFVFITFKEEDPVKKVLEKKFHNVSGSKCEIKVAQPKEVYQQQQFSSGGGRGSYGGRGRGGRGGGQGSANYGKTPRRGGHQNNYKPY

SEQ ID NO: 19524 - DNA, 1362 bp, Saccharomyces cerevisiae
  CDS (1)..(1362)
atgtctgaaaataacgaagaacaacatcaacaacaacaacaacagcaacctgttgccgtcgaaactccctcggcagttgaagctccagcatcagcagatccttcttctgaacagagcgtcgctgtcgaaggcaattctgaacaagctgaagacaatcagggtgaaaatgatccttccgtagttcctgctaatgctattaccggtggtagggaaacttccgatagagttttatatgttggtaacctagacaaagctatcaccgaagacattttaaagcaatatttccaagttggcggaccaattgctaacatcaaaatcatgatcgataagaataataagaacgtcaattacgcttttgttgaataccatcaatctcacgatgccaatattgccttacaaacattgaacggcaaacaaattgaaaacaacattgtcaaaatcaactgggccttccaatcccaacagagttcctccgatgatacatttaacttgtttgtcggtgatttgaatgttaatgttgatgacgaaactttaaggaatgccttcaaagacttcccatcctacttgagtggtcatgttatgtgggacatgcaaactggtagttcaagaggttacggttttgtttcctttacttctcaagatgatgcacaaaatgccatggacagcatgcaaggtcaagatttgaatggtagaccgctaagaatcaactgggctgctaagcgtgataacaataacaataataattatcaacagcgtcgtaactacggtaacaacaaccgtggtggtttccgtcaatataacagtaacaacaataacaacatgaatatggggatgaatatgaacatgaatatgaatatgaacaacagcaggggcatgccaccaagttcaatgggaatgccaattggcgccatgccattaccatctcaaggccaaccccaacaatcccagaccattggtttacctcctcaagtaaatcctcaagctgttgaccacatcattagaagtgccccaccaagagttactactgcctatatcggtaatattccgcactttgccactgaagctgatttaattccgttgttccagaacttcggttttattttagatttcaagcactatccagaaaagggctgttgcttcataaagtatgacactcatgaacaggccgctgtttgtattgttgccttggcaaacttcccatttcaaggcagaaacttgagaaccggttggggtaaggaaagatcaaattttatgccacagcagcagcaacagggcggtcagccacttataatgaatgaccaacaacaaccggttatgtctgagcaacaacagcaacagcagcaacagcagcaacaacaataa

SEQ ID NO: 19525 - protein, 453 aa, Saccharomyces cerevisiae
MSENNEEQHQQQQQQQPVAVETPSAVEAPASADPSSEQSVAVEGNSEQAEDNQGENDPSVVPANAITGGRETSDRVLYVGNLDKAITEDILKQYFQVGGPIANIKIMIDKNNKNVNYAFVEYHQSHDANIALQTLNGKQIENNIVKINWAFQSQQSSSDDTFNLFVGDLNVNVDDETLRNAFKDFPSYLSGHVMWDMQTGSSRGYGFVSFTSQDDAQNAMDSMQGQDLNGRPLRINWAAKRDNNNNNNYQQRRNYGNNNRGGFRQYNSNNNNNMNMGMNMNMNMNMNNSRGMPPSSMGMPIGAMPLPSQGQPQQSQTIGLPPQVNPQAVDHIIRSAPPRVTTAYIGNIPHFATEADLIPLFQNFGFILDFKHYPEKGCCFIKYDTHEQAAVCIVALANFPFQGRNLRTGWGKERSNFMPQQQQQGGQPLIMNDQQQPVMSEQQQQQQQQQQQQ

SEQ ID NO: 19526 - DNA, 1782 bp, Arabidopsis thaliana (mouse-ear cress)
  CDS (150)..(1505)
aagaattgtcttcacgcttccgcgaatcgttaagcttcacaatttcaagcgaagaggatcaaaaaatcaatttttttggagaagaaccagaaatcacaaaaccctagagggctctcttcaaatcaaccattaaaaccgccaattccgttatgacaaagaagagaaagctcgaatctgaatccaacgaaacgtcagagccgacggagaagcagcagcagcaatgtgaaaaagaggatccggaaatcagaaatgttgataatcaaagagacgacgacgaacaagtagtagagcaagacacactaaaggagatgcacgaagaggaagctaaaggtgaagataacatagaagcggagacgtcgtccggatctgggaatcaaggaaatgaggatgatgacgaagaagaacctattgaggatctattggaaccgttttcaaaggatcaacttttgattcttctcaaggaagctgcagagagacatcgcgatgtagctaatcgaatccggattgtggcggatgaagatcttgttcatcgtaagatcttcgttcacgggcttggatgggatactaaagctgattcacttatcgacgcttttaaacagtacggagagattgaagattgcaaatgtgtggttgataaggtatctgggcaatctaaaggttatggctttatcctctttaagtcaaggtctggtgctcgtaacgctcttaagcagcctcagaagaagattggaactcgtatgactgcgtgccagctggcgtctataggacctgttcaggggaaccctgttgtggctcctgctcagcatttcaatcctgagaatgttcagaggaagatttatgtcagtaacgttagtgcagacattgatccgcagaagttgctggagtttttctcaaggtttggggagatagaagaaggtcctttggggcttgataaagctactgggagacctaaaggtttcgctttgtttgtctatagatccctagaaagtgccaagaaggcattggaggagccacacaagacttttgaaggccatgtcttgcattgccacaaagcaaatgatgggccaaaacaggttaagcaacatcaacataaccataactctcacaatcaaaattcccgttaccaaaggaacgacaacaatggttatggtgcccctggaggccatggacatttcatagctggtaataaccaagctgtgcaggcgtttaatccggccattggccaggccctcacagctttgctggcatctcagggtgctgggttgggtttaaaccaagcatttgggcaggctttgttggggacattagggacagctagcccaggagctgtaggtggaatgccaagtggctatggtactcaagcaaatatctcacctggggtctatcctgggtacggtgctcaagccgggtaccagggcggttatcagactcagcaacctggtcagggcggtgcgggaagagggcagcatggtgctgggtatggtggtccttacatgggtcgttagattagccactcaggtaatttaagagcaagctgaacggtcaacacttacgcccaacaaaaatctatggggtaccaaatatttgaatgccacctatctgctttttcttttatatatactgaaaagtgaaaagggatgaatctatgaattggtagctttataactaaagaacgaattaagcaaaagttgttttcttgtttaacttagctaggcatctacctgaatccaaaagagcaacttgttttgttttgtactaataagtatcaacaagtcttgacct

SEQ ID NO: 19527 - protein, 451 aa, Arabidopsis thaliana (mouse-ear cress)
MTKKRKLESESNETSEPTEKQQQQCEKEDPEIRNVDNQRDDDEQVVEQDTLKEMHEEEAKGEDNIEAETSSGSGNQGNEDDDEEEPIEDLLEPFSKDQLLILLKEAAERHRDVANRIRIVADEDLVHRKIFVHGLGWDTKADSLIDAFKQYGEIEDCKCVVDKVSGQSKGYGFILFKSRSGARNALKQPQKKIGTRMTACQLASIGPVQGNPVVAPAQHFNPENVQRKIYVSNVSADIDPQKLLEFFSRFGEIEEGPLGLDKATGRPKGFALFVYRSLESAKKALEEPHKTFEGHVLHCHKANDGPKQVKQHQHNHNSHNQNSRYQRNDNNGYGAPGGHGHFIAGNNQAVQAFNPAIGQALTALLASQGAGLGLNQAFGQALLGTLGTASPGAVGGMPSGYGTQANISPGVYPGYGAQAGYQGGYQTQQPGQGGAGRGQHGAGYGGPYMGR

SEQ ID NO: 19528 - DNA, 1139 bp, Hordeum vulgare (barley)
  CDS (64)..(915)
gtcgacccacgcgtccgatcccttcccctgctcgcctgcccccccttatccccttcagtcaccatggccacctccgccatgacactcgccatgtctgcggcaacggaggcctcgctcttccaccccgcgttcgccgcccaacacaagctcgccccggcgtccgcctccctcccactcattttctctcgcgcgccgctcctccgctccacccgcccccgcgtcccccttacgcccctcgtcacctcctccgacgccgctgaggcgggcctcgactgggccgacgcggaggaagctgaagagacggtgacggaggaggagcccgtggtggcggcctccggtggggacgcggggtacacagcggagccgcccgaggaggccaaggtgtacgtcgggaacctgccgtatgatgtcgacagcgagcggctcgcccagctcttcgaccaggccggtgtcgtcgaggtcgccgaggtcatttacaacaaagagtcaggccagagccgtggatttggatttgttaccatgagtactattgaggaagctgacaaagccatcgagacgtttaaccgctacaacatcagcggaaggcttctgaacgtaaacagggcagctcagaggggctcccgtgttgagagacctcctcgacagtttgcatcttctttcagggcttatgttggtaacctgccatggcaagcggaagactctaggttggtgcaaatgttcagcgagcatggggaagtagttaatgctacgatcgtgtatgacagagaaactgggcgttcgcgaggatttggttttgtaactatggcttcaaaggaggatcttgacagtgctatttcagcgcttgatggacaggagatggatggccgcccactccgagtgaacgttgcagcagagagaccacagcgagggttctgatgcggtgcagcggcggagagcatggcttggcgtttctcgtggacacatgggaacactgctgaaatgttactgcagaagactgaagcatgtcaccacttgaaactcccgcattagcctcccgatggtggctctcctcccatcccatatttttttcatgctttcgttcgctgctggtgtaatcatgttaatttcttgtcaataccatgagttcaacttttaaaaaa

SEQ ID NO: 19529 - protein, 283 aa, Hordeum vulgare (barley)
MATSAMTLAMSAATEASLFHPAFAAQHKLAPASASLPLIFSRAPLLRSTRPRVPLTPLVTSSDAAEAGLDWADAEEAEETVTEEEPVVAASGGDAGYTAEPPEEAKVYVGNLPYDVDSERLAQLFDQAGVVEVAEVIYNKESGQSRGFGFVTMSTIEEADKAIETFNRYNISGRLLNVNRAAQRGSRVERPPRQFASSFRAYVGNLPWQAEDSRLVQMFSEHGEVVNATIVYDRETGRSRGFGFVTMASKEDLDSAISALDGQEMDGRPLRVNVAAERPQRGF

SEQ ID NO: 19530 - DNA, 2188 bp, Pisum sativum (garden pea)
  CDS (75)..(1910)
atctccaaaaccctaattctctcacccgtagggttttgaatagcttccgcagcttcttccctttactctctcagatgggcaagtcaagcaagaaatccgccaccaaggttgatgctgctcccgttgtcgtttcgccagtcaagtctggaaagaaaggcaagaggcaggctgaggaggaaatcaagaaagtgagtgctaagaaacaaaaggtagaggaggttattgctaagcagaagaaggaagctgtggttcagaaagttaaggatgaaagtagttcagaggaagattcctctgaatctgaggatgagaaacccgttgtcaaacctgctgctcctgtcaaaaagacaccagctaagaacgggaatgctaagaaagccaagcccgattctagttcttcagattctgagtctgatgaggacgagtcttcggacgaggatgatgtgagtgctaagaagccagcgaaggttgcggttgctgccaagcctaagcaggcaccaaagaaggaggaaagttctgatgaatcagatgatgaatctgatgaagattcatctgaagatgagaaacctgctccaaaagctgttcctgctaaaaatgggagtgccccagcaaagaaagctgctagttcttctgatgaagagtctgatgaagattcttcctctgatgaagaagcaccaaaagctaaggttgttcctgctgctgtgaagcctgctgctgcaaagaagaaagctgaaagctccgactctgatagctcagaggattctgatgatgaggaggataccaagcctactgtaactgcggtgtcaaagtctgctgctgttgccaaaaagacagaggatgatgatgaagatagcagtgatgaagaggatagcagctctgatgaagataataaaacttccaagccttctaatggaaacaagaagccagtgactgtctctaagaaagaggataagatgaatgttgacaaggatagcagtgacagtgatgaggaaagtgatagtgatgaggagagtgagagtgaggatgaaccatccaaaactcctcaaaaaaagactaaggatgtggagatgattgatgctgacaaatcttcaaagaaagctcctgctaccccagctacaccaagtgagaatggaggttcaaagactttatttgttgggaacctgtcattcagtgtccagcgatctgacattgaaagtttctttcaagaatgcggagaggttgttgatgtccgtcttgcctcagatgaggatgggaggtttaaaggctttggacatgttgagtttgcgactgcagaggcagcacaaagtgcacttgagttgaatgggcaagaattgttgcaaagaggtgttcggcttgatttagctcgggaaaggggagctttcactccaaatagtactggcaaccagaacagtggtagaggccagtcccaaactgtatttgtcaggggttttgataaatctcttggagaggatgagattagagcaaagttggaacaacattttgcttcttgcgggcaggcttcaagggtgtcaatccccaaggattatgatactggctattcaaaggggtttgcatacatggacttcaaagattcagacagctttaacaaagccatagagctccatggaagtgaacttgatggttatcctttgtcaattgatgaagctaagcctagagaaagtacaggttttggtggtagaggaactccaaggggtggtggctctagaggtcgtggtggtcgatttggtgacaggaatagtggaggtcgatttggtgacaggagcggtggaggaagaagtggtggaagggatggtggtagaggtggtagaaggggtggtggtcgttttggattcaataaaccaagccttgctccagaaggcacaggaaaaaagaccacttttgcagacgactagagattggctatttttgtttgctgaaacttgtctcttccgtccggaggatacttaaaaacttatcataacttaagctttttaatttatttctagtagttttgttgctcagttttggtcgttattaattagtatgaattgctgaaagatcttgtgtatctgaaatttttgtgattggtagtttttgtcacatggatgttgaattccttcgggtattgaaacttgcaaatgtttggttaattattttgatataaatttaaaggtctattcttacgcgtgcc

SEQ ID NO: 19531 - protein, 611 aa, Pisum sativum (garden pea)
MGKSSKKSATKVDAAPVVVSPVKSGKKGKRQAEEEIKKVSAKKQKVEEVIAKQKKEAVVQKVKDESSSEEDSSESEDEKPVVKPAAPVKKTPAKNGNAKKAKPDSSSSDSESDEDESSDEDDVSAKKPAKVAVAAKPKQAPKKEESSDESDDESDEDSSEDEKPAPKAVPAKNGSAPAKKAASSSDEESDEDSSSDEEAPKAKVVPAAVKPAAAKKKAESSDSDSSEDSDDEEDTKPTVTAVSKSAAVAKKTEDDDEDSSDEEDSSSDEDNKTSKPSNGNKKPVTVSKKEDKMNVDKDSSDSDEESDSDEESESEDEPSKTPQKKTKDVEMIDADKSSKKAPATPATPSENGGSKTLFVGNLSFSVQRSDIESFFQECGEVVDVRLASDEDGRFKGFGHVEFATAEAAQSALELNGQELLQRGVRLDLARERGAFTPNSTGNQNSGRGQSQTVFVRGFDKSLGEDEIRAKLEQHFASCGQASRVSIPKDYDTGYSKGFAYMDFKDSDSFNKAIELHGSELDGYPLSIDEAKPRESTGFGGRGTPRGGGSRGRGGRFGDRNSGGRFGDRSGGGRSGGRDGGRGGRRGGGRFGFNKPSLAPEGTGKKTTFADD

SEQ ID NO: 19532 - DNA, 2237 bp, Triticum aestivum (common wheat)
  CDS (64)..(2019)
ggcacgagaatacctcaaaaaaatccgcaaaatcacgaaaaaaaatctacctttcgatcggtgatggcggcgcaggcggcgagctcggcgtcggagggcggctccccggccgcggcggccgctgcggctgcggcggcggcatcgtcgttcccggcgacatcgctttacgtgggcgacctcgacgtgagcgtgcaggacgcgcagctcttcgacgtcttcgcccagatcggcggcgtcgtctccgtgcgcgtctgcagggacgtcacctcgcggaagtcgctcggatacgcctacgtcaactacaacaccccggctgacgctgcacgggctcttgaaatgctcaacttcactcctatcaatggacggcctatcaggataatgtattctaaccgtgaccccagcttgcgcaagagtggcacagcaaatatatttattaagaatcttgacaagtcaattgacaacaaagctttgtatgacacattttgtgtgtttggaaacattctttcatgtaaagttgcaacagatcctgctggggaatcaaagggctatggcttcgttcagtacgagcgggatgaggctgctcatgctgctatcgagaaactgaatgggatgcttatgaatgacaagaaggtgtatgttgggcctttcgttcgtaagcaggagagagataactctcccggcaatgtcaagttcaataatgtctatgttaagaacctagctgagactaccactgaagatgacttgaaggaaatctttgggaagtttggagcaataacaagtgttgttgtaatgcgggatggggatggaagatccaagtgttttggatttgtgaattttgaaagtccagatgaagctgctctggctgttcaagatttgaatggcaagaaatttagtgacaaggaatggtatgttggaagagcgcagaaaaagtcagaaagggagattgaattgaaagagaagtttgaaaagaaccttcaagaggcagcggataagtatcagaacaccaacttgtatctgaagaacttggatgatactgttgacgatgaaaagttgcgtgaactttttgctgagttcggaactattacttcctgcaaggttatgcgtgattcaaacggtgctagcagaggttctggatttgtcgcttttaaatctgctgatgatgcttcccgagctcttgctgaaatgaacaacaagatggttggcaataaaccactttatgttgcactcgcacagcgcaaggaagacaggaaagctaggctgcaggcacagttttcacaaatgcgtcctgttccaatggctcaaactgttggtcctcgtatgcaaatgttacctcctggtgttccagttggtcagcaaatgttctatggccagccaccagcgtttattaacccacagcctggatttggcttccagcaacctttcatgccgggaatgaggccaggtggtgctccgatgccaaactttatgatgcctatggttcagcaaggacaacaaccacaacgcccagctggtaggcgagctggtgctggtggaatgcagcaatccatgcagatgggtcagcagcagatgctgggtaggggtggtggtcgtggttaccgctatcagaccgggcgtggcatgcctgatcctgcgatgcatggtgttgggggtgtgatgacatccccatatgagatgggagggatgcctatgagagatgccggtgagtcacagccggttccaattggggcattggcttctgcacttgccaattcacccccagagacgcaaagaatgatgcttggcgagaacttgtaccctcttgttgatcagctggagcacgaccaggctgccaaggtgaccggcatgcttctggagatggaccagactgaggtgcttcacctgcttgagtcgccagacgctctcaaggccaaggttgctgaagccatggaggttctccgcagcgctcagcagcacaccaaccagtcccctgagcagcagctggcttcgctctcgctgaatgacggcctcatctcttcctaagctctacggcgacaatttttgcaccatatcaaacttatctagactgaaaatgacttggtttattattggagacttagcttttgccgttagttgaattagtcttttaggcttcccatggattggctattttatttgcatggattggttgttttgtttaagttgtcgtcagcttgtcactgaatttatcttgctttctcgttaaaaaaaaaaaaaaaaaa

SEQ ID NO: 19533 - protein, 651 aa, Triticum aestivum (common wheat)
MAAQAASSASEGGSPAAAAAAAAAAASSFPATSLYVGDLDVSVQDAQLFDVFAQIGGVVSVRVCRDVTSRKSLGYAYVNYNTPADAARALEMLNFTPINGRPIRIMYSNRDPSLRKSGTANIFIKNLDKSIDNKALYDTFCVFGNILSCKVATDPAGESKGYGFVQYERDEAAHAAIEKLNGMLMNDKKVYVGPFVRKQERDNSPGNVKFNNVYVKNLAETTTEDDLKEIFGKFGAITSVVVMRDGDGRSKCFGFVNFESPDEAALAVQDLNGKKFSDKEWYVGRAQKKSEREIELKEKFEKNLQEAADKYQNTNLYLKNLDDTVDDEKLRELFAEFGTITSCKVMRDSNGASRGSGFVAFKSADDASRALAEMNNKMVGNKPLYVALAQRKEDRKARLQAQFSQMRPVPMAQTVGPRMQMLPPGVPVGQQMFYGQPPAFINPQPGFGFQQPFMPGMRPGGAPMPNFMMPMVQQGQQPQRPAGRRAGAGGMQQSMQMGQQQMLGRGGGRGYRYQTGRGMPDPAMHGVGGVMTSPYEMGGMPMRDAGESQPVPIGALASALANSPPETQRMMLGENLYPLVDQLEHDQAAKVTGMLLEMDQTEVLHLLESPDALKAKVAEAMEVLRSAQQHTNQSPEQQLASLSLNDGLISS

SEQ ID NO: 19534 - DNA, 2255 bp, Medicago sativa (alfalfa)
  CDS (97)..(2004)
ggacactctctctctctgctatttccaaaaccctaattctctctcagccgcaggttttgaatagcttccgccgcatcccccaatttctcattcaatatgcctaaatcaagcaagaaatccgctaccaaagttgatgctgctcctgttgttgtttctccagtgaagtctggaaagaaaggcaagaggcaggctgaggaagaagtcaaggcagtgagtgcaaagaagcaaaaggtagaagaggttgccgccaagcaaaaggcgttgaaggtagtcaagaaggaggaaagtagttccgaggaatcctctgaggaatctgaggatgagaaacctgttgcaaaagctcctgctccttcaaagaagaccccagctaaaaatgggaatgtgaagaaagcccagccagagaccacttcagaggaatctgactctgatgacatctcctccgatgaggaagaagtgaaaaaacccgcagctaaagctgttccatctaaaaatgggagtgcacccgtaaagaaagatgatgaatcttctgaagaagattctgatgaatcttctgaatcttctgatgaagacaagaaacctgcagctaaagctgttccttctaaaaatgggagtgcacctgcaaagaaagatgattcttctgaagaagaagattcagaagattcagatgaagatgagaaacctgcagcaaaagctgtttcttccaaaaatgggagtgtatccgcaaagaaagatgatagttcttctgatgaagactctgaatcttctgacgaagaagataagaaacctgcagccaaagcctctaaaaatgtgagtgcacccacaaagaaagctgcaagttcttccgatgaagaatccgatgaagaatccgatgaagatgaagatgcaaagcctgtgtctaagcctgctgctgttgcaaaaaagagtaagaaagatagctcagattctgacgatgaagatgatgatagcagctctgatgaagataagaaacctgtggcctctaagaaagaggttagtgaatcggagagtgattcgtctgatgacgaccataagatgaatattgacaaggatagttccgactctgacgagagtgaggaggagagtgaggatgaaccattgaaaacacctcagaaaaagatcaaggacgtggagatggttgatgctggcaaatctgggaaaaaagctcctaataccccagctacaccaaatgagaccagtggctcaaagacattatttgttgggaacctgtccttcgacgtgaaacgttctgacatagaaaatttcttccaaggttgcgtagaggttgttgatgtacgtcttgcttcggatggggatggagtatttaaaggctttggacatgttgagtttgcaactgcagaggcagcccaaagtgcacttgagatgaatggccaagaactgttgcatcgtgctctccgacttgatttagctcgggagaggggtgcatttactcctaataataatagtaactactcagcccaaagtggtggaagaggccagtctcaaacagtatttgtcaggggttttgataagaatcttggagaggatgagataagagctaaattgatggagcattttggtggtacttgtggggaacctacaagggtgtcaatccctaaagattatgaatctggttattccaaggggtttgcatacatggacttcaaagattctgacagctttagcaaagctcttgaacttcatgaaagtgaacttgatggttatcagttgtcagtggatgaagccaaacctagagatagtcaaggtcctggtggtagaggtggaggtggaaggattggtggtggtcggtttggtgaaggtggaagaaccggtggatttggtggtaggagtggtggaagaggaggaggtcgatttggtggaagggatagtgccggtagaggtggtcgaggaggaagaggtggccgtggaggattcaataaaccaagctttgcttctgaagggaaaaagactacttttgccgacgactagggtggcagttttgaaacaacttatcttccattttgggatactgaaaactttatcttatgctttttattattttatttctgttagttttgttgctcagttttggtaattttagtaagaattggtaaagatcttgtgtatcggatgtgtatcggaaatttttgtgattgatagcctcagtcatatatgatggatattggaattcctgcagctatccgagcttgcagatgtttggttaaaaaaaaaaaaaaaaa

SEQ ID NO: 19535 - protein, 635 aa, Medicago sativa (alfalfa)
MPKSSKKSATKVDAAPVVVSPVKSGKKGKRQAEEEVKAVSAKKQKVEEVAAKQKALKVVKKEESSSEESSEESEDEKPVAKAPAPSKKTPAKNGNVKKAQPETTSEESDSDDISSDEEEVKKPAAKAVPSKNGSAPVKKDDESSEEDSDESSESSDEDKKPAAKAVPSKNGSAPAKKDDSSEEEDSEDSDEDEKPAAKAVSSKNGSVSAKKDDSSSDEDSESSDEEDKKPAAKASKNVSAPTKKAASSSDEESDEESDEDEDAKPVSKPAAVAKKSKKDSSDSDDEDDDSSSDEDKKPVASKKEVSESESDSSDDDHKMNIDKDSSDSDESEEESEDEPLKTPQKKIKDVEMVDAGKSGKKAPNTPATPNETSGSKTLFVGNLSFDVKRSDIENFFQGCVEVVDVRLASDGDGVFKGFGHVEFATAEAAQSALEMNGQELLHRALRLDLARERGAFTPNNNSNYSAQSGGRGQSQTVFVRGFDKNLGEDEIRAKLMEHFGGTCGEPTRVSIPKDYESGYSKGFAYMDFKDSDSFSKALELHESELDGYQLSVDEAKPRDSQGPGGRGGGGRIGGGRFGEGGRTGGFGGRSGGRGGGRFGGRDSAGRGGRGGRGGRGGFNKPSFASEGKKTTFADD

SEQ ID NO: 19536 - DNA, 1425 bp, Schizosaccharomyces pombe
  CDS (1)..(1425)
atgggcggctctgattttgaagatgacgagctttttaaggatctatatggtgaggaaaatgaaaaaaaagtggagtcagcttcaggaaatcaagaaacgtctaatgtgacgccgacaaaagaaaacgagggctatgaagaactcgaaaaatcgggagaagcgggtgctgaacgtacaaaagaaaacccttttcgagaagaacccggagctgattttgaccgttcgggatcggaccaacaatacagtgctgaagcggaagccaatcaagaagacgatttaaatgaaacgtctcagcaagcgcctgatccttcttcgtatgatattagaggacaagccttgagttccgcaacttgggacaatgccgaggacggtgaaaattctaaaaatgataactataatgaaaatcagtcggccctgaccggttccggtgctatggaatcaaatgaagataatgcagaggaaactagtccctttaatcgagaggacggtaaaatgtttattggtggtttaaattgggagactaccgatgattcccttcgtgattatttcgagcagttcggagaggtcctcgattgtacggttatgcgtgatagtactactggccgttctaggggatttggctttctaacttttaaaaatcccaagtgtgttaatgaggtgatgtctaaagaacatcatctggatggtaaaattatcgatcctaaacgtgctataccccgtgaagaacaggaaaaaactgcaaagatgtttgttggaggagttcctggcgactgtacagaggaagagtttcgcaattttttcaaccaatttggccgcgttcttgatgccactttgatgatggataaagatacgggacggcctcgtgggtttggatttgtaacctacgaaaatgagtccgccgtagaagcaacaatgtctcagccgtatattactatacatggcaagcctgtagaggtgaagcgagctacaccaaaagctagccttcgagacagtcatgacaggcatcagcatggctaccatggtaatgctaatccttactatgctcaaaacatgaacatgtatggaggaatgacgccggctatgatggctcagtattatcgacagatgcagcagtatatggaagcgatgcgtaatatgcctgctgctgctggcgcagtaccatatcctcaacccgtcatgcccgctggtatggctgattggcaacagcaacagcagcagggagcggcatattttgatccttctaaaatgaatcaaggtactggtgatggtgtgcccttcagtccatctatgccttccggctcgtctcgtggcggataccatggccgtaatcctggtggaccgaatcgacaaagatatcgtggtcgtcgggatggtcgtggtggtaacactggcggtgggcacagcttccatccatatcgtcgataa

SEQ ID NO: 19537 - protein, 474 aa, Schizosaccharomyces pombe
MGGSDFEDDELFKDLYGEENEKKVESASGNQETSNVTPTKENEGYEELEKSGEAGAERTKENPFREEPGADFDRSGSDQQYSAEAEANQEDDLNETSQQAPDPSSYDIRGQALSSATWDNAEDGENSKNDNYNENQSALTGSGAMESNEDNAEETSPFNREDGKMFIGGLNWETTDDSLRDYFEQFGEVLDCTVMRDSTTGRSRGFGFLTFKNPKCVNEVMSKEHHLDGKIIDPKRAIPREEQEKTAKMFVGGVPGDCTEEEFRNFFNQFGRVLDATLMMDKDTGRPRGFGFVTYENESAVEATMSQPYITIHGKPVEVKRATPKASLRDSHDRHQHGYHGNANPYYAQNMNMYGGMTPAMMAQYYRQMQQYMEAMRNMPAAAGAVPYPQPVMPAGMADWQQQQQQGAAYFDPSKMNQGTGDGVPFSPSMPSGSSRGGYHGRNPGGPNRQRYRGRRDGRGGNTGGGHSFHPYRR

SEQ ID NO: 19538 - DNA, 1390 bp, Arabidopsis thaliana (mouse-ear cress)
  CDS (71)..(1216)
aatctactgttctctctcctatctgggcaaaaatctcagacaaacctgcaaaattagggtatttgaggatatggattatgatcggtacaagttatttgttggtggtattgcgaaagagacaagtgaagaagctctgaagcagtattttagcagatatggagctgtgttggaagctgttgtagctaaagagaaagtcactggaaaacctagaggttttgggtttgttcgctttgctaatgattgtgatgttgttaaagctcttagagacactcacttcattctcggtaaacccgttgatgtgagaaaggcgattaggaaacatgaactataccaacagccgtttagcatgcagtttttggagagaaaagtgcaacagatgaatggtggtttgcgtgagatgtcgagtaatggtgtgaccagtaggactaagaagatatttgttgggggtttgtcgtctaacacgactgaggaagagtttaagagttactttgagaggtttggtaggactactgatgtagttgtgatgcatgacggtgtgactaacaggccaaggggttttgggtttgttacttatgattcggaggactctgttgaggttgttatgcagagtaatttccatgagttgagtgataaacgcgtggaagtgaaacgggcaatacctaaagaaggaatccagagcaataacggtaatgctgttaatattcctccttcctacagcagctttcaagcaacaccttatgtccctgagcaaaacggatatgggatggttttacagtttcctcctcctgtctttggttatcatcacaatgtccaagccgttcaatatccttatggttaccaattcacagcacaagtggctaacgtttcatggaacaatccgattatgcaacccaccggtttttactgtgctcctcctcatcctactcctcctcccaccaacaatcttggttatatccaatacatgaacgggtttgatctttcgggtacgaacatttccgggtacaatcctctagcatggcctgtaacgggggatgcagctggtgcgctaatacatcagtttgtagatttgaagcttgatgtccacagtcaagcccatcagagaatgaatggaggtaacatgggaataccatgcagaatggtacatatatatgacagttgcagaatgataaatgcaaataggctcacaagggtagtgaaattctttggactcttttaaatggttttttaggttcctcatctttcttcattaactctttggtaaatgtgttgggttggtttggttaccttgtatattgtttaggtatttgattttaaccccaagacttatgtatcatatattactgcatttgtaatatatcacactcatttagttaaaaaaaaaaaaaaaaaa

SEQ ID NO: 19539 - protein, 381 aa, Arabidopsis thaliana (mouse-ear cress)
MDYDRYKLFVGGIAKETSEEALKQYFSRYGAVLEAVVAKEKVTGKPRGFGFVRFANDCDVVKALRDTHFILGKPVDVRKAIRKHELYQQPFSMQFLERKVQQMNGGLREMSSNGVTSRTKKIFVGGLSSNTTEEEFKSYFERFGRTTDVVVMHDGVTNRPRGFGFVTYDSEDSVEVVMQSNFHELSDKRVEVKRAIPKEGIQSNNGNAVNIPPSYSSFQATPYVPEQNGYGMVLQFPPPVFGYHHNVQAVQYPYGYQFTAQVANVSWNNPIMQPTGFYCAPPHPTPPPTNNLGYIQYMNGFDLSGTNISGYNPLAWPVTGDAAGALIHQFVDLKLDVHSQAHQRMNGGNMGIPCRMVHIYDSCRMINANRLTRVVKFFGLF

SEQ ID NO: 19540 - DNA, 1263 bp, Homo sapiens
  CDS (1)..(1263)
atggaggtcccgcccaggctttcccatgtgccgccgccattgttcccctccgctcccgctactttagcctcccgcagcctctcccattggcggccgcggccgccgcggcagctagccccgctcctcccttcgctcgctcccagctccgcccggcagggggcgcgccgggcccagcgccacgtcaccgcccagcagccctcccgattggcgggcggggcggctataaagggagggcgcaggcggcgcccggatctcttccgccgccattttaaatccagctccatacaacgctccgccgccgctgctgccgcgacccggactgcgcgccagcacccccctgccgacagctccgtcactatggaggatatgaacgagtacagcaatatagaggaattcgcagagggatccaagatcaacgcgagcaagaatcagcaggatgacggtaaaatgtttattggaggcttgagctgggatacaagcaaaaaagatctgacagagtacttgtctcgatttggggaagttgtagactgcacaattaaaacagatccagtcactgggagatcaagaggatttggatttgtgcttttcaaagatgctgctagtgttgataaggttttggaactgaaagaacacaaactggatggcaaattgatagatcccaaaagggccaaagctttaaaagggaaagaacctcccaaaaaggtttttgtgggtggattgagcccggatacttctgaagaacaaattaaagaatattttggagcctttggagagattgaaaatattgaacttcccatggatacaaaaacaaatgaaagaagaggattttgttttatcacatatactgatgaagagccagtaaaaaaattgttagaaagcagataccatcaaattggttctgggaagtgtgaaatcaaagttgcacaacccaaagaggtatataggcagcaacagcaacaacaaaaaggtggaagaggtgctgcagctggtggacgaggtggtacgaggggtcgtggccgaggtcagggccaaaactggaaccaaggatttaataactattatgatcaaggatatggaaattacaatagtgcctatggtggtgatcaaaactatagtggctatggcggatatgattatactgggtataactatgggaactatggatatggacagggatatgcagactacagtggccaacagagcacttatggcaaggcatctcgagggggtggcaatcaccaaaacaattaccagccatactaa

SEQ ID NO: 19541 - protein, 420 aa, Homo sapiens
MEVPPRLSHVPPPLFPSAPATLASRSLSHWRPRPPRQLAPLLPSLAPSSARQGARRAQRHVTAQQPSRLAGGAAIKGGRRRRPDLFRRHFKSSSIQRSAAAAAATRTARQHPPADSSVTMEDMNEYSNIEEFAEGSKINASKNQQDDGKMFIGGLSWDTSKKDLTEYLSRFGEVVDCTIKTDPVTGRSRGFGFVLFKDAASVDKVLELKEHKLDGKLIDPKRAKALKGKEPPKKVFVGGLSPDTSEEQIKEYFGAFGEIENIELPMDTKTNERRGFCFITYTDEEPVKKLLESRYHQIGSGKCEIKVAQPKEVYRQQQQQQKGGRGAAAGGRGGTRGRGRGQGQNWNQGFNNYYDQGYGNYNSAYGGDQNYSGYGGYDYTGYNYGNYGYGQGYADYSGQQSTYGKASRGGGNHQNNYQPY

SEQ ID NO: 19542 - DNA, 1089 bp, Homo sapiens
  CDS (1)..(1089)
atggagactgacgcgccccagcccggcctcgcctccccggactcgccgcacgacccctgcaagatgttcatcgggggactcagttggcagactacgcaggaagggctgcgcgaatacttcggccagttcggggaggtgaaggagtgtctggtgatgcgggaccccctgaccaagagatccaggggtttcggcttcgtcactttcatggaccaggcgggggtggataaagtgctggcgcaatcgcggcacgagctcgactccaaaacaattgaccctaaggtggccttccctcggcgagcacagcccaagatggtgactcgaacgaagaagatctttgtgggggggctgtcggtgaacaccacggtggaggacgtgaagcaatattttgagcagtttgggaaggtggacgacgccatgctgatgtttgacaaaaccaccaaccggcaccgagggttcgggtttgtcacgtttgagagtgaggacatcgtggagaaagtgtgtgaaattcattttcatgaaatcaacaacaaaatggtggaatgtaagaaagctcagccaaaggaggtgatgtcgccaacgggctcagcccgggggaggtctcgagtcatgccctacggaatggacgccttcatgctgggcatcggcatgctgggttacccaggtttccaagccacaacctacgccagccggagttatacaggcctcgcccctggctacacctaccagttccccgaattccgtgtagagcggacccctctcccgagcgccccagtcctccccgagcttacagccattcctctcactgcctacggaccaatggcggcggcagcggcggcagcggctgtggttcgagggacaggctctcacccctggacgatggctccccctccaggttcgactcccagccgcacagggggcttcctggggaccaccagccccggccccatggccgagctctacggggcggccaaccaggactcgggggtcagcagttacatcagcgccgccagccctgcccccagcaccggcttcggccacagtcttgggggccctttgattgccacagccttcaccaatgggtaccactga

SEQ ID NO: 19543 - protein, 362 aa, Homo sapiens
METDAPQPGLASPDSPHDPCKMFIGGLSWQTTQEGLREYFGQFGEVKECLVMRDPLTKRSRGFGFVTFMDQAGVDKVLAQSRHELDSKTIDPKVAFPRRAQPKMVTRTKKIFVGGLSVNTTVEDVKQYFEQFGKVDDAMLMFDKTTNRHRGFGFVTFESEDIVEKVCEIHFHEINNKMVECKKAQPKEVMSPTGSARGRSRVMPYGMDAFMLGIGMLGYPGFQATTYASRSYTGLAPGYTYQFPEFRVERTPLPSAPVLPELTAIPLTAYGPMAAAAAAAAVVRGTGSHPWTMAPPPGSTPSRTGGFLGTTSPGPMAELYGAANQDSGVSSYISAASPAPSTGFGHSLGGPLIATAFTNGYH

SEQ ID NO: 19544 - DNA, 1602 bp, Saguinus oedipus
  CDS (252)..(1328)
cggccgccgctggtacttattctttttcagtgcagcgggagagagcgggagtgtacgccgcgcgagagtgggaggcgaagggggcaggccagggagaggcgcaggagcctttgcagccacgcgcgcgccttccctgtcttgtgtgcttcgcgaggtagagcgggcgcgcgtagcgcgggattactttgctgctagtttcggttcgcggcagccgggtgtagtctcggcggcacggcggagatactagcactatgtcggaggagcagttcggcggggacggggcggcggcggcagcaacggcggcggtaggcggctcggcgggcgagcaggagggagccatggtggcgccggcacagggggcagcggcggcggcgggaagcggagccgggaccggaggcggaaccgcatctgggggcaccgaagggggcagcgctgagtcggagggggcgaagatcgacgccagtaagaacgaggaagatgaaggccattcaaactcctccccacgacacactgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggttatggatcagaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtggcttctgctttataacctttaagggagaagaaccagtgaagaagataatggaaaagaaataccacaatgttggtcttagtaaatgtgaaataaaagtagccatgtcgaaggaacagtatcagcaacagcaacagtggggatctagaggaggatttgcaggaagagctcgtggaagaggtggtgaccagcagagtggttatgggaaggtatccaggcgaggtggtcatcaaaatagctacaaaccatatctaaattattccatttgcaacttatccccaacaggtggtgaagcagtattttccaatttgaagattcatttgaatggctcctgccacctgctaatagcagttcaaactaaatttttgtatcaagtccccgaatggaagtatgacgttgggtccctctgaagtttaattctgagttctcattaaaagaaatttgctttcattgttttatttcttaattgctatgcttcagaatcaatttgtgttttatgcccttccccccagtattgtagagcaagtcttgtgttaaaagcccagtgtacagtgtcatgatgtagtagtgtcttactggttttttaataaatccttttaaaaaaaaaaaaaaaaaaaaaaaaaaaaaaacaggccacctgcccgggcggccgctcgagccctatagtgagtcgtattaggatgg

SEQ ID NO: 19545 - protein, 358 aa, Saguinus oedipus
MSEEQFGGDGAAAAATAAVGGSAGEQEGAMVAPAQGAAAAAGSGAGTGGGTASGGTEGGSAESEGAKIDASKNEEDEGHSNSSPRHTEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKGEEPVKKIMEKKYHNVGLSKCEIKVAMSKEQYQQQQQWGSRGGFAGRARGRGGDQQSGYGKVSRRGGHQNSYKPYLNYSICNLSPTGGEAVFSNLKIHLNGSCHLLIAVQTKFLYQVPEWKYDVGSL

SEQ ID NO: 19546 - DNA, 3166 bp, Drosophila melanogaster
  CDS (1091)..(2686)
agaaatgcttcacacgtcgtttgaaaatttgttaagctgtcaattgtaaatattacctgattcctatttcgcaccgattgaaagtggttgtgcatcgaagcgtgtgttgtgtcaagaaccgagcgtggaacgtacagtgaatacctgattttgcctgggtgtgaatcgaattcgtgtgagagagcgtgcgatctgagatctgggatcagaaatctatatctacttgccatacgcagtcagaaattacagcaaccaactaatccctgtcaatagtgtaagaattgttgtgtaaccaaccatcttttaggaccgccaaactgcctccgtctacacattatgtcctcccctcgacgattgcgtttgtgtgcgtgtgtgtgtgtgccacacacttgcactcacacacagacgacaggattggatattttcaatttatgtggctttcattcattgattttccaattcctgccgcgattccacactcacaaacgtcagtttactcgtattaagtgggtgaaatatctgttttcttgagtagttcaaaacatatacatatgtatgccatacatcgtaaacttgggattgggtattcttcttttgtttattaactaaatgtacgtagaataggcatttagccgatggtgggacataagtagcgtctgattcagagaatttttaactaataataacgtaaagaaacgcctaaacatgaacactaataatatatgaatatgtttgtaatacttactaaaattatatcatcgaaattacaagagatagaaacattgtttatttgtcgtttttagtagattgacctagtgtaggatcctttttgttttggcttggtcccacgagcaatgtgtgtatagagtggttcggggcaacctttttgtgttgaatattgtaccttgggatgcatctgaatagaacggatgaactgagtgagtgcattcatgaatgcagcgatgcagaatatgtgggatgcttccgttgactgaatgacatggtggatcatttctagagcgaagtgtgagcccctgcggcgaatagaagttctttaatcccctcctcgtttctagcagccttctaggaaatggatttcgttcaagtgtcggaggaggagggcgacgagcccatccagctgccggctgaggaggatggcactctgcttctgtccacactgcaagctcagttccctggatcctgcggtctgaagtaccgcaacctggacacgaaggctgtgcgcggagttcgctccaacgagggcagactgtttccgcccagcgtggagtccggctggggcgagtacgcttacttttgcgtctttcccaaggagaacaagcgcaagagcgacgataacttggagaactcaactgccaagaccaaacgcatcgagacccgtctgcgctgcactgatctcatcgtgctcggcttgccgtggaagaccacagaggagagcttgcgtgagtacttcgagacctacggcgaggtgctgatggcccagatcaagaaggacaccaagtcgggccagtccaagggcttcggtttcgtgcgcttcggctcttacgatgcccagatgcgcgtgctcaccaatcgccatctgatcgacggtcgctggtgcgaggttaaggtgcccaactcgaagggcatgggccaccaggtgccttgcaaggtgttcgtgggccgctgcaccgaggacattaactcggacgacttgcgcgagtatttctccaagtttggcgaagtcactgatgtgttcattccccggcccttcagggcctttagctttgtaaccttccttgatcccgacgtggcacagtccctgtgcggagaggatcacattatcaagggcgtttcggtccatgtgtcgaatgctgctccaaaggccgagcagaacagaaaccaacaggtccagagctacaactacaactctgccaacagctttggcatgcactcataccacccacagggtaaccacatgaatccgggccgcaacggacaccaccgaggtaataaccaacacaatgctcacggcggtgagaacgcaattgtgcccaataatcacaacattggcaccgccggctacggcatgggtggcaacaattacggcggcaactcgggcgggggctaccacaacaatggcggcaatcactccagtggcgggaacacgaaccgccaggacggcggcagccagtacaacagtcgccagtcgaattttcacggaatgaaccagccgcataacggcaacgtgggcggcagcaacggctggatgaaccgtggccacctggacatgcccaacctgcaggccctgggcatcaactcgcagggatcgagctcctccaaccagggccaaaacatgagcaaccagtcaatgctcaatctcaactcattgcccatcaatcccgcactggtcgctgccgccttgaaccagtggagcctggtcggcaaccagctgcagaaccaaaaccaggaccaacagggcggcaattttctatcttggatggctcagaacgggggccacaacaatgccaacaactttggtggacggaaggggccgaataacccgaacaacaatccggccgccaacggaataaagaccgacaactcggagccacagaatgggaacaccggttggtcgaaccagagcagcggatctcaaaacgccgcggagaagtcaaactttctttaaggcggtgcctgtcacccaatgatgtggttaatgtggttaaccaacacctctgtagcttacttaaatttacatatatgtattccacatacaaaccagttaagaattgtatttaatatgtaatagatattttgataattgtaaacaagatgacactggatggctaataacacaattgataaaacacacttcaaaataaattctgcgccaaagctcagtaaaaattgtatcattgtatcacttaagtagaatttgatttgtattttgttgtttattaaatatattttggcttacgctaagaaagtttagttataaagattgtgcacttataatgctggatctgcggagaatttccaatataacaaagttttctttaagatatctaaacgaatttggcgcagcctcattttagaggagaattcatttaacatgtacattcatttcaaaaaataaagaatgcaaaagcatattagtacaaagtga

SEQ ID NO: 19547 - protein, 531 aa, Drosophila melanogaster
MDFVQVSEEEGDEPIQLPAEEDGTLLLSTLQAQFPGSCGLKYRNLDTKAVRGVRSNEGRLFPPSVESGWGEYAYFCVFPKENKRKSDDNLENSTAKTKRIETRLRCTDLIVLGLPWKTTEESLREYFETYGEVLMAQIKKDTKSGQSKGFGFVRFGSYDAQMRVLTNRHLIDGRWCEVKVPNSKGMGHQVPCKVFVGRCTEDINSDDLREYFSKFGEVTDVFIPRPFRAFSFVTFLDPDVAQSLCGEDHIIKGVSVHVSNAAPKAEQNRNQQVQSYNYNSANSFGMHSYHPQGNHMNPGRNGHHRGNNQHNAHGGENAIVPNNHNIGTAGYGMGGNNYGGNSGGGYHNNGGNHSSGGNTNRQDGGSQYNSRQSNFHGMNQPHNGNVGGSNGWMNRGHLDMPNLQALGINSQGSSSSNQGQNMSNQSMLNLNSLPINPALVAAALNQWSLVGNQLQNQNQDQQGGNFLSWMAQNGGHNNANNFGGRKGPNNPNNNPAANGIKTDNSEPQNGNTGWSNQSSGSQNAAEKSNFL

SEQ ID NO: 19548 - DNA, 2188 bp, Nectria haematococca
  CDS (144)..(1667)
gaattcgcggccgccccaggttaaaaaggtatacaaggcgcaactgaaatcttccttctgcatccgcttctctccatcctcattctgtctattcacctcgtttagacatttccccttccatccccctcacacacacattcacaatggccaagtccaagacaaaggagagcaagaaggctaaggccgctgagcccctcgctgccgtcaaggccggaggcatcaccaagccctccaagaccaccaaggccaagtccaaggagctggccaagtctgccgctaagaagctcgtcaaggagaaggactccaagaagaagaagaaggccgagcccgagtctgagtcttccgagtccgagtctgagagcgaagccgagtcctctgacgactccgactcttcctctgaggaggagaagaaggtcaccaagaaggccaccaccaacggcaaggccaaggccaaggctcctaccccttcttccgactctgagtccgagtctgactctggctccgacgactctgacgactccgacagtgagtctgaggaggaggagaagcccaaggccaaggccaccaaggtcaacggtaccgccaaggctgccgctaagaaggctgagtcctctgactcttccgactctgagtctgactctgactccgactctgacgacgagtctgaggagaaggaggagaagaagcccgccgccaaggttgctgagaagaaggccgcttcctctgacgactcggacgactctgatgattccgaggaggattctgatgacagcgatgacagctctgaggagtctgatgccaaggccaagactgaggaggctccctccaagaagcgcaaggccgaggacgacatcgactccgacgaggctaagaagaccaagactgatgctcccactacccttttcgctggtagcctgagctggaacatcgatgacgatgccctctacgaggccttcaaggagttcaatggtctcgtcggcgctcgtgttgtcactgagaagggaactggccgcagccgtggcttcggttacgtcgacttcaacgaccctgagggttgcaccaaggcctacgaggccatgcagggtttcgagctcgacggccgtgccctcaacctcgactacgccaacgctcgccctgccgatgccaaccccgcgggccgtgctgccgaccgcgccaagcgacacggcgacaccctcagtcccgagagcgacactctcttcgttggtaacctgcctatcgacgttgaccaggatgccgtccgtgagttctttggcgaggtcgctgaggttgccagcgtccgacttcccaccgaccctgactctggtaacctgaagggtttcggttatgtcagcttcaactctgttgaggatgccaaggctgtcattgacgccaagaacggtgcccctatcggcaacggacgcatgtctcgcagcgtccgtctggactttgccagcagccgaccccagcagggcggtggtggcggcggcttcggaggtggtcgtggaggcggtcgcggtggcggccgtggtggtttcggtggccgtggtggtggtggtcgcggtggtggtcgtggacgtggcggtcgtggcggtggtcgtggtggctttggcaccggtgctaacagcactcctgccagctactccggcaccaagatctcgttcgactaaacgtgggctcatgcataatactgcagaccgagtgggcatttggcgggtttaccattaaagtgggctttgtgggctgtcgtttcaacacaagttatacctcccttgaggagtagtgggctttgagaatacgcttcacatccatggatgtgaagccatgatagacctgggggcatatacacttggggaccgtgggctcgtggcatctagcaaagacgccatcactggcgactacggctttttgatgttgggttttgaacaagtctgtcgacaagatggacaccacgtgggcttcatgagggatttgacggctctttgggaagattctcccccagtcttttgtaaagaagacaggacggagtggaccaagtcggttcgtgcgaatgctctgagggtcctgggggcttttcgaaacgcaacggaacgacctacgttgcctcgcctgacttgagcttcagttgacgatgaccctgcctttggcgaccacccaccctaattccttaatcacccgcggccgcgaattc

SEQ ID NO: 19549 - protein, 507 aa, Nectria haematococca
MAKSKTKESKKAKAAEPLAAVKAGGITKPSKTTKAKSKELAKSAAKKLVKEKDSKKKKKAEPESESSESESESEAESSDDSDSSSEEEKKVTKKATTNGKAKAKAPTPSSDSESESDSGSDDSDDSDSESEEEEKPKAKATKVNGTAKAAAKKAESSDSSDSESDSDSDSDDESEEKEEKKPAAKVAEKKAASSDDSDDSDDSEEDSDDSDDSSEESDAKAKTEEAPSKKRKAEDDIDSDEAKKTKTDAPTTLFAGSLSWNIDDDALYEAFKEFNGLVGARVVTEKGTGRSRGFGYVDFNDPEGCTKAYEAMQGFELDGRALNLDYANARPADANPAGRAADRAKRHGDTLSPESDTLFVGNLPIDVDQDAVREFFGEVAEVASVRLPTDPDSGNLKGFGYVSFNSVEDAKAVIDAKNGAPIGNGRMSRSVRLDFASSRPQQGGGGGGFGGGRGGGRGGGRGGFGGRGGGGRGGGRGRGGRGGGRGGFGTGANSTPASYSGTKISFD

SEQ ID NO: 19550 - DNA, 861 bp, Homo sapiens
  CDS (1)..(861)
atgtcggaggagcagttcggcgggacggggcggcggcacgcgaacggcggcggtaggcgctcggcgggcgacgaggagggagccatggtggcggcgacacagggggcagcggcggcgcgggaagcggacgcgggaccgggggcggaaccgcgtctggaggcaccgaagggcagcgccgagtcggagggggcgaagattgacgccagtaagaacgaggaggatgaagggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggggaattccggaattcctcagaggcaggagaaggcttggagctacccccaaactcaatccactgttggcagctgagcgtgtag

SEQ ID NO: 19551 - protein, 286 aa, Homo sapiens
MSEEQFGGTGRRHANGGGRRSAGDEEGAMVAATQGAAAAREADAGPGAEPRLEAPKGSAESEGAKIDASKNEEDEGKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGEFRNSSEAGEGLELPPNSIHCWQLSV

SEQ ID NO: 19552 - DNA, 1192 bp, Bombyx mori
  CDS (71)..(982)
attcgttgttgaaggtcgcgtgtagaccatagttttagtttaattctaattattaggcgtaattttagtcatggctaataacgataattttgcacaagatattaccaccgacaaccagcttaatggaaatgcagagaacggtggcggtgattcgcaagatcataacagtgctgaggccccaggacgcgatgacgacagaaaactttttgttggtgggctgagctgggagaccacagataaggagctccgtgatcattttggagcataccgtgaaatagagagtattaatgtaaagacagtaccaaacacaggcagatcacgagggtttgccttcattgtgtttaaggccccagagtcaatagacaaggtcatggctgctggtgaacacaccatcaacaacaagaaagtagacccaaagaaggctaaagcacgacatgggaagatttttgtcggaggactcagcagtgaaatctcagatgatgaaatcagaaacttcttcagtgaatttggaactatcttagaagtggagatgccctttgacaaaacaaagaaccaaagaaagggcttctgtttcatcacatttgaatctgagcaagttgtaaatgatttgcttaagactcccaaaagaacaattggtggaaaggaggtcgatgtgaagcgtgcaacaccaaaaccagatggccccggaggcataggcacgcgaggtggccgcggcggacgcggtgccagaggaggccgcggcggccgtggtggatacggcggccaaccttggggtaaccagggttacggcggctacggctacggtcagggtggctatggcggcggatacgacagctacggctacgggggctacggttacgatggctacgggggctacggcggttacgattactctggataccctaattacgggtaccaggggggcaagacgcgcgggggaggcggcggagcgcggaccacacagcgacaccaaccctactagctactgcgacacacgatacactaccactcaggttaagtgaccggtgatgagcgccctcgctgccgtcctgccgccgtgagggcgcgtcattccattccacgtttaatgtaatttaagagagtaatcgttgtaagaatttaaggataaaacagtgtcgtggtcgcgctcgtcgactaacgtctcgatttattataatatagtatgatttat

SEQ ID NO: 19553 - protein, 303 aa, Bombyx mori
MANNDNFAQDITTDNQLNGNAENGGGDSQDHNSAEAPGRDDDRKLFVGGLSWETTDKELRDHFGAYREIESINVKTVPNTGRSRGFAFIVFKAPESIDKVMAAGEHTINNKKVDPKKAKARHGKIFVGGLSSEISDDEIRNFFSEFGTILEVEMPFDKTKNQRKGFCFITFESEQVVNDLLKTPKRTIGGKEVDVKRATPKPDGPGGIGTRGGRGGRGARGGRGGRGGYGGQPWGNQGYGGYGYGQGGYGGGYDSYGYGGYGYDGYGGYGGYDYSGYPNYGYQGGKTRGGGGGARTTQRHQPY

SEQ ID NO: 19554 - DNA, 1011 bp, Chironomus tentans
  CDS (54)..(947)
gttgtattctttaagttctagtgattaattagaaagaaagataagttagtgaaatggcagatttacatgaaaacggtgatcaaatgcaacaagatgatggttataatggacaagatatggatcatcaaaacggcggtggagattcatcagaaattggacgcgatgatgacagaaagttgtttgtcggtggattgagctgggagacaacagagaaggaattacgcgatcatttcggacaatatggtgaaattgacagcatcaacgttaaaaccgatccaactaccggccgttcacgtggatttgcattcattgtctacaaatcagctgattcaattgacaaagttgttgctgctggcgatcacataatcaacaacaagaaagttgatccaaagaaggcaaaagctaggactggaaagatctttgttggtggacttattcctgaaatcagtgacgatgagattagagcttactttgcacaattcggaaacattgtggaaatggaaatgccatttgataagcaaaagaatcaacgtaaagccttctgctttattacctttgactcggaaacagttgtcaatgaactgttaaagaccccaaagcaaacaattagtggtaaggaagttgatgtgaagaaagccacaccgaagccggataatgctccaatgatgaatatacgtggaggtggcggtggacgaaatatgcgtggaggacgtggtggccgacaattccaaggtggaaattggggcggcaattacagtagtagtggtggaccatatggccaaagtggtggtagttggaatcaaggaaattggggaagcaattacgataactatcagggtggatatggtggtccaatggacggctactacggaaactatgattcaggctatggaaactacggaagtggtggcaattatgatcgcgcaactttcctgcctgaatcataaacatccctgattcgtgcacatttgacgaattgtcgtctatcgtcaatctatacgatttgtacac

SEQ ID NO: 19555 - protein, 297 aa, Chironomus tentans
MADLHENGDQMQQDDGYNGQDMDHQNGGGDSSEIGRDDDRKLFVGGLSWETTEKELRDHFGQYGEIDSINVKTDPTTGRSRGFAFIVYKSADSIDKVVAAGDHIINNKKVDPKKAKARTGKIFVGGLIPEISDDEIRAYFAQFGNIVEMEMPFDKQKNQRKAFCFITFDSETVVNELLKTPKQTISGKEVDVKKATPKPDNAPMMNIRGGGGGRNMRGGRGGRQFQGGNWGGNYSSSGGPYGQSGGSWNQGNWGSNYDNYQGGYGGPMDGYYGNYDSGYGNYGSGGNYDRATFLPES

SEQ ID NO: 19556 - DNA, 1320 bp, Drosophila melanogaster
  CDS (1)..(1320)
atggtcgagggtcagacagccgttcagcagcagcagcagcaaccatccggcgcgggcggtgccagcggcgtgggaagcaccaccggatccgctggaggaccggctacggccaacaatgtgaccaacagtcaggcccaaaccaatgggggcaccactgcgaccacgactgccgcagcgggtgccggatccacgacaaatgcggccgtcggccaggccacagcaaacaatgctgcgagcaacaacaacaataataataataataccaacaacaacaataacaataacgccactgcaaacaacaacaacaataatgagccagaccccaagaccaatttgattgtgaactacttgccacagacgatgtcgcaggacgagatccgttcgttgttcgtcagttttggcgaggtggagagctgcaagttgatacgcgacaaggtgacaggacaaagtctgggctacggattcgtgaactacgtgaagcaggaggatgcggaaaaggcaatcaacgcattgaacggcctcaggctgcagaacaaaaccatcaaggtctccattgcacgccccagctccgagagcatcaagggtgccaatctctatgtatcgggtcttccaaaaaatatgacacagtcggatttggaatcattgttcagtccatacggcaagatcataacctcgcgtattctttgtgataatatcactggtctctccaagggcgttggctttatacgcttcgatcagcgatttgaggccgaccgggccattaaagagctgaacggcaccactccgaagaattccaccgaacccataaccgtcaagttcgccaacaatcctagcagcaataagaacagcatgcagcctttggcagcctatatagcgccccaaaatacgcgtggcggacgagcatttccggccaacgctgctgccggagcggcagccgccgccgctgcagctgccatccaccccaatgcgggccgatacagctctgtaatctcgcgatattcaccgttgaccagtgacctgatcactaatggcatgatccaaggcaacaccattgccagctccggctggtgcattttcgtctacaacctggcgcccgataccgaggagaacgtgctgtggcaactgtttgggcccttcggagcagtgcaatctgttaaggtgattcgtgatctgcagagcaacaagtgcaagggctttggcttcgtcaccatgacgaattacgaagaggctgtcctggccatacagtcgctgaacggctacacacttggcaaccgagtgcttcaggtcagctttaagaccaacaagaacaagcaaacgtaa

SEQ ID NO: 19557 - protein, 439 aa, Drosophila melanogaster
MVEGQTAVQQQQQQPSGAGGASGVGSTTGSAGGPATANNVTNSQAQTNGGTTATTTAAAGAGSTTNAAVGQATANNAASNNNNNNNNTNNNNNNNATANNNNNNEPDPKTNLIVNYLPQTMSQDEIRSLFVSFGEVESCKLIRDKVTGQSLGYGFVNYVKQEDAEKAINALNGLRLQNKTIKVSIARPSSESIKGANLYVSGLPKNMTQSDLESLFSPYGKIITSRILCDNITGLSKGVGFIRFDQRFEADRAIKELNGTTPKNSTEPITVKFANNPSSNKNSMQPLAAYIAPQNTRGGRAFPANAAAGAAAAAAAAAIHPNAGRYSSVISRYSPLTSDLITNGMIQGNTIASSGWCIFVYNLAPDTEENVLWQLFGPFGAVQSVKVIRDLQSNKCKGFGFVTMTNYEEAVLAIQSLNGYTLGNRVLQVSFKTNKNKQT

SEQ ID NO: 19558 - DNA, 1161 bp, Drosophila melanogaster
  CDS (1)..(1161)
atggcggaacaaaacgattccaacggaaactacgacgatggtgaagagatcaccgagccagagcagctgcgcaaactgttcatcggcggactggactaccgcaccaccgatgatggcctgaaggctcacttcgagaagtggggcaacattgtcgacgtggtggtgatgaaggatcccaagacgaagcgctctcgcggcttcggtttcatcacgtactcccagtcgtacatgatcgacaatgcgcagaatgccaggccacacaagatcgatggacgcaccgtggagcccaagagggctgtgccacgccaggagatcgattccccgaatgcgggagccacggtaaagaagctctttgtgggcgggcttcgagacgatcacgatgaagagtgcctgcgcgagtacttcaaggactttggccagatcgtgagcgtgaacattgtttccgacaaggacaccggcaagaagcgcggcttcgccttcattgagttcgatgactacgatcccgttgacaaaatcatccttcagaagacccactccatcaagaacaagaccctggacgtgaagaaggctattgccaagcaggatatggatcgacagggcggaggtggcggacgcggaggtcctcgagctggcggtcgcggtggtcagggtgaccgcggccagggaggcggtggctggggaggccagaacagacagaacggtgggggcaactggggcggacgtggcggcggcggaggattcggcaacagcggcggtaactttggaggcggtcagggcggcggctctggcggttggaatcagcaaggcggaacgggaggtggtccatggaataaccagggtggcggcaacggcggctggaacggtggtggtggtggcggcggctacggcggcggaaacagcaatggcagctggggcggtaacggtggtggaggtggtggtggcggtggcttcggaaatgaataccagcagagctacggcggcggtccacagcgcaacagcaactttggcaacaaccgtccagctccttacagtcaaggaggtggtggtggaggattcaacaagggtaaccagggtggaggtcaaggctttgctggcaacaactacaacaccggaggtggtggccagggtggaaatatgggaggcggcaatagacggtactag

SEQ ID NO: 19559 - protein, 386 aa, Drosophila melanogaster
MAEQNDSNGNYDDGEEITEPEQLRKLFIGGLDYRTTDDGLKAHFEKWGNIVDVVVMKDPKTKRSRGFGFITYSQSYMIDNAQNARPHKIDGRTVEPKRAVPRQEIDSPNAGATVKKLFVGGLRDDHDEECLREYFKDFGQIVSVNIVSDKDTGKKRGFAFIEFDDYDPVDKIILQKTHSIKNKTLDVKKAIAKQDMDRQGGGGGRGGPRAGGRGGQGDRGQGGGGWGGQNRQNGGGNWGGRGGGGGFGNSGGNFGGGQGGGSGGWNQQGGTGGGPWNNQGGGNGGWNGGGGGGGYGGGNSNGSWGGNGGGGGGGGGFGNEYQQSYGGGPQRNSNFGNNRPAPYSQGGGGGGFNKGNQGGGQGFAGNNYNTGGGGQGGNMGGGNRRY

SEQ ID NO: 19560 - DNA, 1758 bp, Strongylocentrotus purpuratus
  CDS (69)..(1217)
gggtgaacgattaagggagttgaccaaattgtgcataatcttctctagctaaacacaaaccaggcaaaatgggcgaagaaataggaaaaatatttgttggtggtgttgaccgcaacacacatgcagatacattccgagcatactttgagaagtttggaaagctgagtgatattatcttgatgatggataaagataaacctggtcagaacaaaggctttggttttgtgacgtttgctgacccggcctgcgtagacgatgtgaccaacgaaaagaaccacaacctggaaggaaaagggcttgattgcaaacgttgcaaagctcgaggatcagagaagagaatgggaccaggtgatcagagaactaagaaggtctttgtgggaggtatctcacaacaagctaccaaagaagatctctatgaactattcagatcacatggaaatgtggaagatgtacatattatgaacgacaccgacactggaaaacacagaggcttcggctttgtgacgttggatagtgaagaagccgtagagaaattggtccgaatgcaccatctggagctcaaggggaaatcgatggagatcaagaaggcccagcctaagatgaaccgagggttcggaggtccaggaggacagggtggcccagggggtccaggaggcttcccacaggggggtaactggaaccaaggtggtggtcaaggaggatacggaggaggcggcagcaacggctacggaggcggcaaccaatggggtcagcaaatgggtcaatacggtggtggacagcaaggtggtggttaccagcaacagcgaggtggtggtcaacagccaggctacaacaggcaacagcagcaaccacaatcaggctatggtcaacaaggacaacaaagttatggaggtgcacaaagctatggtagttatggaggctatggacaggcacagcaggaccctacggccaacaacaacaagcagcacctcagcagcagtatgcaagccaaggatcgatgggtagctacgctcaagaaagcatccggctatggacctcagagaggaaactacaaccaaggttatagtcaagcagctccccagacacagacccccacaccgcagccaccacagcagcagagctatgcacaggtggacagtggtcaagacatgtatggcaccaacaactacggcaaggctaacatggggggaaaccagttccatccgtacagtcgataatcagctaaccaggagcttgtgggaacaaccctcagtctcacatatctgttctctatgtttggtatgaagggctgttttcatggctggtattttcatgatcctgcttgtaaatcatcccattttgtgtgtccagttctatgatattgttggggggggggggggggataatttggtctttgtatagctcgtttaactttgaatgtaatcactgacagtctggtgtagtccttatgcaaatttgtttaaataattgcacgttattatatggttctatataataaagagtgaaatagatatttgacacagtgtgaatacctgcaaaaaagatatatgctttggtttggtctatagttgtgcaaattgggtttactacaaggcttctacaattgtcatgtgttgagactctcaaaggaattgaattctggcattccatctattggttgaaaagatatcaaaacatctcaataggttcattttggaagatgaattgcttgtataaacaatacacatagttgaaaacatcactgacttgaaaaaaaac

SEQ ID NO: 19561 - protein, 382 aa, Strongylocentrotus purpuratus
MGEEIGKIFVGGVDRNTHADTFRAYFEKFGKLSDIILMMDKDKPGQNKGFGFVTFADPACVDDVTNEKNHNLEGKGLDCKRCKARGSEKRMGPGDQRTKKVFVGGISQQATKEDLYELFRSHGNVEDVHIMNDTDTGKHRGFGFVTLDSEEAVEKLVRMHHLELKGKSMEIKKAQPKMNRGFGGPGGQGGPGGPGGFPQGGNWNQGGGQGGYGGGGSNGYGGGNQWGQQMGQYGGGQQGGGYQQQRGGGQQPGYNRQQQQPQSGYGQQGQQSYGGAQSYGSYGGYGQAQQDPTANNNKQHLSSSMQAKDRWVATLKKASGYGPQRGNYNQGYSQAAPQTQTPTPQPPQQQSYAQVDSGQDMYGTNNYGKANMGGNQFHPYSR

SEQ ID NO: 19562 - DNA, 1431 bp, Tetrahymena thermophila
  CDS (1)..(1431)
atgtccaaataagttaagaagggtcaagttgaaaagaagattaaggctgaagaagaaaagaagaaggttgtctaacaatcctccgatgatagtgacgattcttccagcgaagatgaaaagcctgttgtcaataacaagaagaaccaaaaggtttaagaaaaggctgctgaaaaggttaccaaggctaagaagcaagtttctgaatcttctgatgacagtgaatctgaagaagaaaagcctgcccccaagaaggctgtcgctgctaagactgctcctgttgccaagaaggctgttgccaagaaggaatcctctgattctgatgacagtgaatctgaagaagaaaagcctgcccccaagaaggctgtcgctgctaagactgctcctgttgccaagaaggctgttgccaagaaggaatcctctgattctgatgacagtgaatctgaagaagaaaagcctgcccccaagaaggctgtcgctgctaagactgctcctgctgccaagaaggctgttgccaagaaggaatcctctgattctgatgacagtgaatctgaagaacaaaagcctgcccccaagaaggctgccgttaaacccgctgccaagaagtaagaatctgaagatgaagacagtgatgaatcagaagaataaaagcctgctaccaagaaggctgaaaagatgtaagtcgaagaagaatcttctgaagaataaaagcctattaaataagaccaacctatccaaaaggcctaaaacggtaatgccaacggtaaataaggtggtgacaagttctctaatgaagttatcgttaagggtttgagctttgatgctgatgaaaacgatattggtaacttcttagacgaaaactgcggttccgttgctagagttaacctcttaaagaacgaataaggacgttctaagggtattgccttcgtcagctttgaaactgaagaaggttgcaacaaggctgttgaaatgagcaactctgaattcatgggtagatatcttattattgaaaagaccaagcccaagactgaaagacctgctcacttacctgttgatgaagactccaagactatctttgttggtaacctctctttcagaaccgacaaggaaactcttaagaagttcttcgcctcttgcggtaaggttgctgatgctcgtatcgctgaagctgatggaaagagcagaggtttcggtcacgttgaattcgaagaaagatccggtgttgaaaatgctttaaagaaggttggtgaataaatcgacggaagacccatcaaggttgatgtcgctgcttccagaggtaaacgtgaaggtttcaacagatcctaaggaaacttcaataacaacagaggtggtccccgtggtggtaacaactcttttgctaacgaaagaaagggtgccattacttaattctaaggaaaaatccaatctctctga

SEQ ID NO: 19563 - protein, 476 aa, Tetrahymena thermophila
MSKQVKKGQVEKKIKAEEEKKKVVQQSSDDSDDSSSEDEKPVVNNKKNQKVQEKAAEKVTKAKKQVSESSDDSESEEEKPAPKKAVAAKTAPVAKKAVAKKESSDSDDSESEEEKPAPKKAVAAKTAPVAKKAVAKKESSDSDDSESEEEKPAPKKAVAAKTAPAAKKAVAKKESSDSDDSESEEQKPAPKKAAVKPAAKKQESEDEDSDESEEQKPATKKAEKMQVEEESSEEQKPIKQDQPIQKAQNGNANGKQGGDKFSNEVIVKGLSFDADENDIGNFLDENCGSVARVNLLKNEQGRSKGIAFVSFETEEGCNKAVEMSNSEFMGRYLIIEKTKPKTERPAHLPVDEDSKTIFVGNLSFRTDKETLKKFFASCGKVADARIAEADGKSRGFGHVEFEERSGVENALKKVGEQIDGRPIKVDVAASRGKREGFNRSQGNFNNNRGGPRGGNNSFANERKGAITQFQGKIQSL

SEQ ID NO: 19564 - DNA, 1542 bp, Candida glabrata
  CDS (1)..(1542)
atgagttcagacgaggaagactttaacgatatctatggtgatgaacaccaagatcaacaacagacagtttctaatgaaagtaaaccagtagattcaaccaccgctccaagcactgagtcagccagcgttccaatggatcccttggctgctttgcaagctttatcatctaacttaaataatagtaataacactgataacaacaatgataaagatactagctccggatcacagacaactgctgatggtaatgctgttagctcagagcaaaatggatcaaatgttagctcagagcctcaagttagcaaccaaacgcaaaactctgaacaaagagaaagcattgaggaagctaacagaagacaagtcaaagctgacctatctagagaaaactgtaaaatgtttattggtggtctgaattgggaaactaccgaagatggtttacgtgaatacttcagcaagtacggtaatgttgtagaacttaaaatcatgaaagatccaaacactggtagatccagaggttttggtttcttgagtttcgatgcaccaagttccgttgacgaagtcgtgaagacacaacatattcttgacggtaaagtaatagatccaaagagagctatcccaagagaagaacaagataagacaggtaaaatctttgtaggtggtttgggtacagatgtaaggccaaaagaattcgaagaatacttctcccaatggggtaccatcattgatgcacaattaatgcttgataaggatactggtagatccagaggttttggatttgttacatatgactcaccagacgctgcagaaaaggtatgtgaatcaaggtatagagaattcaaaggtaagcaaatagaaataaaaagagcagagccaagacaccagcagaagcaggctggacagcaagctgtaagtcctcctgtggccggcatgggcatgaatccaatgtctaacccaatggccaacccaatggctggcatgtatcaaaatccgatgatgggtggtttcaaccctatgtttaacccacaagctatgcaagattactaccaaaagatgcaagaatattatcagcaactacaacagcaaacgggcatggattattctcaaatgttccaacagcagatgtcaatgatgatgccaggattccaaatgccaccaatgaatgctgatggctctggttctcctctaaataatgccggttctgaaaatactccatctggtgacgaccataacggaagcgataactcttcttcttctaatgtgcaaacgattggtggtgacagtaatgatagtaattcagcatcaaatgagagaaatgaggacggcagtaatagaatgaagaaaaactcgttaccaaagaatataccaagagggcctagaggacccagtgaaagaaatgacagaggttcatatcacagagaccgttctggtggttcccgtcatggtggttaccatggctctagtaatggttcatacagaagagaacgtggcggttacaacggagggcgtcgcagcaatggatatcacccttataacagatcataa

SEQ ID NO: 19565 - protein, 513 aa, Candida glabrata
MSSDEEDFNDIYGDEHQDQQQTVSNESKPVDSTTAPSTESASVPMDPLAALQALSSNLNNSNNTDNNNDKDTSSGSQTTADGNAVSSEQNGSNVSSEPQVSNQTQNSEQRESIEEANRRQVKADLSRENCKMFIGGLNWETTEDGLREYFSKYGNVVELKIMKDPNTGRSRGFGFLSFDAPSSVDEVVKTQHILDGKVIDPKRAIPREEQDKTGKIFVGGLGTDVRPKEFEEYFSQWGTIIDAQLMLDKDTGRSRGFGFVTYDSPDAAEKVCESRYREFKGKQIEIKRAEPRHQQKQAGQQAVSPPVAGMGMNPMSNPMANPMAGMYQNPMMGGFNPMFNPQAMQDYYQKMQEYYQQLQQQTGMDYSQMFQQQMSMMMPGFQMPPMNADGSGSPLNNAGSENTPSGDDHNGSDNSSSSNVQTIGGDSNDSNSASNERNEDGSNRMKKNSLPKNIPRGPRGPSERNDRGSYHRDRSGGSRHGGYHGSSNGSYRRERGGYNGGRRSNGYHPYNRS

SEQ ID NO: 19566 - DNA, 1251 bp, Candida glabrata
  CDS (1)..(1251)
atgtctgaagagattaagaacgaggtcattgagacccctgaagaagtaattgagaagccagaagaagtatcccaagaagttgaaggcgataacgcttctcaggagaacgatgatgataagccatcggttgttccagcatctgctactaaaggtggtagagaaacttctgacagagtcctatatgttggtaacttggacaagtctatcactgaggaccttttgaagcaatatttccaagctggtggaccaattcaaaatgtcaaaatcatcgaagacatgaagaacgaatatgtcaattatgcctttgttgaatacatcagatcccatgatgcaaatgttgccttgcaaactttgaacggtgttcaattagaaaacaagactttgaagattaactgggcttttgagacacaacaagccgccgaaaatgacgacacttttaacttatttgtcggtgacttgaacgttgatgtcgacgatgaaactttggcaggtactttcagagagttcccaactttcatccaagctcatgttatgtgggatatgcaaactggtagatccaggggctatggtttcgtctctttctctaatcaagaagaggcacaaaaggccatggatgctatgcaaggtaaggatttgagcggtagacaaatcagaattaattgggctaccaagagagaaagaaacatgggtaataactttgggaacaaccgcggtagtcgtggtggtaacttccgcccatacggtaaccaaggtcaccataacagaaacaacagaaatatgatgcctcctgccatgggtatgccaatggatggtttgatgccaatgcagcaaggccagcaaaatggtcagcaaccaaatgtccagcaacagcaaccaatggttccaccacctgtcaacccacaagctattgaagatatgattagaagagctccaccaagagttaccactgcttacattggtaacattcctcattatgcaactgaagccgacttgattcctcttctacaaaactttggtttcatcttggatttcactcactatcctgaaaagggatgttgtttcattaagtatgatacccacgagcaagcagctgtttgtatcgtagctctagctaacttcccattccaaggcagaaatttgagaactggttggggtaaggagagaaccaacttcatgccacctcaaggtgctccaggtcaacaaatgccagttatgatggatccatcccaagctcctccagctcctcagtaa

SEQ ID NO: 19567 - protein, 416 aa, Candida glabrata
MSEEIKNEVIETPEEVIEKPEEVSQEVEGDNASQENDDDKPSVVPASATKGGRETSDRVLYVGNLDKSITEDLLKQYFQAGGPIQNVKIIEDMKNEYVNYAFVEYIRSHDANVALQTLNGVQLENKTLKINWAFETQQAAENDDTFNLFVGDLNVDVDDETLAGTFREFPTFIQAHVMWDMQTGRSRGYGFVSFSNQEEAQKAMDAMQGKDLSGRQIRINWATKRERNMGNNFGNNRGSRGGNFRPYGNQGHHNRNNRNMMPPAMGMPMDGLMPMQQGQQNGQQPNVQQQQPMVPPPVNPQAIEDMIRRAPPRVTTAYIGNIPHYATEADLIPLLQNFGFILDFTHYPEKGCCFIKYDTHEQAAVCIVALANFPFQGRNLRTGWGKERTNFMPPQGAPGQQMPVMMDPSQAPPAPQ

SEQ ID NO: 19568 - DNA, 1359 bp, Candida glabrata
  CDS (1)..(1359)
atgagttcagacgaggaagattttaatgatatctatgataccaaggatgagagcaaagttgatgctaaggatgatgtgaaagcggaggagaaggttcctgaggctgccacaagtgcgcttgatcagctggcggcattacaagccagttctgctaaccctgacagcaataaagacgatgctgctaagatgccatgggagacattgcaaaatactctcaaccaattacagactgtgactaaagaagagtcaccagataagagtaaagaggaaaagagtagtaatgctagtgtagatagtggcaccaatgtacagagcggcaatactggcgataggacagtcaaagctgacctgtcaaaggacagttgtaaaatgtttattggtggtttgaactgggaaacaacagaggatggtctgcgcgattattttagtaaatatggtaaagttgaagaattgaagattatgaaagatccagccactggtagatctcgtggttttggtttcttgacttttgaatccgcatcttctgtggatgaagttgtaaagacccaacatattttggatggtaaagttatcgatcctaaaagagccattccaagagaagaacaagataagactggtaagatttttgtaggtggtatcggtccagatgtgagacctaaagaattcgaagaatttttcgcacaatggggtactatcattgatgcgcagctgatgttggataaagatactggtagatctagaggatttggattcattacatatgatacaccagatgctgtagataaggtctgtcagaataaattcatcgactttaaaggaagaaaaatagaaatcaaaagggccgctccaagacatcttcaaaaaactggtggtgcgcgccaaccagcacaacaaagctctaattcacaatatggcatgggcacaggaagtaatagcagtggtcaatatccaggttacggcttccaggatcctatgatgttttcgaacccaatgatgagtggttacaaccctatgtttgctaataacaaccctcagatgcaagagtacttccaaaaaatgcaagactactataaacaggttcaacaacaaggtggtatggattacaaccagatgtatcaacaacagatgcagcaaatggctatgatgatgcctggtttcaacccttccactatgggtcagcaatcgcaaggtagccctgatgccaactcaactaagagccaaagtaacgaagcttcgacaccaacaccagatgatcaagatagaggtaacaaagattcttcaagaagatccggtggtccaggtggtttccgcggtcgtccaaatgatagcagaagaggttatcatccatacaataggtag

SEQ ID NO: 19569 - protein, 452 aa, Candida glabrata
MSSDEEDFNDIYDTKDESKVDAKDDVKAEEKVPEAATSALDQLAALQASSANPDSNKDDAAKMPWETLQNTLNQLQTVTKEESPDKSKEEKSSNASVDSGTNVQSGNTGDRTVKADLSKDSCKMFIGGLNWETTEDGLRDYFSKYGKVEELKIMKDPATGRSRGFGFLTFESASSVDEVVKTQHILDGKVIDPKRAIPREEQDKTGKIFVGGIGPDVRPKEFEEFFAQWGTIIDAQLMLDKDTGRSRGFGFITYDTPDAVDKVCQNKFIDFKGRKIEIKRAAPRHLQKTGGARQPAQQSSNSQYGMGTGSNSSGQYPGYGFQDPMMFSNPMMSGYNPMFANNNPQMQEYFQKMQDYYKQVQQQGGMDYNQMYQQQMQQMAMMMPGFNPSTMGQQSQGSPDANSTKSQSNEASTPTPDDQDRGNKDSSRRSGGPGGFRGRPNDSRRGYHPYNR

SEQ ID NO: 19570 - DNA, 1252 bp, Paracentrotus lividus
  CDS (38)..(1078)
ccttgacgaacatcccggaggaagtcgcgccgataacatggacacatctaacttttccacaaacggtacagattattcacaacaatcagaatcacaaggacaatctatggatcactcagaagaatcaaagggaagtcggaaggcaggagaacgaatttatgcatcaaaagagcaagaagatgacaagaagctctttgtcggtggtcttgcctggaacacaacaccagagacacttcaacaatacttctcagcttatggtactgttcaggactgtgaaataaagaaggaccaggtcacaaagaaacccagagggtttggattcatccttttcgagtctgcagattcagttacaaaagttctagatgtgcccgaacacaaagtagatgacaagaccatagaccccaagcctgccaacccactcaagaaaccagaaaagaagaaaaagatcttcatcggtggaatcggttcagatctcaaagacgacgatatcaaatcttacttcagccaatttggaacggttgttgaaacagaatttccagaagacaagacgactggtagaaggctgggctttgcctttgtcaagtatgaaacatcagatgaagcacagaaggctcagaatagtagatttcacaccatctcaaataagaaagttgaagttagcgaagcggtatcgagggaagagagacagcaacagaagatgagaggaggtatgatgggcggaagaggaggaagaggaggcagaggaggatatggtcccgggtataggggtggatatggaagctatggtggctatgaagacccaggcttctatggtggaggatacagcggcggtggcggaggctacggtggcggatacggaggtggatacggtggcggacaggctggctaccaaagctatggctcttatggctcatacgaccaaggaggctacaaccaaggaggtggaggaggctacggtggatatggagactacagcggtggtggtggatacggaggctacggacaaggcagtggaggatacggcggtggcggctacaacggtggatatgaacaatcagggactgcaaagccccagtaaatcgacgtggggcgcggcgcccaccacccctacactcgctaaagacgtgttttaaggccaggaagggggacccatgaacagattaacgacggacactcctgtggagtcaacacttgcccctactacaaaaaaaatggaaaacaaaaattgtacaaaaaaaaaaaaaaaaaaaaa

SEQ ID NO: 19571 - protein, 346 aa, Paracentrotus lividus
MDTSNFSTNGTDYSQQSESQGQSMDHSEESKGSRKAGERIYASKEQEDDKKLFVGGLAWNTTPETLQQYFSAYGTVQDCEIKKDQVTKKPRGFGFILFESADSVTKVLDVPEHKVDDKTIDPKPANPLKKPEKKKKIFIGGIGSDLKDDDIKSYFSQFGTVVETEFPEDKTTGRRLGFAFVKYETSDEAQKAQNSRFHTISNKKVEVSEAVSREERQQQKMRGGMMGGRGGRGGRGGYGPGYRGGYGSYGGYEDPGFYGGGYSGGGGGYGGGYGGGYGGGQAGYQSYGSYGSYDQGGYNQGGGGGYGGYGDYSGGGGYGGYGQGSGGYGGGGYNGGYEQSGTAKPQ

SEQ ID NO: 19572 - DNA, 1927 bp, Oryza sativa
  CDS (219)..(1412)
gcggtttacgcgttggactccccccctctcacctcgccgccgcctcctccatccatccaatctcccacccccctctaaacccgcacgcgaagcctagggtttcctccacctccaaacccccccaccaccctcccttcctccgatcgatccgcctccgaggggcatcggcgtcggcggcggcggcggcggaggcgagcttgctgttgttgttgtgtgggatggcggggtacccggaggagaaccagcacgggatgaacgggtacgaggaggaggaggaggtggaggaggtggaggggttcgacgaggagggtcgacccggtagacggggcggcggcggtcgggatgggggcgatggcggcgcgtatggcgacgccagcggggacgacgggagggcgcccggcggggactcgtcggggaagattttcgtcggaggcgttgcttgggagacaaccgaagaatcattctccaagcattttgagaagtatggggctataactgattctgtaattatgaaggacaagcatactaagatgcctcgtggatttggatttgttacattttccgatccatctgttatagacaaggttttggaggatgagcacgttatagatggaagaacggttgaagttaaaaggacagtcccaagggaagaaatgtcatcaaaagatggtccaaagacaaggaaaatctttgttggtggattaccttcatcactaactgaagatgagttgagggagcacttctccccatatggtaagattgttgaacatcaaataatgcttgatcatagcactgggcgttctagaggatttggttttgtcacttttgaaagtgaggattctgtggaaagggttatatcagagggaagaatgcgtgaccttggtggaaagcaggttgaaataaagaaggctgagccaaagaaacatggtggtgatcacagtagtaatgggagatctagtcatgggagcgggggtggttaccgcagttcataccgtagtggtggagctgctgcttctggtggtggaggcggaggtggtggtggcggcagtggcagcagtggtggctatgggtatggtgctggttaccgatcagctggaggaggttattatgatagtactgcatatggttatggcagaggagggtatggctatggaggtaatgctggatttggatcaggatatggtggtggttatggtggctccttgtatggaggtgcctatggtgcttatggggcatatggtggtggtgcctatggagggggtgcctatggcggaggtgcttatggtggtggtgcctatggtggcgctccgggtgcctatggtggtgctggaggatatggcagttatggtggagctggagcaggaggtgctggtgggcggggttccagcaggtaccatccatatgggaaatgagtgaactcatgagagttttttctaggatacaataagtgcacctcctggaaaatcagcgttttatcttgggttactcaatcagcggcaccagaacatttatttagtttcatcaaattatctcgtaactggaccaactgtgtaattttagtcgctgaacccatccgtagtctgctgtagaagctacacatgaaagctatgttgtattccgttagttttcatatgctgagagaattagaaccctcaaacaaagccttttgtgttaggaacagtattggtatgattgacctattatattttgtgcggtagtgacattgccttcgcaagcagctaactgttgccatctgcccttatatgtaagggaaccgttaacggatttgcttaaatcttctaatttgactgtttttattgaccttgctgctataatctctgtatatcattgttctgcgctctgtatttcttacggcagtgaagaatgcatggtccactgcaatacatatgtccgtctgattatactc

SEQ ID NO: 19573 - protein, 397 aa, Oryza sativa
MAGYPEENQHGMNGYEEEEEVEEVEGFDEEGRPGRRGGGGRDGGDGGAYGDASGDDGRAPGGDSSGKIFVGGVAWETTEESFSKHFEKYGAITDSVIMKDKHTKMPRGFGFVTFSDPSVIDKVLEDEHVIDGRTVEVKRTVPREEMSSKDGPKTRKIFVGGLPSSLTEDELREHFSPYGKIVEHQIMLDHSTGRSRGFGFVTFESEDSVERVISEGRMRDLGGKQVEIKKAEPKKHGGDHSSNGRSSHGSGGGYRSSYRSGGAAASGGGGGGGGGGSGSSGGYGYGAGYRSAGGGYYDSTAYGYGRGGYGYGGNAGFGSGYGGGYGGSLYGGAYGAYGAYGGGAYGGGAYGGGAYGGGAYGGAPGAYGGAGGYGSYGGAGAGGAGGRGSSRYHPYGK

SEQ ID NO: 19574 - DNA, 1427 bp, Oryza sativa
  CDS (59)..(1111)
gacccgcctcttccaacgaaacgcgaaaccctagcccgtctgatctctctctatcgccatggccggcggcaagatgaaggagcacgacggcgccagcccagccaaaatcttcatcggcgggctgcctaaggacaccaccatgggtactttcaaagaatactttgggaagtatggggagatagttgatgccgtcataatgaaggaccgctttacccagaaacccagaggatttggatttattacctttgcagatcctgctgttgttgacagagtgattgaggacaaccatgttattaatggaaaggaggttgaaattaagagaactattccaaagggtgctgcccccctaaaagatttcaagacgaagaaaatatttgttggtggattaccatctgctttgaaagaagatgaattcaaggagttcttttcgaaatttggaaaggtggtggaacatgaaatcattcgtgaccattcaactaaccggtcacgaggatttggatttgtagtctttgatgcagaaaaaactgtagatgaattattagctaagaaaggcaatatgattgatctaaatggttctcaggtggagatcaagaaggccgaaccaaagaaaccctctaacccacctcatcgttcatttgatagtgaacctaggggccgtccacatgcggatggttatgatggattgggcaactcttataattatggtggtagctttggcccctatagatcacctggaagttttggcactaggcctggtggttacagtagttcttatggccctggtgactatggtagtggctatggtgcttatggtggagcattaggaggatatcgtggagaatcatctctctattctagtcgctttggtagcacttatggaggaagctttggtggtggttatgctggtggcagttatgctggtggtttaggtggtgcatatgggcgtgatgctgggggttttggtggttctagctatggccctagttatgactcttcttcaggtcctggtgctggtgttggctttggcacgggtggactctatggtgctagaggaggctatggtagcagtggtgctggtgcttctggtcgttatcatccatatgcaaggtagacagcttcagatgctgccatgtgtgtgttagataagcttgcagaaggtcggtactagacaaggcaagataaattatctgcagctagaaaagaagagttgaagtttaatctgctaaggttatgtacctctcctgctagatttggctctgctaaggtttatgtacgcctgttagattggctctgctaaggttgctgtaccactcctgactcctgttagattggcttgtagaatttaaaatcactttttcagtgtttagaattcaagagatcgcacatatgctttgattagatagcaaagtcactatggctgttagttt

SEQ ID NO: 19575 - protein, 350 aa, Oryza sativa
MAGGKMKEHDGASPAKIFIGGLPKDTTMGTFKEYFGKYGEIVDAVIMKDRFTQKPRGFGFITFADPAVVDRVIEDNHVINGKEVEIKRTIPKGAAPLKDFKTKKIFVGGLPSALKEDEFKEFFSKFGKVVEHEIIRDHSTNRSRGFGFVVFDAEKTVDELLAKKGNMIDLNGSQVEIKKAEPKKPSNPPHRSFDSEPRGRPHADGYDGLGNSYNYGGSFGPYRSPGSFGTRPGGYSSSYGPGDYGSGYGAYGGALGGYRGESSLYSSRFGSTYGGSFGGGYAGGSYAGGLGGAYGRDAGGFGGSSYGPSYDSSSGPGAGVGFGTGGLYGARGGYGSSGAGASGRYHPYAR

SEQ ID NO: 19576 - DNA, 2090 bp, Oryza sativa
  CDS (105)..(1823)
cccctcccctccctaaaaccctagcaactactagggtttctctctctctcctccccccctacacagccgccgctgcacccgccgccgccgccgccacaccaccgatggggaaggcgagcaagaagtccgtggccgtggccgtcgcgcccgctgctgtgccggccaaggggaagggcggcaagaagcgggaggcggaggacgagatcgagaaggcggtgagcgccaagaagcagaaggccgcggcggcgccgccggccaaggccgtccccgcgcccaaggcggacgccaagaaggccaagaagcagccgccgcccaagaaggccgcgagcagcagcagcggcagcagctctgaggaggactcgtcggagtccgaggaggaggtcaaggtccaggtgaagaagactactaagcctgtcaagcaggagtcttcttctgatgagagcagcgatgagagctctgatgatgaggatgctaagcctgcggatccggttgctaataatggtcttaagaaaggcaagccagcgagcagcgattctgagagtgattcagacgatgaaatggatgaggacgagaaacctgctgctccagtgaaaaaaacttctgtgactgcacaaaagaaaaaagatgattctgacagctctgagagtgagtcagatgagagtgattcggacgaggatgtgcctacaaagtctaaagcccctgctgtagctgccaagaatgatgattctactgatggttccgagtccgaaagtgactctgaggatgaggatgctgcacccaagggtgctgccaagaaggaaagcagcagtgatgaagaggatgacagttctgaggaaagctctgatgatgaacctaaacaacctcaacaaaaaaaggcccaagaggaatcctctgaagagtcttctgaagaagatagtgatgaagaggatgaaaaattggccaaaactcctaagaagaaaacgcctgctgccaccaaatcacaaaatgatgaacctaaaactcctgcgagtaaccaaagtcagggaactgagtcagcaaccctttttatgggcaacctttctttcaatttaaatcaggaccaagtgaaggaatttttccaggaagttggtgaggttatcagtgttcgtttggctacacatgaagatggctcctccaggggctttggccatgttcaatttgcttcatctgaagaagctaagaaggcgcttgaattgcatggctgtgatctggatggtcgtccagtgagacttgacttggctcatgaaagaggtgcatacacccctcacagcaggaatgatactggatcattccagaaacaaaacagaggttccagccagtctatatttgtcaagggttttgattcatctcttgaggagagcaagatccgagaatctcttgaaggacattttgctgattgcggagagatcacacgagtctcagttcccatggatcgtgaaactggtgcaagcaaagggatagcatacatagattttaaggatcaggcttccttctcgaaggcacttgaactaagtgggtctgaccttggtggctacaacctgtatgttgatgaagccaagcctaaaggagatagccgagatggtggtgggagaagaggtggccgatctggtgacagatttggcggccgatctggtgacaggtttggcggccgatctggtggtaggtttggaggtagagatggtggcagaagaggtggacgtggtggcagagatggtggcagaagaggcggacgtggcggttttcagagcaggcagagtgctggtacagctagtacaggaaagaagacaacttttggagatgagtaatggagcttgatcttgcacagctacatgcctacatcttatgcagctgtcaaaaggactgcctacctgcaactgtagtgaaatgcgatgagttctactcccatggtttactctatattgccgccgaatggctgtaccagtgaacaagttactgtgctggtatttttgtctgcagttttggtgtgtttccggtgattgtactggacatctagcgattagtgtaatgcaaggatttcctattacattgttatacatcaagtatttgcttcc

SEQ ID NO: 19577 - protein, 572 aa, Oryza sativa
MGKASKKSVAVAVAPAAVPAKGKGGKKREAEDEIEKAVSAKKQKAAAAPPAKAVPAPKADAKKAKKQPPPKKAASSSSGSSSEEDSSESEEEVKVQVKKTTKPVKQESSSDESSDESSDDEDAKPADPVANNGLKKGKPASSDSESDSDDEMDEDEKPAAPVKKTSVTAQKKKDDSDSSESESDESDSDEDVPTKSKAPAVAAKNDDSTDGSESESDSEDEDAAPKGAAKKESSSDEEDDSSEESSDDEPKQPQQKKAQEESSEESSEEDSDEEDEKLAKTPKKKTPAATKSQNDEPKTPASNQSQGTESATLFMGNLSFNLNQDQVKEFFQEVGEVISVRLATHEDGSSRGFGHVQFASSEEAKKALELHGCDLDGRPVRLDLAHERGAYTPHSRNDTGSFQKQNRGSSQSIFVKGFDSSLEESKIRESLEGHFADCGEITRVSVPMDRETGASKGIAYIDFKDQASFSKALELSGSDLGGYNLYVDEAKPKGDSRDGGGRRGGRSGDRFGGRSGDRFGGRSGGRFGGRDGGRRGGRGGRDGGRRGGRGGFQSRQSAGTASTGKKTTFGDE

SEQ ID NO: 19578 - DNA, 1399 bp, Oryza sativa
  CDS (19)..(1107)
agctagcgcgcggcgtccatggggaaggcggaggcgaggtccagggagcacggcgggggcggaggaggaggcagcggcagcgcggggaagatcttcgtcggtggactgccccgtgacaccacggaagcggattttgtgaagcattttggccagtatggagaaatagttgattcagtgataatgagggataagcacacatctcagccaaggggctttggctttattacatattctaaccctgccgttgtggatagagtgatggatgatatccatgaattcaatggaaagcaagttgaaatcaagagaaccattccaaaagattctgtgcaatcaaaggatttcaaaactaaaaagatatttgttggtgggcttcctcaagcactgacagaagatgatttcaagcatttcttccagaaatatggccctgtggtggaccatcagattatgcgtgatcatcaaaccaagcgttcacgaggctttggatttatagtttttagttctgatcaggttgtagatgatttattagcaaatggaaatatgattgatcttgctggtgcaaaggtggagatcaagaaagcagaaccaaagaaatcctcaaatccaccaccatcatcacatggtagtgcctctagatcagcatatggtagggattctaggggtcattcttctggcaatgactatggtggactggccaatgcttatagcaactacaacagtggtggatttgggccttataggaaccatggagtttatggtggtggtagtctcagtggttatggtgggataggtgaatatggtgttcagtatggccgttactatccaggattaggaggatctggtagcatgccttcttttggttatgctagtcgtgttgggccgtatggaggaggttttgatggaccttacgctggtgggaacttaagtggatacaggcgtggtggtgatgagagctttggtggcctcagtagttctagctttggtggcgctatgtatggcggcgcagcatatgatcccgcactaggtggttatgcatctggtagcacacctgaaagaagcaggggaaatttggctggtggttcaggccggtacaatccatatggacgatagagatgcccttgaaggattcgacccatgataatattctcagcaatcttacttcctcattgccttcttttagcttcttatatggtgggcatcttagcaatgctagtacccttattagattgagcgtgtgcacaagtaatttattctgtacatgtttgctagttctcctgagcttaaagctttaatcggtaccatgtagtgatcagactagatgttgtaatgatggttttgtttgggatgaacggaattctggtgttgttagttttatatcatctacgaagtaagtttaagctgc

SEQ ID NO: 19579 - protein, 362 aa, Oryza sativa
MGKAEARSREHGGGGGGGSGSAGKIFVGGLPRDTTEADFVKHFGQYGEIVDSVIMRDKHTSQPRGFGFITYSNPAVVDRVMDDIHEFNGKQVEIKRTIPKDSVQSKDFKTKKIFVGGLPQALTEDDFKHFFQKYGPVVDHQIMRDHQTKRSRGFGFIVFSSDQVVDDLLANGNMIDLAGAKVEIKKAEPKKSSNPPPSSHGSASRSAYGRDSRGHSSGNDYGGLANAYSNYNSGGFGPYRNHGVYGGGSLSGYGGIGEYGVQYGRYYPGLGGSGSMPSFGYASRVGPYGGGFDGPYAGGNLSGYRRGGDESFGGLSSSSFGGAMYGGAAYDPALGGYASGSTPERSRGNLAGGSGRYNPYGR

SEQ ID NO: 19580 - DNA, 1191 bp, Ashbya gossypii
  CDS (1)..(1191)
atggctaaggctacaagcgctaagaaggtttccaagaaggagatgaagaagaaggaggaggcggcagccgctgccgctgctgcctcgtcgagctcgtcgagcagttcgtctgagtccgagagtggatcgagcgacgagtccagcgacgagtccagcgacagctctagcgacaacagctcttcttccaactctagcagcgactctagctccagcgacagcagcgactctgagtccagctctagcagcgactctgacagctctgacagcgaggaggagaccaagaacagcacatcgtcgtcgtcatcctcggattccgaggctgaggagaaggagaagtctgctagcagcaaatcatcgagtagctccagcagcgagtcatcctccgacagcgagtcgtctgcgtccgacaacgagggctccaaggaagagtccaagaagcgctctgcggagtctgaggacgacgctgtggccaagaagcagaagacggacggtcagcccgctacgatctttgtcggcagactctcgtggtccgtggacgacgagtggctgaagaccgagttcgaccacatcggcggtgtagtcggcgctcgtgtcatctacgagcgcggtaccgacaagtcgcgcggctacggctacgtcgactttgaggacgtctcttacgcagagaaggccgtcaaggaaatgcacggtaaggagattgacggcagagctatcaactgtgacatgtccacctccaagcccgcctctgcgcctcgcgaggaccgtgccaagaagtacggcgacaccccatcgcagccttctgacacacttttcctcggcaacttgtccttcaacgccgaccgcgatgcgctcttcgagcttttcagcaagcacggtaatgtcatcagcgtccgtatccctacccacccagagtctaaccagccaaagggcttcggctacgtccagtacggctccgtcgaggaggcccaggccgctctcgacgccttgcagggcgagtacatcgacaacagacccgttagaatcgacttctcgtctcctagacctcctcagcagggcggtgcaacccgcggccgtggcggcttccgtggcggcagaggcggcggcagaaccggatctggcgccaacaatgcccctcttggcaagccgcgccagtctgctgcattcaaaggcaccaagaagacgttcgactga

SEQ ID NO: 19581 - protein, 396 aa, Ashbya gossypii
MAKATSAKKVSKKEMKKKEEAAAAAAAASSSSSSSSSESESGSSDESSDESSDSSSDNSSSSNSSSDSSSSDSSDSESSSSSDSDSSDSEEETKNSTSSSSSSDSEAEEKEKSASSKSSSSSSSESSSDSESSASDNEGSKEESKKRSAESEDDAVAKKQKTDGQPATIFVGRLSWSVDDEWLKTEFDHIGGVVGARVIYERGTDKSRGYGYVDFEDVSYAEKAVKEMHGKEIDGRAINCDMSTSKPASAPREDRAKKYGDTPSQPSDTLFLGNLSFNADRDALFELFSKHGNVISVRIPTHPESNQPKGFGYVQYGSVEEAQAALDALQGEYIDNRPVRIDFSSPRPPQQGGATRGRGGFRGGRGGGRTGSGANNAPLGKPRQSAAFKGTKKTFD

SEQ ID NO: 19582 - DNA, 1581 bp, Ashbya gossypii
  CDS (1)..(1581)
atgagtttttcggacgaagaagattttgacgacatctatggagacgataacaagcagaactccgagactgctgttgccgctggcaagcggaaggcggacggggaggccggggcaggcccgacgtcaaaggaggaggctgcgcgcggtgcagacaattccggggcgtctgcggcagagaccacgaccacgcctgcttcttggttagatcagttggctgcgctccaagtactatcatccaatttgaatcagttacagcaatctacaaataataattcaaataataatactaattcttctgatagcacaagtaatgattctaataaaggtaatgtcccagatcagatgcttgccagagggatgcctgatctctcccagttgcagcagttgcagcagacgatgaaccagctccagcaacaggctgcgccgctaacgcagcagcagcagcaagaggcaaagcaggtgaaggcggacctttcccgtgatatcaacaagatgttcattggcggtttgaattgggagaccactgaggataacctacgggaatacttttccaagtatggcaacgtaacggaggtgaagatcatgagagatggcactaccggtaggtcgcgcggtttcggctttctgtctttcgcggacgcatcgagtgttgatgaggtcgtgaagacccagcatatcttggacggcaaggtcattgatccaaaagagagcgatcccacgggaagagcaagaaaagcgggtaagatttttgtcgccggcatcggtcctgacgtgaggcctaaagagttcgaggaatttttctcccagtggggatcaattattgatgctcagcttatgttagacaaggacactggtaggtccagggggtttggctttatcacgtacgattctccagatgccgtggaccgcgtgtgccaaaataagtttattgagttcaagggcaaacgtattgaaatcaagagagctgagcctcgtcaggtgcagaagcagaggaccacgaatgcctcccccacggggcagccattttccttgaatacttctcaagctcctcagcctccacagcagcagttccaaatgatggctaatccgatgatggccaatcccctgtttaacccacaggcgatggcggactactatgcaaagatgcaagaatactaccaacaatctggtatcgattatagtcaaatgtaccagcagcagatgcagcagatgcagcaaatgatgtcgatgatgactggtggaaacgcgcctgccggaggcatgcccgcgggtgctaatggcgccggcggcaatggcgatgacactaacggggtaccaaccattggtgaagattcatcctctacttcttccggaaaggacaacaatgataaggaatcatcaaacaaccgccatgattcttatgggaatagagatcgggaaaggtctcctgatgctcgtagaggccataggaattacaacgacagagaagaaggcggacatggtttccgccgtgaaaatcgggatcgtgggttccgcggtcgtgaacgtcgtggtggaggatacggcagagatagacgtggctaccacccatattctaggtga

SEQ ID NO: 19583 - protein, 526 aa, Ashbya gossypii
MSFSDEEDFDDIYGDDNKQNSETAVAAGKRKADGEAGAGPTSKEEAARGADNSGASAAETTTTPASWLDQLAALQVLSSNLNQLQQSTNNNSNNNTNSSDSTSNDSNKGNVPDQMLARGMPDLSQLQQLQQTMNQLQQQAAPLTQQQQQEAKQVKADLSRDINKMFIGGLNWETTEDNLREYFSKYGNVTEVKIMRDGTTGRSRGFGFLSFADASSVDEVVKTQHILDGKVIDPKESDPTGRARKAGKIFVAGIGPDVRPKEFEEFFSQWGSIIDAQLMLDKDTGRSRGFGFITYDSPDAVDRVCQNKFIEFKGKRIEIKRAEPRQVQKQRTTNASPTGQPFSLNTSQAPQPPQQQFQMMANPMMANPLFNPQAMADYYAKMQEYYQQSGIDYSQMYQQQMQQMQQMMSMMTGGNAPAGGMPAGANGAGGNGDDTNGVPTIGEDSSSTSSGKDNNDKESSNNRHDSYGNRDRERSPDARRGHRNYNDREEGGHGFRRENRDRGFRGRERRGGGYGRDRRGYHPYSR

SEQ ID NO: 19584 - DNA, 900 bp, Dictyostelium discoideum
  CDS (1)..(900)
atggccaaagatcaaaaagctatcgaaagtaaaaaaagaaagaaggaagaatctgaatcagaaactgagtcaagtgaggaaaacaatgcttcatcatcttcagaatcagaatcagaagatgaattaaaagttgttggtgaaggttcatcctcatcaaagagcacttttaccaaaaaggaatcagctgccaaagatgaatcaagcaataccaaaactgatgatgacttaaaagtatttgttggtcaattaccatcaggtgttactgaatacgacttaaaggaatacttctctgaatgtggtgacatttcaaacattaaaatcttaaatagtaacccacaaagagttgccgctttcatcacttttgccgatgaaaagggtagagatactgccatcacatacaacggtaaagacttcaacggtcaaggtagtctcagaatcaatggtgccaatagcaagccatccgacggtgaaggtgaaccaaccacaatcgtctgtagaaatattgcattcactgtcgatgaaaccctcgttaaagaattcttctctaaatgtggttccatcagtcgtgtctccttaccagtctatgaagattctggtagattaaagggtttcgcctttgtcagcttcgactctgaagatgccgttgaaaaagctattgcactcactggtactaaattcgaaggtcgtgaaattcaagttgaaagaagtcaacgtggtggtggtagatcatcatcattcggtcgtggtggcggtcgtggtggtttcggcggcggtcgtggtggtcgtggtggttttggtaacggcggtggtcgtggtggtttcggtggtggtcgtggaggcggtcgtggtggtagcggtggtcgtggtggtttcggtaacaaacgtggtagattcgaataa

SEQ ID NO: 19585 - protein, 299 aa, Dictyostelium discoideum
MAKDQKAIESKKRKKEESESETESSEENNASSSSESESEDELKVVGEGSSSSKSTFTKKESAAKDESSNTKTDDDLKVFVGQLPSGVTEYDLKEYFSECGDISNIKILNSNPQRVAAFITFADEKGRDTAITYNGKDFNGQGSLRINGANSKPSDGEGEPTTIVCRNIAFTVDETLVKEFFSKCGSISRVSLPVYEDSGRLKGFAFVSFDSEDAVEKAIALTGTKFEGREIQVERSQRGGGRSSSFGRGGGRGGFGGGRGGRGGFGNGGGRGGFGGGRGGGRGGSGGRGGFGNKRGRFE

SEQ ID NO: 19586 - DNA, 876 bp, Oryza sativa
  CDS (1)..(876)
atgctggaagagaggaagctgttcgtggcgggcctcccgcagcagacgcgggagggcgacctgcggggccacttcgcccggtacggcgaggtggtgcacacccgggtggtgctcgacatggccagcggcaacagccgcggcttcggcttcgtggagttcgccgacgaggcggcgacgctgagggcgctcgccgacgacgagatgcccaaccacgtcttccgtggccgcaaggttgatgttaagagagccgagcgtagacatgatcataagcaaaccagtccatctattaagaaccaaaacgacagcgtgcagaaaaatcaatttatttttcaaaagaaggtctttgttggtggtttgcacgaaactgttacagtgaaggacctcataagttattttgagaaatttggcaccataacggatgctgtggtcatgcgtaatagaactacaaatagagcaaggggatttggtttcatatcttttgattcacatgaagctgtgtgcaagatactactaaataggttccataatttaaatggaagggatgtcgaagttaaaattgccgtcccaaagagtccaacctactcagaggcaaaatattatcacatgagaatggatatgagtttaagtcctatcacttattatgatggaatggtccatgtccatccatacacaccatacacatttggctgtgttacacctcttgctcacttaactcattcaggttatggttatggaggacctattgattattcatgttatgcttatggaggaccaattggacatcagcatgatcttgtgggttcttactattatgctaaagattatagcaaaactactcctatcgacctcgataccacagataccacaaagaaatga

SEQ ID NO: 19587 - protein, 291 aa, Oryza sativa
MLEERKLFVAGLPQQTREGDLRGHFARYGEVVHTRVVLDMASGNSRGFGFVEFADEAATLRALADDEMPNHVFRGRKVDVKRAERRHDHKQTSPSIKNQNDSVQKNQFIFQKKVFVGGLHETVTVKDLISYFEKFGTITDAVVMRNRTTNRARGFGFISFDSHEAVCKILLNRFHNLNGRDVEVKIAVPKSPTYSEAKYYHMRMDMSLSPITYYDGMVHVHPYTPYTFGCVTPLAHLTHSGYGYGGPIDYSCYAYGGPIGHQHDLVGSYYYAKDYSKTTPIDLDTTDTTKK

SEQ ID NO: 19588 - DNA, 1191 bp, Plasmodium yoelii yoelii
  CDS (1)..(1191)
atgacttcaaatgatataataaatgaatcaaatgataatgatgcattctcaaaaataaaagaaaataaaaatgaagaaactgtgaaaaaagtaatagacaatatttctctcgaaaatgaaagtgacaacaattgtgaaaacagagaaaaacgagaacgaagtttatctaacggttcttataggcgtggaaaaaaaaaaatgtgttgttgtcatgaaaaaagcatgtcaaaatgctccaccaaaaatgataaaagtagttcatcatctaggagtaaaaatgcggacactctaagtactggtaatgcaaaaattagaaagataaaaattgttggaaaagtaaaaattgttggaaaaataaaaattagaaaaataaaaattgttggcaacatatctgaacttatgcttacacatttagcttcaacaggaattattgaatatggaagtaactcaaaaaatataaatgaaccatttaaatttttcattggaggaattccacaaaatattacaaataaatatataaccgaatattttgaaaaatatggatctgtgcaaaatgtagttatcgcacaagatcacgagacaaaaaggaacagagggtttgcctttgtaaccatgtcatctcatataaataaagataaaatattaatggattctcacgaattgaatgggaaacgagtggatgttcgtgaggaacacaatacgacaccctcagatattcaaagaaaaatatttgtaggggggttaagctactattggactaaagatactttggaaaggcataaacaattaaaaaataaaataaataaatatatatatatttatttttcggcatttggagaaatagatatagtacaaattgttgtagattctagtggtagatctcgatgttttggttttgtagttttcacaaatgaatcatcagttgcaaaagttctcaagcacaaaaggcataaaatttatgataaaatggttgaagttagaaaagccgaacctaagaagccaaaaatgtctataaaacgacaaaataataaaagtcattccaaatattcccacccgcctccttttatgggtcctttcccttataataaagaaagtatgactcagtttcaaaacgttccagatttttattctaactataattattatccaaattcgattgaaaatatgcaacaaccggattataacaattaa

SEQ ID NO: 19589 - protein, 396 aa, Plasmodium yoelii yoelii
MTSNDIINESNDNDAFSKIKENKNEETVKKVIDNISLENESDNNCENREKRERSLSNGSYRRGKKKMCCCHEKSMSKCSTKNDKSSSSSRSKNADTLSTGNAKIRKIKIVGKVKIVGKIKIRKIKIVGNISELMLTHLASTGIIEYGSNSKNINEPFKFFIGGIPQNITNKYITEYFEKYGSVQNVVIAQDHETKRNRGFAFVTMSSHINKDKILMDSHELNGKRVDVREEHNTTPSDIQRKIFVGGLSYYWTKDTLERHKQLKNKINKYIYIYFSAFGEIDIVQIVVDSSGRSRCFGFVVFTNESSVAKVLKHKRHKIYDKMVEVRKAEPKKPKMSIKRQNNKSHSKYSHPPPFMGPFPYNKESMTQFQNVPDFYSNYNYYPNSIENMQQPDYNN

SEQ ID NO: 19590 - DNA, 1287 bp, Neurospora crassa
  CDS (1)..(1287)
atgggcaagaaggattccgtcaaggccaccaaggccaccaaggtcgccaaggccgagcccgtcaaggctgctaagcccgtcaaggccaccaaggctgagaagccctccaagaagtccaagaaggaggagtcctcttccgaggaggaggagtccgagtctgagtcttctgaggaggagtccagcgaggatgagtccagcgatgagtcttccgatgaggagatgaccgacgctcctgccgccaaggagaccaagaaggccgagtcttccgactctgactccgattctgactctgacgactccgagtctgaggagacttccgaggaggagaagcccgccgtcaaggaggagaagaaggagagctccgatgatgaggagagcgactccgacaactccgattccgactctgactctgactcttccgagtccgaggagaagtctgagtccgaggagccttccaagaagcgcaaggctgaggagtcctccgaggaggaggaggctcccaagaaggccaagactgaggaggttgccgacgacaagagcaccctctgggttggtaacctcggctggggtatcgatgatgctatcctcttggctgagttcgaggactgcgagggtgctaagagcgctcgcgtcgtcactgaccgtgagtctggccgctcgcgcggtttcggctacgtcgactttgccaccaacgagcaggcgcagaaggcttatgatgccaagagcggtgctcttcttgagggccgtgagatgcgtctcgacttcgctgccaaggatgccggcaacaagccccaagacaaggccgccaaccgcgctgccaagcacggtgacaccatctctcccgagtccgacaccctcttcgtcggtaacatgcccttctccgccgacgagtctgtcgtctccgacttcttcaactccgtcgcttccgttgccagcctccgtatccctactgaccaggagtccggccgccccaagggcttcgcctatgttaccttcaactccgttgaggatgccaagaacgctttcgagcaactgaacggctccgacctcaatggccgtcccgtccgtctcgactacgccaagccccgtgacaacaacggtggcggtggtggcttcggcggcggccgcggtggtggccgtggcggtggccgtggtggtttcggtggccgtggtggtggccgtggtggccgtggtgacttcggtggccgtggcggtggccgcggtggcggacggggtggtttcggtggcagccgtggtggcttccagggcaagaagaccaccttctaa

SEQ ID NO: 19591 - protein, 428 aa, Neurospora crassa
MGKKDSVKATKATKVAKAEPVKAAKPVKATKAEKPSKKSKKEESSSEEEESESESSEEESSEDESSDESSDEEMTDAPAAKETKKAESSDSDSDSDSDDSESEETSEEEKPAVKEEKKESSDDEESDSDNSDSDSDSDSSESEEKSESEEPSKKRKAEESSEEEEAPKKAKTEEVADDKSTLWVGNLGWGIDDAILLAEFEDCEGAKSARVVTDRESGRSRGFGYVDFATNEQAQKAYDAKSGALLEGREMRLDFAAKDAGNKPQDKAANRAAKHGDTISPESDTLFVGNMPFSADESVVSDFFNSVASVASLRIPTDQESGRPKGFAYVTFNSVEDAKNAFEQLNGSDLNGRPVRLDYAKPRDNNGGGGGFGGGRGGGRGGGRGGFGGRGGGRGGRGDFGGRGGGRGGGRGGFGGSRGGFQGKKTTF

SEQ ID NO: 19592 - DNA, 2447 bp, Oryza sativa
  CDS (143)..(2266)
gattacctccccgcccgcgcacctcgagcccccaggtccgcctcgcctctccgtcgcttgccgccgcccgcagtggtcgccggccgcgcggggcttcgccggtgtcgcttcctcgtttggaattaattaagcaatacttaatatgggcaagtcaagcaagaaatctgctgttgaagttgcacctacctctgtctcagtctcagaggggaaatctgggaagaagggaaagagaaatgcagaagatgagattgagaaagctgtgagtgccaagaaacaaaagactgtacgtgagaaggttgtgccctcaaaggaggaagccaaaaaagtgaagaagcagcccccaccgaagaaggttgagagcagcagttctgaggaggattcttcagaatctgaagaggaggtaaaggcccaaccaaagaagactgtccaaccgaagaaggctgcacaacctgctaaagaggagtcaagtgatgatagcagtgatgatagctcctcagatgatgagcctgcaaaaaaacctgttgctcgtccaaataaggctgcactttctaccaacagtagcagcagtgatgatagcagtgatgagagtttatcagatgatgaacctgtgaaaaagcctgctgcccctttgaagaagccagttgcacttgctaccaatggatcaaaaaaggttgagacagacagcagcagctctgatagcagctctgatgaggagtctgatgaggatgataaaaaaactgctgctccagtgaagaaaccttcagttgctgctatacaaaagaagacccaggagtctgacagttctgatagtgactctgattctgaatcagatgaggatgtgccgactaaagcaccagcagtagccaagaaaaaggaagaatccagtgaaagctctgattctgaaagtgattcagactctgatgatgaggctgctgctgttaaaaaggaagaagaatccagtgatagctcagacagtgactctgaatctgagtctgattctgatgaaccagcaaaacctactattcctgcaaaaaggccactgacaaaagacacaaagaagggacaatccaaggatgaatctgaagatagttctgatgagagttctgaggaaagtggtgatgaacctccgcaaaagaagattaaggattctacaacttctggtactaccaagccttcccctaaggctaccaagaaagaaatcagcagtgatgacgaaagtgatgaagatgacagttctgatgaaagctctgatgaggatgttaagcaaaaacaaactcaagctaagaagcaagcaccagtagcacaagagagtagcagctccgatgaatcttctgaagaagatagtgacatggaaagtgatgaaccagcaaaaactccccaaaagaaggaaactgctgtgtctgttggttcgaataagtctgcgacaaaaccgggacaagaggaaccaaaaacgcctgccagcaaccaaaatcaagctaccgggtcaaagactctttttgttggaaatttaccatacaatgtggagcaagaacaagtgaagcaatttttccaggaggcaggtgaagttgttgatattcgtttcagtacctttgaagatgggaacttcaggggctttggacatgttgaatttgccacagcggaagctgctaagaaggcacttgaacttgctggtcatgacctgatgggacggccggtcaggcttgacctggctcgtgagagaggcgcgtatactcctggcagcgggagggacaatagttctttcaagaagcctgctcaaagctcaggaaacactatatttattaaaggctttgatacttctcttgacatacaccagatccggaattcacttgaagaacattttggctcgtgtggagagattacacgggtttcaattccaaaggattatgaaaccggtgcaagcaaagggatggcgtacatggattttgcggacaacggttccttgtcgaaagcatacgaactgaatggatctgacctcggtggatacagcttgtatgttgatgaagcgaggcctaggcccgataacaacagagagggtggcttcagcggtggaagagactttaacagcagtgggagaggaggaagacgtggtggacgtggtgatggtagccgtggacgcggtgaccgtggacgtggtagaggctttggtaggggtgacaggggccatggtggacggggtacaccgttcaagcagagcgctggtacacctagtgcaggaaagaagacaacattcggtgacgacgactagacgaacaatttgagccgattttgttctagtactgtagtaatctccatcccccctaatatatgcgattctagtgagccgtgaattggctacctccggactgttacattctagccgtgttatgtactttgttggcagttgggaccgtgttggtaaatttgcccgacagatttggcaattttgg

SEQ ID NO: 19593 - protein, 707 aa, Oryza sativa
MGKSSKKSAVEVAPTSVSVSEGKSGKKGKRNAEDEIEKAVSAKKQKTVREKVVPSKEEAKKVKKQPPPKKVESSSSEEDSSESEEEVKAQPKKTVQPKKAAQPAKEESSDDSSDDSSSDDEPAKKPVARPNKAALSTNSSSSDDSSDESLSDDEPVKKPAAPLKKPVALATNGSKKVETDSSSSDSSSDEESDEDDKKTAAPVKKPSVAAIQKKTQESDSSDSDSDSESDEDVPTKAPAVAKKKEESSESSDSESDSDSDDEAAAVKKEEESSDSSDSDSESESDSDEPAKPTIPAKRPLTKDTKKGQSKDESEDSSDESSEESGDEPPQKKIKDSTTSGTTKPSPKATKKEISSDDESDEDDSSDESSDEDVKQKQTQAKKQAPVAQESSSSDESSEEDSDMESDEPAKTPQKKETAVSVGSNKSATKPGQEEPKTPASNQNQATGSKTLFVGNLPYNVEQEQVKQFFQEAGEVVDIRFSTFEDGNFRGFGHVEFATAEAAKKALELAGHDLMGRPVRLDLARERGAYTPGSGRDNSSFKKPAQSSGNTIFIKGFDTSLDIHQIRNSLEEHFGSCGEITRVSIPKDYETGASKGMAYMDFADNGSLSKAYELNGSDLGGYSLYVDEARPRPDNNREGGFSGGRDFNSSGRGGRRGGRGDGSRGRGDRGRGRGFGRGDRGHGGRGTPFKQSAGTPSAGKKTTFGDDD

SEQ ID NO: 19594 - DNA, 1363 bp, Saccoglossus kowalevskii
  CDS (76)..(1260)
ccgtaccgtacccacgtgtcgccgttagctcctctgcactccttcttttttagcgggctttagtagctgtagaaaatggaggccgaaagccagcaaacctcctcaggaacctcaaacgagatcccgaatgaccccgggaaaatgttcatcggaggtttaagctggcagactacaccagatggccttagagagtattttagtaagtttggcgaggtaactgaatgtatggtgatgcgagaccaagctacaaaacgttctagaggatttggttttattacgttcagggatcccgccagcgtagagaaggtgttagcacaggcagcgcacgagttagaccaaaagaagattgaccccaaagtggcttttcctaagaggtctcaccctaaggtcacaagaacaaagaagatattcgttggggggttatcggcaaacacaacagctgacgacatcaagaaccacttttctcaatatggaaaggtagaagaagcacagctcatgtttgataaacagactaacaggcatagaggatttggatttgtaacttttgacagtgaagacgtagttgataaaatatgcgagatacacttccatgaagtcaacagcaaaatggtggaatgcaagaaagctcaacccaaggaagtgatgttccagggagcactagcacgtgacccaacatattttgcagtgtaccctcccaactttgctgcctatgggcgtggctttcctggatatgctcctggatttgcatatccattccctggattccctggttatggctatatgcctcagcctgcacctctaccccctccgacagtgggtggtgatcggcgtactcctggcgcacctccctactcctacgcagattatggctctgctggtccagctcctgcagcaggagctgtgttaactcgtggcacagtgcccagaacagaggcctctgctatgcatcagcatgactatgggcgggagtaccaacatgcagtgataaacagctatcagagttttggccctccagcctcaccagccagcagcagggcctatcaccctgctaacagcactagccctggacccattgatatctactcaggcagtcagggagagagtgcaggaggctacttgcaggctgctagcccgcagccatctggttttggaccttctattgcagccgtcagctcgcctgcatctagcctcctctgctatcacccagacatgctaaagggccccctgtttgcatcgacttttcataatggctatccctgatctgcttggcatcctaaataagaggctggttttagcagtagtatcggctatggagcaatccaggaaggaaattctactttaggaactgctatttcttttacac

SEQ ID NO: 19595 - protein, 394 aa, Saccoglossus kowalevskii
MEAESQQTSSGTSNEIPNDPGKMFIGGLSWQTTPDGLREYFSKFGEVTECMVMRDQATKRSRGFGFITFRDPASVEKVLAQAAHELDQKKIDPKVAFPKRSHPKVTRTKKIFVGGLSANTTADDIKNHFSQYGKVEEAQLMFDKQTNRHRGFGFVTFDSEDVVDKICEIHFHEVNSKMVECKKAQPKEVMFQGALARDPTYFAVYPPNFAAYGRGFPGYAPGFAYPFPGFPGYGYMPQPAPLPPPTVGGDRRTPGAPPYSYADYGSAGPAPAAGAVLTRGTVPRTEASAMHQHDYGREYQHAVINSYQSFGPPASPASSRAYHPANSTSPGPIDIYSGSQGESAGGYLQAASPQPSGFGPSIAAVSSPASSLLCYHPDMLKGPLFASTFHNGYP

SEQ ID NO: 19596 - DNA, 936 bp, Mus musculus
  CDS (1)..(936)
atgtcggacgcggctgaggagcagcccatggagacgacgggcgccaccgagaacggacacgaggccgcccccgaaggcgaggccccggtcgagcccagcgcggctgccgcggcccccgcggcctcggccgggtctgggggcgggaccacgaccgcaccgagcgggaaccagaacggcgcggagggcgaccagatcaacgccagcaagaacgaggaggacgcgggaaaaatgttcgttggtggtctgagctgggataccagcaaaaaagacttaaaggattattttactaagtttggagaggttgttgactgtacaataaaaatggatcccaacactggacgatcaagagggtttgggtttattctcttcaaagattcttctagtgtggaaaaggtcttagatcagaaggagcacaggctggatggtcgtgtcattgaccctaaaaaggctatggctatgaagaaggaccctgtgaagaaaatctttgtgggaggtctaaaccctgaagccacagaggaaaagatcagagaatacttcggccagtttggggagattgaggccattgagcttccaatagatcccaagttgaacaaaagacggggttttgtttttattacatttaaagaggaagatcctgtgaagaaagttctggagaagaaatttcatactgtcagtggaagcaagtgtgaaatcaaggttgcccagcccaaagaggtgtatcagcaacagcagtatggctctgggggcagaggaaatcgcaatcgagggaaccgaggcagtggtggaggtcagagtcagagttggaatcagggctacggcaactactggaaccagggctacggctaccagcagggctacgggccgggctatggcggctacgactactcgccctatggctattacggctacggccccggctacgactacagtaagtag

SEQ ID NO: 19597 - protein, 311 aa, Mus musculus
MSDAAEEQPMETTGATENGHEAAPEGEAPVEPSAAAAAPAASAGSGGGTTTAPSGNQNGAEGDQINASKNEEDAGKMFVGGLSWDTSKKDLKDYFTKFGEVVDCTIKMDPNTGRSRGFGFILFKDSSSVEKVLDQKEHRLDGRVIDPKKAMAMKKDPVKKIFVGGLNPEATEEKIREYFGQFGEIEAIELPIDPKLNKRRGFVFITFKEEDPVKKVLEKKFHTVSGSKCEIKVAQPKEVYQQQQYGSGGRGNRNRGNRGSGGGQSQSWNQGYGNYWNQGYGYQQGYGPGYGGYDYSPYGYYGYGPGYDYSK

SEQ ID NO: 19598 - DNA, 1454 bp, Oryza sativa
  CDS (75)..(1208)
gcgtccgccgctcccaccaccctcgtctctcccctccacttcgcgagacctccaaaaccctagtttcgtcggcgatggcggcggcggcggcggcgggggcggcggcgggtggggggttcgttggggagaggaggaagctgttcgtgggagggatcccgacgtcggcgcaggaggcggagctgcggggccacttcgggcagtacggggcggtgaggtcggtgatcgtgatgcgggacaaggagaccgggcatggccgggggttcgggttcgtggagttcgaggaggaggaggacgccgccagggcgctcggcgacggggagcaccccaggcacctcatctgcggccgcgtcgttgatgtcaagagggctagggcaaggcctcaacgaaaccatgatgatcaatcttcacagcatcagcacttcggacagggtcaggatcagggtcaccagccagcacctgtgagtggtacagaggatggcggcgacggcatgaactatgcttcgaagaaggtctttattggtggtctgcgggacaacatcactgaggaggagttcaagacatatttcgagagttttggcaccgtaacagatgtggtagtcatatatgacagtatgacaaacaggtctagggggtttggtttcgtcacctttgactcagaggaagcggtgaggaaggtgatagaacacagttttcatgacttgaaaggaacaagggtagaagccaagattgccatccccaaggatgcttcgtattaccgtaatggcagaggtcgtggctcaagaaactttggtggaaggggtcatgctggttttgatggtccctcgtaccaaccatacaatgacagatatggtttctacaacagctataatatgcctcaacctgttccaccacatccctactatcctggtgtatattatggtatgggaggaggttatccctatgcgaatgcatattcaaacatgggagcccctgctaatattcctccaggcatgatgacaaggcgtccagtttatggtgcatatcctccaatgtttccagggtacggcgttatatatagaggttatgtgggtgctgcaccctctattcagcatgatagtaatggtgggagcgatagcaaaaaggatcaaacttcagtagatgtacaagaagttgacagtgctgcttccgttgcaacaaaacttgagtttatgaagctagggtcacaatgactttctggacaaattacttctaaattgatgacaccagagttcgacattttgggaaccctcaattgtgaagacttgagctgagattctttggttgacaagtacatcattggaattcaacttacccaccctcattccttgcttcatctgcctgtacactgaaaacgtgcaagttgacctcactgcttcttgtaccgatgtttaaattctttgttgatttaatgtaccaggatcagaacatccaatcct

SEQ ID NO: 19599 - protein, 377 aa, Oryza sativa
MAAAAAAGAAAGGGFVGERRKLFVGGIPTSAQEAELRGHFGQYGAVRSVIVMRDKETGHGRGFGFVEFEEEEDAARALGDGEHPRHLICGRVVDVKRARARPQRNHDDQSSQHQHFGQGQDQGHQPAPVSGTEDGGDGMNYASKKVFIGGLRDNITEEEFKTYFESFGTVTDVVVIYDSMTNRSRGFGFVTFDSEEAVRKVIEHSFHDLKGTRVEAKIAIPKDASYYRNGRGRGSRNFGGRGHAGFDGPSYQPYNDRYGFYNSYNMPQPVPPHPYYPGVYYGMGGGYPYANAYSNMGAPANIPPGMMTRRPVYGAYPPMFPGYGVIYRGYVGAAPSIQHDSNGGSDSKKDQTSVDVQEVDSAASVATKLEFMKLGSQ

SEQ ID NO: 19600 - DNA, 2469 bp, Oryza sativa
  CDS (473)..(1891)
ggtccattatttataccatttccgcgtccccccaccctcctcccccgctttcccaatcgaggcgagcaccgcaattgcagggttccggaggccgaataaaaaagtttggcctctccccgcaaaaaagtaaaaaacccaaaacaaccatccaccagcgcatcgcggcaccgcgagcgagcgagcggagggagggaggtggagagcaaaagttcgataaaaggagaggaggagacgaagcgtcgaagcccaagtaacatccccccaacctccgcctcctcctcctccccctcctcccatgcccgcatcgagatcttagccgcgccggagatcgagagggaggagcggcgacgcgggcgcccccgatccctcctcctcgccgccgccgccgccggcggcgccggagcagcagcagccgacgacgacgacgaccgccgcagcagccgatcgggggaggaggggaggggaggacgcgatggaggcggactccgggaagctcttcgtcggcggcatctcgtgggagacggacgaggaccgcctccgcgagtacttcagccggttcggggaggtcaccgaggccgtcatcatgcgggaccgcaacaccggccgcgcccgtgggttcggcttcgtggtcttcaccgacgcaggcgtcgccgagcgggtcaccatggataagcacatgatcgacgggcgcatggtggaagcgaagaaagctgttcccagggacgaccagagcatcaccagcaagaacaatggcagcagcatagggtcacctggaccaggccgtactagaaagatctttgttggaggcttggcctctaatgttactgaggttgaatttagaaggtattttgagcaatttggtgtgattacggatgtggttgtcatgtacgaccacaacacgcagaggcctaggggctttggattcatcacctatgactcagaagatgcggtggacaaggcactgcacaagaacttccatgagctgaatggtaagatggttgaggtcaagagagctgttccaaaggagcaatcacctggacctgctgcacgttcacctgcgggagggcagaactatgctatgagcagggtccatagcttcttgaatggtttcaaccagggttataacccaaaccctattggaggttatggcatgagggttgatggaaggtatggtctgcttacaggcgcacggaatggattctcttcatttggccctggttatggaatgggcatgaattctgaatctgggatgaatgcgaattttggcgccaattctagttttgtcaataactccaatgggcggcagataggttcattctacaatggtagttcaaacagattaggtagtcctattggttatgttggtcttaatgatgattcaggatcactattgagttcaatgtcaaggaatgtttggggtaatgaaaatctgaactacccaaacaaccccacaaacatgagttcttttgcaccatctggaactggaggtcaaatgggtattaccagtgacggtattaattggggagggcctactcctggccatggaatgggcaacatttcaagccttgggctggctaaccttggccgtggagctggagacagttttggcttgccttctggcagctatggaaggagcaatgcaactggtaccattggtgaacccttctctgcaccacccaatgcatatgaagtgaacaatgcagatacatatggcagcagctccatttatggagactcaacttggaggttcacgtcatctgagattgatatgcctccttttggtaatgaccttggaaatgttgatccagatatcaaatcaaacataccagcaagttacatgggcaactatactgttaataataatcagacaagcagaggtatcacttcctagcgagagtactattatattcatatatgacttgggatagatgaaagaagcattatatcaggtattcaggtgcatgactatgaattggtgatatcaggttaatatacgggttagttaattgtttctagctaaccagaggtgtggtttatggacaccaccatgctagaggagcgaatacaaacgttttgtgaaggtttcagattttagtttaattcctacatgtattaggtcttggtttttgaatgagatgtgcagtggtgattgcggcacatacttagagtgttccaacataagctggaatcctgtcatatggacaaacttgtataccaaaggaatgctttattatcttgcccatttatggctacattagctcgcttgttttcattccctttttaaccaattccatttgtatactagagatctgcttgacttactagtgaaactattcggggacgccgatcctatctttgcagttggctcccagaaataaagccaccaaaagtgcatacttatttgttctaccttgatttgccatatgtatatgcttctgttcgttttaaaatagaactttgggtttgatt

SEQ ID NO: 19601 - protein, 472 aa, Oryza sativa
MEADSGKLFVGGISWETDEDRLREYFSRFGEVTEAVIMRDRNTGRARGFGFVVFTDAGVAERVTMDKHMIDGRMVEAKKAVPRDDQSITSKNNGSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPAARSPAGGQNYAMSRVHSFLNGFNQGYNPNPIGGYGMRVDGRYGLLTGARNGFSSFGPGYGMGMNSESGMNANFGANSSFVNNSNGRQIGSFYNGSSNRLGSPIGYVGLNDDSGSLLSSMSRNVWGNENLNYPNNPTNMSSFAPSGTGGQMGITSDGINWGGPTPGHGMGNISSLGLANLGRGAGDSFGLPSGSYGRSNATGTIGEPFSAPPNAYEVNNADTYGSSSIYGDSTWRFTSSEIDMPPFGNDLGNVDPDIKSNIPASYMGNYTVNNNQTSRGITS

SEQ ID NO: 19602 - DNA, 2715 bp, Dictyostelium discoideum
  CDS (1)..(2715)
atgcaaatggatgaaagtgaattattagataaaagtccaaatccatcttcttcgccacaatcattatcatcaccaaaaaaagtattttctccaagtgaaaaaccatacgatactcatgaattaataattaataatgaacaacaaccacaagaagaaataaatcaacaacaaaatgaaaatcaatctctacaaataaataataataataataataataataataataataataataataataataataataataataataataataataataataataataataatagtgttaataataaagaattggaattagaaagagatcaaacaaatgtttttgtaaaacatttaccatatgaatttaatgatgaagatttagagaatttattttcaaaatatggaaaagttttaagttccaaagtaatgattgatccaaaaggaaattcatatggatatggatttgttagattttcaagtccacaagaatctgccgccgcaattgaagaattggatggttaccaataccaaaataaaaaattactatgtagattatccaatctttatacaaatttaaatagtaaatacccatcaaataatttatttattaaaccacttccatatgatgtaacagatgatcaattaaggaaattatttgaaccatttggtaaaattattgaatgtaaagtaatgttggatcataatggacaaagtaaatttgcaggatttgttagattttcaagtgaattggatgcttcaaaggcaatagatgctatgaatggtgttaggattaataaagatagtggttatccattagtagtaaaatacgccgatactgaacaacaaaaaataagtagaaagcaaaggaaaatgcaaactatatatcaagaaaaaataatagcaccaccaatatttccaccacaatttttacaacctacagttttaccaaataataataataataataataataataataataataataataataataataataataataataataataataataataataataataaaatcgcaaatatagttggtattgatcagctcgataaactggatcatcatactcttctccaacaacagcatcaaattttaatcgaccattcccatcaacagcaacaagaacaacaagaacaacaagaacaacaacatattctaatagaccattcccaacaacatccacatttaattaataaccaaaattattatacaaattatatggaatatatgtatttatcatatggagattacccaaacccgaatcatcatcatcatcatcaatactatacaactcaacaaatatatcatcaaccaatttattatcccactgcaaattattatactgatattcatcaccaaattcatccaactcaacatattcaacctcaacaaccccaacaactcctacaatcacaacaattgcaatcacaacaactgcaaccacaacaacttcaacaacaactgcaacagcagcagcaacaacaacaacaactacaacaacaaaatttgaatatagaaattccaaatcaatctattagaacaagtggtggaataaataaaaataattcaaaaaaaaagaaaaagaaacatcaacaagtacaatcacaaacttcacaaaattcaatccaaattgcgtcatcgagcactcctttaaatacatcatcttcttcaactatcacatcatttggttcacctccaaatacttcaataccctcaccaacctctgattctatatcaccattaccatataataaaaataataataataataataataataataataataataataataataataataataataataataataataataataataataataataataataataataataataattataataataataatgtaattataaatacgcaacaaacaacaccaaataaaaggaatagaagtgaaaaaattaaaaataaaaattgtaatataaacgaagtaaataaaaacttttccaaactaaatattgataataataataacaataataataataataataataataataataataataataataataataataataataataataataataataataataataataataataataataataataataataataataataataataataataataataataataataataatttgactacaacaacaacaactaccacaacgacaaatacaacaaatttaacaaatttagaaagtttaaatccattatcggcatcatcatcatcaataacaagtaatagtggtggaggtaaacatacaaatgatacgaatttatttgtatttcatttaccaccatttgtagacgactcttatttatttcagttattttctcaatttggtaaactacaatcagttagagttatcaccgataaagatactggcgaaaataaaggttatggatttgtaaaattttatcaaactgatgaagctttaaaatgccaaaaagaaatgaatggatttagaattggttcaaagttcctaaaagtcaaattaaagaatgaaaaagaaagtatgaattctggaaaatctcaccaccagcaccaaaaccaaaacaaaaaccaaaatgaacaacatttagaagaggaagaagaagaacaaactttcaatttacctgaaaataatattgatggaaatgaaagtaatcaagaaattgttggatctggaaattatacttga

SEQ ID NO: 19603 - protein, 904 aa, Dictyostelium discoideum
MQMDESELLDKSPNPSSSPQSLSSPKKVFSPSEKPYDTHELIINNEQQPQEEINQQQNENQSLQINNNNNNNNNNNNNNNNNNNNNNNNNNNNNNSVNNKELELERDQTNVFVKHLPYEFNDEDLENLFSKYGKVLSSKVMIDPKGNSYGYGFVRFSSPQESAAAIEELDGYQYQNKKLLCRLSNLYTNLNSKYPSNNLFIKPLPYDVTDDQLRKLFEPFGKIIECKVMLDHNGQSKFAGFVRFSSELDASKAIDAMNGVRINKDSGYPLVVKYADTEQQKISRKQRKMQTIYQEKIIAPPIFPPQFLQPTVLPNNNNNNNNNNNNNNNNNNNNNNNNNNNNNKIANIVGIDQLDKLDHHTLLQQQHQILIDHSHQQQQEQQEQQEQQHILIDHSQQHPHLINNQNYYTNYMEYMYLSYGDYPNPNHHHHHQYYTTQQIYHQPIYYPTANYYTDIHHQIHPTQHIQPQQPQQLLQSQQLQSQQLQPQQLQQQLQQQQQQQQQLQQQNLNIEIPNQSIRTSGGINKNNSKKKKKKHQQVQSQTSQNSIQIASSSTPLNTSSSSTITSFGSPPNTSIPSPTSDSISPLPYNKNNNNNNNNNNNNNNNNNNNNNNNNNNNNNNNNNNNNYNNNNVIINTQQTTPNKRNRSEKIKNKNCNINEVNKNFSKLNIDNNNNNNNNNNNNNNNNNNNNNNNNNNNNNNNNNNNNNNNNNNNNNNNNNNNNNNLTTTTTTTTTTNTTNLTNLESLNPLSASSSSITSNSGGGKHTNDTNLFVFHLPPFVDDSYLFQLFSQFGKLQSVRVITDKDTGENKGYGFVKFYQTDEALKCQKEMNGFRIGSKFLKVKLKNEKESMNSGKSHHQHQNQNKNQNEQHLEEEEEEQTFNLPENNIDGNESNQEIVGSGNYT

SEQ ID NO: 19604 - DNA, 1062 bp, Mus musculus
  CDS (1)..(1062)
atggagaaaactttagaaactgttcctttggagaggaaaaagagagaaaaggaacagttccgaaagctctttattggtggcttaagctttgaaaccacagaagaaagtttgagaaactactatgagcaatggggaaagctcacagactgtgtggttatgcgggatcctgcaagcaaaagatcaagaggatttggctttgtaactttctcatccatggccgaggttgacgctgccatggctgcaaggccccattccattgatggcagggtagttgagccaaaacgtgctgtagcaagagaggagtctggaaaaccaggagcccatgtgactgtgaagaagctgtttgttggtggaattaaggaagatactgaggaacaccaccttagagattactttgaagagtatggaaaaattgatactattgaaataattaccgataggcagtctggaaagaaaagaggctttggctttgttacttttgatgaccatgatcctgtggataaaattgtcttgcaaaaatatcacaccataaatggtcacaatgcagaagttagaaaggcattgtctagacaagaaatgcaggaagtccaaagttctaggagtggaagaggaggaaactttggttttggggattctcgtggtggcggtggcaattttggaccaggaccaggaagcaactttagggggggatctgatggatacggaagtggacgtggatttggggatggctataatgggtatggaggaggacctggaggtggcaattttggaggtagccctggttatggaggaggaagaggaggatatggtggtggaggacctggatatggcaaccagggtgggggctacggaggtggttatgacaactatggaggaggaaattatggaagtggaagttacaatgattttggaaattataaccagcagccttctaactatggtccaatgaagagtggaaactttgggggtagcaggaacatgggaggaccatatggtggagggaactatggtcctggaggaagtggaggaagtggtggctatggtggaaggagcagatattaa

SEQ ID NO: 19605 - protein, 353 aa, Mus musculus
MEKTLETVPLERKKREKEQFRKLFIGGLSFETTEESLRNYYEQWGKLTDCVVMRDPASKRSRGFGFVTFSSMAEVDAAMAARPHSIDGRVVEPKRAVAREESGKPGAHVTVKKLFVGGIKEDTEEHHLRDYFEEYGKIDTIEIITDRQSGKKRGFGFVTFDDHDPVDKIVLQKYHTINGHNAEVRKALSRQEMQEVQSSRSGRGGNFGFGDSRGGGGNFGPGPGSNFRGGSDGYGSGRGFGDGYNGYGGGPGGGNFGGSPGYGGGRGGYGGGGPGYGNQGGGYGGGYDNYGGGNYGSGSYNDFGNYNQQPSNYGPMKSGNFGGSRNMGGPYGGGNYGPGGSGGSGGYGGRSRY

SEQ ID NO: 19606 - DNA, 1077 bp, Plasmodium falciparum
  CDS (1)..(1077)
atgatgatagaaaacgatgaaacattaaatgaattacataatgatgaagaattttgtattaaagaacaattaagtcatgttgatcatgatgaaaaagttcatgtagacagcatcgtaaaaaaaagtgagtgtgcacataattatgaacaaagggaaaaaagagatagaagttcgtctgttgattctaagccagagataaaaaaaatatgtcgctgccacgaatccaactgttcaaaaagctccaaatatgaaaagagttcttgtggttctaagaataaaagtggagattccttaagaattaacgaatgtttgaataattcgaaaaatttaaatgaaccgtttaagttttttatcggaggtattccacaatatattacaagcaagcatataacggagtatttcgaacaatatggaacagttcaacatgtcgtgattgctcaagatcatgagacgaaaaggaacagaggatttgcgtttgttacgatggcttcccatataaataaggaaagaattttaagggatactcatgaattaaacggaaaaagagtagacgttagagaagaaaataatactactccatctgatattcaaagaaaaatttttgttggtggtcttaactattattggactaaagatactttggaaagttatttttcaacttttggagaaatcgatgtagttcaaatcgttttagattctagtggtagatctcgctgttttggttttgtagttttctctaatgaaaattcagttgccaaagttttgaaacataagaggcacaaaatatatgacaaaatggttgaagtcagaaaagcggaacctaagaaaccaaaaatgtccattaaaagatcaaacaataaaaatttctccaagtttcctccacatattccattcatggcacccttccctccatgcaataaagaaaccatggctcagtgggctaactttatgtataacacatgtggagtaccatttttatttaatcaaagatttcagaaccttccagatttttattcaaattataattattatcagaattctttggaaaatatacaacaatctgaatataataattaa

SEQ ID NO: 19607 - protein, 358 aa, Plasmodium falciparum
MMIENDETLNELHNDEEFCIKEQLSHVDHDEKVHVDSIVKKSECAHNYEQREKRDRSSSVDSKPEIKKICRCHESNCSKSSKYEKSSCGSKNKSGDSLRINECLNNSKNLNEPFKFFIGGIPQYITSKHITEYFEQYGTVQHVVIAQDHETKRNRGFAFVTMASHINKERILRDTHELNGKRVDVREENNTTPSDIQRKIFVGGLNYYWTKDTLESYFSTFGEIDVVQIVLDSSGRSRCFGFVVFSNENSVAKVLKHKRHKIYDKMVEVRKAEPKKPKMSIKRSNNKNFSKFPPHIPFMAPFPPCNKETMAQWANFMYNTCGVPFLFNQRFQNLPDFYSNYNYYQNSLENIQQSEYNN

SEQ ID NO: 19608 - DNA, 1167 bp, Plasmodium falciparum
  CDS (1)..(1167)
atgacatcagaagagaacattaattataattcaaataattcaaatgaaaattcagtacaggataaaaagagtgttgaggaacataatatagacgataaatctttaagggatgaagataataaatcaataaaggaaggtaataataataataatactaatactaatactgataataataataataacaataataatagtagtaatatatctataaagggtgatgaagaagaacatgatgaaaaatctttaggagaagataataaatccgtaaaggatgatgaatcagaggcagaaaaattaagaagacttatagcacctttatcaaaagaacagctgattgatatattagctacctctgctttaatacatgaagatatacgggaaaaatgtaacgaagcagtagcttcttctccttcaactagacgtttgatggtaagaaatattccttttagtacgagagatgaacaatttttgaaatattttgaaagttttggtgaaattgaagatggcataattgttagagaaaaggaaggtaggtcaaaaggttatggttttgttacatttaaatatgtggaatcagttcaaaaatgtttgaaaagtagtcatacattggataataaagaattacaagtacgtttagttgctgatccttttactgatcattatcaaaacaaattatttgtaagaaacttatctcaaaaaacaaatgttagcacattacgttcaatttttgaaaagtacggaaaattagaagaatgtgttattatacatgacaatgaaggaaaatctaaaggatatggctttctaaccttctcttcaccaagagaagcttttaaggttatgcaacaacctgaacgtattatagataatagggtagttttcttacattttgccgtttcacaaaatttaaaaaaatatcaaaataatcaaaattatgtgaaaaaaaatcaaaattttaattattatcaaaaaaataatttaaataacagaaacaattttgtaagaagaacaccaatgtatcatcatgaaaatgaagctccaaatacatttaactatcctgtatcatttgttccgaatgtttataccaatgttccacatggttatcaacttaactaccctggtaatttagattccttcaatgctttttataacaatccgcgatattaa

SEQ ID NO: 19609 - protein, 388 aa, Plasmodium falciparum
MTSEENINYNSNNSNENSVQDKKSVEEHNIDDKSLRDEDNKSIKEGNNNNNTNTNTDNNNNNNNNSSNISIKGDEEEHDEKSLGEDNKSVKDDESEAEKLRRLIAPLSKEQLIDILATSALIHEDIREKCNEAVASSPSTRRLMVRNIPFSTRDEQFLKYFESFGEIEDGIIVREKEGRSKGYGFVTFKYVESVQKCLKSSHTLDNKELQVRLVADPFTDHYQNKLFVRNLSQKTNVSTLRSIFEKYGKLEECVIIHDNEGKSKGYGFLTFSSPREAFKVMQQPERIIDNRVVFLHFAVSQNLKKYQNNQNYVKKNQNFNYYQKNNLNNRNNFVRRTPMYHHENEAPNTFNYPVSFVPNVYTNVPHGYQLNYPGNLDSFNAFYNNPRY

SEQ ID NO: 19610 - DNA, 1332 bp, Drosophila melanogaster
  CDS (1)..(1332)
atgtccaacgcggataagatgcaggaccaggagcacgacgacgagcagtcctccgacatagagggatccggcgacaatgtgggccgtgatgacggcaccgacgatgacgacgacagcaacggcaacatgcagcaggagaatggagatggcggcaacggtggcgacggccaggagcactctggcgacgaggagcaacaccacagccaggacaacgagggcaacgataactccgcaggccaacagcagcaaatgcagcaagtggaccgaaccagcgccaccaatctgatcatcaattacttgccacaggacatgaccgaccgcgaactgtacaacctctttagcggctgcgggcccatcaacacctgcaagataatgcgcgacttcaagaccggatatagcttcggctacggcttcgtggactacaaaacggagtcggactcggaggacgccatccagaagctaaatggcttctatgtgcgcaacaagcgattaaaggtgtcgtatgctcgaccgggtgggcagtccattaaggatacgaatttgtacgtcatcaacctgtcgcgaaacatcaacgacgacatgctcgaccgcatcttctcgccctatggcctgattgttcagcgaaacatcctgcgggataagctcactggacgaccgcgcggcgttgcttttgtgcgttacaataagcgcgaggaagctcaagaggcgatcaaggcgctgaacaacacggtgccggagggcggatcccagccaatctgggtacgactcgccgaggaacacggcaaggccaaggcggcccagtttatggcccagatcggaggtggcaatggtggcggaggcggtggtccgccccacatgggcccaggtggaccgatgcacccacctcatcaccacaataatcaccatcacaacaaccaccacaatccgcatatgccgccgcatcatcatcagccgcagcatccacaccagcatccgcagcaccatccgcagctgcaccacatgcagcaccaccatcccaacaaccacaacaacaatcaccccaacaaccaccatcataacaacaacaacaacaaccaccacaacatgggcggcccgcatccgcaccacatgcagcaaatgcacccgatgggcatgaacatgggcatgggcgtaaacatgggaatgggcatgggcatgggcatgcccattcacggaggcggcggtggtggtggtggcggcggcggtggaggcggtggtggtaacttccaccacatggcgcacagaggtagatcaaatagaacaacacgatctcaaaaaccgcatccatataaccatgcacagaaatttatttaa

SEQ ID NO: 19611 - protein, 443 aa, Drosophila melanogaster
MSNADKMQDQEHDDEQSSDIEGSGDNVGRDDGTDDDDDSNGNMQQENGDGGNGGDGQEHSGDEEQHHSQDNEGNDNSAGQQQQMQQVDRTSATNLIINYLPQDMTDRELYNLFSGCGPINTCKIMRDFKTGYSFGYGFVDYKTESDSEDAIQKLNGFYVRNKRLKVSYARPGGQSIKDTNLYVINLSRNINDDMLDRIFSPYGLIVQRNILRDKLTGRPRGVAFVRYNKREEAQEAIKALNNTVPEGGSQPIWVRLAEEHGKAKAAQFMAQIGGGNGGGGGGPPHMGPGGPMHPPHHHNNHHHNNHHNPHMPPHHHQPQHPHQHPQHHPQLHHMQHHHPNNHNNNHPNNHHHNNNNNNHHNMGGPHPHHMQQMHPMGMNMGMGVNMGMGMGMGMPIHGGGGGGGGGGGGGGGGNFHHMAHRGRSNRTTRSQKPHPYNHAQKFI

SEQ ID NO: 19612 - DNA, 978 bp, Drosophila melanogaster
  CDS (1)..(978)
atggcggaacaaaacgattccaacggaaactacgacgatggtgaagagatcaccgagccagagcagctgcgcaaactgttcatcggcggactggactaccgcaccacagatgatggcctgaaggctcacttcgagaagtggggcaacattgtcgacgtggtggtgatgaaggatcccaagacgaagcgctctcgcggcttcggtttcatcacgtactcccagtcgtacatgatcgacaatgcgcagaatgccaggccacacaagatcgatggacgcaccgtggagcccaagagggctgtgccacgccaggagatcgattccccgaatgcgggagccacggtaaagaagctctttgtgggcgggcttcgagacgatcacgatgaagagtgcctgcgcgagtacttcaaggactttggccagatcgtgagcgtgaacattgtttccgacaaggacaccggcaagaagcgcggcttcgccttcattgagttcgatgactacgatcccgttgacaaaatcatccttcagaagacccactccatcaagaacaagaccctggacgtgaagaaggctattgccaagcaggatatggatcgacagggcggaggtggcggacgcggaggtcctcgagctggcggtcgcggtggtcagggtgaccgcggccagggaggcggtggctggggaggccagaacagacagaacggtgggggcaactggggcggagctggcggcggcggaggattcggcaacagcggcggtaactttggaggcggtcagggcggcggctctggcggttggaatcagcaaggcggaagcggaggtggtccatggaataaccagggtggcggcaacggcggctggaacggtggtggtggcggcggctacggcggcggaaacagcaatggcagctggggcggtaacggtggtggaggtggtggtggccagggtggaaatatgggaggcggcaatagacgttactag

SEQ ID NO: 19613 - protein, 325 aa, Drosophila melanogaster
MAEQNDSNGNYDDGEEITEPEQLRKLFIGGLDYRTTDDGLKAHFEKWGNIVDVVVMKDPKTKRSRGFGFITYSQSYMIDNAQNARPHKIDGRTVEPKRAVPRQEIDSPNAGATVKKLFVGGLRDDHDEECLREYFKDFGQIVSVNIVSDKDTGKKRGFAFIEFDDYDPVDKIILQKTHSIKNKTLDVKKAIAKQDMDRQGGGGGRGGPRAGGRGGQGDRGQGGGGWGGQNRQNGGGNWGGAGGGGGFGNSGGNFGGGQGGGSGGWNQQGGSGGGPWNNQGGGNGGWNGGGGGGYGGGNSNGSWGGNGGGGGGGQGGNMGGGNRRY

SEQ ID NO: 19614 - DNA, 2067 bp, Arabidopsis thaliana
  CDS (179)..(1525)
atgaacaaaaacatcctctgtttctctcttttcatatttttctccacatttcctcatctgggtcatctccaaaaatgatttgatgataacccaaattcgcaatttgattaggacaacaacaacaactttatttatctgattccgtctttgattttcagacaagaaaaaaaaaaaaaagatggaatcggatctggggaagctcttcattggtgggatttcgtgggatacagacgaagaaaggttaagagactactttagcaactatggtgatgttgttgaagctgtgatcatgagagatcgtgccacaggtcgtgcacgtggcttcggcttcattgtctttgcagacccctgtgtctcagagagagtgatcatggataaacacatcatcgatggccgcacggttgaggcgaagaaggctgtgcctcgagatgatcagcaggtgctaaagcgacacgctagtcctatccaccttatgtcacctgtccatggtggtggtggaaggacaaagaagatcttcgttggaggtttaccgtctagcattaccgaggaggagttcaagaactactttgatcagtttggtactattgctgatgttgttgtaatgtatgatcataacacgcagaggccaagaggttttggcttcatcacatttgattcagatgatgctgttgatagagttcttcacaagaccttccatgagctcaatgggaaactagttgaggtcaaaagagctgtacctaaggagatttcccctgtttctaatatccgaagcccgcttgctagcggtgttaactatggaggcgggtctaataggatgcctgctaatagctactttaacaactttgctcctggtcctggtttttataacagtctaggtcctgttggtcgtcggtttagtcctgttattggtagtggtagaaatgcggtttctgcttttggcctcgttttgaatcatgacttgagtttgaatttgaatccaagctgcgatgggacaagttctacgtttggttataaccgtattccaagcaacccttacttcaacggtgcttccccgaaccgttacacctctccaatcgggcacaatagaactgagtctccttacaattcgaacaatagagacttatggggaaacagaaccgacactgcaggtcccggttggaacttgaatgtctcgaatggaaacaacagaggaaattggggacttccttcttcttctgctgttagtaatgataacaatggctttggaaggaactatgggacaagttctggactttcctcgtccccatttaatggttttgaaggttctataggggaactgtacagaggcggctcagtctacagcgactcaacgtggcagcaacagcagctaccatctcagtcttctcacgagctagacaatttgtctcgcgcttacggttatgatattgacaatgtaggttcagacccatctgcaaatgacccagaaacttacaatggaagctacaatgttggaaatagacaaactaatagaggtattgctgcataggttatcaaaaaccaagaaaacaaaaaaaaaagttgagagatttgtagattgaaagcaaccaaatttcagttgcagagtttgaacaggttctcatgacaaagaaaccaactttgttgatcacagtgccaaagattatggtttgctttctcttttgttagaccaaaaaaaaaaaaaaaaaagagaaaaacaaagaaccgtttttgtttttcttcttcttacataaagatcagatcgtagcagccagacaaccaaagatactacaaggtggatttagatttgcttctcaaaaaagtttttttttttctttcatagaataaccaaacaaagatcgtagaattttcgatcaaagattcttcagagttctgtgctctgttttgtaattgtactttttttttcttgtttacaaaatgaattgttcatgaaaactttgttttcttaaaaaaaaaattagcgtgggagaaatattgtgtaagagagggatatgactattttgttgcatgtatccctaatgagatatatatatatatatatttttttaaagc

SEQ ID NO: 19615 - protein, 448 aa, Arabidopsis thaliana
MESDLGKLFIGGISWDTDEERLRDYFSNYGDVVEAVIMRDRATGRARGFGFIVFADPCVSERVIMDKHIIDGRTVEAKKAVPRDDQQVLKRHASPIHLMSPVHGGGGRTKKIFVGGLPSSITEEEFKNYFDQFGTIADVVVMYDHNTQRPRGFGFITFDSDDAVDRVLHKTFHELNGKLVEVKRAVPKEISPVSNIRSPLASGVNYGGGSNRMPANSYFNNFAPGPGFYNSLGPVGRRFSPVIGSGRNAVSAFGLVLNHDLSLNLNPSCDGTSSTFGYNRIPSNPYFNGASPNRYTSPIGHNRTESPYNSNNRDLWGNRTDTAGPGWNLNVSNGNNRGNWGLPSSSAVSNDNNGFGRNYGTSSGLSSSPFNGFEGSIGELYRGGSVYSDSTWQQQQLPSQSSHELDNLSRAYGYDIDNVGSDPSANDPETYNGSYNVGNRQTNRGIAA

SEQ ID NO: 19616 - DNA, 1811 bp, Arabidopsis thaliana
  CDS (270)..(1565)
aattcgatttggattgcagaaaaagaaaagaaaagaaaagactaaaaatttggacgataagcagaaaagagagaggagggcctctcgccctcttattaaaaccttgccttctccaaatctgaagatttctcaatcctaaaatcttttttttttcctctttctccgtttctttattttcggaatccaagatcgtgggtcgatcggtttttacacaatccgatcacgacccatctgctctttttcatcctattttgcttcccttgaggtaaatggaaatggaatcatgtaagctcttcatcggtggtatatcttgggaaaccagtgaagatcgtcttcgtgactattttcacagttttggtgaggttttagaggctgttattatgaaggatcgtgccactggccgtgctcgtggctttggtttcgttgtctttgctgatcctaatgttgctgaaagagtcgtcttgcttaaacatatcattgatggtaaaattgttgaggcaaagaaggctgttccaagagatgatcacgtagtatttaataaaagtaacagcagccttcagggatcacctggcccatcaaactccaagaagatctttgtgggaggtttggcatcatccgtgacagaggctgagttcaaaaagtattttgctcagtttgggatgatcactgatgttgtggtgatgtatgaccacagaacccagcggcctagaggctttgggttcatttcatatgactctgaggaagctgttgacaaagtactgcagaagacattccacgaactcaatggtaagatggtggaggtcaaactggctgttcctaaggatatggctctcaacacaatgcggaaccaaatgaatgtaaatagctttggcactagtagaatcagttcattactgaatgagtacacccagggattcagcccgagtccaatctctggttatggagtgaaacctgaagttaggtacagtccagcagtaggtaataggggaggattctcaccgtttggacatggatacggaatcgagctgaattttgagccaaaccagactcagaactacggttctggttccagtggaggctttggacgaccctttagccctggatatgctgcgagtctcggcaggttcggtagccaaatggagtcgggaggagctagtgttgggaacggttctgtcctaaatgcagcaccaaagaaccatttatggggaaatggtggtctaggttacatgtcaaactctccgatatcaagaagcagcttcagtggaaactctggaatgtcttcactaggcagcattggtgacaactggggaacagctgcacgtgcacgcagtagctaccacggtgagagaggaggtgtaggattagaagcaatgagaggagttcatgttggtggttacagcagcggctcaagcatcttggaggcagactctctgtacagcgactcgatgtggctttcgctgcctgcaaaggcagaggaaggattgggaatgggaccattggacttcatgtctagaggaccagctggatacatcaacaggcaaccaaacggaggaattgcagcttagagaagtgacaaatctataccatggagatcagatgattgcagaagagagtttttagaagaggaaaaaagtttattaaaaaaaaaaaaattatttgtaccaaaaagcttaaagcttttatttactttttactattttgatttgttgttatagctttcttttcacccttttttctaatttggggttttgtttcttttgtttttatcgttaaagaaaaaagatgtaaacttgagtgatataaaaagagac

SEQ ID NO: 19617 - protein, 431 aa, Arabidopsis thaliana
MEMESCKLFIGGISWETSEDRLRDYFHSFGEVLEAVIMKDRATGRARGFGFVVFADPNVAERVVLLKHIIDGKIVEAKKAVPRDDHVVFNKSNSSLQGSPGPSNSKKIFVGGLASSVTEAEFKKYFAQFGMITDVVVMYDHRTQRPRGFGFISYDSEEAVDKVLQKTFHELNGKMVEVKLAVPKDMALNTMRNQMNVNSFGTSRISSLLNEYTQGFSPSPISGYGVKPEVRYSPAVGNRGGFSPFGHGYGIELNFEPNQTQNYGSGSSGGFGRPFSPGYAASLGRFGSQMESGGASVGNGSVLNAAPKNHLWGNGGLGYMSNSPISRSSFSGNSGMSSLGSIGDNWGTAARARSSYHGERGGVGLEAMRGVHVGGYSSGSSILEADSLYSDSMWLSLPAKAEEGLGMGPLDFMSRGPAGYINRQPNGGIAA

SEQ ID NO: 19618 - DNA, 1053 bp, Oryza sativa
  CDS (65)..(859)
gagccccaaaaccttatcttcccaaagcctcatctcctccttcctcccaccacctcgcctcgccatggcggccaccctcttctccacctcgctcacccccaccttcctcccggccgtcccctgccccaagcccgcgccgccggcctcagcctgcttcccctgcgcgctgccgccgcgcgccgcgctagcggcgccaccggcgccgctgcggaggcggctttctcccgtggccgtcgcggtgtcgtcggaggtggaggaggaggagggtggcgcggagtccgagggggagttcgccgaggacctcaaggtgtttgttggtaaccttccgttcagcgtcgacagcgcgcagctcgcggggctcttcgagcaggccggctccgttgagatggtcgaggttgtatatgacagacagaccggaagaagccgtggctttggattcgtcacaatgtctacagctgaagaagctggtgctgccgtcgaacaattcaatggatacacattccaaggaagacctctgagggtaaactcagggccgcctccgcctcgggatgatttcgcgccaagatcacctaggggtggtgggagcaactttgattcatccaacaagctctatgtagggaaccttgcttggggtgtcgacaactcgacactcgagaacctgttcagtgagcagggaaccgtgctcgatgccaaggtcatctacgacagggagagcggcaggtcgaggggttttggttttgtcacctatggctccgctgaagaagtcaacaatgccatatcaaatcttgacggcgttgacctggacggcaggcagatccgagttacagttgcagaatcaaagccaaggcgccaattttgagattttttttttggttatgttgatttagaggttgatgatgtgcttccaagatgttagtttgtagcttctactattgtacaccaatatggcgaaaaggaaaattgatgcggttgatgagagactgaaagtctgaaattgtacacgaggggaagatttttccccaaagatgcaatatgcacagatcctcttgttag

SEQ ID NO: 19619 - protein, 264 aa, Oryza sativa
MAATLFSTSLTPTFLPAVPCPKPAPPASACFPCALPPRAALAAPPAPLRRRLSPVAVAVSSEVEEEEGGAESEGEFAEDLKVFVGNLPFSVDSAQLAGLFEQAGSVEMVEVVYDRQTGRSRGFGFVTMSTAEEAGAAVEQFNGYTFQGRPLRVNSGPPPPRDDFAPRSPRGGGSNFDSSNKLYVGNLAWGVDNSTLENLFSEQGTVLDAKVIYDRESGRSRGFGFVTYGSAEEVNNAISNLDGVDLDGRQIRVTVAESKPRRQF

SEQ ID NO: 19620 - DNA, 1983 bp, Vicia faba
  CDS (69)..(1616)
aattcggcacgaggaaaaatacacatatcgtaggcacgaggaaaaatacacatatcgtagtgagttgaatgtgtgattcccaatctgaaaccctagtaaccaccttcgtttcacgcgaacaacaaacaatggtgagaaagagaaagctcgtcgctaaatcttctcaaccagaggaaccaccgctcaaacagcaccactctcaaccgcaacctgatcccgaaccggaaccgtatatccccaccgaagaagttgaggaagaatacgaagaagttgaggaggaatatgaagaggttgaagaaatagaggtggaggaagaagaagaagaggaggaggaggaagaagacggaggtgaacaagctcaaggtggcgaatacctagaagaagacgatgaaccgattaaggatctagtggagcctttcaccaaggaacagatcgcgactctcctttgcgaagcggcggcgaaacaccgcgatgtggcggaccggatccgtaagatcgctgatggagatgcttcccaccggaagatctttgtacatggtttgggatgggacaccacttccgcaacgctgattaacgccttttcgcaatacggtgaaattgaggattgtaaggctgttactgataaggcttctgggaaatctaagggttatgggtttattctttttaagaagaggagtggggcgaggaatgctttgaaggagccgcagaagaagattgggaaccggatgacggcgtgtcagctggcgtctattggtcctgttgcacagactccgcagccggcggttcagttggtgcagccaggctcggagtatacgcagaggaagatttatatcagtaatgttggtccggaattggatccgcataagctgtttgcctatttctcgaggtttggagaaattgaggaagggccgttagggcttgacaaggcgacggggaagccgaaagggttttgcttgtttgtttataagagtgctgagagtgcaaggaggtcattggaggagcctcataaggaatttgaggggcatattttgcactgccagagggcaattgatggtcctaaggcggggaagactcaacatccacagccacagcagctacaacatgtgaattcattgaatcaattcaatcaattgaaccaactgaacccggcaactcagaggacacaatttcagagaaatgacaatgttggatatgttggtggtagtagtgttgcagttagtcaaccagggcacttgatggctccggcaggaccaacaatcgggtacaaccaggccgctgcttctgctgcacagggattgaacccggtgctgacgcctgctcttggacaggctttgacagcactacttgcatctcagggtgctactttggggctgagtgatttattggggagtcttggaacaagtaatgctcttaatcatggtggtgttccagctgcaggtcatggagttcagagtgggtacagtgctcagcccactataagtccatcagttatgggagcctatgggaattcagtaccacaggttgggttgcaggtgcaatatccaaaccagcagattggacagggtggttctggaagagggcaatatggcggtgctgcatcttacatggggcactaagtggtttgcagataccacataagtgcatcagtcttttattactggcatggtgattcttttgaagtttaaggagctgatgcaattggggtgtttaaaatgaaatataacctagtatactgatcagaatatttaaatttccaaaccgtgttctgttttcgccgccttctttttcgtaatttctttaatttcaaactattgtattattttgaattttagtttatcttctaaaaacctatggaactgtttttagtagtactttgaactttatttacatccttactttcactggttggatgctgaacaagttatattttaaattttatgtatgtgtggaccattttgcgtcgaaaaaaaaaaaaaaaaaaaa

SEQ ID NO: 19621 - protein, 515 aa, Vicia faba
MCDSQSETLVTTFVSREQQTMVRKRKLVAKSSQPEEPPLKQHHSQPQPDPEPEPYIPTEEVEEEYEEVEEEYEEVEEIEVEEEEEEEEEEEDGGEQAQGGEYLEEDDEPIKDLVEPFTKEQIATLLCEAAAKHRDVADRIRKIADGDASHRKIFVHGLGWDTTSATLINAFSQYGEIEDCKAVTDKASGKSKGYGFILFKKRSGARNALKEPQKKIGNRMTACQLASIGPVAQTPQPAVQLVQPGSEYTQRKIYISNVGPELDPHKLFAYFSRFGEIEEGPLGLDKATGKPKGFCLFVYKSAESARRSLEEPHKEFEGHILHCQRAIDGPKAGKTQHPQPQQLQHVNSLNQFNQLNQLNPATQRTQFQRNDNVGYVGGSSVAVSQPGHLMAPAGPTIGYNQAAASAAQGLNPVLTPALGQALTALLASQGATLGLSDLLGSLGTSNALNHGGVPAAGHGVQSGYSAQPTISPSVMGAYGNSVPQVGLQVQYPNQQIGQGGSGRGQYGGAASYMGH

SEQ ID NO: 19622 - DNA, 2187 bp, Drosophila melanogaster
  CDS (1005)..(2114)
agtgtcgtcttgttggttgtcgcgttcgtgtgcgcgcactgagaaaagcggaacgccagcgttgcactaaccgttgcagtttctatattactctcgagtcgcccgatttcagagctgttcgtaccgctcgtgggagtgcgtgcgttttaaccaaaacaactaccaaatcgcgtacaagataccaaaccaatataaccgagaggcccgaaaggaaaacccctgctgtggagggcattttgcattttgtttacctcgatggctgtgtggagtgcaatttgacgattatataatataaaatacaaaatacaaaaaatagggaaaacgagtaacagtgcgcggcattcgattttaattgcaatcaactacaataaccgctgaaatcttttgcagtaatatgttgccttcaaatcaattgggaaaccaacaaccaaagttaacgcaacgtttctaaaacttaaagtctaaacaacaaacgaaataatagttacgaaatacacaataatatttaaaccaaaccaaaagtggcctgcaaaacgaagcaaccaaaacaaccaaaacaaccaagaaatgtgattcaatgtgtgcaatgtaaccaaattataattaacaagctaaataaaacgataactagagcaggagaaaagccgtggaaaatcagcgggaaagccaaccaaagccaggccaaatggaaaacaaggaatccggcagccaatcgaacagccaactagcagccatcgtggccaatgattaagggaacactctgttagccaactcgtagtagcagcatcccccgtccacacataacacccagtaacacagccactcagccgcacagaaccactcgacctcccctcgcatctcgatgctcgcacagaaggcgttggagcaacaattatagaatagacagccagacgaccacatcagctcagctcagccccaactgcaaactccaatcaccagctccagctccaactcaatctcaatcccgagccaaaacccccaacatggacatcaagattgagcagcagcagcagcaacagcaagtggagctgggaccctgttccccctcggaggtgcccaatgatcccggaaaaatgttcattggcggcctcagttggcagacaagtccagagagcttacgcgattacttcggacgttacggtgatatctcagaggctatggtcatgaaggatcccacgacgcgcagatccagaggcttcggctttgtcacattcagcgatccaaatagcgtagataaggtactcacccaaggcacacacgagctggatggcaaaaaggtcgatccgaaagtagcttttccgcgccgtgcacatcccaagatggtgacgagaacgaagaaaatctttgtgggcggcctctcggcgcccaccacactggaggatgtcaaaagttacttcgaacagtttggtccgatcgaggatgcaatgttgatgttcgataagcagaccaatcggcacagaggttttggcttcgttacatttcaaagcgaagatgtggtagacaaagtttgcgaaattcatttccacgagataaacaacaaaatggtcgagtgcaagaaggcgcagccgaaggaagtgatgctgccggccaatctggccaagacgcgggctgccgggcgttctgcatacgataacatcatgtggggactggggacattgcccgaaggttttccggcagctgcctatgctgcttatgccgctggtcgcggatactcgggctatcccagttttggactgccctatccaactgttgatctaaccaatgggcagctgacacccaacaacaatacaccgctgctgacccaggcgctgtcagtgatgaacaactatcaggcggctgctgccgctgcccacagctatgggccgtcggcatcgccgcatgccgccgccgccaacacggccacccggcagggattcccctccaccaactcacctggccccaccatcgacatgtacagctcggcggccgccgacaatgtgggctatgtgcaggccaccagtccgcagccgtccggcttccccatcgccgtcagccgcgccccgttgaactacagcccgatttattcgttgaactttgcgatggctaatatataaaagactgataacccaaaaatataaatgcaagagaacaaaacaaaacaaaagatatgcaaaaaaaaaaaaaaaa

SEQ ID NO: 19623 - protein, 369 aa, Drosophila melanogaster
MDIKIEQQQQQQQVELGPCSPSEVPNDPGKMFIGGLSWQTSPESLRDYFGRYGDISEAMVMKDPTTRRSRGFGFVTFSDPNSVDKVLTQGTHELDGKKVDPKVAFPRRAHPKMVTRTKKIFVGGLSAPTTLEDVKSYFEQFGPIEDAMLMFDKQTNRHRGFGFVTFQSEDVVDKVCEIHFHEINNKMVECKKAQPKEVMLPANLAKTRAAGRSAYDNIMWGLGTLPEGFPAAAYAAYAAGRGYSGYPSFGLPYPTVDLTNGQLTPNNNTPLLTQALSVMNNYQAAAAAAHSYGPSASPHAAAANTATRQGFPSTNSPGPTIDMYSSAAADNVGYVQATSPQPSGFPIAVSRAPLNYSPIYSLNFAMANI

SEQ ID NO: 19624 - DNA, 2822 bp, Drosophila melanogaster
  CDS (513)..(2417)
gagttaaaaaaaattccttgcccgaagcggaaggattgtcgaatttcgtggatttttgcgaatatttcccgtgtaattttcgtcacgcgtcgtttatttgcaccagcgagtgtgtgtgagtgtgtgtataacgtactggtgtgtgtgcgtaaaatctgaaaccttgccatctaatattggtggtattaaaatgagtattacctaagaaaaacaaaaataattcagtgcggttataaaatacataatatttaacaaaatagttgcaaaaagtcaacagaaaagtgcaaaaagaaaaaaatctcaagaaaaacaaagtatttggtgcgacctaaagtgattttctcagcgtgtgtctttgggataagcgaaaaaccagcaaaatttactgctttggaaactccgctctcaacataagcaccaacaacaacaccatcaacccccccggcggcagcagcacccacctccagattcagcaccaccaggctcagcaccacccccaaaacagtgcgagaatgctgttcgagaatccggcggttgcggccaagttgccctttccgtacaacgtgcccccgcccctgcaggcggcggcggcagcagcggcggctgtcccaaatctaaggtttcagacacccattaaagcgtttgcctgcctgacagcagccacaaggtcagtatcggagatgaacgccacttctctatatgccggcaatcccatggagaacgcggccgcagcagccgccgccgcagcagcgggcttgattgatccgcaccacaatcgcgatctccaccaggcgctggtggcctcgatagccaataatagtgtggccgccatcggcggtggcctgaccacagcggcagtcttgaagagtgccgctcagcagtcccagcaggcggtgcaacagaaccagaacgcggtagtggtgacaccgggactggaacagcccaaacaggaaccagcccaacaggcggcactggcgctgctcaaggagaatgtaaacgcctccgccggagcgggacagaacaacggtcaggcggccatgggtggcagcaacaagagcggctcctctggcagatccacgcccagcctgagcggaggcagtggctccgatccggcacccggcaaactctttgtcggcggtctcagctggcagacgtcgtctgacaagctcaaggaatacttcaacatgttcggcaccgtcaccgatgtgctcatcatgaaggatcccgtcacccagcgcagtcgcggctttggtttcatcacattccaagaaccctgcaccgtggagaaggttctcaaggtgcccattcacacactcgatggcaagaagatcgatcccaagcatgccaccccaaagaatcgacctcgtcaggccaacaagaccaagaagatcttcgtgggcggcgtctcacaggatacttcggccgaggaggttaaggcttacttcagccagttcggacccgtcgaggagacggttatgttgatggaccagcagacaaagcgccaccgtggcttcggatttgtcacctttgagaatgaggatgtggtcgatcgcgtatgtgagattcacttccacaccatcaagaacaagaaggtcgagtgcaagaaggcacagcccaaggaagcagtcacaccggctgctcagcttctccagaagcgcattatgttgggcaccctcggcgtccagctgcccacagctcctggccagctgattggagcccgtggtgccagcgtggccaccatgaacccactggccatgcttcaaaatcccacacagctactgcaatccccggcagcagccgctgccgcccagcaggccgccctcatatcacagaacccatttcaagtacaaaacgccgctgcggcagcctcgattgccaatcaggctggcttcggcaagctgttgaccacatatccgcagactgcgctgcatagcgtcagatatgcaccctactcgatccccgccagcgccgccactgccaacgccgccttgatgcaggctcatcaggcgcaaagcgtggccgccgctgcccatcatcaccagcagcagcaacagcagcagcatcatcaccagcagcagacccacaatgcccatgtggccgccgcccagcagcagcagcagagccaccacaacgccgtctcgaatcccgcttcgcaggcgcactcggcagcagcggctgccgccctggcggccaatgccgcgaatggggcaggtgccgctggagcccacagcctggccgctgccgctcagcaagctggcttaatggccggcaatcccctgaatgccgctgctgccgccgccgccgctgctgccaatccggcggctgcctactccaactatgcgctggccaacgtggacatgtccagcttccagggcgtcgattggagcaccatgtacggcatgggcatgtacgtctaagacgcgagttttgtttggtaatttgaatgaaacactctcaccatgcatacaccattcacaaccaccccccatacacccacaaccactaccacatgtgaacagcagccccccacatccattaatattcatagaaccacacacaaacactcatacgaagttggttttcctttgagtttggctaagttagtagtccgatacacggaaggcaaattaagtattatatttaaggcgccctcgagcgagttcgataaatactaactaatatatatatatataacaaatcataagcaatataagcgagaaaaaagaacaaaaacggaagcaaagcaaagcgaaggaaaaacaaaatctaaaaccaaaaagcaaaaattacggagcgttagagaagcaaaaaaaaaaaaaaaa

SEQ ID NO: 19625 - protein, 634 aa, Drosophila melanogaster
MLFENPAVAAKLPFPYNVPPPLQAAAAAAAAVPNLRFQTPIKAFACLTAATRSVSEMNATSLYAGNPMENAAAAAAAAAAGLIDPHHNRDLHQALVASIANNSVAAIGGGLTTAAVLKSAAQQSQQAVQQNQNAVVVTPGLEQPKQEPAQQAALALLKENVNASAGAGQNNGQAAMGGSNKSGSSGRSTPSLSGGSGSDPAPGKLFVGGLSWQTSSDKLKEYFNMFGTVTDVLIMKDPVTQRSRGFGFITFQEPCTVEKVLKVPIHTLDGKKIDPKHATPKNRPRQANKTKKIFVGGVSQDTSAEEVKAYFSQFGPVEETVMLMDQQTKRHRGFGFVTFENEDVVDRVCEIHFHTIKNKKVECKKAQPKEAVTPAAQLLQKRIMLGTLGVQLPTAPGQLIGARGASVATMNPLAMLQNPTQLLQSPAAAAAAQQAALISQNPFQVQNAAAAASIANQAGFGKLLTTYPQTALHSVRYAPYSIPASAATANAALMQAHQAQSVAAAAHHHQQQQQQQHHHQQQTHNAHVAAAQQQQQSHHNAVSNPASQAHSAAAAAALAANAANGAGAAGAHSLAAAAQQAGLMAGNPLNAAAAAAAAAANPAAAYSNYALANVDMSSFQGVDWSTMYGMGMYV

SEQ ID NO: 19626 - DNA, 918 bp, Caenorhabditis elegans
  CDS (1)..(918)
atggaagctacagataacaagattaacggtaacgcctctgagactatcaaggaaaatggacactcgacgaagggaaacgaggacaagaagatattcgttggtggaatctcgcccgaagtgaacaacgaagatttgagctcccacttcacccaatatggagaagttgctcaagctcaagtcaagtacgaccggactaacggccgctccagagggttcgcatttgtcgagttcaccactggagagggctgtaaattggcccttgctgctcgcgaacaaaccatcaagggaaaatctgtcgaggtaaagccagcaaaatcgagggaaaacaagaaggtgtttgttggaggactcccatcggactacagcgagcaagatcttcgctctcatttcgaacaattcggcaaggtcgacgacattgaatggccattcgataagcagaccaaggctcgtcgcaacttcgcttttatcgtattcgaggaggaggagtccgcagacaaagcatcttcccagacaaaacagaccttcggaactcgcgaatgtgacgtgaaaaaagcagttccacaaggaaaacggttcccaggcgcccaagggcgtatgccaggtggtcgcggaatgtatggtggacgtggtggaaataacaactcgggatggtatgctggatggggacaaattggagctatgccatacggagctactggagcagcttggggagactggtacggaaacggttattacggccaacaaggtgcagcacatcacaacaacagcggatcatcgcaaggttacggaagcggataccagagaaataacagtggattcgattaccaacaagctcaaggagccagacagggcaacaatggccaaccacgcttccaacagcagccacaacaacaaactgctcaagcccaacagttctaa

SEQ ID NO: 19627 - protein, 305 aa, Caenorhabditis elegans
MEATDNKINGNASETIKENGHSTKGNEDKKIFVGGISPEVNNEDLSSHFTQYGEVAQAQVKYDRTNGRSRGFAFVEFTTGEGCKLALAAREQTIKGKSVEVKPAKSRENKKVFVGGLPSDYSEQDLRSHFEQFGKVDDIEWPFDKQTKARRNFAFIVFEEEESADKASSQTKQTFGTRECDVKKAVPQGKRFPGAQGRMPGGRGMYGGRGGNNNSGWYAGWGQIGAMPYGATGAAWGDWYGNGYYGQQGAAHHNNSGSSQGYGSGYQRNNSGFDYQQAQGARQGNNGQPRFQQQPQQQTAQAQQF

SEQ ID NO: 19628 - DNA, 756 bp, Homo sapiens
  CDS (1)..(756)
atggccgatctgacatcggtgctcacttctgttatgttttctccctctagtaaaatgtttatcggtggactgagctggcagacctcaccagatagccttagagactattttagcaaatttggagaaattagagaatgtatggtcatgagagatcccactacgaaacgctccagaggcttcggtttcgtcacgttcgcagacccagcaagtgtagataaagtattaggtcagccccaccatgagttagattccaagacgattgaccccaaagttgcatttcctcgtcgagcgcaacccaagatggtcacaagaacaaagaaaatatttgtaggcgggttatctgcgaacacagtagtggaagatgtaaagcaatatttcgagcagtttggcaaggtggaagatgcaatgctgatgtttgataaaactaccaacaggcacagagggtttggctttgtcacttttgagaatgaagatgttgtggagaaagtctgtgagattcatttccatgaaatcaataataaaatggtagaatgtaagaaagctcagccgaaagaagtcatgttcccacctgggacaagaggccgggcccggggactgccttacaccatggacgcgttcatgcttggcatggggatgctgggatatcccaacttcgtggcgacctatggccgtggctaccccggatttgctccaagctatggctatcagttcccagactatttgccggtttcacaagacataatttttatcaactag

SEQ ID NO: 19629 - protein, 251 aa, Homo sapiens
MADLTSVLTSVMFSPSSKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPDYLPVSQDIIFIN

SEQ ID NO: 19630 - DNA, 984 bp, Mus musculus
  CDS (1)..(888)
atgtctgaatatattcgggtaacagaagatgagaacgatgaacccattgaaataccatcagaagacgatgggacggtgttgctgtccacagttacagcccagtttccaggggcatgcggcctgcgctaccggaatcccgtgtctcagtgtatgagaggagtccgactggtggaaggaattctgcatgccccagatgctggctggggcaatctggtatatgttgtcaactatcccaaagataacaaaaggaaaatggatgagacagatgcttcctctgcagtgaaagtgaaaagagcagtccagaaaacatctgacctcatagtgttgggtctcccctggaaaacaactgagcaggatctgaaagactatttcagtacttttggagaggttcttatggttcaggtcaagaaagatcttaaaactggtcactcgaaagggtttggctttgttcgatttacagaatatgaaacccaagtgaaagtaatgtcacaacgacatatgatagatgggcgatggtgtgactgtaaacttcccaactctaagcaaagcccagacgagcctttgagaagcagaaaggtgtttgttggacgttgtacagaggacatgactgctgaagagcttcagcagtttttctgtcagtatggagaagtggtagatgtcttcattcccaaaccattcagagcttttgccttcgtcacctttgcagatgataaggttgcccagtctctttgtggagaggatttgatcattaaaggaatcagcgtgcatatatccaatgctgaacctaagcataatagcaatagacagttagaaagaagtggaagatttggtgttcatctcatttcaaatgtttatggaagaagcacttcattgaaagtagtgctgtaaatattctgccataggaatacttctgtctacatgctttctcatccaagaattcgtcatcacgctgcacaggctgcgtctttgacggtgggtgttcca

SEQ ID NO: 19631 - protein, 295 aa, Mus musculus
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKDYFSTFGEVLMVQVKKDLKTGHSKGFGFVRFTEYETQVKVMSQRHMIDGRWCDCKLPNSKQSPDEPLRSRKVFVGRCTEDMTAEELQQFFCQYGEVVDVFIPKPFRAFAFVTFADDKVAQSLCGEDLIIKGISVHISNAEPKHNSNRQLERSGRFGVHLISNVYGRSTSLKVVL

SEQ ID NO: 19632 - DNA, 1604 bp, Arabidopsis thaliana
  CDS (163)..(1398)
gctgtcttcttcctcttcctcctctcaaatcggctacagccattggaaaagctaaagccttttcgtaatttctggaagtttctgcagtcggttttcacggtttcgtagattgaggtggatttgtgattctgggtcagaagtaagatagtggaatataaattcatggattcggatcaaggaaagctttttgtcggtggtatttcatgggaaactgatgaagataagctgagagaacatttcaccaactatggagaggtttctcaggctattgtgatgagagacaagctcacaggtcgacctaggggttttgggttcgttatcttctcggatccttctgttctcgatagggttcttcaagagaaacacagcattgataccagagaggttgatgtgaagagagccatgtcaagagaggagcagcaagtctctggaagaactgggaatcttaatacatctagaagttctggaggtgatgcttacaataaaaccaagaagatctttgttggaggcttgccacctactttgactgatgaagagtttcgccagtactttgaagtttatggccctgtgactgatgttgcaatcatgtatgaccaggctaccaaccgtcctcgtgggtttggatttgtttccttcgactctgaagatgcggtagacagtgttttgcacaagactttccatgatttgagcggtaaacaagttgaagtaaagcgtgctcttcctaaagatgccaatcctggaggtggtggacgatcaatgggtggtggtggctctggtggttaccagggttatggtggcaatgaaagcagttatgatggacgtatggattccaataggtttttgcagcatcaaagtgttggaaatggtttaccatcttatggttcttctggttatggcgctggctatggaaatggtagtaatggtgccgggtatggtgcctatggaggttacactggttctgctggaggttatggcgctggtgctactgctggatatggagcaacgaacattccaggtgctggctatggaagtagtactggagttgctccgagaaactcatgggacactccagcttctagtggttatgggaacccaggctatgggagtggtgctgctcatagtggatatggagttcctggtgcagctcctcctacgcagtcaccatctggctatagtaaccaaggctacggttatggagggtacagtggaagtgattctggttatggaaatcaagctgcatatggtgtggttggagggcgtcctagtggtggcggttcaaacaaccctggtagtggtggctacatgggaggtggttatggtgatggatcttggcgatctgacccgtcacaaggttatggtggtgggtacaatgatggtcagggtcgacaaggccagtagtgactgtgtaaggggattatgaccgccctggtttctggatccttgtcaagaagaatttagctcaaatcaaaggttccacaacttcctaacgggttggactgcttgaatctctttataagcatgtgctatctattacaataagtcacttctattaagttatttttcggttgagtgtacttttgagttttggcagagttattataact

SEQ ID NO: 19633 - protein, 411 aa, Arabidopsis thaliana
MDSDQGKLFVGGISWETDEDKLREHFTNYGEVSQAIVMRDKLTGRPRGFGFVIFSDPSVLDRVLQEKHSIDTREVDVKRAMSREEQQVSGRTGNLNTSRSSGGDAYNKTKKIFVGGLPPTLTDEEFRQYFEVYGPVTDVAIMYDQATNRPRGFGFVSFDSEDAVDSVLHKTFHDLSGKQVEVKRALPKDANPGGGGRSMGGGGSGGYQGYGGNESSYDGRMDSNRFLQHQSVGNGLPSYGSSGYGAGYGNGSNGAGYGAYGGYTGSAGGYGAGATAGYGATNIPGAGYGSSTGVAPRNSWDTPASSGYGNPGYGSGAAHSGYGVPGAAPPTQSPSGYSNQGYGYGGYSGSDSGYGNQAAYGVVGGRPSGGGSNNPGSGGYMGGGYGDGSWRSDPSQGYGGGYNDGQGRQGQ

SEQ ID NO: 19634 - DNA, 1516 bp, Arabidopsis thaliana
  CDS (1)..(1485)
atgcaatcggataatggaaagcttttcatcggtgggatatcttgggacaccaatgaggaacgtctcaaggagtatttcagcagttttggagaagtgatcgaagctgtcatcttgaaagatcgtaccactggtcgtgctcgtggtttcggttttgttgtttttgctgatcctgctgttgctgagattgttatcaccgaaaaacataatattgatggcagattggttgaagccaagaaagctgttcccagagatgaccaaaacatggtaaatagaagcaacagcagtagcatccaaggttctcccggtggtccaggtcgcacaaggaagatatttgttggaggattaccttcttcggttacagagagtgatttcaagacgtattttgagcagtttggtacaactacggatgtggttgtcatgtatgatcacaacacacaaaggcctagaggtttcgggtttataacctacgattccgaggaggcggttgaaaaggtattgctcaagacattccatgaactaaatggtaaaatggttgaggttaagcgagctgttccaaaggagttatctccaggtccaagtcgcagtcctcttggtgcaggttacagctatggagttaatagggtcaataacctccttaatgggtatgctcaagggtttaatcccgctgcagttggaggctacggacttaggatggatggtcggttcagtccggttggtgctggaagaagcgggtttgcaaattacagttctggatacgggatgaatgtgaactttgatcagggattgcccacagggttcacgggaggtacaaattacaatggaaatgttgactatggccgaggaatgagcccgtactacattggtaacacaaacaggtttggtcctgcggttggctatgaagggggcaacggaggaggaaactcatccttcttcagttcggttacacggaacttatggggaaacaatggtggtcttaactataacaacaataatacaaactcaaactccaatacatatatgggaggatcatcaagtgggaacaacacacttagtggtccatttggaaattcaggagtcaattggggtgctcctggaggaggaaacaatgctgtgagtaacgagaatgtgaagtttggttatggaggaaacggtgaatctggttttgggttgggaacaggtggttatgcagcaagaaacccaggggctaacaaggcagcaccatcctcttcattctcttctgcctcagcaaccaacaacacgggttatgatacagcaggacttgcagagttttacgggaatggtgcagtttatagtgaccctacatggagatcaccaactcctgagacagaagggcctgctccttttagctatgggattggaggaggggttccttcttcagatgtttcagctagaagttcatctccaggttatgttggcagttacagtgtgaacaagagacaaccaaacagaggaattgctacttagtacaatcgtttttgttttaccacgatattgt

SEQ ID NO: 19635 - protein, 494 aa, Arabidopsis thaliana
MQSDNGKLFIGGISWDTNEERLKEYFSSFGEVIEAVILKDRTTGRARGFGFVVFADPAVAEIVITEKHNIDGRLVEAKKAVPRDDQNMVNRSNSSSIQGSPGGPGRTRKIFVGGLPSSVTESDFKTYFEQFGTTTDVVVMYDHNTQRPRGFGFITYDSEEAVEKVLLKTFHELNGKMVEVKRAVPKELSPGPSRSPLGAGYSYGVNRVNNLLNGYAQGFNPAAVGGYGLRMDGRFSPVGAGRSGFANYSSGYGMNVNFDQGLPTGFTGGTNYNGNVDYGRGMSPYYIGNTNRFGPAVGYEGGNGGGNSSFFSSVTRNLWGNNGGLNYNNNNTNSNSNTYMGGSSSGNNTLSGPFGNSGVNWGAPGGGNNAVSNENVKFGYGGNGESGFGLGTGGYAARNPGANKAAPSSSFSSASATNNTGYDTAGLAEFYGNGAVYSDPTWRSPTPETEGPAPFSYGIGGGVPSSDVSARSSSPGYVGSYSVNKRQPNRGIAT

SEQ ID NO: 19636 - DNA, 2421 bp, Arabidopsis thaliana
  CDS (434)..(1801)
ctctcttttaccatctttggcctgaagaaaaaaaaaaggaatccttcttaatggatttggtaaatcaattaagaaagcattacacaaaataaaaaaggaaagttttttaataagcttcattgagagagagatatagagagagaaaagagagagaggccatattttgataagagaagaagaacccttatagagaaagagaaagagagagacagagagagtggatggatgtcttatagaatgaacaaaacatcctctgtttctcttgtccttgtccctttttccagatcttaaggttttccacattttatcatctgggtcctctccttaatgatttgaagacactcaattcctatttgatcggggactagaatttggattctgtttcagacaaaagtagatttccctgtctctttcccgtttgattttcaataagatgaatccggaggagcaaaagatggaatctgcatcggatctgggcaagctcttcattggcgggatttcatgggacacagatgaagaacgactgcaagagtattttggcaagtatggagatttggttgaagctgtgatcatgagagaccgtactaccggacgtgcccgtggctttgggtttatcgtttttgcagatccttctgttgccgagagagtcatcatggacaaacacatcattgatggccgcacggtcgaggcgaagaaagctgtcccgcgggatgatcagcaagtgctaaaacgacacgccagtccaatgcaccttatctcacctagccatggtggtaatggtggtggagcacggacaaagaagatctttgttggaggtttaccgtctagcattactgaggccgagttcaagaactactttgatcagtttggtacaattgctgatgttgtggtaatgtatgatcataatacacagaggccaagaggctttggcttcatcacttttgattccgaagagtctgttgatatggttctccacaagacctttcatgagctaaacggaaaaatggttgaggttaaaagagcagtgccaaaggagctctcctcgactactcctaaccgaagcccacttattgggtatggtaacaactatggagtagtccctaataggtcttctgctaatagctacttcaatagttttcctcctggttataataataataatctaggctctgctggccggtttagtcctattggtagcggtagaaatgctttctctagcttcgggctcggattgaatcaagaactgaatttgaattcaaactttgatggaaacactcttgggtatagccggatccctggcaaccaatacttcaacagtgcttcaccaaaccgttacaactctccaattgggtacaacagaggagactctgcttacaacccgagcaacagagacttgtggggaaacagaagcgattcctctggtccaggttggaacttgggagtttcggttggtaacaacagaggaaactggggactttcttctgtggtgagcgataacaatggctatggaagaagctatggggctggttctggactttcggggttatcattcgcgggtaatacaaacggttttgatggctctataggggaattgtatagaggcagctcagtttatagcgactcaacatggcagcagtcaatgcctcatcatcagtcttctaatgagttagacggcttgtctcgctcttatggctttggtattgacaatgtaggctcagacccatcagccaatgcctcagaaggatactccggaaactacaatgtcggaaatagacaaacacatagaggtattgaagcatagaaagaaatcgacgaagagaagtgagaattgtagatcaagaagaacagccatttccgttgcagagtttgaagagttgttatttcgatatcaagtagagaaagaaaccaactttcttcatcacagtgagtttcttgttttgtttttttcgtcgttagcatcacaaacacaaaaaagagaagtttatttttactttaaaaattcttacataagataagatcagattggtagctgcaaagatacaacatggatgataaaaaaagatttggtttcgtctccatagcaataaccagagatcgttgattctcgatcactattctttaggtttctctccttcttcttccatgatttcttgatgttgtgtgctctgtttgtaactctaattgttaaaattttttatgttacagattttttttttcttttggtttttaaactttggattcgaattgttcatgggaacttttggatttttctattagcgtgagagaaaacacattgtgcaaaaggctccaaaatgattattttgttacatttcatactttttacctttgggtttcttttctcttctgcttacagtataatctatttattaagtacatgtggttaattcatgattttaaggt

SEQ ID NO: 19637 - protein, 455 aa, Arabidopsis thaliana
MNPEEQKMESASDLGKLFIGGISWDTDEERLQEYFGKYGDLVEAVIMRDRTTGRARGFGFIVFADPSVAERVIMDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSVYSDSTWQQSMPHHQSSNELDGLSRSYGFGIDNVGSDPSANASEGYSGNYNVGNRQTHRGIEA

SEQ ID NO: 19638 - DNA, 1641 bp, Mus musculus
  CDS (187)..(1353)
ggcgggagcggcggcggcagacgcgtgtggcgaccggcgcgggaaagcggcttcctagttagggaagcgttagccccgtggacccagcagctgtcaccggtgagctacttggaaggccgatttggcgagcttgtaggaggagcttgagaccttcacgtcccctccgactctcagctggaaggcaagatggttgaagcagatcgcccaggaaagctcttcattggtgggcttaatacagaaacaaatgagaaagcccttgaagcagtatttggcaagtatggacgaatagtggaaatacttttgatgaaagaccgggaaaccaacaaatcaagaggatttgcttttgttaccttcgaaagcccagcagatgctaaagatgcagctagagatatgaatggaaagtccttggatggaaaagccatcaaggtggagcaagctaccaaaccatcttttgaaagtggcaggcgtggaccacctccacctccaagaagcaggggccctcccagaggtcttcgaggaggaagtggaggaactaggggacccccttcacgtggaggatacatggatgatggtggttattccatgaactttaacatgagttcttccaggggaccacttccagtaaagagaggaccaccaccacgaagcgggggtccccctcctaaaagatcaacaccttccggaccagttcgaagcagcagtggaatgggcggaagaacaccagtgtcccgtggaagagatagctacgggggtccaccacgaagggaacccctgccatctcgcagagatgtttatttgtccccaagagatgatggatattctacaaaagatagctattcaagcagagattacccaagctcccgagacaccagagattatgcaccgccaccaagagattatacttaccgtgattacagtcattccagttcccgtgatgactatccatcaagaggctacggtgatagagatggatatggtcgggatcgtgactattcagatcatccaagtggaggttcctacagagattcatatgagagttatggaaactcacgcagtgcaccccctacacgagggccaccaccatcttatggaggaagcagtcgctatgatgattacagcagctcacgcgatggctacggtggaagtcgagacagttactcaagcagcagaagtgatctctactcaagtggccgtgatcgagttggcagacaagaacgagggcttcccccttctatggaaagggggtaccctcctccacgtgattcctacagcagttcaagccgaggagcgccaagaggaggtggccgtggagggagccgatctgatagagggggaggcagaagcagatattagaaacaaataagactttggatcaaggtctccatgcaaagaaacaaaggatggaaagtcttctgtcataactacccaaggactactaaaagaaaagttgtgttacctttttaaattttctgttttaagtttcccttcatttttgtgttcttgtgaggaaaaagtaaaacatgattaattttgatattatgaattgctttcaacaagcaaatgttaaatgtgtaagacttgacttgtactagtgttgtaattttccaagtaaaagtgttcctaaaaaaaaaaaaaaaaaaa

SEQ ID NO: 19639 - protein, 388 aa, Mus musculus
MVEADRPGKLFIGGLNTETNEKALEAVFGKYGRIVEILLMKDRETNKSRGFAFVTFESPADAKDAARDMNGKSLDGKAIKVEQATKPSFESGRRGPPPPPRSRGPPRGLRGGSGGTRGPPSRGGYMDDGGYSMNFNMSSSRGPLPVKRGPPPRSGGPPPKRSTPSGPVRSSSGMGGRTPVSRGRDSYGGPPRREPLPSRRDVYLSPRDDGYSTKDSYSSRDYPSSRDTRDYAPPPRDYTYRDYSHSSSRDDYPSRGYGDRDGYGRDRDYSDHPSGGSYRDSYESYGNSRSAPPTRGPPPSYGGSSRYDDYSSSRDGYGGSRDSYSSSRSDLYSSGRDRVGRQERGLPPSMERGYPPPRDSYSSSSRGAPRGGGRGGSRSDRGGGRSRY

SEQ ID NO: 19640 - DNA, 1041 bp, Mus musculus
  CDS (1)..(1041)
atggaggcaaatgggagcccaggcacctcgggcagcgccaacgactcccagcacgaccccggtaaaatgtttatcggtggactgagctggcagacctcaccagatagccttagagactattttagcaaatttggagaaattagagaatgtatggtcatgagagatcccacaacgaaacgctccagaggcttcggtttcgtcaccttcgcagacccagcaagtgtagataaagtattaggtcagccccaccatgagttagattccaagacgattgacccaaaagttgcatttcctcgtcgagcgcaacctaagatggtcacaagaacaaagaaaatcttcgtaggaggattgtctgcgaacacagtagtggaagatgtaaagcagtatttcgagcagtttggcaaggtagaggatgcgatgctgatgttcgacaaaaccaccaacaggcacagagggtttggctttgtcacctttgagaatgaagacgttgtggagaaagtctgtgagattcatttccatgaaatcaataataaaatggtagaatgtaagaaagctcagccgaaagaagtcatgttcccacctgggacaagaggccgggcccgggggctgccatacaccatggatgcgttcatgcttggcatggggatgctgggctaccccaactttgtggcaacctatggcagaggctaccccggatttgctcctagctatggctaccagttcccaggcttcccggcagcagcttatggaccagtggcagcggcagctgtggcagcggctcgaggatcagtcctgaatagctacagtgctcaaccgaattttggcgcgcccgcttccccggcaggctccaacccggcgcggcccggaggcttcccgggggccaacagcccaggacctgtcgccgatctctacggccctgccagccaggactccggagtggggaattacataagcgcggccagcccacagccgggctccggcttcggccacggcatagctggacctttgattgcaacggcctttacaaatggataccactga

SEQ ID NO: 19641 - protein, 346 aa, Mus musculus
MEANGSPGTSGSANDSQHDPGKMFIGGLSWQTSPDSLRDYFSKFGEIRECMVMRDPTTKRSRGFGFVTFADPASVDKVLGQPHHELDSKTIDPKVAFPRRAQPKMVTRTKKIFVGGLSANTVVEDVKQYFEQFGKVEDAMLMFDKTTNRHRGFGFVTFENEDVVEKVCEIHFHEINNKMVECKKAQPKEVMFPPGTRGRARGLPYTMDAFMLGMGMLGYPNFVATYGRGYPGFAPSYGYQFPGFPAAAYGPVAAAAVAAARGSVLNSYSAQPNFGAPASPAGSNPARPGGFPGANSPGPVADLYGPASQDSGVGNYISAASPQPGSGFGHGIAGPLIATAFTNGYH

SEQ ID NO: 19642 - DNA, 1559 bp, Arabidopsis thaliana
  CDS (247)..(1386)
gcttcctcctcaaaaggtgaaaaattagagcgagagagatagagagagatttcaaaacgaaaatccagagaaagggtcttgccagtttagggcatccttgtgggtgagagagcgattgagagatttcaaaaggaggaagaggaagatacgagtgtgagagagatttagagggagagaagaaagagagattctttttgagtgtgttaaggtttcatttcctctgcagatctacatttatctcttctcatggaacggaagcttgtggttttgggaatcccgtgggatattgattccgatgggcttaaggattacatgtcaaaatttggagacttggaggattgtattgtcatgaaggatcgatcaactggaagatctcgtggatttggatatgtcacttttgcttcagctgaagatgcaaagaatgctttgaaaggtgaacactttttagggaacaggatcttggaagttaaagtggctacaccaaaggaagagatgagacagcctgcaaaaaaagtgacgaggatcttcgttgctcgaatcccttcatcagtctctgaatcagatttccgaagccattttgagaggtatggggaaataacagacttatacatgcctaaggactacaactcgaagcagcaccgaggaatagggtttatcacattctctagtgctgattcagtggaggatctgatggaggacactcatgatctgggaggtacaacagttgctgttgatcgggcaacaccaaaagaggatgatcatccgcctaggccaccgccagtggctagaatgtcgcgcccacccgtggctattgcaggtggatttggagctccaggtggttatggagcttatgatgcttacatttctgcagctacaagatacgcagcgcttggtgcccctactttgtatgataatcccgccacgttttatggaagaggggaaccaaccacaaggggaataggaaacaagatctttgttggacggcttcctcaagaagcatccgttgatgatcttcgcgattattttgggagatttggccatattcaagatgcttatattccaaaggacccaaagagaagtggacatagaggttttggatttgttacctttgctgaaaatggtgttgcagatcgtgtagcccgaagatctcatgaaatctgtggacaagaggtagcaatagattcagcaacgcctcttgatgaagctggacctagcgctggcgcaagttccatgttaagttcttctcgtcctgaatattttggtggctatggaggtcctatgcgcgcatttggtcgaatgtatggaggcatgagcttggacgattggggatatggaatgccaaacgcaagaccatcaagaccagaccggaggtaccggccatattaatgcagcagaccaacatttcattagctttggctttgtctttttatagaaacttcactttgtcagatctattttaattgaagcttttgtttatgttttaccctcggaaccagtgaacctactttgtgtggtgtattatgcaaacaagtaaaaagttggaacagagaaagctttac

SEQ ID NO: 19643 - protein, 379 aa, Arabidopsis thaliana
MERKLVVLGIPWDIDSDGLKDYMSKFGDLEDCIVMKDRSTGRSRGFGYVTFASAEDAKNALKGEHFLGNRILEVKVATPKEEMRQPAKKVTRIFVARIPSSVSESDFRSHFERYGEITDLYMPKDYNSKQHRGIGFITFSSADSVEDLMEDTHDLGGTTVAVDRATPKEDDHPPRPPPVARMSRPPVAIAGGFGAPGGYGAYDAYISAATRYAALGAPTLYDNPATFYGRGEPTTRGIGNKIFVGRLPQEASVDDLRDYFGRFGHIQDAYIPKDPKRSGHRGFGFVTFAENGVADRVARRSHEICGQEVAIDSATPLDEAGPSAGASSMLSSSRPEYFGGYGGPMRAFGRMYGGMSLDDWGYGMPNARPSRPDRRYRPY

SEQ ID NO: 19644 - DNA, 1665 bp, Arabidopsis thaliana
  CDS (108)..(1379)
gtcgctcctttctcttctccaagggttttagggcttttaggcggctgccgcttctttttcatcttcttcttcgttctccgaaggtttagggtttcgattttcccatcatggatccttatggaacggaaacagttatcgaagacgaaatccacgatcctaaaccatccgaagatattgaagacgatgacgacaaatctcagcctcactctggtggcggcgtcgatagtgctggaaagatatttgttggaggtttagccagggagacaacttcagctgaattcctcaagcattttgggaaatatggagagatcactgattctgtgattatgaaggataggaaaactggacagcctcggggatttgggtttgtcacatatgctgattcctctgtggtcgacaaagttatccaagacaatcacattataattggcaagcaggttgaaattaagcggacgataccaagaggatccatgagctctaacgatttcaaaaccaagaagatatttgttggtggaattccttcatctgtggatgatgatgaattcaaggagttctttatgcaatttggagagctgaaggaacatcagattatgcgtgatcactcaactggaagatcacgtggctttgggtttgttacatatgaaagtgaagatatggttgatcatctcttggcgaaagggaacagaattgagctttcagggactcaggtagagataaagaaggcagagcctaaaaaaccaaactcggttacaaccccatcgaagcggttcggtgactctcgctctaactttggtggaggttatggagatggttatggtggcggacacggtggaggatatggtggtccaggtggtccttacaagtcaggtggcggttatggaggtggccggtctggtggttatggagggtacggaggagaattcggtgggtatggcggtggtggatatggtggtggtgtgggaccttatagaggagaaccagctcttggatattctggtcgttatggaggaggaggcggtggttacaatagaggtggatacagtatgggagggggcggtgggtacggtggtggaccaggtgatatgtatggtgggtcatacggtgaaccaggaggtggttatggtggacctagtggcagttatggaggcgggtatggtagtagcggaataggtgggtatggtggtggaatgggtggtgctggtggcggaggctatagaggaggtggtggctatgatatgggtggagttggagggggaggcgcaggaggatatggtgctggtggtggcggaaacggtggaggatcattttatggaggaggaggaggtagaggtggatatggaggcgggggcagcggacggtaccatccttatggaaggtagagagttcgatgaaagcttgaatcttcttcttacttgttgtgtcatgcttagcatcatgtatggttatcaagattgatagctagtcattgtattttgagagatgaggcttttagggctttgattcccctgagtagtttaaatcaatacattttttagattataattatctcggcgtaacaatgccagattattttttactctcatgtgacatctttagagttagcttgtagcaacgcttttgaggttttggctcaaatcttattagaagaagactcttgtttgtacc

SEQ ID NO: 19645 - protein, 423 aa, Arabidopsis thaliana
MDPYGTETVIEDEIHDPKPSEDIEDDDDKSQPHSGGGVDSAGKIFVGGLARETTSAEFLKHFGKYGEITDSVIMKDRKTGQPRGFGFVTYADSSVVDKVIQDNHIIIGKQVEIKRTIPRGSMSSNDFKTKKIFVGGIPSSVDDDEFKEFFMQFGELKEHQIMRDHSTGRSRGFGFVTYESEDMVDHLLAKGNRIELSGTQVEIKKAEPKKPNSVTTPSKRFGDSRSNFGGGYGDGYGGGHGGGYGGPGGPYKSGGGYGGGRSGGYGGYGGEFGGYGGGGYGGGVGPYRGEPALGYSGRYGGGGGGYNRGGYSMGGGGGYGGGPGDMYGGSYGEPGGGYGGPSGSYGGGYGSSGIGGYGGGMGGAGGGGYRGGGGYDMGGVGGGGAGGYGAGGGGNGGGSFYGGGGGRGGYGGGGSGRYHPYGR

SEQ ID NO: 19646 - DNA, 1395 bp, Oryza sativa
  CDS (1)..(1395)
atggagtcggatcaggggaagctgttcatcggcggcatctcgtgggagaccaccgaggagaagctccgcgaccacttcgccgcctacggcgacgtctcccaggccgccgtcatgcgcgacaagctcaccggccgcccccgcggcttcggcttcgtcgtcttctccgacccttcctccgtcgacgccgccctcgtcgacccccacaccctcgacggccgcacggttgatgtgaagcgggcgctctcgcgggaggagcagcaggccgcgaaggcggcgaaccctagcgcgggggggaggcacgcctccggtgggggcggtggtgggggaggcgccggtggtggtggtggtggcggcggtggtgacgccggcggtgcgcggacgaagaagatcttcgtcggcgggctgccctccaacctgacggaggacgagttccggcagtacttccagacctacggggtcgtcaccgacgtcgtcgtcatgtacgaccagaacacgcagcggccgagggggttcgggttcatcaccttcgacgcggaggacgccgttgaccgcgtgctgcacaagaccttccatgacctgagcgggaagatggtggaggtgaagcgcgccctgcccagggaggccaaccctggctccggcagtggtggccgttccatgggaggcggcggtgggggttaccagagtaacaatgggccgaactccaattctgggggctatgatagcagaggtgacgctagcaggtatggtcaggcgcagcagggtagtggtggttatcccggttatggtgctggaggatatggtgctggtacggttggttatggatatgggcatgctaaccctggaactgcgtatgggaattatggggctggaggatttggaggtgttcctgctgggtatggtgggcattatggcaatccaaatgcgcctggttcaggttaccagggtggtcctccaggagcaaacagaggaccatggggtggtcaagctccgtctggttatggcactgggagttatggtggcaatgcaggctatgctgcttggaacaactcttctgctggaggtaatgcacccactagtcaggccgctggtgcaggcacaggctatgggagccagggctatggatatggtggatatggaggagatgcatcgtatggtaatcatggtggatatgggggttatggaggaaggggagatggtgctggcaatccagctgctggcggtggatctgggtatggtgctggctatggaagcgggaatggcggttctggttatccaaatgcttgggctgatccttcacaaggtggagggtttggggcttcagtcaatggagtgtctgaaggccaatcaaattatggcagtggttatggtggtgtgcaacctagggttgctcagtaa

SEQ ID NO: 19647 - protein, 464 aa, Oryza sativa
MESDQGKLFIGGISWETTEEKLRDHFAAYGDVSQAAVMRDKLTGRPRGFGFVVFSDPSSVDAALVDPHTLDGRTVDVKRALSREEQQAAKAANPSAGGRHASGGGGGGGGAGGGGGGGGGDAGGARTKKIFVGGLPSNLTEDEFRQYFQTYGVVTDVVVMYDQNTQRPRGFGFITFDAEDAVDRVLHKTFHDLSGKMVEVKRALPREANPGSGSGGRSMGGGGGGYQSNNGPNSNSGGYDSRGDASRYGQAQQGSGGYPGYGAGGYGAGTVGYGYGHANPGTAYGNYGAGGFGGVPAGYGGHYGNPNAPGSGYQGGPPGANRGPWGGQAPSGYGTGSYGGNAGYAAWNNSSAGGNAPTSQAAGAGTGYGSQGYGYGGYGGDASYGNHGGYGGYGGRGDGAGNPAAGGGSGYGAGYGSGNGGSGYPNAWADPSQGGGFGASVNGVSEGQSNYGSGYGGVQPRVAQ

SEQ ID NO: 19648 - DNA, 1512 bp, Neurospora crassa
  CDS (1)..(1512)
atgttcattggtggcctgaactgggagactacagaccaatccctgagagattacttctcgcagttcggcgaggttgtagaatgcaccgttatgagagatggcgccaccggtcgctcgcgtggcttcggatttcttaccttcaaggacccaaaaacagtgaacattgttatggtcaaggaacactaccttgacggcaagatcatcgacccgaagcgcgccattccccgcgatgagcaagagaagacttccaagatctttgttggtggcgtttctcaggagaccacggaccacgagttccgcgagtactttgcccaattcggccgtgtcgtcgatgccaccctcatgatggataaggacactggccgtccccgtggtttcggcttcgtcacctttgagtccgaagctggcgtcgaggcgtgtctctctgccaaccttgagatccatggtaagcctatcgaagtcaagaaagcccaaccccgcggcaacctgcgcgaggaggctgaggaagctgcgagacgcggcggcggcaagttcggccagcgccgcagcggtcagcaaggtggtggcatggatgatggctccggtcaaggcggtatgaatgtcatgggcggcatgggcggcgccggcactgccggtatgaccccccaactcatggcccagtatctccagcggatgcagcaggccttccagatgatgcagcaacagatggccatgaacaggggcatgcagaaccccatggtccaaatgatgcagatgcagcagatgcaacaaatgcaacaacagatgatggccgctcagcaagcccatgccgcggctcaggcgggtgcaggacagcaaggcagcggtggccgcgctggtagtgtcggcgcgggtcaggggcctaacgcgcagaacccccaggcgatggctgccgccatgggcatgaacccggcgatgatgcagcaaatgatgggcggcgctggcggtcccggagccggtggtgctgatggaggtgccggtggtcctaaggggggattcggcggcttcgacggacagcagggtttcgatggccagcagcgcggccccggcggcggtaatcgcggtcctcgcaacgatcccgctggtggcaactacggcggtggaatgcccggtgctggagcgggctacaacatgggcgccaccagctgggagggcatgtacgatgacgtcccccaaccgatgatgggcggtcccggtttcggtcctggcatgggcggcatgggtatgggtatgggcggcggcatgggcggtggcggtggtggtggaggacgtggcggtttccataagggtcgcggccatcaccacggcagcggcggtggtcatcagcagggcggccatcaaggctcgcattcgcccggcggaccggtcgacccggccagcgcacctcctcctaacgcccctacgggtcccaagaacgctggcaaacctggtgcaaactatcgcggtggtggaagaggtggatccaggggcttccatccttatgctcggggttaa

SEQ ID NO: 19649 - protein, 503 aa, Neurospora crassa
MFIGGLNWETTDQSLRDYFSQFGEVVECTVMRDGATGRSRGFGFLTFKDPKTVNIVMVKEHYLDGKIIDPKRAIPRDEQEKTSKIFVGGVSQETTDHEFREYFAQFGRVVDATLMMDKDTGRPRGFGFVTFESEAGVEACLSANLEIHGKPIEVKKAQPRGNLREEAEEAARRGGGKFGQRRSGQQGGGMDDGSGQGGMNVMGGMGGAGTAGMTPQLMAQYLQRMQQAFQMMQQQMAMNRGMQNPMVQMMQMQQMQQMQQQMMAAQQAHAAAQAGAGQQGSGGRAGSVGAGQGPNAQNPQAMAAAMGMNPAMMQQMMGGAGGPGAGGADGGAGGPKGGFGGFDGQQGFDGQQRGPGGGNRGPRNDPAGGNYGGGMPGAGAGYNMGATSWEGMYDDVPQPMMGGPGFGPGMGGMGMGMGGGMGGGGGGGGRGGFHKGRGHHHGSGGGHQQGGHQGSHSPGGPVDPASAPPPNAPTGPKNAGKPGANYRGGGRGGSRGFHPYARG

SEQ ID NO: 19650 - DNA, 1179 bp, Arabidopsis thaliana
  CDS (1)..(1179)
atggattataactcagatcgtggttatgatgactcttaccatcatcacgtacacgacgaacaattaccacaatcggattttgaagtggagacctttgatgaccggaggaacggtggtgcagccgttgatactggtgggattcagatgaagcattccgttgaccatcgccattcttcttcgtccatgtcttctcctgggttcgtgctggttattaagatattgatggggaggtttcttgtggtgccttttgtctttgtttatgttaggaaactgttcgtaggtggagtttcttgggaaacaactgcagaaacttttgcgaattactttggaaagtttggagaagttgtcgactctgtaatcatgacagatagaataactgggaacccaagggggtttgggtttgtcacttttgctgattcagctgttgctgagaaagttttggaggaagatcatgtaatagatgaccgaaaggttgatctgaaaaggacacttcctagaggggacaaggatactgatatcaaagcggtatcaaagaccaggaaaatctttgttggtggacttccaccacttttggaagaagatgaactgaagaattatttctgtgtatatggtgacataattgagcatcagatcatgtatgaccaccacacgggaaggtcaaggggatttggttttgtaaccttccagaccgaagattctgttgatagacttttctccgatggaaaagttcacgagctcggtgacaaacaggtggaaataaaaagggccgaaccaaagagaaccgggagagataacagctttcgatcctatggtgctagtggcaagtatgatcaggaagatagttatagtgggaaagctaatgaagattacagtatgtattcgggttatggtggttatggcggttatggagcctacgcagggaactccatggttaaccctgctggtttttatggttatggtggtgggtatggctatggttatggctatggaggtcaaatgttcaacatgggctatggagctggcggttatagccatatgggtagtggctatggtgttgctgcggctgctgcttatggaggtggaaaatctcatggaaacggaaataacggctcaagtagtggcaaaggaaatgggactaatggttctgggccagatcgataccatccttatcaaaagtag

SEQ ID NO: 19651 - protein, 392 aa, Arabidopsis thaliana
MDYNSDRGYDDSYHHHVHDEQLPQSDFEVETFDDRRNGGAAVDTGGIQMKHSVDHRHSSSSMSSPGFVLVIKILMGRFLVVPFVFVYVRKLFVGGVSWETTAETFANYFGKFGEVVDSVIMTDRITGNPRGFGFVTFADSAVAEKVLEEDHVIDDRKVDLKRTLPRGDKDTDIKAVSKTRKIFVGGLPPLLEEDELKNYFCVYGDIIEHQIMYDHHTGRSRGFGFVTFQTEDSVDRLFSDGKVHELGDKQVEIKRAEPKRTGRDNSFRSYGASGKYDQEDSYSGKANEDYSMYSGYGGYGGYGAYAGNSMVNPAGFYGYGGGYGYGYGYGGQMFNMGYGAGGYSHMGSGYGVAAAAAYGGGKSHGNGNNGSSSGKGNGTNGSGPDRYHPYQK

SEQ ID NO: 19652 - DNA, 858 bp, Rattus norvegicus
  CDS (1)..(858)
atgtcggacgcggctgaggagcagcccatggagacgacgggcgccaccgagaacggacacgaggccgcccccgaaggcgaggccccggtcgagcctagccctggggcagcggcccccgcgactccggcggggtctgggggcgggaccacggccgccccgagcgggaaccagaacggcgccgaaggcgaccagatcaacgccagcaagaacgaggaggacgcgggaaaaatgttcgttggtggtctgagctgggataccagcaaaaaagatctaaaggattattttactaagtttggagaggtcgttgactgtacaataaaaatggatccgaacactggtcgatcaagagggtttgggtttattctcttcaaagattcttctagtgtggagaaggtcttagatcagaaggagcacagactggatggtcgtgtcattgaccctaaaaaggctatggctatgaagaaggaccctgtgaagaaaatctttgtgggaggtctaaaccctgaagccacagaggaaaagatcagagaatactttggccagtttggggagattgaggccattgaacttccaatagatcccaagttgaacaaaagacggggttttgtttttattacatttaaagaggaagaccctgtgaagaaagttctggagaaaaaattccatactgtcagtggtagcaagtgtgaaatcaaggttgcccagccgaaagaggtgtaccagcaacagcagtatggctctgggggccgaggaaatcgcaatcgagggaaccgaggcagtggtggaggtcagggtagtacaaattacgggaagagccagcgacgtggtggtcatcagaataactacaagccatactga

SEQ ID NO: 19653 - protein, 285 aa, Rattus norvegicus
MSDAAEEQPMETTGATENGHEAAPEGEAPVEPSPGAAAPATPAGSGGGTTAAPSGNQNGAEGDQINASKNEEDAGKMFVGGLSWDTSKKDLKDYFTKFGEVVDCTIKMDPNTGRSRGFGFILFKDSSSVEKVLDQKEHRLDGRVIDPKKAMAMKKDPVKKIFVGGLNPEATEEKIREYFGQFGEIEAIELPIDPKLNKRRGFVFITFKEEDPVKKVLEKKFHTVSGSKCEIKVAQPKEVYQQQQYGSGGRGNRNRGNRGSGGGQGSTNYGKSQRRGGHQNNYKPY

SEQ ID NO: 19654 - DNA, 1470 bp, Rattus norvegicus
  CDS (212)..(1210)
cgcccgggcaggtgcgggaaaaatgttcgttggtggtctgagctgaggtcttcctactcactgggctcgagcggccgcccgggcaggtctgtggacccgggacaagccctaggggggtccgagtgtgaccgcggccaagcccgctcgccttctgcggcgagtagggcctcgcggcgtcatcggcggcgaggaggccgccggcctgccgaccatgtcggacgcggctgaggagcagcccatggagacgacgggcgccaccgagaacggacacgaggccgcccccgaaggcgaggccccggtcgagcctagccctggggcagcggcccccgcgactccggcggggtctgggggcgggaccacggccgccccgagcgggaaccagaacggcgccgaaggcgaccagatcaacgccagcaagaacgaggaggacgcgggaaaaatgttcgttggtggtctgagctgggataccagcaaaaaagatctaaaggattattttactaagtttggagaggtcgttgactgtacaataaaaatggatccgaacactggtcgatcaagagggtttgggtttattctcttcaaagattcttctagtgtggagaaggtcttagatcagaaggagcacagactggatggtcgtgtcattgaccctaaaaaggctatggctatgaagaaggaccctgtgaagaaaatctttgtgggaggtctaaaccctgaagccacagaggaaaagatcagagaatactttggccagtttggggagattgaggccattgaacttccaatagatcccaagttgaacaaaagacggggttttgtttttattacatttaaagaggaagaccctgtgaagaaagttctggagaaaaaattccatactgtcagtggtagcaagtgtgaaatcaaggttgcccagcccaaagaggtgtaccagcaacagcagtatggctctgggggccgaggaaatcgcaatcgagggaaccgaggcagtggtggaggtcagagtcagagttggaatcagggctacggcaactactggaaccagggctacggctaccagcagggctacgggccgggctatggcggctacgactactcgccctatggctattacggctacggccccggctacgactacagtcagggtagtacaaattacgggaagagccagcgacgtggtggtcatcagaataactacaagccatactgagaggcagcaggagcggccgagtgacgaccgcacacgctttgtttggacgcggagtgaacacaattatgtaccaaatttaacttggcaaacttttatggcctgtcccatgtgcatcttatttaaaatttcccccggaaatcactctcctgtttactattccagagctctagttgttgtaggcagcgtgtggcgtctcagaggtcagagcggcattagggggctgattttattaccaggttaccctgttctagattggaggg

SEQ ID NO: 19655 - protein, 332 aa, Rattus norvegicus
MSDAAEEQPMETTGATENGHEAAPEGEAPVEPSPGAAAPATPAGSGGGTTAAPSGNQNGAEGDQINASKNEEDAGKMFVGGLSWDTSKKDLKDYFTKFGEVVDCTIKMDPNTGRSRGFGFILFKDSSSVEKVLDQKEHRLDGRVIDPKKAMAMKKDPVKKIFVGGLNPEATEEKIREYFGQFGEIEAIELPIDPKLNKRRGFVFITFKEEDPVKKVLEKKFHTVSGSKCEIKVAQPKEVYQQQQYGSGGRGNRNRGNRGSGGGQSQSWNQGYGNYWNQGYGYQQGYGPGYGGYDYSPYGYYGYGPGYDYSQGSTNYGKSQRRGGHQNNYKPY

SEQ ID NO: 19656 - DNA, 1374 bp, Ciona intestinalis
  CDS (48)..(1229)
gttacgtgattaattttatcgatttctagtaacatctgtacataaacatgtcacaaaacgatggcgaagaagcaggaaaaatctttgttggtggtcttgcccgacaaactacattagaaggtctcagaagttactttgaaaactatggagaagtctcggattgtgtcctaatgaaggataaagagactgggttctcccgagggttcggttttgtaactttcacaaatccatcaagtgttgcagctgtagtaaaagctagaccccacaacttggataataaaatgattgacccaaagccatgtacaacaaaagctgcacaacaacaaaagaaagtgagttcaacaaattacagcaaagctcataaaatattcattggtggaatttcaatggaagcatctgaagccgacgtacaaagctattttgagcgttatggaaccgtggttgaagttgtgtttgttgtgaacaaagaagacacaagcaaaccacacaaagggtttggtttcgtaacatttgaagacgaatcatccgtagatcaagcaatcgcgaaacattaccatatcatcaaagataaaagagttgaagctaaaaaagcggagtcaagagacaaaatgggagggggcaggaacgatcaacagcagggttatgggatgggatatggacaagggaacaacatgatgtataaccaaggtatgaatcaagcaggtggaaaccggatgggaggacagaacatgatgggtaactatggatacgggaaccagaattttccaacagcctaccctcaacaacaaggttacggtggcaatcaaggctatggttacggatatgggtatggaggcaacatgggtggcaacatgcctggccaaatgggtgggatgcaaggtgggcaaatggggggaatgcccaaccagatgggagggaatatgcaagggggtcagatgggtggaaacatgggaaacatgcagggtggatatcaaccaggcatgatgggaatgcaagggagaggggttaataatggaaatggagctcaaccaaatgctgcgagcacgtatccgcaaaaccccacaagttacggaccaatgccaacatctggaggaggatacaaccaaggcaacactggttcaaacaactcgagtggtcaagcaaatactggcaacactggtggaggaagttatggacagaagagtggaggaggttctaacaactcgggctaccatccttaccgaagataaacaataaacattgtattcaaaattgtcaaacttttaatcatgatcttacatatgtacaatagattcacgccaggccaacaacctttttatttcgcttttataaataaaacagtgaaccaacacttcaaaaaaaaaaaaaaaaaaa

SEQ ID NO: 19657 - protein, 393 aa, Ciona intestinalis
MSQNDGEEAGKIFVGGLARQTTLEGLRSYFENYGEVSDCVLMKDKETGFSRGFGFVTFTNPSSVAAVVKARPHNLDNKMIDPKPCTTKAAQQQKKVSSTNYSKAHKIFIGGISMEASEADVQSYFERYGTVVEVVFVVNKEDTSKPHKGFGFVTFEDESSVDQAIAKHYHIIKDKRVEAKKAESRDKMGGGRNDQQQGYGMGYGQGNNMMYNQGMNQAGGNRMGGQNMMGNYGYGNQNFPTAYPQQQGYGGNQGYGYGYGYGGNMGGNMPGQMGGMQGGQMGGMPNQMGGNMQGGQMGGNMGNMQGGYQPGMMGMQGRGVNNGNGAQPNAASTYPQNPTSYGPMPTSGGGYNQGNTGSNNSSGQANTGNTGGGSYGQKSGGGSNNSGYHPYRR

SEQ ID NO: 19658 - DNA, 1357 bp, Halocynthia roretzi
  CDS (38)..(1045)
tattttaaatatataaaatactgtaggataaaacagcatggcccagcatgatgatgaagtcggcaagatttttattggtggtctagctcgtcagacagaagatgacggattgagagcttattttgaatcttttggtgaagtagtcgagtcgattgtcatgaaagataaggttactggcttctcccgtggatttggttttgtaaaatttagtgatcagcagagtgtgagcaaagttctgaaaaatggaccacacagcttggataacaagaaaatcgaccccaaaccttgtacaccaaagggtatacagcaagaaaagaaatctgcagccatggagcatacgcaatctcataagatttttatcggcggtattgcacagagttcgacaactgaagatgtcaaaaagtacttcgaagagggctttggcacagtcaatgaagtagtttttgtaatcaacaaagaagacaatcgacacaaaggatttgggtttgtcacttttgcgaatgagcaagcagtcaataaagcagttgatatgcactttcatgaaattggagataagcagattgaagctaagagagctactccgagagaaaaaatgccacctaggtctcatgataacaatcaaggaatgtccaatgatgcctacgggtatggttatggtggccagggccctcaaggaggagggtggatgcaaggccctgcaggtgcaaatgcaatgatgggatatggttatggttatggtcagggattcccaaccagttatccgcagggttacggacaaggggggtattacgggtatggttataatccgggggcatatggtggaatgggccaaatgaacaaaggagacgcgggcaagggaacgaattacagtaacatgggtagctatcaacaaacgacttctggttatggacctgctagagccaatcagtcttatggaggaggatcagattacaataacggatatgggaaaaatggcggggatgcttctggtggcggaggtggtggaaggtcttcttcacagggctatcacccatataagagatgaatcagtttctggtaaaatcaggccctttttaagctaccatacagaagtccaaattgcacaatttgtgcctacatgccttgattttaccaatgcaggatgaggcatgtatgttacctgctgaaattctgcaaatattgtttcaccttcctagaaaccctgattattccttttgtacatttcactttttgagtacctgatggggtttgcaaacctcatttcctatgtactgattctgtcgtagtgttgtgtaattgtaattaagttttatgtattaaacctaatgtagaatattgtaaaaaaaaaaaaaaaaaa

SEQ ID NO: 19659 - protein, 335 aa, Halocynthia roretzi
MAQHDDEVGKIFIGGLARQTEDDGLRAYFESFGEVVESIVMKDKVTGFSRGFGFVKFSDQQSVSKVLKNGPHSLDNKKIDPKPCTPKGIQQEKKSAAMEHTQSHKIFIGGIAQSSTTEDVKKYFEEGFGTVNEVVFVINKEDNRHKGFGFVTFANEQAVNKAVDMHFHEIGDKQIEAKRATPREKMPPRSHDNNQGMSNDAYGYGYGGQGPQGGGWMQGPAGANAMMGYGYGYGQGFPTSYPQGYGQGGYYGYGYNPGAYGGMGQMNKGDAGKGTNYSNMGSYQQTTSGYGPARANQSYGGGSDYNNGYGKNGGDASGGGGGGRSSSQGYHPYKR

SEQ ID NO: 19660 - DNA, 1518 bp, Drosophila melanogaster
  CDS (91)..(1377)
ggattttcttgcctgtcattcaatttgtggttggcttcacctgagtgctgtagtaaatcaggctattttaattttgacatctcttcgaaaatggatgcgggaaattgtgcctcgtcggcctgccttggagattgcaaaggcgacggaaagacggccattaaggaagaaggctacgagcatttgcgcaagatcttcattggcggcctatccactcagacgaccgtggaaacgctgcgcggattctttagtcagttcggtatcgtggccgatgcggtggtcttgcgggatccggtgagcaaccattctaggggctttggcttcgtcacctatgtggatcccaagtccgtggaaattgtccaaagggcacgtccccacaccattgataataaaattgtggagaccaagcacgcactgccacgtcaagatttcaaaaggggtggcggcgttggttccgttgtcggaagttttggctgtgaagccggtttcatgaactcgaaaaggatctttctgggcggcttgaaggaataccacgatgagaatatcgtacgcgaatacttttcgcagtttggccctgtggccagcgtgaaattgctcatggacagggagaccggacgtcagcgggcatttggcttcctcgagttcgtggatccatccagtgccgagaaggcattggcaccgcgcaagcactggattcttcagacattggtggaggtgaagagatccacccagaaggccgacaggcgttttcggttccccatatttagctcggttcgagccggctacattccgccccagccggccactgctgatagctacaattacaacaatcccaactacaatccctatctggcccaatccgtcctgccgccatcggcattcactaacggctgggcccactatgtaattccgatggcacccaagccaacacccggacagaacatggctgcttcgttgccgtcacagcagctggcagagcactcgctcaacggacacggtccggacatgtggtcctcctatccgaagaccggtatctactcggcccaggagtggacttccagcaaagtggccgaatggggaccgaaggccgggcacaaacatgcccagacatcgaccaacgatcgtgccaaaatcgatttgaaagaactccaggcagctactttcaataacaagctggatttcggcgcccgtggcgacgcggatcgcatgtcgggagctggcttgggattgggtttgactggcggtgccgccgtgggagttggagctattaagaagtggcccacccaggactataaggtcttcaagccagctaaatctccgaccaacggagtgattccgaagatcggcaaagaggctacaacaccaccctacggtatctaagtggcggacgatggaacgcagttaaacccaatttactgccacagtttaatgctattactacaataatttgcaggcgattccgttcaagatatttaataaataataaagcatacgggtccttttgagacttaaaatcgtaaa

SEQ ID NO: 19661 - protein, 428 aa, Drosophila melanogaster
MDAGNCASSACLGDCKGDGKTAIKEEGYEHLRKIFIGGLSTQTTVETLRGFFSQFGIVADAVVLRDPVSNHSRGFGFVTYVDPKSVEIVQRARPHTIDNKIVETKHALPRQDFKRGGGVGSVVGSFGCEAGFMNSKRIFLGGLKEYHDENIVREYFSQFGPVASVKLLMDRETGRQRAFGFLEFVDPSSAEKALAPRKHWILQTLVEVKRSTQKADRRFRFPIFSSVRAGYIPPQPATADSYNYNNPNYNPYLAQSVLPPSAFTNGWAHYVIPMAPKPTPGQNMAASLPSQQLAEHSLNGHGPDMWSSYPKTGIYSAQEWTSSKVAEWGPKAGHKHAQTSTNDRAKIDLKELQAATFNNKLDFGARGDADRMSGAGLGLGLTGGAAVGVGAIKKWPTQDYKVFKPAKSPTNGVIPKIGKEATTPPYGI

SEQ ID NO: 19662 - DNA, 2303 bp, Drosophila melanogaster
  CDS (371)..(1636)
gcgatttatcatataagttaggttataatatcgtatgcatcaaaatcatacaattatttataagctagttttttaaggaaaaaacacttaaatttagtgaatttgcagtgcgaaatctttaaaaaaccacagacgaacacttggcacaaacgaaagttacgtgtgaacgtcgtggcttttgtttaattgttttgaaggaaaaaagaactttggcaacgttgaaaccaacctaagatattgcccaaaaagcaaccaaccgaacacaagttaatttctttgcaccccgtgttaataaaaaagcggcaagattacgtcaattattgagaacctacccggcgccatagctcacaaccacaaccaaaacaacatcatggaggaagacgagaggggcaaactttttgtgggcggtctatcctgggagacgacgcaggagaacctgtcgcgctacttctgccgcttcggggacatcattgactgtgtggtgatgaagaacaacgagagcggcaggtcgcgcggctttggcttcgttaccttcgccgatcccaccaacgtcaaccacgtgctgcagaacggaccgcacacgctcgacggtcgcaccatcgaccccaagccgtgcaatccgcgcactctgcagaaaccgaagaagggcggcggctacaaggtcttcctgggtggcctgccctcgaacgtcaccgagaccgatctgcggaccttctttaaccgctacggcaaggtcaccgaggtggttatcatgtacgaccaggagaagaagaagtcccgcggcttcggctttctctccttcgaggaggagtcctccgttgagcacgtgaccaacgagcggtacatcaatctgaatggcaagcaggtcgaaatcaagaaggccgagcctcgtgatggatctggcggccaaaactccaacaacagtaccgtgggaggcgcctatggcaagcttggtaacgagtgcagccactggggaccgcaccatgctcccatcaacatgatgcagggccagaatggccagatgggtggaccgccgctgaatatgcccattggagcgccgaatatgatgcctggctatcagggttggggcacctcgccgcagcagcaacaatacggctacggcaacagtggcccaggatcgtaccagggatggggagctccaccaggaccccagggaccaccaccgcagtggtcgaactacgctggacctcagcagacgcagggctacggcggatacgacatgtataactcgacgtcgaccggagctccttcgggaccatcgggcggcggcagctggaactcgtggaacatgccacctaactctgccggacccactggggcaccaggagccggagcgggcaccgccactgacatgtactcgcgtgctcaagcctgggcgacgggcggtccctcgaccactggaccagtgggcggcatgccccggaccggacccggtaattcggcctccaagtctggctctgagtacgactacggcggctatggatccgggtacgactacgactacagcaactatgtgaagcaggagggcgcctcgaactacggagcagggccgcgatcagcgtacggcaacgacagctccacgcagccaccctatgcaacctcgcaggctgtctaaagagagaaggatcgtgtggaggagaagtaggagtagcggagcagagaggagcggagtagcatgtcgtcctcggcgaatgatgaagaagacagaaaagatggtggtaattgtaagctaaagcgtcgtctgttcgtttttatttcagatcagatcagttgttgaaattaatatttaaaactcttgtacaactattatttaaagcgaaaaaaaatttaacatgagaataactagcgacaagtcagattcatagatatacatgtatgttctatagcagcgagtatgtaattcataggcgaaacatcagcactctcacccatttagacaagagaacattatttctttcatgcgcctcataaacaccacactcaacaagcattctcctgtaccccacactcaccaacaaaccaaccaaccagccaggatcaactaacaagatcttcccaaccaactaaaacccgtagacacttatgatacatggcattaacaagaaacaaaatagaaatgtgaagatataaacgtaatgatttacaaatataaagtttagctaattagacacaagaaggtcaagaatagagcgcgaaataccaacacaaagaacataagaacttataattttatttaaagagtaaacaagtaaagatccccattaattactaaaattagtaaa

SEQ ID NO: 19663 - protein, 421 aa, Drosophila melanogaster
MEEDERGKLFVGGLSWETTQENLSRYFCRFGDIIDCVVMKNNESGRSRGFGFVTFADPTNVNHVLQNGPHTLDGRTIDPKPCNPRTLQKPKKGGGYKVFLGGLPSNVTETDLRTFFNRYGKVTEVVIMYDQEKKKSRGFGFLSFEEESSVEHVTNERYINLNGKQVEIKKAEPRDGSGGQNSNNSTVGGAYGKLGNECSHWGPHHAPINMMQGQNGQMGGPPLNMPIGAPNMMPGYQGWGTSPQQQQYGYGNSGPGSYQGWGAPPGPQGPPPQWSNYAGPQQTQGYGGYDMYNSTSTGAPSGPSGGGSWNSWNMPPNSAGPTGAPGAGAGTATDMYSRAQAWATGGPSTTGPVGGMPRTGPGNSASKSGSEYDYGGYGSGYDYDYSNYVKQEGASNYGAGPRSAYGNDSSTQPPYATSQAV

SEQ ID NO: 19664 - DNA, 957 bp, Drosophila melanogaster
  CDS (1)..(957)
atggttttcgttcacgtttcggagaaggagggcgacgagcccatcgagctgccggctgaggaggatggcactttgctgctgtccacactgcaggcgcagtttccggaatctagcggtctgcagtaccgcaacgtggacacgaaggcggtgcgtggagttcgctccaacgagggccgactgtattcgcccagcgaagaaaccggctggggcgagtaccattacttttgcgtctttcccaagaagaacaagcgccagagcgaagataacttggaaaactcaactgccaaaaccaagcgcactgaggcccatctgcgctgctttgatctcatcgtgctcggcttgtcctataacaccaccgagcaggatttgcgtgagtacttcgagacctacggcgatgtggtgaaggctgagatcaagaaggacaccaggtcgggccactccaagggtttcgggttcgtgcgcttcggctcttacgatgtccagatgcacgtactctctaagcgccattcaattgatggtcgctggtgcgaggttaaggtgcccgcctcgaggggcatgggcaatcaggagcctggcaaggtattcgtcggccgctgcaccgaggacatagaggcggatgacttgcgcgagtacttctcaaagtttggcgaagtgatcgacgtgttcattcccaagcccttcagggcttttagctttgtaacctttctcgatccgtatgtaccacgcgtcgtgtgcggagagaaacacataatcaagggagtttcggtccatgtgtcgactgctgacaaaaagaacgtgcagaacaaaaaccaactgttccagaccaacaactacaacaatttggacaacaactttaagatgcaaccggccaacaactttagaatgcacccagccaacaactttagcatgcattcatttaatccacatggttaccaaatgaatcgcgtcatgaactag

SEQ ID NO: 19665 - protein, 318 aa, Drosophila melanogaster
MVFVHVSEKEGDEPIELPAEEDGTLLLSTLQAQFPESSGLQYRNVDTKAVRGVRSNEGRLYSPSEETGWGEYHYFCVFPKKNKRQSEDNLENSTAKTKRTEAHLRCFDLIVLGLSYNTTEQDLREYFETYGDVVKAEIKKDTRSGHSKGFGFVRFGSYDVQMHVLSKRHSIDGRWCEVKVPASRGMGNQEPGKVFVGRCTEDIEADDLREYFSKFGEVIDVFIPKPFRAFSFVTFLDPYVPRVVCGEKHIIKGVSVHVSTADKKNVQNKNQLFQTNNYNNLDNNFKMQPANNFRMHPANNFSMHSFNPHGYQMNRVMN

SEQ ID NO: 19666 - DNA, 1675 bp, Drosophila melanogaster
  CDS (333)..(1331)
tcaggcgatacatacaaaggaaaagaaaatcaaaacggaaagcgagaagaaatgcttcactcgtcgtttgaaaatttgttaagctgtcaattgtaaatattacctgattcctatttcgcaccgattgaaagtggttgtgcatcgaagcgtgtgttgtgtcaagaaccgagcgtggaacgtacagtgaatacctgattttgcctgggtgtgaatcgaattcgtgtgagagagcgtgcgatctgagatctgggatcagaaatctatatctacttgccatacgcagtcagaaattacagcaaccaactaatccctgtcaatagtccttctaggaaatggatttcgttcaagtgtcggaggaggagggcgacgagcccatcgagctgccggctgaggaggatggcactctgcttctgtccacactgcaagctcagttccctggatcctgcggtctgaagtaccgcaacctggacacgaaggctgtgcgcggagttcgctccaacgagggcagactgtttccgcccagcgtggagtccggctggggcgagtacgcttacttttgcgtctttcccaaggagaacaagcgcaagagcgacgataacttggagaactcaactgccaagaccaaacgcatcgagacccgtctgcgctgcactgatctcatcgtgctcggcttgccgtggaagaccacagaggagagcttgcgtgagtacttcgagacctacggcgaggtgctgatggcccagatcaagaaggacaccaagtcgggccagtccaagggcttcggtttcgtgcgcttcggctcttacgatgcccagatgcgcgtgctcaccaatcgccatctgatcgacggtcgctggtgcgaggttaaggtgcccaactcgaagggcatgggccaccaggtgccttgcaaggtgttcgtgggccgctgcaccgaggacattaactcggacgacttgcgcgagtatttctccaagtttggcgaagtcactgatgtgttcattccccggcccttcagggcctttagctttgtaaccttccttgatcccgacgtggcacagtccctgtgcggagaggatcacattatcaagggcgtttcggtccatgtgtcgaatgctgctccaaaggccgagcagaacagaaaccaacaggtccagagctacaactacaactctgccaacagctttggcatgcactcataccacccacagggtaaccacatgaatccgggccgcaacggacaccaccgagggcggcaattttctatcttggatggctcagaacgggggccacaacaatgccaacaactttggtggacggaaggggccgaataacccgaacaacaatccggccgccaacggaataaagaccgacaactcggagccacagaatgggaacaccggttggtcgaaccagagcagcggatctcaaaacgccgcggagaagtcaaactttctttaaggcggtgcctgtcacccaatgatgtggttaatgtggttaaccaacacctctgtagcttacttaaatttacatatatgtattccacatacaaaccagttaagaattgtatttaatatgtaatagatattttgataattgtaaacaagatgacactggatggctaataacacaattgataaaacacacttcaaaataaattctgcgccaaagctcagta

SEQ ID NO: 19667 - protein, 332 aa, Drosophila melanogaster
MDFVQVSEEEGDEPIELPAEEDGTLLLSTLQAQFPGSCGLKYRNLDTKAVRGVRSNEGRLFPPSVESGWGEYAYFCVFPKENKRKSDDNLENSTAKTKRIETRLRCTDLIVLGLPWKTTEESLREYFETYGEVLMAQIKKDTKSGQSKGFGFVRFGSYDAQMRVLTNRHLIDGRWCEVKVPNSKGMGHQVPCKVFVGRCTEDINSDDLREYFSKFGEVTDVFIPRPFRAFSFVTFLDPDVAQSLCGEDHIIKGVSVHVSNAAPKAEQNRNQQVQSYNYNSANSFGMHSYHPQGNHMNPGRNGHHRGRQFSILDGSERGPQQCQQLWWTEGAE

SEQ ID NO: 19668 - DNA, 897 bp, Rattus norvegicus
  CDS (1)..(897)
atgacctggctcagcgatcagctccgagtaaagtgtcggttgtcttgttgggtgcgtttattttatttttggtgctgctgggaggcaggggaagtggaagctgtttttaggtgttcaagttctgagcttcctaattggagctgtgattacaggttgaaagtccctaatcaaaaaaaaaacggcggccgcggatcccgcccgagcgggaaccagaacggcgaaggcgaccagatcaacgccagcaagaacgaggaggacgcgggaaaaatgttcgttggtggtctgagctgggataccagcaaaaaagatctaaaggattattttactaagtttggagaggtcgttgactgtacaataaaaatggatccgaacactggtcgatcaagagggtttgggtttattctcttcaaagattcttctagtgtggagaaggtcttagatcagaaggagcacagactggatggtcgtgtcattgaccctaaaaaggctatggctatgaagaaggaccctgtgaagaaaatctttgtgggaggtctaaaccctgaagccacagaggaaaagatcagagaatactttggccagtttggggagattgaggccattgaacttccaatagatcccaagttgaacaaaagacggggttttgtttttattacatttaaagaggaagaccctgtgaagaaagttctggagaaaaaattccatactgtcagtggtagcaagtgtgaaatcaaggttgcccagcccaaagaggtgtaccagcaacagcagtatggctctgggggccgaggaaatcgcaatcgagggaaccgaggcagtggtggaggtcagggtagtacaaattacgggaagagccagcgacgtggtggtcatcagaataactacaagccatactga

SEQ ID NO: 19669 - protein, 298 aa, Rattus norvegicus
MTWLSDQLRVKCRLSCWVRLFYFWCCWEAGEVEAVFRCSSSELPNWSCDYRLKVPNQKKNGGRGSRPSGNQNGEGDQINASKNEEDAGKMFVGGLSWDTSKKDLKDYFTKFGEVVDCTIKMDPNTGRSRGFGFILFKDSSSVEKVLDQKEHRLDGRVIDPKKAMAMKKDPVKKIFVGGLNPEATEEKIREYFGQFGEIEAIELPIDPKLNKRRGFVFITFKEEDPVKKVLEKKFHTVSGSKCEIKVAQPKEVYQQQQYGSGGRGNRNRGNRGSGGGQGSTNYGKSQRRGGHQNNYKPY

SEQ ID NO: 19670 - DNA, 2185 bp, Homo sapiens
  CDS (190)..(1413)
cgcgcggtgaccgttggcgccgaggggaggaggcagccgccgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtcttgactggagcacgacccaagagactctgcgcagctacttttcccaatatggagaagtcgtagattgtgttatcatgaaagataaaaccaccaaccagtctcgaggctttgggtttgtcaaatttaaagacccaaactgtgtggggacggtgctggccagcagaccgcacacgctagatggccgaaacatcgaccccaagccatgcacaccccgggggatgcagccggagagaacacggccgaaggaaggatggcagaaaggacccaggagcgataacagtaaatcaaataagatatttgtcggtggaattcctcacaattgtggtgagacagagctcagggaatacttcaagaagttcggagtggtcacggaggtagtcatgatctatgacgccgagaagcagaggccccgaggttttggatttattactttcgaggacgaacaatcagtggaccaggctgtcaacatgcattttcacgacatcatgggcaaaaaagtggaagttaaacgagctgagcctcgggacagcaagagccaagcgccgggacagccaggtgccagccagtgggggagccgggttgtgcccaacgctgccaatggctgggcaggccagcccccgcccacgtggcagcaaggatatggcccgcaaggaatgtgggtgccggcaggacaggcgattggtggctatggaccgccccctgcaggaagaggagcccccccgccacccccaccgttcacctcctacatcgtgtccacccctcctggaggctttccccctccccagggcttccctcagggctacggtgccccgccacagttcagttttggctacgggcctccacctccaccgccagatcagtttgcccctccgggggttcctcctccaccagccactcccggggcagcacctctggctttcccaccgcctccgtctcaggctgccccggacatgagcaagcccccgacagctcagccagacttcccctatggtcagtatgcaggttacgggcaggacttgagtggcttcggacagggcttctcagaccccagccagcagcctccttcctacgggggtccctccgtgccagggtcggggggcccccccgccggcggcagcggctttggacgagggcagaaccacaacgtgcaagggttccacccctaccgacgctagcccgcggcgccgcgacgtctgcacggcccagacccaggattccaaacttgtgaactcgtgacaatcacaaacttggcggcaaagtggcgactcaaccttgggggggggggcggggggagggcgcgaggcttttggagcggctgtgggtgtcgtctggactgaggtttttaaatatttctttctctaacccatcagcacaataaaaaaaagtcactggttcaacaacagggtttaaaaaaaatgtcttcagctttaattcaaaacttcaggtttctttttcttccttttttttggaaattattttcctgagccttttgttttacggtatattgtaaacttttatgttaaagaaaaaatatacatttacaaattgtgagatttttaagagaaattttctacgatgtatactggcttattttttaatttaaaacggggtttccgtcggcactggtggagggggtgcgctgttagtcccctcgctcctggctttgggggttgggacttggtggtccagaaactctgggagcttctagaagaaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaagcctttctccccaggcacgtggcttcagggcgtttcccattgaccagtttgaccctggtttgaataaagagaagtgcgtttggattagaaa

SEQ ID NO: 19671 - protein, 407 aa, Homo sapiens
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYAGYGQDLSGFGQGFSDPSQQPPSYGGPSVPGSGGPPAGGSGFGRGQNHNVQGFHPYRR

SEQ ID NO: 19672 - DNA, 2078 bp, Mus musculus
  CDS (77)..(1297)
ccgggccgcggctgcggggagggacgagcggtgaccttccggaggagcggggcgcagcgggccgggacggggcgccatgaacagcgcgggcgccgacgaaatcgggaagctctttgtgggcggcctggactggagtaccactcaagagactctacgcagctacttttcccagtatggtgaggttgtggattgtgtcatcatgaaagataaaaccaccaaccagtctagaggctttggatttgtcaagtttaaagaccccaattgtgtggggacagtgctggccagcagaccacacaccctagatggccgaaatatcgacccgaagccgtgcacacctcgggggatgcagccagagcgaacacggcccaaggaaggctggcagaaaggacccaggagcgacagcagcaaatccaacaagatctttgtcgggggcattccccacaactgcggggagacggagctcagggagtacttcaagaagtttggagtggtcacagaggtggttatgatctatgatgcggagaagcagcggcctcgaggttttggatttattactttcgaggacgaacaatcagtggaccaggctgtcaacatgcattttcacgacatcatgggcaaaaaagtggaggttaaacgggctgaaccacgggacagcaagaatcaagctccaggacagccaggagccagccagtggggcagccgcgtggcgcccagtgcagccaacggctgggcaggccagcccccgcccacgtggcaacaaggatatggcccacaaggaatgtgggtgccagcaggacaggccattggtggctatggcccaccccctgcgggcagaggagccccgcccccgcccccacccttcacctcctacattgtatccacaccgcctggaggcttccccccaccacagggcttcccacagggctatggcgccccaccacagttcagttttggctacggtcctcctcccccaccccctgatcagtttgcccctccaggggtccctcctccacctgccaccccaggggctgccccgctggccttcccaccacctccgtctcaggctgccccagacatgagcaaacccccaacagcccagccggacttcccctatggtcaatatggttacgggcaggacttgagtggcttcggccagggcttctcggaccccagccagcagccgccctcctatgggggcccctctgtaccaggttcggggggtccccccgctggcggcagtggcttcggacgcgggcagaaccacaacgtgcagggcttccatccctaccggcgctagccaggggcatggcggcggggcaggcaggattcgggactggtgaacttgtgacaatcacactcgggacaaaataaatgaccactcgacctggggggaggggcagcggaggccgcatctggactgaggttttaaatatatttcttttctctgacccatcagcacaataaaaacacgtcactggttcaacaacagggtttaaaaaacgccttcagctttaattcagaatttcaggtttctttttcttcttccttttttttcctttttttgagattattttcttgagccttttgttttatggtatattgtaaacttttatgttaaagaaaaaatatacatttacaaattgtgagatttttaagagaaattttctacaatgtatactggcttattttttaatttaaagcagggttcgggtgtgggaagcgggagccctggctcccgccggcgcgggctggggtgcgggcagagactactgcgtgcatttggttttttgttcattccttgctttgagcggcttgtgtggctgcaggtgcaacagggcccctggcacaggtggcagtgctgaagtctcgggtggcctgggccccacccacacaggtgtggcaggcaaggccttgctggaggcccctcagtagggctcaggttcccattgaccagtttgacccggtttgaataaaacagcgtgtttggatcagaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 19673 - protein, 406 aa, Mus musculus
MNSAGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDSSKSNKIFVGGIPHNCGETELREYFKKFGVVTEVVMIYDAEKQRPRGFGFITFEDEQSVDQAVNMHFHDIMGKKVEVKRAEPRDSKNQAPGQPGASQWGSRVAPSAANGWAGQPPPTWQQGYGPQGMWVPAGQAIGGYGPPPAGRGAPPPPPPFTSYIVSTPPGGFPPPQGFPQGYGAPPQFSFGYGPPPPPPDQFAPPGVPPPPATPGAAPLAFPPPPSQAAPDMSKPPTAQPDFPYGQYGYGQDLSGFGQGFSDPSQQPPSYGGPSVPGSGGPPAGGSGFGRGQNHNVQGFHPYRR

SEQ ID NO: 19674 - DNA, 1891 bp, Xenopus laevis
  CDS (117)..(1199)
gtacgtgatgacgttccgttccaccccctgtatggaaaccccgtagtctagcgccgtcttaccgttggctggcttggtaggagaagctgcagagaccggagaggggtgacggagttatgaacaaccaaggcggggacgagatcggaaagctctttgttggtggccttgactggagcacaacgcaggaaaccctgcgcagctatttttctcagtatggagaagtcgtagactgtgtaataatgaaagataaaacaacaaatcagtcaagaggctttggctttgtcaaatttaaggatcccaattgtgtaggaacagtcttagccagcagaccacacacactggatggccggaatattgatccaaagccatgtacccctcgaggaatgcagcctgaaagaagccggccacgagaaggctggcagcaaaaagaacccagaactgaaaacagtaggtccaacaaaatttttgtgggaggaattccacacaactgtggagaaactgaactgaaggaatattttaatagatttggagtggtaactgaggtggttatgatatatgatgccgaaaaacagaggccaagaggttttggatttataactttcgaggacgaacaatcagtggaccaggctgtcaacatgcattttcacgacatcatgggcaaaaaagttgaagtcaaacgggcagaaccacgtgatagcaaaagccaaactccaggacctcctggatcaaaccaatggggaagccgagcaatgcaaagcacagctaatggatggacagggcaacctcctcaaacatggcagggctacagtccacaaggtatgtggatgccaacaggacagacgattggcgggtatgggcaacctgcaggccgggggggtcctcctccaccaccttcctttgcgccattcctagtgtcaacaacccctggacctttcccaccaccgcagggctttcctcctggatatgccacaccgcctccctttggctatggctatgggccaccccctccccctcctgatcagttcgtctcttcaggagttccaccacctcctggtacaccaggagcagcaccgttagcgttccctcctcccccagggcagtcagctcaggatctgagcaaaccccccagtggtcagcaggattttccttttagccagtttggaaatgcctgctttgtgaaattgtccgagtggatttgacctctcgaagtccatcaaaggttatggacaagacatgagtgggtttgggcaaagtttcccggacctcaaccagcagcccccttacacgacaggaccctccacaccagcatcgggaggcccagccgccgtgggaagtggtttgggcagaggacagaatcacaatgtacaaggattccatccctacaggcgttaatatgaggcaggcagaattgtgcaaagtggcgatgagctgatgcttccacctctgaacttgtgacaatcacgtggtgaagacacatcctgcttatagacttatagttctatgtttgaaggagaagctgtgggtatttgaactacagttttcagatctttctctgacccatcagcacaaataaagccaatgagtcactggttccaaacagggtttgaaaacatctgcagctttaatggaactcttcaggtttaatttggggtttgtttttgttctttttatttagttttttgttttgggagggatatttctgagcctttgttttaccatatagtaaacttttatgtttaaagatgaaaatatatacatttacagattgtgaatttttaaaaaatgaattttctactatgtattcaggtttattttttaatttaatggcagggtttccggtgacactggagttcagattttaactccttgcttctaaaaaaaaaaaaaaaaa

SEQ ID NO: 19675 - protein, 360 aa, Xenopus laevis
MNNQGGDEIGKLFVGGLDWSTTQETLRSYFSQYGEVVDCVIMKDKTTNQSRGFGFVKFKDPNCVGTVLASRPHTLDGRNIDPKPCTPRGMQPERSRPREGWQQKEPRTENSRSNKIFVGGIPHNCGETELKEYFNRFGVVTEVVMIYDAEKQRPRGFGFITFEDEQSVDQAVNMHFHDIMGKKVEVKRAEPRDSKSQTPGPPGSNQWGSRAMQSTANGWTGQPPQTWQGYSPQGMWMPTGQTIGGYGQPAGRGGPPPPPSFAPFLVSTTPGPFPPPQGFPPGYATPPPFGYGYGPPPPPPDQFVSSGVPPPPGTPGAAPLAFPPPPGQSAQDLSKPPSGQQDFPFSQFGNACFVKLSEWI

SEQ ID NO: 19676 - DNA, 918 bp, Homo sapiens
  CDS (1)..(918)
atggagaattctcagttgtgtaagctgttcatcggcggcctcaatgtgcagacgagtgagtcgggcctgcgcggccactttgaggcctttgggactctgacggactgcgtggtggtggtgaatccccagaccaagcgctcccgttgctttggcttcgtgacctactccaatgtggaggaggcggacgccgccatggccgcctcgccccatgccgtggacggcaacactgtggagctgaagcgggcggtgtcccgggaggattcggcgcggcccggtgcccacgccaaggttaagaagctctttgtcggaggccttaaaggagacgtggctgagggcgacctgatcgagcacttctcgcagtttggcaccgtggaaaaggccgagattattgccgacaagcagtccggcaagaagcgtggattcggcttcgtgtatttccagaatcacgacgcggcagacaaggccgcggtggtcaagttccatccgattcagggccatcgcgtggaggtgaagaaagcagtccccaaggaggatatctactccggtgggggtggaggcggctcccgatcctcccggggcggccgaggcggccgggggcgcggcggtggtcgagaccagaacggcctttccaagggcggcggcggcggttacaacagctacggtggttacggcggcggcggaggcggcggctacaatgcctacggaggcggcggcggcggttcgtcctacggtgggagcgactacggtaacggcttcggcggcttcggcagctacagccagcatcagtcctcctatgggcccatgaagagcggcggcggcggcggcggtggaggcagtagctggggcggtcgcagtaatagtggaccttacagaggcggctatggcggtgggggtggctatggaggcagctccttctaa

SEQ ID NO: 19677 - protein, 305 aa, Homo sapiens
MENSQLCKLFIGGLNVQTSESGLRGHFEAFGTLTDCVVVVNPQTKRSRCFGFVTYSNVEEADAAMAASPHAVDGNTVELKRAVSREDSARPGAHAKVKKLFVGGLKGDVAEGDLIEHFSQFGTVEKAEIIADKQSGKKRGFGFVYFQNHDAADKAAVVKFHPIQGHRVEVKKAVPKEDIYSGGGGGGSRSSRGGRGGRGRGGGRDQNGLSKGGGGGYNSYGGYGGGGGGGYNAYGGGGGGSSYGGSDYGNGFGGFGSYSQHQSSYGPMKSGGGGGGGGSSWGGRSNSGPYRGGYGGGGGYGGSSF

SEQ ID NO: 19678 - DNA, 1677 bp, Mus musculus
  CDS (97)..(1122)
cacagcgccaggacgagtcccgtgcgcgtccgtccgcggaggtctttctcatctcgctcggctgcgggaaatcgggctgaagcgactgagtccgcgatggagagagaaaaggaacagttccgaaagctctttattggtggcttaagctttgaaaccacagaagaaagtttgagaaactactatgagcaatggggaaagctcacagactgtgtggttatgcgggatcctgcaagcaaaagatcaagaggatttggctttgtaactttctcatccatggccgaggttgacgctgccatggctgcaaggcctcattccattgatggcagggtagttgagccaaaacgtgctgtagcaagagaggagtctggaaaaccaggagcccatgtgactgtgaagaagctgtttgttggtggaattaaggaagatactgaggaacaccaccttagagattactttgaagagtatggaaaaattgatactattgaaataattaccgataggcagtctggaaagaaaagaggctttggctttgttacttttgatgaccatgatcctgtggataaaattgtcttgcaaaaatatcacaccataaatggtcacaatgcagaagttagaaaggcattgtctagacaagaaatgcaggaagtccaaagttctaggagtggaagaggaggaaactttggttttggggattctcgtggtggcggtggcaattttggaccaggaccaggaagcaactttagggggggatctgatggatacggaagtggacgtggatttggggatggctataatgggtatggaggaggacctggaggtggcaattttggaggtagccctggttatggaggaggaagaggaggatatggtggtggaggacctggatatggcaaccagggtgggggctacggaggtggttatgacaactatggaggaggaaattatggaagtggaacttacaatgattttggaaattataaccagcagccttctaactatggtccaatgaagagtggaaactttgggggtagcaggaacatgggaggaccatatggtggagggaactatggtcctggaggaagtggaggaagtggtggctatggtggaaggagcagatattaagcttcttcctacttaccatgggcttcactgtataaataggagaggatgagagcccagaggtaacagaacagcttcaggttatggaaataacaatgttaaggaaactcttactctcagtcatgcataaatatcagtggtatggcagaagacaccagagcagatgcagacagccattttgtgaatggattggattatttaataacattaccttactgtggaggaaggattgtaaaaaaaaatgcctttgagacagttcttaggctttttaattgttgtttctttctagtggtctttgtaagagtgtagaagcattccttctttgataatgttaaatttgtaagtttcaggtgacatgtgaaaccttttttaagatttttctcaaaagttttgaaaagctattagccaggatcatggtgtaataagacataacgtttttccttcccaattttaagtgcgtgtgtagagttaagaagctgttgtacatttatgatttaataaaatattctaaaggaaaaaaaaaaaaaaaaaaaaaaaaaaaaaaaaaaaaaaaaaaaa

SEQ ID NO: 19679 - protein, 341 aa, Mus musculus
MEREKEQFRKLFIGGLSFETTEESLRNYYEQWGKLTDCVVMRDPASKRSRGFGFVTFSSMAEVDAAMAARPHSIDGRVVEPKRAVAREESGKPGAHVTVKKLFVGGIKEDTEEHHLRDYFEEYGKIDTIEIITDRQSGKKRGFGFVTFDDHDPVDKIVLQKYHTINGHNAEVRKALSRQEMQEVQSSRSGRGGNFGFGDSRGGGGNFGPGPGSNFRGGSDGYGSGRGFGDGYNGYGGGPGGGNFGGSPGYGGGRGGYGGGGPGYGNQGGGYGGGYDNYGGGNYGSGTYNDFGNYNQQPSNYGPMKSGNFGGSRNMGGPYGGGNYGPGGSGGSGGYGGRSRY

SEQ ID NO: 19680 - DNA, 1166 bp, Mus musculus
  CDS (27)..(1166)
ttggaagaggcgagtccggtctcaaaatggaggtaaaaccgccgcccggtcgcccccagcctgactccggccgtcgccgccgccgccggggggaggagggccacgatccaaaggaaccagagcagctgaggaagctgtttattggtggtctgagctttgaaaccacagatgatagcttaagagaacattttgagaaatggggcacacttacagattgtgtggtaatgagagatcctcaaacaaaacgttccagaggctttggttttgtgacctactcttgtgtcgaagaggtggatgctgcaatgtgtgctcggccacacaaggttgatggacgtgtggtggaaccaaagagagctgtttctagagaggattctgtaaagcctggtgcccatttaacggtgaagaagatttttgttggtggtattaaagaggatacagaagaatataatctgagagactactttgaaaagtatggcaagattgaaaccatagaagttatggaagataggcagagtgggaaaaagagaggatttgcttttgtaacttttgatgatcatgacacagttgataaaattgttgttcagaaataccacactattaatgggcataattgtgaagtgaaaaaggccctttctaaacaagagatgcagtctgctggatcacagagaggtcgtggaggtggatctggcaactttatgggacgtggaggaaactttggtggtggcggaggaaactttgggcgtggaggaaactttggtggaagaggaggctatggtggtggaggtggtggcagcagaggcagttatggaggtggtgatggtggatataatggatttggaggtgatggtggcaactatggtggtggtcctggttacagtagtagaggaggttatggaggtggtggaccaggatatggaaaccaaggtggtggatatggtggtggaggaggaggatatgatggttacaatgaaggaggaaattttggtggaggtaactatggtggtggtgggaactataatgactttggaaattatagtggacagcaacaatctaattatggacccatgaaggggggcagttttggtggaagaagctcaggcagtccctatggtggtggctatggatctggaggtggaagtggtggatatggtagcagaaggttctaa

SEQ ID NO: 19681 - protein, 379 aa, Mus musculus
MEVKPPPGRPQPDSGRRRRRRGEEGHDPKEPEQLRKLFIGGLSFETTDDSLREHFEKWGTLTDCVVMRDPQTKRSRGFGFVTYSCVEEVDAAMCARPHKVDGRVVEPKRAVSREDSVKPGAHLTVKKIFVGGIKEDTEEYNLRDYFEKYGKIETIEVMEDRQSGKKRGFAFVTFDDHDTVDKIVVQKYHTINGHNCEVKKALSKQEMQSAGSQRGRGGGSGNFMGRGGNFGGGGGNFGRGGNFGGRGGYGGGGGGSRGSYGGGDGGYNGFGGDGGNYGGGPGYSSRGGYGGGGPGYGNQGGGYGGGGGGYDGYNEGGNFGGGNYGGGGNYNDFGNYSGQQQSNYGPMKGGSFGGRSSGSPYGGGYGSGGGSGGYGSRRF

SEQ ID NO: 19682 - DNA, 1793 bp, Homo sapiens
  CDS (225)..(1220)
ggcaccgcgcgggacggagcttggctgttggtcggtgggttcccgtgcggcggcggccaaggaggaggagacacagttggagcagctccgtgggctgactggggcgaggcctcagcagcgcgagcttgagtgcggccgagcctgcggcgccttcccctgcgggtggggacgagcgggccccgcggcgtcatcggcggcgaggagccgccgcgcctcggcctagcatgtcggaagcgggcgaggagcagcccatggagacgacgggcgccaccgagaacggacatgaggccgtccccgaagcgagtcgcggccggggctggacgggcgccgcggcggggctggaggcgcgaccgccgcgcccccgagcgggaatcagaacggcgccgagggaccagatcaacgccagcaagaacgaggaggacgcgggaaaaatgttcgttggtggcctgagctgggatactagcaaaaaagatttaaaagactattttactaaatttggagaggtcgttgactgtacaataaaaatggatcccaacactggacggtcaagagggtttgggtttatcctgttcaaagatgcagccagtgtggagaaggtcctagaccagaaggagcacaggctggatggccgtgtcattgaccctaaaaaggccatggctatgaagaaggacccggtcaagaaaatcttcgttgggggtctgaatcctgaaagtcccactgaggaaaagatcagggagtactttggcgagtttggggagattgaggccattgaattgccaatggatccaaagttgaacaaaagacgaggttttgtgtttatcacctttaaagaagaagaacccgtgaagaaggttctggagaaaaagttccatactgtcagtggaagcaagtgtgagatcaaggtggcccagcccaaagaagtctatcagcagcagcagtatggctctgggggccgtggaaaccgcaaccgagggaaccgaggcagcggaggtggtggtggaggtggaggtcagagtcagagttggaatcagggctacggcaactactggaaccagggctacggctaccagcagggctacgggcctggctatggcggctacgactactcgccctatggctattacggctacggccccggctacgactacagtcagggtagtacaaactacggcaagagccagcgacgtggtggccatcagaataactacaagccatactgaggcggccaagggagcgaccaactgatcgcacacatgctttgtttggatatggagtgaacacaattatgtaccaaatttaacttggcaaactttctattgcctgtcccatgtgcatcttatttaaaatttcccccatggaaatcactctcctgttgactatttccagagctctaggtgtttaggcagcgtgtggtgtctgagaggccatagcgccatcatgggctgatttttattaccaggtcccccagaagcaggtgagaggctctgcttcctgctgccgctctgcagcctggacctgtggaccctggttgtaaagagtaaattgtatcttaggaaaccagtgtcacctttttttcaccttttaattttatattatttgcgtcatacatttcctgtaacggaagtgttaattttactgtactttttggtaccccttttgggaatctaatgtattgtaaggtattttacacgtgtcctgattttgccacaacctggatattgaagctatccaagcttttgaaataaaatttaaaaaccccaagcctgggtgagtgtgggaaaaaaaaaaaaaaa

SEQ ID NO: 19683 - protein, 331 aa, Homo sapiens
MSEAGEEQPMETTGATENGHEAVPEASRGRGWTGAAAGLEARPPRPRAGIRTAPRDQINASKNEEDAGKMFVGGLSWDTSKKDLKDYFTKFGEVVDCTIKMDPNTGRSRGFGFILFKDAASVEKVLDQKEHRLDGRVIDPKKAMAMKKDPVKKIFVGGLNPESPTEEKIREYFGEFGEIEAIELPMDPKLNKRRGFVFITFKEEEPVKKVLEKKFHTVSGSKCEIKVAQPKEVYQQQQYGSGGRGNRNRGNRGSGGGGGGGGQSQSWNQGYGNYWNQGYGYQQGYGPGYGGYDYSPYGYYGYGPGYDYSQGSTNYGKSQRRGGHQNNYKPY

SEQ ID NO: 19684 - DNA, 1012 bp, Spinacia oleracea
  CDS (1)..(684)
atgtgggagcaagaggggtccacaaatgctgttcttgaaggtgagtctgacccagaaggagcggttagttggggttctgaaactcaagtttctgatgaaggtggagttgaaggaggtcaagggttctctgaacctcctgaagaagctaaattgtttgtgggtaatttgccttatgatgttgatagtgagaaattggctgggatttttgatgcggctggtgttgttgagattgctgaggtgatttacaacagggagactgataggagtagaggttttgggtttgtgaccatgagtacagttgaagaagctgagaaggctgtggagttgttgaatggatatgatatggatggaaggcaattaacagtaaacaaggctgctccaaggggatcacctgaaagggctccacgaggagattttgaaccttcgtgcagagtgtatgttggtaaccttccatgggatgtggacacgtctcgccttgagcaactatttagtgaacatggcaaagttgtgagtgccagagtagtttctgacagggagactggtcgttcacgtggatttggctttgtcactatgtcctctgagtcggaggttaatgacgccattgctgctctcgatggacagaccttggatggaagggcagtcagggtaaatgttgctgaagaaagacccaggcgtgctttttgatttaatccataaacgcaactctgctggttgatagtattagttaattttctcccccttttttttttttgcccccactcttttggttgagactattaatagctcatattttgacaccggcggttccaaagaatgttgtgattttagttagttcctacaatggctgcaattatggtaatcaaactcatttcatatttcaatatacgcaaatttgctaaacttgttctgcagcttgtctcctcttcatatctgtgttgtttgtactggatatagcttctatatagctgtatattgaaagtttcttatttggaagaaaaaaaaaaaaaaaaaa

SEQ ID NO: 19685 - protein, 227 aa, Spinacia oleracea
MWEQEGSTNAVLEGESDPEGAVSWGSETQVSDEGGVEGGQGFSEPPEEAKLFVGNLPYDVDSEKLAGIFDAAGVVEIAEVIYNRETDRSRGFGFVTMSTVEEAEKAVELLNGYDMDGRQLTVNKAAPRGSPERAPRGDFEPSCRVYVGNLPWDVDTSRLEQLFSEHGKVVSARVVSDRETGRSRGFGFVTMSSESEVNDAIAALDGQTLDGRAVRVNVAEERPRRAF

SEQ ID NO: 19686 - DNA, 1068 bp, Homo sapiens
  CDS (1)..(1068)
atgtcggaggagcagttcggcggggacggggcggcggcagcggcaacggcggcggtaggcggctcggcgggcgagcaggagggagccatggtggcggcgacacagggggcagcggcggcggcgggaagcggagccgggaccgggggcggaaccgcgtctggaggcaccgaagggggcagcgccgagtcggagggggcgaagattgacgccagtaagaacgaggaggatgaaggccattcaaactcctccccacgacactctgaagcagcgacggcacagcgggaagaatggaaaatgtttataggaggccttagctgggacactacaaagaaagatctgaaggactacttttccaaatttggtgaagttgtagactgcactctgaagttagatcctatcacagggcgatcaaggggttttggctttgtgctatttaaagaatcggagagtgtagataaggtcatggatcaaaaagaacataaattgaatgggaaggtgattgatcctaaaagggccaaagccatgaaaacaaaagagccggttaaaaaaatttttgttggtggcctttctccagatacacctgaagagaaaataagggagtactttggtggttttggtgaggtggaatccatagagctccccatggacaacaagaccaataagaggcgtgggttctgctttattacctttaaggaagaagaaccagtgaagaagataatggaaaagaaataccacaatgttggtcttagtaaatgtgaaataaaagtagccatgtcgaaggaacaatatcagcaacagcaacagtggggatctagaggaggatttgcaggaagagctcgtggaagaggtggtggccccagtcaaaactggaaccagggatatagtaactattggaatcaaggctatggcaactatggatataacagccaaggttacggtggttatggaggatatgactacactggttacaacaactactatggatatggtgattatagcaaccagcagagtggttatgggaaggtatccaggcgaggtggtcatcaaaatagctacaaaccatactaa

SEQ ID NO: 19687 - protein, 355 aa, Homo sapiens
MSEEQFGGDGAAAAATAAVGGSAGEQEGAMVAATQGAAAAAGSGAGTGGGTASGGTEGGSAESEGAKIDASKNEEDEGHSNSSPRHSEAATAQREEWKMFIGGLSWDTTKKDLKDYFSKFGEVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGNYGYNSQGYGGYGGYDYTGYNNYYGYGDYSNQQSGYGKVSRRGGHQNSYKPY

SEQ ID NO: 19688 - DNA, 1240 bp, Rattus norvegicus
  CDS (50)..(1111)
tcgcggcggcggcgggtgtcgtctcggcggcggcggaggcagtagcactatgtcggaggagcagttcggaggggacggggcggcggcggcggcaacggcggcggtaggcggctcggcgggcgagcaggagggagccatggtggcggcggcgcagggggcagcggcggcggcgggaagcgggagcggcggcggctctgcggccggaggcaccgaaggaggcagcaccgaggcagagggagcgaagatcgacgccagtaagaatgaggaggatgaaggccattcaaactcctccccacgacacactgaagcagcgacggcacagcgggaagaatggaaaatgtttataggaggccttagctgggacaccacaaagaaagacctgaaggactacttttccaaatttggggacgttgtagactgcactctgaagttagatcctatcacagggcgatcaaggggttttggctttgtgctatttaaagagtcggagagtgtagataaggtcatggatcagaaagaacataaattgaatgggaaagtcattgatcctaaaagggccaaagccatgaaaacaaaagagcccgtcaaaaaaatttttgttggtggcctttctccagacacacctgaagaaaaaataagagagtactttggtggttttggtgaggttgaatccatagagctgcctatggacaacaagaccaataagaggcgtgggttctgtttcattacctttaaggaagaggaaccagtgaagaagataatggagaagaaataccacaatgttggtcttagtaaatgtgaaataaaagtagccatgtcgaaggagcagtatcagcagcagcagcagtggggatctagaggagggtttgcaggaagagctcgcggaagaggcggtggccccagtcaaaactggaaccagggatatagtaactattggaaccaaggctatggcagctatggatataacagccaagggtacggtggttatggaggatatgactacactggttacaacagctactatggatatggtgactatagcaatcagcagagtggttatgggaaagtatccagacgaggtggtcatcaaaatagctacaaaccatactaaattattccatttgcaacttatccccaacaggtggtgaagcagtattttccaatttgaagattcatttgaaggtggctcctgccacctgctaatagcagttcaaactaaattttttctatcaagttcccg

SEQ ID NO: 19689 - protein, 353 aa, Rattus norvegicus
MSEEQFGGDGAAAAATAAVGGSAGEQEGAMVAAAQGAAAAAGSGSGGGSAAGGTEGGSTEAEGAKIDASKNEEDEGHSNSSPRHTEAATAQREEWKMFIGGLSWDTTKKDLKDYFSKFGDVVDCTLKLDPITGRSRGFGFVLFKESESVDKVMDQKEHKLNGKVIDPKRAKAMKTKEPVKKIFVGGLSPDTPEEKIREYFGGFGEVESIELPMDNKTNKRRGFCFITFKEEEPVKKIMEKKYHNVGLSKCEIKVAMSKEQYQQQQQWGSRGGFAGRARGRGGGPSQNWNQGYSNYWNQGYGSYGYNSQGYGGYGGYDYTGYNSYYGYGDYSNQQSGYGKVSRRGGHQNSYKPY

SEQ ID NO: 19690 - DNA, 1245 bp, Mus musculus
  CDS (1)..(1245)
atgtctgaatatattcgggtaacagaagatgagaacgatgaacccattgaaataccatcagaagacgatgggacggtgttgctgtccacagttacagcccagtttccaggggcatgcggcctgcgctaccggaatcccgtgtctcagtgtatgagaggagtccgactggtggaaggaattctgcatgccccagatgctggctggggcaatctggtatatgttgtcaactatcccaaagataacaaaaggaaaatggatgagacagatgcttcctctgcagtgaaagtgaaaagagcagtccagaaaacatctgacctcatagtgttgggtctcccctggaaaacaactgagcaggatctgaaagactatttcagtacttttggagaggttcttatggttcaggtcaagaaagatcttaaaactggtcactcgaaagggtttggctttgttcgatttacagaatatgaaacccaagtgaaagtaatgtcacaacgacatatgatagatgggcgatggtgtgactgtaaacttcccaactctaagcaaagcccagacgagcctttgagaagcagaaaggtgtttgttggacgttgtacagaggacatgactgctgaagagcttcagcagtttttctgtcagtatggagaagtggtagatgtcttcattcccaaaccattcagagcttttgccttcgtcacctttgcagatgataaggttgcccagtctctttgtggagaggatttgatcattaaaggaatcagcgtgcatatatccaatgctgaacctaagcataatagcaatagacagttagaaagaagtggaagatttggtggtaatccaggtggctttgggaatcagggtgggtttggtaacagtagagggggtggagctggcttgggaaataaccagggtggtaatatgggtggagggatgaactttggtgcttttagcattaacccagcgatgatggctgcggctcaggcagcgttgcagagcagttggggtatgatgggcatgttagccagccagcagaaccagtcgggcccatctgggaataaccaaagccagggcagcatgcagagggaaccaaatcaggcttttggttctggaaataattcctacagtggttctaattctggtgccccccttggttgggggtcagcatcaaatgcaggatcgggcagtggttttaatgggggctttggctcgagcatggattctaagtcttctggctggggaatgtag

SEQ ID NO: 19691 - protein, 414 aa, Mus musculus
MSEYIRVTEDENDEPIEIPSEDDGTVLLSTVTAQFPGACGLRYRNPVSQCMRGVRLVEGILHAPDAGWGNLVYVVNYPKDNKRKMDETDASSAVKVKRAVQKTSDLIVLGLPWKTTEQDLKDYFSTFGEVLMVQVKKDLKTGHSKGFGFVRFTEYETQVKVMSQRHMIDGRWCDCKLPNSKQSPDEPLRSRKVFVGRCTEDMTAEELQQFFCQYGEVVDVFIPKPFRAFAFVTFADDKVAQSLCGEDLIIKGISVHISNAEPKHNSNRQLERSGRFGGNPGGFGNQGGFGNSRGGGAGLGNNQGGNMGGGMNFGAFSINPAMMAAAQAALQSSWGMMGMLASQQNQSGPSGNNQSQGSMQREPNQAFGSGNNSYSGSNSGAPLGWGSASNAGSGSGFNGGFGSSMDSKSSGWGM

SEQ ID NO: 19692 - DNA, 1269 bp, Xenopus tropicalis
  CDS (17)..(946)
ctgtgcttgcgtttcaatgagtaccggcgatatggatacgacgcaactctgcaaactgtttatcggggggcttaacgtgcagaccaccgaagagggcctacgccagcattttgagacctacggtcaactgacggactgcgtggtggttatcaacccacagaccaagcggtctcgatgtttcggtttcgtaacctactcgagtgccgcggaggccgacgcggcggtggaggcctcgccccacgtggttgacggtaacaacgttgagctgaagcgggccgtctccagggaagattccgccaagccgggggcacacgctaaagtgaagaagctctttgttggcggcctgaaagaggacgtcggcgagagtgacttgctcgaacacttcgcccagtttggcgccgtggaaaaagtggagatcattgccgataaagtgtccggcaagaaacgcggcttcggctttgtgtactttaccaaccacgattccgccgacaaggccgcggtggtcaagttccactccatcaacgggcaccgcgtcgaggtaaagaaggccgtgcccaaggaggaactttcccagggttccaatagatccttccgcggcggcaggggcgggagaggccgaggtggcggcggagcgccccgggactacaatggcatccctggaagtggcggcaaagctgctttcggtgggggctacggcggctatgggggcggcaaccagggctacggctcgtacggaggcggctatggcgagcagagcgactacggcaatggctacaacagtttcgggagctacagccagcaccagtcctcgtacgggcccatgaagggagcgggaagcggcagctggaaccggcccaacacgtcaggcccctaccgcggaggttatagcggcggcggaggaggaggttatggcgtcggcagctcctatggcggcggctccttctgaaaggtttaataactttggcgcagtgagagatggaaataatccacacaaacaccgataaactcgaacttctttcatattttcatgtgtgttttgggctctgattgtttttatactattgtaacctgagatctagagcgggaaactgacaatggcagttacggaagccgtattctcccacacccaccctggttttttgtttttggccagcctgttgggctgctgcaagcaaacagtaccccctgtacccttttttgtttttactttttaaataaatcggtttattacccactttgttcccctaaaaaaaaaaaaaaaaaaaaaaa

SEQ ID NO: 19693 - protein, 309 aa, Xenopus tropicalis
MSTGDMDTTQLCKLFIGGLNVQTTEEGLRQHFETYGQLTDCVVVINPQTKRSRCFGFVTYSSAAEADAAVEASPHVVDGNNVELKRAVSREDSAKPGAHAKVKKLFVGGLKEDVGESDLLEHFAQFGAVEKVEIIADKVSGKKRGFGFVYFTNHDSADKAAVVKFHSINGHRVEVKKAVPKEELSQGSNRSFRGGRGGRGRGGGGAPRDYNGIPGSGGKAAFGGGYGGYGGGNQGYGSYGGGYGEQSDYGNGYNSFGSYSQHQSSYGPMKGAGSGSWNRPNTSGPYRGGYSGGGGGGYGVGSSYGGGSF

SEQ ID NO: 19694 - DNA, 1224 bp, Xenopus tropicalis
  CDS (1)..(1224)
atggaatacataagagtggcagaggatgagaatgaagagccaatggagataccatctgaagatgatgggacagtactgttgtctacagttactgcccagtttcctggtgcatgtggtctgagatacagaaacccagtgaatcagtgtatgcgtggtgttcgattggttgaagggattctccatgctcctgaaaatggctggggaaaccttgtttatgtagtcaattatccaaaagataacaaaaggaagatggatgaaactgatgcttcttctgcagtcaaaataaaacgtgcagtgacaaaaacatcagatctaattgtgttaggtcttccgtggaaaaccacagaacaagatttgaaagactatttcagcacatttggtgaagtgattatggtgcaggtaaagaaagatgctaagacaggtcattctaaaggatttggatttgttagatttgcagactatgagacacaagtaaaagtgatgtctcagcgtcatatgattgatggccgttggtgtgactgtaagctaccaaattctaagagtccagatgaacctatgcgcagcaggaaggtctttgttgggcgttgcacagaagatatgagtgctgaggagcttcgccagttcttcagccagtatggagaagttgtggatgtctttattccaaagcctttcagagcatttgcatttgttacatttgctgatgaccaggttgcacaatctctctgtggtgaagacctgatcattaaaggagtcagcgttcatgtttctactgcagagcccaagcacaataacaataggcaattagagagaggtggcagatttcctggcccaagttttgggaaccagggttaccccaacagccggccaagtagtggtgcacttggcaacaaccagggtggtaatatgggtggtggtggagggatgaattttggggcctttagcataaatccagcaatgatggcagctgcccaggcagcattgcaaagcagctggggtatgatgggtatgctcgctagtcaacagaatcaatctggcccccagggaagtaatcagggtcaaggaaatcaacaaagggaccagccacaaagttttggttcaaataattcttatggttccaactctggtgcaataggttgggggtcccctaatgctggatctggcagtggatttaatggcggctttagttcaagcatggaatcaaaatcttcaggatggggaatgtag

SEQ ID NO: 19695 - protein, 407 aa, Xenopus tropicalis
MEYIRVAEDENEEPMEIPSEDDGTVLLSTVTAQFPGACGLRYRNPVNQCMRGVRLVEGILHAPENGWGNLVYVVNYPKDNKRKMDETDASSAVKIKRAVTKTSDLIVLGLPWKTTEQDLKDYFSTFGEVIMVQVKKDAKTGHSKGFGFVRFADYETQVKVMSQRHMIDGRWCDCKLPNSKSPDEPMRSRKVFVGRCTEDMSAEELRQFFSQYGEVVDVFIPKPFRAFAFVTFADDQVAQSLCGEDLIIKGVSVHVSTAEPKHNNNRQLERGGRFPGPSFGNQGYPNSRPSSGALGNNQGGNMGGGGGMNFGAFSINPAMMAAAQAALQSSWGMMGMLASQQNQSGPQGSNQGQGNQQRDQPQSFGSNNSYGSNSGAIGWGSPNAGSGSGFNGGFSSSMESKSSGWGM

SEQ ID NO: 19696 - DNA, 1820 bp, Brachydanio rerio
  CDS (45)..(989)
cttagcagcagtcgagtcttacggcggtcactaacggcaaacaaatgtctgaaatggagaagctgtgcaaactcttcgttggcggtctaaacgtccaaacgactaatgatggtctccgctcttattttgagcagtttgggaacctgacggactgcgtggtggtccagaacgatcagcttcagcgatcccgttgtttcggcttcgttacgtactccacctcggaggaggctgatgcagcaatggccgccaggccacatgttgtagacggtaaaaacgtggaggtgaagagagccgtggctcgagaagacgccggaaggcccgaagctctcgccaaagtcaagaaaatattcgtcggtggcctaaaagatgacatcgaagaaaaagacctcaccgaatttttctcgcagttcggcatgatcgagaaatccgaagtcatcaccgacaaagacaccggcaagaagcgtggtttcggctttgtccacttcgaagacaacgactctgcagacaaagccgtcgtgctcaagttccacatgatcaacggacacaaggtggaggtgaagaaagcgctcacgaaacaagagatccaggctgccggtggagcccgcggcggcagagggagaggcggaggaagaggcatgggccgcaatcaaaatggcttcggcggcggtagaggaggaggctacggcggctacgggggcggctatggcggaggatacggcggaaacgatggcggctacggcggtagctatggaagtggaggctacggtggcggttacggaggtggatacggaggaggctacggtgagcagatggggggctatggcggtggaaacgattacagtgactttggcagcggttacggccagcagtcgtccggctacggtcccatgaaaggtggaaacacatacggcggcaggagcggagccccctacccccgtggtggtggcggtgggcctggttacggcaggggtggttatggaggctactaaagcaggttgggaaagactctgcagctgctcccctcccccaggttctctcggtttccacattgggctcattcacccggccatgcaagagatggcggacactgtgaaagcatacctaaaagacctcaattcttaacaggtaggaagaagatctcttcccagaaacctgacttgctcgaccagctttagttgtaggacatgttctattattattattattattctatatatctctatatgtcatttatttcccaattttagggcatgcagcaagatggccccgcttttctttctttctttttaaagaaacgatttgttcgcagccgattcgtttttaaattttgttcaacactggcgatttgttgtctaaatgcatactcaatagacctgttttctatataaactgttgcctagcagtgtcatgggggggattaacgcatgcagttttgagtttgtgttcgtctttgtaaaacccaccacgagattttttttcctaactagtttatcatgatggggatggattaggcttacgtgatttttgttttatttagtaaactagaagagaaacgcactcatctgagttcagttcaacgttgtgtaagcatcatacttccaacattctcttgtgtattgtatattatgtcttcagatcaatccagtattgttaaacattgatatgcaattgtatgttactttttaaataaaagtttcacagcttaaaaaaaaaaaaaaaaaaaaaaaaaaaaaaaaaaaaaccaaaaaaaaaaaaaaaaaaaaaaaaaaaaaaaaaaaaaaaaaaaaaaaaaaaaaaaaaaaaaaaaaaaaaaaaaaaaa

SEQ ID NO: 19697 - protein, 314 aa, Brachydanio rerio
MSEMEKLCKLFVGGLNVQTTNDGLRSYFEQFGNLTDCVVVQNDQLQRSRCFGFVTYSTSEEADAAMAARPHVVDGKNVEVKRAVAREDAGRPEALAKVKKIFVGGLKDDIEEKDLTEFFSQFGMIEKSEVITDKDTGKKRGFGFVHFEDNDSADKAVVLKFHMINGHKVEVKKALTKQEIQAAGGARGGRGRGGGRGMGRNQNGFGGGRGGGYGGYGGGYGGGYGGNDGGYGGSYGSGGYGGGYGGGYGGGYGEQMGGYGGGNDYSDFGSGYGQQSSGYGPMKGGNTYGGRSGAPYPRGGGGGPGYGRGGYGGY

SEQ ID NO: 19698 - DNA, 1863 bp, Brachydanio rerio
  CDS (52)..(1074)
cttttcacttgctgctgttacgtttttaggttttcacattcaactaccaccatgtcagacgccgagcagcagtatatggaaacctcactgaacggccacgagggtgaggatgatttgaacggagccgggcagtacgatcagggcaacggggatgcgcaggccggggcgcaaggaaacgccggtgcggacgggacggccggagacgatggagcggacggcgggcaaattgatgcgagcaaaggagaggaagatgcggggaaaatgttcgtcgggggcctcagctgggacaccagtaaaaaggatcttaaagattatttctctaaatttggagaggtgacagactgcaccattaaaatggacccaaacactggacgttcaaggggattcgggttcattcttttcaaagagccatcaggtgtagataaggttttagcacaaaaggagcacagactggatggacgacagattgaccccaagaaggcaatggcaatgaaaaaggagccagttaagaagatctttgttggcggactgaaccctgaaaccacagaagagaggatccgcgagtatttcggtgcctttggcgagattgagactatcgagcttccaatggaccccaagtcaaacaagaggagaggctttgtcttcattaccttcaaggaagaagaggcggtcaagaagattctggagaagaaatatcacaatgtcagtggaaccaaggacacaagcggaaaagaaggcctttgtgagattaagattgcacagcctaaggaagtgtaccagcagcagcagtatggaggtcgctttggtggaggaggaagaggaagggggcgtggaggtcagggtcagaactggaaccagggctacaataactactggaatcaaggctacggaaaccaaggctatggcggatacggcgggcagcaaggctacggaggatacggcggctacgggaactacgactactcgggcggctactatggcggatacggcggatatgactacaaccagggcaatacaagctatggaaaaactccaagacgtggggctcaccagagtagctacaagccatactgatcatgtgtagtgcaggtcgtaaagctgccgagcaggaaccagcggtctggtcgcagtgaacgttgggatcttttactttttggaagttggcagaatctggacttctgcttcattttgtacagaaaacaaaaggaactgggggggcgcaaatgtcacttttcacatttgttttattttacttttgttttttgtttttgttttattttcgtgttttgtgtcctttttacatttccagaaatggaagtgttatttttttactgtactttttggtacctttttgaatctaatgtattgtatggttgtattttacatcatggctgtgtctatcacatctaggctcagagctctctaaaaatgctttcaaaataaacatttttggttgatttttacttcttttggttagtgttcctagatgatttccttttctccccctagtgtcacctgtgctttgtgttgcatggcttcacggtgagatgaaaagggatttctttatgattgtaagcttgtccattttgaaatctgttagcggcaagtcttggtgacatttttattcttttaatttgtttgttttttttcctctccctgtactgcttttaaggagacttcctcccatcgtgttagatatttaagagtggctttaatagtgattaaactatacctcaaaacatacacaggtaaactgtaacacgactctttctggaaacactggatacacattcctccagtgtcttggacaaatttcaagaaataaacttgatttttaagaaaaaaaaaaaaaaaaaaaaaaaa

SEQ ID NO: 19699 - protein, 340 aa, Brachydanio rerio
MSDAEQQYMETSLNGHEGEDDLNGAGQYDQGNGDAQAGAQGNAGADGTAGDDGADGGQIDASKGEEDAGKMFVGGLSWDTSKKDLKDYFSKFGEVTDCTIKMDPNTGRSRGFGFILFKEPSGVDKVLAQKEHRLDGRQIDPKKAMAMKKEPVKKIFVGGLNPETTEERIREYFGAFGEIETIELPMDPKSNKRRGFVFITFKEEEAVKKILEKKYHNVSGTKDTSGKEGLCEIKIAQPKEVYQQQQYGGRFGGGGRGRGRGGQGQNWNQGYNNYWNQGYGNQGYGGYGGQQGYGGYGGYGNYDYSGGYYGGYGGYDYNQGNTSYGKTPRRGAHQSSYKPY

SEQ ID NO: 19700 - DNA, 918 bp, Brachydanio rerio
  CDS (1)..(918)
atgacggctcaaatggaaaaccagctttgcaagctatttgtcggcggtcttaacgtccagactaccgacgatgggctgcgaaaccatttcgagcagtacggcaagctcacggactgcgtggtggtgcagaaccaacaattgaagcgctcgcgttgcttcggttttgtgacctactcgagtccggacgaggcggactccgccatgtcggcccgacctcacattctagatggcaataacgtggagctgaaaagggctgtggcccgagaagacgcgggcaagcccgaggctctcgcaaaggtaaaaaagatcttcatcggcggtctaaaagacgatatcgaagaggatcacctccgtgactgtttctcgcagttcggcgcggtggagaaggcggaggtgatcacggacaaagagaccggcaagaagcgaggcttcggctttgtctatttcgaagataacgactcggccgacaaagccgtggtgctcaagttccacatgattaacggtcataaagtggaggtaaagaaagccctcaccaagcaggagatgcaagctgccggtagccgcggcggtggtcgtggcggccgaggaggcggaagggggatgggcagaccgcagaacggctacggcgggcgcggcggaggatacggcaactacggtggcggcggctatgggggcaacgacggctacggtggtggctatggaggcggatacggtggcgggtatgggggaggctacggggaccaaatggaaggctacggcggtggtaacggctacaatgactttggcagcggctatggccagcagtcctctggctatggcccaatgaaaggtaattactcgggcagaagcaacgctccttactcccgaggtggtggtggtggtggttacggcagggggggttacggaggctcgtattaa

SEQ ID NO: 19701 - protein, 305 aa, Brachydanio rerio
MTAQMENQLCKLFVGGLNVQTTDDGLRNHFEQYGKLTDCVVVQNQQLKRSRCFGFVTYSSPDEADSAMSARPHILDGNNVELKRAVAREDAGKPEALAKVKKIFIGGLKDDIEEDHLRDCFSQFGAVEKAEVITDKETGKKRGFGFVYFEDNDSADKAVVLKFHMINGHKVEVKKALTKQEMQAAGSRGGGRGGRGGGRGMGRPQNGYGGRGGGYGNYGGGGYGGNDGYGGGYGGGYGGGYGGGYGDQMEGYGGGNGYNDFGSGYGQQSSGYGPMKGNYSGRSNAPYSRGGGGGGYGRGGYGGSY

SEQ ID NO: 19702 - DNA, 1659 bp, Brachydanio rerio
  CDS (52)..(981)
gaaagcggcttttcagcgccaatattttacagcgatccaaatctactaaaaatggccgacgagcagttcatggagacctccgagaacgggaatgaggagaacctgaacggaggagaggccgcgggggagaacggagccggtgagggactgcagatcgacgccagcaagtgcgaagaagatgccggtaaaatgtttgttggaggactcagctgggacaccagtaagaaagacctaaaggactacttctcgaagtttggtgaggtgatggactgcaccatcaagatggattcaaacactggtcggtcacgagggtttggcttcatcttgttcaaagaatcagacagcgtggacagggtgctgcagcagaaggaacacaggctagatggccgacagatcgaccctaagagagccatggccataaagaaagagcccgtcaagaagatctttgttggtggccttaaccctgaaaccacagaagagaagatccgtgaatatttcggctcctttggagagatcgaaactattgaacttccaactgatcccaagaccagcaaacggaggggtttcgtttttattacatttaaggaagagttcgccgtcaagaagatcctggagaagaaataccataatgtttgtggaagcaagtgtgagatcaaaatcgctcagcccaaggagatctaccagcagcagcagtttggggcccgtggtggaggattcgggggccgcggccgggggcgtggaggtccaggccagagctggaaccagggctataacaactactggaatcagggttatgggggtcagggctacggatacggtggccagcaaggctatggaggttatggaggatacggcaactatgattactcctctggatactatggttatggcagtggttatgactacactgaccaaggagctgcaagttatggaaagacacccagacgtggaggccaccagagtggctacaagccatactgaactcgcacacaacagaactgaagtattcccaaaaagcagagtctgaccacaacgctgacaacagttcacacaaacagacacagactctttcctttaaccggacgagacatgacccatttgtacagaacagctgaataggggaagcagcgtcacacttccacatttttattttaattttattttccttttgtccacatttccagcaatggaagtgttatttttactgtactttttggtaccttttttgaataatgttattgtatggttgtattttacatgtctactggatttgccacattgaggttcgggagctgccagagcttttgaaataaaacgattttgagtaaatttttctcaatgtttccagatgtttactatgctttttctgcttcctgttgttgcatagcgtaggagagtctttttaaaaaacatccagtgaatgtcagcgttttgggtaatatctaatagtgactggaagtgtccgctcttttgttggcttttcattttaatcctgtttcttttattttgtttgacttgcctgctgggttatgatgcttcagtttgtcaatttggatttatttgctagtgaccagcattgttgcttactgaaatctcattcctatagtgctttttggtagaaaataaatgatttgtaagtttaaaaaaaaaaaaaaaaaa

SEQ ID NO: 19703 - protein, 309 aa, Brachydanio rerio
MADEQFMETSENGNEENLNGGEAAGENGAGEGLQIDASKCEEDAGKMFVGGLSWDTSKKDLKDYFSKFGEVMDCTIKMDSNTGRSRGFGFILFKESDSVDRVLQQKEHRLDGRQIDPKRAMAIKKEPVKKIFVGGLNPETTEEKIREYFGSFGEIETIELPTDPKTSKRRGFVFITFKEEFAVKKILEKKYHNVCGSKCEIKIAQPKEIYQQQQFGARGGGFGGRGRGRGGPGQSWNQGYNNYWNQGYGGQGYGYGGQQGYGGYGGYGNYDYSSGYYGYGSGYDYTDQGAASYGKTPRRGGHQSGYKPY

SEQ ID NO: 19704 - DNA, 1245 bp, Xenopus laevis
  CDS (71)..(946)
gtgaactgtaggcggcagtctcttgcgcttcaactgatgcgtagtagaaaattatgcagtcttgctcgagatggagctgtctgagatcacccgcagtaccctagttagcacgttatcgcgtttgcttcgtcgtcataaagaatctaaccccgatttttttttaatacgcagcaaaatgttcatcggaggtcttagttgggatacgagcaagaaagaccttacagagtatctgtctcgatttggggaggtgctagattgcacaatcaaaactgatccagtgactggtcgatcaagaggatttggttttgttcttttcaaagatgccgtgagcgttgacaaagtgcttgaaacaaaagagcataaattggatggcaagcttattgacccaaagagagctaaggcactgcaaggcaaagagcctcctaagaaagtgtttgtcggtggactcagtcctgaaacaacagaggagcagatcaaacagtattttggtggattcggagaaattgaaaatattgaactgccaatggacacaaagacaaatgaaaggagagggttttgttttgtcacctacacagacgaagaacccgtacagaagcttttggaaagtcgatttcatcaaattggtacaggaaagtgtgaaataaaagctgcacagcccaaagaagtctacaggcagcaacaacagaagcaacagaaaggaggaaggggtggcaccagaggaagaggcagaggtcaaggttacagcaactactacgatcaaaactatggaggctatggaaacaatgattcctatggtgatcaaggctatggtggttatgattactctggatataactatgggaactatggatataatcaaggttacacagactacagtgggcaacaaagcacatacggcaaagcaagaggtggaggaaaccatcaaaacaattaccagccttactaatgcaatgacaaattaaaccttagatggagatggttaaagagaagaacatcacgcagcagtgctgggagaaccatcacattactcttgagaggactatgaccaaggcacgaagtgtcttgctgtaaatagaaaatgggattttgtttcttttatttttatggcatttttgccatctgtatgataagggttttatgttcagcaatattaattgtcatttgtgcttgtgaagtgatcagtgcattcattttgatggaaatgaagtttgtaataaaagtaagaacagcaaaaaaaaaaaaaaa

SEQ ID NO: 19705 - protein, 291 aa, Xenopus laevis
MELSEITRSTLVSTLSRLLRRHKESNPDFFLIRSKMFIGGLSWDTSKKDLTEYLSRFGEVLDCTIKTDPVTGRSRGFGFVLFKDAVSVDKVLETKEHKLDGKLIDPKRAKALQGKEPPKKVFVGGLSPETTEEQIKQYFGGFGEIENIELPMDTKTNERRGFCFVTYTDEEPVQKLLESRFHQIGTGKCEIKAAQPKEVYRQQQQKQQKGGRGGTRGRGRGQGYSNYYDQNYGGYGNNDSYGDQGYGGYDYSGYNYGNYGYNQGYTDYSGQQSTYGKARGGGNHQNNYQPY

SEQ ID NO: 19706 - DNA, 1364 bp, Xenopus laevis
  CDS (87)..(1184)
gagccattgcgctataatctacactcttccttcctgtcgcttctcttttgtttcagtcgttgtcgagttaaaaagggagagtcaccatgcacaagtccgaggcacccaacgagccagagcaactccgcaagctgttcattggaggcttgagttttgaaaccacagatgaaagtctccgcgagcactttgagcaatggggcacccttacagactgtgtggttatgagggatccaaactcaaaacgttcccgtggctttggatttgttacatacttatctacagatgaagtagatgctgccatgactgctcgcccacataaagtggatgggcgagtggttgaacctaaaagggctgtctctagagaggattcctctaggcctggtgcacacctcaccgtaaagaaaatctttgtaggtggtatcaaggaggacacagaagaagatcatttacgagaatatttcgagcaatatggcaaaattgaagttatagagataatgactgaccgaggcagtggcaagaaaagaggctttgcatttgtcacatttgaagatcatgattccgttgacaagattgtcatccagaaatatcacaccgtcaacaaccacaattgtgaagtgcggaaggcactctccaaacaggaaatggcaagtgtttctggcagtcagagaggacgtggtggctctggaaactatggaagccgtggtgggtttggtaatgataactttggtggtcgtggtggcaactttggtggcaacagaggaggagggggtggatttggtaatcgaggttatggtggagacggctacaatggtgatggcaattatggtggcagccctccctactcgggtggtaaccgaggctatggtgctggccaaggaggtggatatggtgctggccaaggaggtggatatggtggtggtggccaaggaggtggatatggtggaaatggaggatacgatggttataatggcggaggcagtggcttcagtggctctggtggtaactttggtagcagtgggggatataacgactttggcaactacaacagtcagtcatcatccaactttggcccaatgaaaggtggaaattatggtggtggcagaaattctggaccatatggaggtggctatggcggagggtctgctagcagcagtagcggatatggcggtgggaggaggttttaatttttccacaggggaatatccatctacatgattaaacgaaacgtggaccttggtttgtgaagaagtgtccagatacaggttttaaggttaactgatgtgacggatctgaccaacttcaaatttcacagctactgtgtagctctgttttgtttttttgttcttttccaaaataaaaaaaaa

SEQ ID NO: 19707 - protein, 365 aa, Xenopus laevis
MHKSEAPNEPEQLRKLFIGGLSFETTDESLREHFEQWGTLTDCVVMRDPNSKRSRGFGFVTYLSTDEVDAAMTARPHKVDGRVVEPKRAVSREDSSRPGAHLTVKKIFVGGIKEDTEEDHLREYFEQYGKIEVIEIMTDRGSGKKRGFAFVTFEDHDSVDKIVIQKYHTVNNHNCEVRKALSKQEMASVSGSQRGRGGSGNYGSRGGFGNDNFGGRGGNFGGNRGGGGGFGNRGYGGDGYNGDGNYGGSPPYSGGNRGYGAGQGGGYGAGQGGGYGGGGQGGGYGGNGGYDGYNGGGSGFSGSGGNFGSSGGYNDFGNYNSQSSSNFGPMKGGNYGGGRNSGPYGGGYGGGSASSSSGYGGGRRF

SEQ ID NO: 19708 - DNA, 1161 bp, Brachydanio rerio
  CDS (112)..(945)
gtcgagtaagtgactgtgttgggcgggtcgagacacagcggacacatataaaccagcacacgcttttgtcttgtctattgattctgagtggcattaacgttactggaaaaaatggcagaggcagaccgacctgggaagctcttcatcggtggcctgaacactgaaactagtgagaaagtcctcgaagcctatttcagcaaatttggcagaatatcggaagttctgttgatgaaagatcgtgaaacaaacaaatctagaggttttgcgtttgtaacttatgaaaatcctagtgatgctaaggatgctgccagagaaatgaatggaaagcctcttgatggaaagccaattaaagtggagcaagccacaaaacctcagtttgagacttcaggacgccgtgggccaccaccacctcgcagtcgtggcccttctagagggctgcgagggtccagaggaggcccaagtggaatgcggggcccaccaagcagagaacccttttttaaaggcatgtcgtccagagggccaccaccaatgaaaagaggccccccagagcgaaacggaggacccccacccaagagatctgcaccttctgggccaatgggcagaccgtccagagaccgggatccatatggcccccctccacgcagagattctcttatgtcacggcgggatgatggtcctccacatcgagatgaccactatggtagtaaagacagttattccagccgtgactacatgagctcacgggacagcagagactatggcccacctccacgagattatccataccgggagtattcaggccattccagttccagagatgactatgggtcaggatcaagaggctatagtgatcgtgatggctatggtggaggacgagagccccggggttatatagatcgacccagtgcaggctcctatagagatccttatgatggttacggataaatggaggaaaaactgctttgacggtaatacttcattgctgagcagtaccaactgtcaattatggatgaagcaggatggtccatggtgtaatgcagaccatcctttcggaggctgctgttccttgaggctgaaagcatttggatggagtcacgcaatgctacaatttctcttctttttcccaataaaatcattttaagtaaaaaaaaaaaaaaaaaa

SEQ ID NO: 19709 - protein, 277 aa, Brachydanio rerio
MAEADRPGKLFIGGLNTETSEKVLEAYFSKFGRISEVLLMKDRETNKSRGFAFVTYENPSDAKDAAREMNGKPLDGKPIKVEQATKPQFETSGRRGPPPPRSRGPSRGLRGSRGGPSGMRGPPSREPFFKGMSSRGPPPMKRGPPERNGGPPPKRSAPSGPMGRPSRDRDPYGPPPRRDSLMSRRDDGPPHRDDHYGSKDSYSSRDYMSSRDSRDYGPPPRDYPYREYSGHSSSRDDYGSGSRGYSDRDGYGGGREPRGYIDRPSAGSYRDPYDGYG

SEQ ID NO: 19710 - DNA, 1579 bp, Brachydanio rerio
  CDS (122)..(1261)
gaccgtcgagtaagtgactgtgactgtgttgggcgggtcgagacacagcggacacatataaaccagcacacgcttttgtcttgtctattgattctgagtggcattaacgttactggaaaaaatggcagaggcagaccgacctgggaagctcttcatcggtggcctgaacactgaaactagtgaaaaagtcctcgaagcctatttcagcaaattcggcagaatatcggaagttctgttgatgaaagatcgtgaaacgaacaaatctagaggttttgcgtttgtaacttatgaaaatcctggtgatgctaaggatgctgccagagaaatgaatggaaagcctcttgatggaaagccaattaaagtggagcaagccacaaaacctcagtttgagacttcaggacgccgtgggccaccaccacctcgcagtcgtggcccttctagagggctgcgagggtccagaggaggcccaagtggaatgcggggcccaccaagcagagaacccttttttaaaggcatgtcgtccagagggccaccaccaatgaaaagaggccccccagagcgaaacggaggacccccacccaagagatctgcaccttctgggccaatgggcagaccgtccagagaccgggatccatatggcccccctccacgcagagattctcttatgtcacggcgggatgatggtcctccacatcgagatgaccactatggtagtaaagacagttattccagccgtgactacatgagctcacgggacagcagagactatggcccacctccacgagattatccataccgggagtattcaggccattccagttccagagatgactatgggtcaggatcaagaggctatagtgatcgtgatggctatggtggaggacgagagccccggggttatatagatcgacccagtgcaggctcctatagagatccttatgatggttacggtaactcacgcagcgccccaccctcgaggggtccccctccgtcctacagtgggagtggcggaagcagtcgttatgacgactatggcagcagttcccgggatggatatggcagtcgtgacagttatcccagcagtcggagtgacccgtactccactaatcgtggtgaccgaccgggtaggcaggagcgagggcctcccccactcgaaagaggctatcctcgtgaatacagcagctcaagccgtggggcacctcgtgggggtggacgcggtggccgccgacctgatagaggaatgggccgaaaccgatactgaaatggactgtggagatggaaaatgagtcggagaaatgaaatggtggcttctcgttcaaaagactttgagcttcaaaagcgttcttttaaacactgaacttcaagcttccgtttcaagctgtacccaaacttgtgacgttttttttattttgtaatttttaaatgcaaagttcttttctctacccagctcacatttactggtaccgttgcaaatcttaagtgtgttctttgttttctagtgatttgtaaaacctgcaatgccgtaacgttggctttcatttaccaataaagtgtttttaatcaaaaaaaaaaaaaaaaa

SEQ ID NO: 19711 - protein, 379 aa, Brachydanio rerio
MAEADRPGKLFIGGLNTETSEKVLEAYFSKFGRISEVLLMKDRETNKSRGFAFVTYENPGDAKDAAREMNGKPLDGKPIKVEQATKPQFETSGRRGPPPPRSRGPSRGLRGSRGGPSGMRGPPSREPFFKGMSSRGPPPMKRGPPERNGGPPPKRSAPSGPMGRPSRDRDPYGPPPRRDSLMSRRDDGPPHRDDHYGSKDSYSSRDYMSSRDSRDYGPPPRDYPYREYSGHSSSRDDYGSGSRGYSDRDGYGGGREPRGYIDRPSAGSYRDPYDGYGNSRSAPPSRGPPPSYSGSGGSSRYDDYGSSSRDGYGSRDSYPSSRSDPYSTNRGDRPGRQERGPPPLERGYPREYSSSSRGAPRGGGRGGRRPDRGMGRNRY

SEQ ID NO: 19712 - DNA, 25 bp, Primer
atgagctctgacgaagaagatttca

SEQ ID NO: 19713 - DNA, 25 bp, Primer
ttacctattatatggatggtagcca

SEQ ID NO: 19714 - DNA, 1179 bp, Saccharomyces cerevisiae
  CDS (1)..(1179)
atgtccaactttaagaattttactttaaattcctttgaagattattacggaaagccctctgaaacgccaaaaatggaggaagagaaattggaagtaacaaatgtgaatgcgtcctcttcaaaaaaagtacataaaagcaaaaagagcacttcaaaatatgaccaaaagaatgtatttagaaactcaatgacaggaattgcacaaatactgccaacaaaacctgtgaaaattatagagcagaatattgattttgccaatccgaagagcttcgacctcctgcaatctacacatactatttgctttaataaaagaattaacactactaataccaagttgaatgtggaaactcatacttctagtgatattgacaacgacatattgcacgttggagcccccacagacttggggggaaacagtaatgacgaagcggaaacaaggcaactaaggaagtttcgatggtccaataataaagaaaaaagtctttgtgaaaagttaacagtcatatattgggccctcttgctccacacaacaaagagagcaagtaaaaggagacctatattatgtcatcaaatgatagctgagttttttaacagagtttataaggagaaatcaagagtacctataacttcaagatatattagagataacctcgtcgcttgggtcactcaaggaaaggaattgcatgaaaaaggttgggtaggggatgccaaaactggcgatttgcaagaacagttcaatatagccactgtcaaattatatgaaagcgcagaagacgggcgtctttccattggtaaagacaaaccctttcgagaggaaaacaccggcagtgatagtttggttcgagcggaagaggactctaccgctgtcactaatgaaaatggacatatttcttcagaaaaaaacttgaaaaaagatcgtagagagtctataaggaaccaaatcctgactttagacctaaatgacgaagattttttccaaaatgtaatgaaagttttatcagccattgatgaaccagaactgagacaatatgtaatcgtaatctcagaattagttagcatggaaatggatgatggtaaaacggtacgagaaaagctccgagacgttgaattgaatattaataggttgcaggttgatataaaagaaataaaggaaatgcttgttacactgataaacaaatga

SEQ ID NO: 19715 - protein, 392 aa, Saccharomyces cerevisiae
MSNFKNFTLNSFEDYYGKPSETPKMEEEKLEVTNVNASSSKKVHKSKKSTSKYDQKNVFRNSMTGIAQILPTKPVKIIEQNIDFANPKSFDLLQSTHTICFNKRINTTNTKLNVETHTSSDIDNDILHVGAPTDLGGNSNDEAETRQLRKFRWSNNKEKSLCEKLTVIYWALLLHTTKRASKRRPILCHQMIAEFFNRVYKEKSRVPITSRYIRDNLVAWVTQGKELHEKGWVGDAKTGDLQEQFNIATVKLYESAEDGRLSIGKDKPFREENTGSDSLVRAEEDSTAVTNENGHISSEKNLKKDRRESIRNQILTLDLNDEDFFQNVMKVLSAIDEPELRQYVIVISELVSMEMDDGKTVREKLRDVELNINRLQVDIKEIKEMLVTLINK

SEQ ID NO: 19716 - DNA, 28 bp, Primer
atgtccaactttaagaattttactttaa

SEQ ID NO: 19717 - DNA, 26 bp, Primer
tcatttgtttatcagtgtaacaagca

SEQ ID NO: 19718 - DNA, 2685 bp, Escherichia coli K12; identical to SEQ ID NO: 1982
  CDS (1)..(2685)

SEQ ID NO: 19719 - protein, 894 aa, Escherichia coli K12; identical to SEQ ID NO: 1983

SEQ ID NO: 19720 - DNA, 2679 bp, Caulobacter crescentus; identical to SEQ ID NO: 1984
  CDS (1)..(2679)

SEQ ID NO: 19721 - protein, 892 aa, Caulobacter crescentus; identical to SEQ ID NO: 1985

SEQ ID NO: 19722 - DNA, 2709 bp, Salmonella enterica subsp. enterica serovar Typhi; identical to SEQ ID NO: 1986
  CDS (1)..(2709)

SEQ ID NO: 19723 - protein, 902 aa, Salmonella enterica subsp. enterica serovar Typhi; identical to SEQ ID NO: 1987

SEQ ID NO: 19724 - DNA, 2691 bp, Listeria innocua; identical to SEQ ID NO: 1988
  CDS (1)..(2691)

SEQ ID NO: 19725 - protein, 896 aa, Listeria innocua; identical to SEQ ID NO: 1989

SEQ ID NO: 19726 - DNA, 2727 bp, Yersinia pestis; identical to SEQ ID NO: 1990
  CDS (1)..(2727)

SEQ ID NO: 19727 - protein, 908 aa, Yersinia pestis; identical to SEQ ID NO: 1991

SEQ ID NO: 19728 - DNA, 2658 bp, Pseudomonas aeruginosa; identical to SEQ ID NO: 1992
  CDS (1)..(2658)

SEQ ID NO: 19729 - protein, 885 aa, Pseudomonas aeruginosa; identical to SEQ ID NO: 1993

SEQ ID NO: 19730 - DNA, 2634 bp, Staphylococcus aureus; identical to SEQ ID NO: 1994
  CDS (1)..(2634)

SEQ ID NO: 19731 - protein, 877 aa, Staphylococcus aureus; identical to SEQ ID NO: 1995

SEQ ID NO: 19732 - DNA, 2703 bp, Agrobacterium tumefaciens; identical to SEQ ID NO: 1996
  CDS (1)..(2703)

SEQ ID NO: 19733 - protein, 900 aa, Agrobacterium tumefaciens; identical to SEQ ID NO: 1997

SEQ ID NO: 19734 - DNA, 2658 bp, Staphylococcus aureus; identical to SEQ ID NO: 1998
  CDS (1)..(2658)

SEQ ID NO: 19735 - protein, 885 aa, Staphylococcus aureus; identical to SEQ ID NO: 1999

SEQ ID NO: 19736 - DNA, 2691 bp, Sinorhizobium meliloti; identical to SEQ ID NO: 2000
  CDS (1)..(2691)

SEQ ID NO: 19737 - protein, 896 aa, Sinorhizobium meliloti; identical to SEQ ID NO: 2001

SEQ ID NO: 19738 - DNA, 2703 bp, Clostridium acetobutylicum; identical to SEQ ID NO: 2002
  CDS (1)..(2703)

SEQ ID NO: 19739 - protein, 900 aa, Clostridium acetobutylicum; identical to SEQ ID NO: 2003

SEQ ID NO: 19740 - DNA, 2583 bp, Mycobacterium tuberculosis; identical to SEQ ID NO: 2004
  CDS (1)..(2583)

SEQ ID NO: 19741 - protein, 860 aa, Mycobacterium tuberculosis; identical to SEQ ID NO: 2005

SEQ ID NO: 19742 - DNA, 2547 bp, Streptomyces coelicolor; identical to SEQ ID NO: 2006
  CDS (1)..(2547)

SEQ ID NO: 19743 - protein, 848 aa, Streptomyces coelicolor; identical to SEQ ID NO: 2007

SEQ ID NO: 19744 - DNA, 2694 bp, Photorhabdus luminescens; identical to SEQ ID NO: 2008
  CDS (1)..(2694)

SEQ ID NO: 19745 - protein, 897 aa, Photorhabdus luminescens; identical to SEQ ID NO: 2009

SEQ ID NO: 19746 - DNA, 2688 bp, Chromobacterium violaceum; identical to SEQ ID NO: 2010
  CDS (1)..(2688)

SEQ ID NO: 19747 - protein, 895 aa, Chromobacterium violaceum; identical to SEQ ID NO: 2011

SEQ ID NO: 19748 - DNA, 2715 bp, Bordetella pertussis; identical to SEQ ID NO: 2012
  CDS (1)..(2715)

SEQ ID NO: 19749 - protein, 904 aa, Bordetella pertussis; identical to SEQ ID NO: 2013

SEQ ID NO: 19750 - DNA, 2796 bp, Bordetella bronchiseptica; identical to SEQ ID NO: 2014
  CDS (1)..(2796)

SEQ ID NO: 19751 - protein, 931 aa, Bordetella bronchiseptica; identical to SEQ ID NO: 2015

SEQ ID NO: 19752 - DNA, 2556 bp, Streptomyces avermitilis; identical to SEQ ID NO: 2016
  CDS (1)..(2556)

SEQ ID NO: 19753 - protein, 851 aa, Streptomyces avermitilis; identical to SEQ ID NO: 2017

SEQ ID NO: 19754 - DNA, 2553 bp, Enterococcus faecalis; identical to SEQ ID NO: 2018
  CDS (1)..(2553)

SEQ ID NO: 19755 - protein, 850 aa, Enterococcus faecalis; identical to SEQ ID NO: 2019

SEQ ID NO: 19756 - DNA, 2664 bp, Pseudomonas syringae; identical to SEQ ID NO: 2020
  CDS (1)..(2664)

SEQ ID NO: 19757 - protein, 887 aa, Pseudomonas syringae; identical to SEQ ID NO: 2021

SEQ ID NO: 19758 - DNA, 2655 bp, Pseudomonas putida; identical to SEQ ID NO: 2022
  CDS (1)..(2655)

SEQ ID NO: 19759 - protein, 884 aa, Pseudomonas putida; identical to SEQ ID NO: 2023

SEQ ID NO: 19760 - DNA, 2724 bp, Bradyrhizobium japonicum; identical to SEQ ID NO: 2024
  CDS (1)..(2724)

SEQ ID NO: 19761 - protein, 907 aa, Bradyrhizobium japonicum; identical to SEQ ID NO: 2025

SEQ ID NO: 19762 - DNA, 2613 bp, Leptospira interrogans; identical to SEQ ID NO: 2026
  CDS (1)..(2613)

SEQ ID NO: 19763 - protein, 870 aa, Leptospira interrogans; identical to SEQ ID NO: 2027

SEQ ID NO: 19764 - DNA, 2661 bp, Xanthomonas campestris; identical to SEQ ID NO: 2028
  CDS (1)..(2661)

SEQ ID NO: 19765 - protein, 886 aa, Xanthomonas campestris; identical to SEQ ID NO: 2029

SEQ ID NO: 19766 - DNA, 2661 bp, Xanthomonas axonopodis; identical to SEQ ID NO: 2030
  CDS (1)..(2661)

SEQ ID NO: 19767 - protein, 886 aa, Xanthomonas axonopodis; identical to SEQ ID NO: 2031

SEQ ID NO: 19768 - DNA, 2814 bp, Ralstonia solanacearum; identical to SEQ ID NO: 2032
  CDS (1)..(2814)

SEQ ID NO: 19769 - protein, 937 aa, Ralstonia solanacearum; identical to SEQ ID NO: 2033

SEQ ID NO: 19770 - DNA, 2667 bp, Listeria innocua; identical to SEQ ID NO: 2034
  CDS (1)..(2667)

SEQ ID NO: 19771 - protein, 888 aa, Listeria innocua; identical to SEQ ID NO: 2035

SEQ ID NO: 19772 - DNA, 2724 bp, Rhizobium loti; identical to SEQ ID NO: 2036
  CDS (1)..(2724)

SEQ ID NO: 19773 - protein, 907 aa, Rhizobium loti; identical to SEQ ID NO: 2037

SEQ ID NO: 19774 - DNA, 2565 bp, Rathayibacter rathayi; identical to SEQ ID NO: 2038
  CDS (1)..(2565)

SEQ ID NO: 19775 - protein, 854 aa, Rathayibacter rathayi; identical to SEQ ID NO: 2039

SEQ ID NO: 19776 - DNA, 2658 bp, Geobacter sulfurreducens; identical to SEQ ID NO: 2040
  CDS (1)..(2658)

SEQ ID NO: 19777 - protein, 885 aa, Geobacter sulfurreducens; identical to SEQ ID NO: 2041

SEQ ID NO: 19778 - DNA, 2577 bp, Mycobacterium paratuberculosis; identical to SEQ ID NO: 2042
  CDS (1)..(2577)

SEQ ID NO: 19779 - protein, 858 aa, Mycobacterium paratuberculosis; identical to SEQ ID NO: 2043

SEQ ID NO: 19780 - DNA, 2724 bp, Rhodopseudomonas palustris; identical to SEQ ID NO: 2044
  CDS (1)..(2724)

SEQ ID NO: 19781 - protein, 907 aa, Rhodopseudomonas palustris; identical to SEQ ID NO: 2045

SEQ ID NO: 19782 - DNA, 24 bp, Primer
atgaataacgaacccttacgtccc

SEQ ID NO: 19783 - DNA, 28 bp, Primer
ttacatatcctcatgaaattcttcaagt

SEQ ID NO: 19784 - DNA, 723 bp, Escherichia coli; identical to SEQ ID NO: 417
  CDS (1)..(723)

SEQ ID NO: 19785 - protein, 240 aa, Escherichia coli; identical to SEQ ID NO: 418

SEQ ID NO: 19786 - DNA, 723 bp, Listeria innocua; identical to SEQ ID NO: 453
  CDS (1)..(723)

SEQ ID NO: 19787 - protein, 240 aa, Listeria innocua; identical to SEQ ID NO: 454

SEQ ID NO: 19788 - DNA, 798 bp, Yersinia pestis; identical to SEQ ID NO: 2052
  CDS (1)..(798)

SEQ ID NO: 19789 - protein, 265 aa, Yersinia pestis; identical to SEQ ID NO: 452

SEQ ID NO: 19790 - DNA, 744 bp, Salmonella enterica subsp. enterica serovar Typhi; identical to SEQ ID NO: 2054
  CDS (1)..(744)

SEQ ID NO: 19791 - protein, 247 aa, Salmonella enterica subsp. enterica serovar Typhi; identical to SEQ ID NO: 460

SEQ ID NO: 19792 - DNA, 714 bp, Listeria innocua; identical to SEQ ID NO: 455
  CDS (1)..(714)

SEQ ID NO: 19793 - protein, 237 aa, Listeria innocua; identical to SEQ ID NO: 456

SEQ ID NO: 19794 - DNA, 723 bp, Listeria monocytogenes; identical to SEQ ID NO: 457
  CDS (1)..(723)

SEQ ID NO: 19795 - protein, 240 aa, Listeria monocytogenes; identical to SEQ ID NO: 458

SEQ ID NO: 19796 - DNA, 729 bp, Listeria monocytogenes; identical to SEQ ID NO: 429
  CDS (1)..(729)

SEQ ID NO: 19797 - protein, 242 aa, Listeria monocytogenes; identical to SEQ ID NO: 430

SEQ ID NO: 19798 - DNA, 729 bp, Listeria innocua; identical to SEQ ID NO: 2062
  CDS (1)..(729)

SEQ ID NO: 19799 - protein, 242 aa, Listeria innocua; identical to SEQ ID NO: 432

SEQ ID NO: 19800 - DNA, 729 bp, Bacillus subtilis; identical to SEQ ID NO: 421
  CDS (1)..(729)

SEQ ID NO: 19801 - protein, 242 aa, Bacillus subtilis; identical to SEQ ID NO: 422

SEQ ID NO: 19802 - DNA, 747 bp, Bacillus halodurans; identical to SEQ ID NO: 445
  CDS (1)..(747)

SEQ ID NO: 19803 - protein, 248 aa, Bacillus halodurans; identical to SEQ ID NO: 446

SEQ ID NO: 19804 - DNA, 723 bp, Bacillus halodurans; identical to SEQ ID NO: 433
  CDS (1)..(723)

SEQ ID NO: 19805 - protein, 240 aa, Bacillus halodurans; identical to SEQ ID NO: 434

SEQ ID NO: 19806 - DNA, 714 bp, Bacillus halodurans; identical to SEQ ID NO: 427
  CDS (1)..(714)

SEQ ID NO: 19807 - protein, 237 aa, Bacillus halodurans; identical to SEQ ID NO: 428

SEQ ID NO: 19808 - DNA, 811 bp, Corynebacterium glutamicum; identical to SEQ ID NO: 2072

SEQ ID NO: 19809 - protein, 269 aa, Corynebacterium glutamicum; identical to SEQ ID NO: 462

SEQ ID NO: 19810 - DNA, 732 bp, Bacillus subtilis; identical to SEQ ID NO: 425
  CDS (1)..(732)

SEQ ID NO: 19811 - protein, 243 aa, Bacillus subtilis; identical to SEQ ID NO: 426

SEQ ID NO: 19812 - DNA, 744 bp, Caulobacter crescentus; identical to SEQ ID NO: 2076
  CDS (1)..(744)

SEQ ID NO: 19813 - protein, 247 aa, Caulobacter crescentus; identical to SEQ ID NO: 442

SEQ ID NO: 19814 - DNA, 711 bp, Streptococcus pneumoniae; identical to SEQ ID NO: 2078
  CDS (1)..(711)

SEQ ID NO: 19815 - protein, 236 aa, Streptococcus pneumoniae; identical to SEQ ID NO: 436

SEQ ID NO: 19816 - DNA, 729 bp, Streptococcus pneumoniae; identical to SEQ ID NO: 2080
  CDS (1)..(729)

SEQ ID NO: 19817 - protein, 242 aa, Streptococcus pneumoniae; identical to SEQ ID NO: 438

SEQ ID NO: 19818 - DNA, 708 bp, Streptococcus pneumoniae; identical to SEQ ID NO: 2082
  CDS (1)..(708)

SEQ ID NO: 19819 - protein, 235 aa, Streptococcus pneumoniae; identical to SEQ ID NO: 450

SEQ ID NO: 19820 - DNA, 717 bp, Escherichia coli; identical to SEQ ID NO: 423
  CDS (1)..(717)

SEQ ID NO: 19821 - protein, 238 aa, Escherichia coli [sequence omitted]

SEQ ID NO: 19822 - DNA, 708 bp, Lactococcus lactis subsp. lactis; identical to SEQ ID NO: 443
  CDS (1)..(708)

SEQ ID NO: 19823 - protein, 235 aa, Lactococcus lactis subsp. lactis; identical to SEQ ID NO: 444

SEQ ID NO: 19824 - DNA, 756 bp, Escherichia coli; identical to SEQ ID NO: 439
  CDS (1)..(756)

SEQ ID NO: 19825 - protein, 251 aa, Escherichia coli; identical to SEQ ID NO: 440

SEQ ID NO: 19826 - DNA, 732 bp, Clostridium acetobutylicum; identical to SEQ ID NO: 2090
  CDS (1)..(732)

SEQ ID NO: 19827 - protein, 243 aa, Clostridium acetobutylicum; identical to SEQ ID NO: 448

SEQ ID NO: 19828 - DNA, 747 bp, Bordetella parapertussis; identical to SEQ ID NO: 2092
  CDS (1)..(747)

SEQ ID NO: 19829 - protein, 248 aa, Bordetella parapertussis; identical to SEQ ID NO: 510

SEQ ID NO: 19830 - DNA, 747 bp, Bordetella bronchiseptica; identical to SEQ ID NO: 2094
  CDS (1)..(747)

SEQ ID NO: 19831 - protein, 248 aa, Bordetella bronchiseptica; identical to SEQ ID NO: 508

SEQ ID NO: 19832 - DNA, 738 bp, Bacillus cereus; identical to SEQ ID NO: 503
  CDS (1)..(738)

SEQ ID NO: 19833 - protein, 245 aa, Bacillus cereus; identical to SEQ ID NO: 504

SEQ ID NO: 19834 - DNA, 732 bp, Bacillus anthracis; identical to SEQ ID NO: 2098
  CDS (1)..(732)

SEQ ID NO: 19835 - protein, 243 aa, Bacillus anthracis; identical to SEQ ID NO: 502

SEQ ID NO: 19836 - DNA, 738 bp, Bacillus anthracis; identical to SEQ ID NO: 499
  CDS (1)..(738)

SEQ ID NO: 19837 - protein, 245 aa, Bacillus anthracis; identical to SEQ ID NO: 500

SEQ ID NO: 19838 - DNA, 765 bp, Streptomyces avermitilis; identical to SEQ ID NO: 2102
  CDS (1)..(765)

SEQ ID NO: 19839 - protein, 254 aa, Streptomyces avermitilis; identical to SEQ ID NO: 498

SEQ ID NO: 19840 - DNA, 756 bp, Enterococcus faecalis; identical to SEQ ID NO: 2104
  CDS (25)..(756)

SEQ ID NO: 19841 - protein, 243 aa, Enterococcus faecalis; identical to SEQ ID NO: 496

SEQ ID NO: 19842 - DNA, 708 bp, Enterococcus faecalis; identical to SEQ ID NO: 2106
  CDS (1)..(708)

SEQ ID NO: 19843 - protein, 235 aa, Enterococcus faecalis; identical to SEQ ID NO: 494

SEQ ID NO: 19844 - DNA, 675 bp, Shigella flexneri; identical to SEQ ID NO: 2108
  CDS (1)..(675)

SEQ ID NO: 19845 - protein, 224 aa, Shigella flexneri; identical to SEQ ID NO: 506

SEQ ID NO: 19846 - DNA, 723 bp, Shigella flexneri; identical to SEQ ID NO: 491
  CDS (1)..(723)

SEQ ID NO: 19847 - protein, 240 aa, Shigella flexneri; identical to SEQ ID NO: 492

SEQ ID NO: 19848 - DNA, 927 bp, Pseudomonas putida; identical to SEQ ID NO: 2112
  CDS (1)..(927)

SEQ ID NO: 19849 - protein, 308 aa, Pseudomonas putida; identical to SEQ ID NO: 490

SEQ ID NO: 19850 - DNA, 711 bp, Lactobacillus plantarum; identical to SEQ ID NO: 487
  CDS (1)..(711)

SEQ ID NO: 19851 - protein, 236 aa, Lactobacillus plantarum; identical to SEQ ID NO: 488

SEQ ID NO: 19852 - DNA, 699 bp, Streptococcus mutans; identical to SEQ ID NO: 485
  CDS (1)..(699)

SEQ ID NO: 19853 - protein, 232 aa, Streptococcus mutans; identical to SEQ ID NO: 486

SEQ ID NO: 19854 - DNA, 699 bp, Streptococcus agalactiae; identical to SEQ ID NO: 2118
  CDS (1)..(699)

SEQ ID NO: 19855 - protein, 232 aa, Streptococcus agalactiae; identical to SEQ ID NO: 484

SEQ ID NO: 19856 - DNA, 747 bp, Oceanobacillus iheyensis; identical to SEQ ID NO: 481
  CDS (1)..(747)

SEQ ID NO: 19857 - protein, 248 aa, Oceanobacillus iheyensis; identical to SEQ ID NO: 482

SEQ ID NO: 19858 - DNA, 756 bp, Escherichia coli O6; identical to SEQ ID NO: 479
  CDS (1)..(756)

SEQ ID NO: 19859 - protein, 251 aa, Escherichia coli O6; identical to SEQ ID NO: 480

SEQ ID NO: 19860 - DNA, 699 bp, Escherichia coli O6; identical to SEQ ID NO: 477
  CDS (1)..(699)

SEQ ID NO: 19861 - protein, 232 aa, Escherichia coli O6; identical to SEQ ID NO: 478

SEQ ID NO: 19862 - DNA, 765 bp, Streptomyces sp; identical to SEQ ID NO: 2126
  CDS (1)..(765)

SEQ ID NO: 19863 - protein, 254 aa, Streptomyces sp; identical to SEQ ID NO: 468

SEQ ID NO: 19864 - DNA, 714 bp, Streptococcus mutans; identical to SEQ ID NO: 2128
  CDS (1)..(714)

SEQ ID NO: 19865 - protein, 237 aa, Streptococcus mutans; identical to SEQ ID NO: 476

SEQ ID NO: 19866 - DNA, 762 bp, Streptomyces griseus; identical to SEQ ID NO: 2130
  CDS (1)..(762)

SEQ ID NO: 19867 - protein, 253 aa, Streptomyces griseus; identical to SEQ ID NO: 466

SEQ ID NO: 19868 - DNA, 726 bp, Clostridium perfringens; identical to SEQ ID NO: 471
  CDS (1)..(726)

SEQ ID NO: 19869 - protein, 241 aa, Clostridium perfringens; identical to SEQ ID NO: 472

SEQ ID NO: 19870 - DNA, 726 bp, Streptococcus pyogenes; identical to SEQ ID NO: 469
  CDS (1)..(726)

SEQ ID NO: 19871 - protein, 241 aa, Streptococcus pyogenes; identical to SEQ ID NO: 470

SEQ ID NO: 19872 - DNA, 705 bp, Pseudomonas fluorescens; identical to SEQ ID NO: 463
  CDS (1)..(705)

SEQ ID NO: 19873 - protein, 234 aa, Pseudomonas fluorescens; identical to SEQ ID NO: 464

SEQ ID NO: 19874 - DNA, 765 bp, Streptomyces coelicolor; identical to SEQ ID NO: 2138
  CDS (1)..(765)

SEQ ID NO: 19875 - protein, 254 aa, Streptomyces coelicolor; identical to SEQ ID NO: 474

SEQ ID NO: 19876 - DNA, 23 bp, Primer
atgggacacaagcccttataccg

SEQ ID NO: 19877 - DNA, 23 bp, Primer
ttatcgcgatgattttcgctgcg

SEQ ID NO: 19878 - DNA, 765 bp, Escherichia coli K12
  CDS (1)..(765)
atgaaaataataacctgctttaagctggtgcctgaagaacaggacattgttgtcactccagaatacaccctgaatttcgacaatgccgacgccaaaatcagccagttcgatctcaatgccattgaagctgcaagccagctcgcaacagatgacgatgagatagccgcgctgaccgttggcggctcattgttgcagaactcgaaagtgcgcaaagacgtgctatcccgcgggccgcacagcctgtatttggtgcaggatgcgcaacttgaacatgcactgcctctcgataccgcaaaagcgctggcggcagcaattgaaaagatcggcttcgatttactgatctttggtgaaggttccggcgacctttatgcccagcaggttggcttgctggtcggagaaattctgcaacttccggtgattaatgcagtgagtgctattcagcgtcagggcaatacactggtgattgaacgcacgcttgaagatgatgttgaagttattgaactctctgttccagccgtgctctgcgtcacctccgatattaacgtgccacgcattccttcgatgaaagccattctcggcgcgggtaaaaaaccggtaaatcagtggcaggcaagtgatattgactggagccagagcgcgccacttgctgaactggtcggcattcgcgtaccgccgcaaacagaacgtaagcacatcattatcgataacgattcgccggaggccattgccgagctggcggaacatctgaagaaagccctgaactga

SEQ ID NO: 19879 - protein, 254 aa, Escherichia coli K12
MKIITCFKLVPEEQDIVVTPEYTLNFDNADAKISQFDLNAIEAASQLATDDDEIAALTVGGSLLQNSKVRKDVLSRGPHSLYLVQDAQLEHALPLDTAKALAAAIEKIGFDLLIFGEGSGDLYAQQVGLLVGEILQLPVINAVSAIQRQGNTLVIERTLEDDVEVIELSVPAVLCVTSDINVPRIPSMKAILGAGKKPVNQWQASDIDWSQSAPLAELVGIRVPPQTERKHIIIDNDSPEAIAELAEHLKKALN

SEQ ID NO: 19880 - DNA, 879 bp, Rhizobium meliloti
  CDS (1)..(879)
atgcaccttgtagtctgtatcaaacaggtgccggattccgcgcaaatacgcgtccatccggtgaccaacacgatcatgcgacagggcgtgccgaccattatcaacccccatgatctggccgccctcgaagaagcactgaagttgtgcgacacgtatggaggcgaggttaccgtggtgaccatgggccctaagatggccgaggacgcgctgcgcaaggcactcacgtttggcgcacaccgcgccgttctcttgaccgaccgccattttgcaggctcggatacgctcgcgacctccttcgcccttgctcaagcaatcgcggagatcggcgagaccttcggcacgcctgatgttgtgttcaccggcaagcagacgatcgacggcgacactgcccaagttggacctggaattgccaagcgcctcgacctacagcagctcacttacgtggcgaagattctctccattgatgccgcttcgcgcgagatcactgttgagcggcgcgcggaaggcggctcgcagatcctgagaaccggactaccatgccttgtcactatgctggacggcgccgacgccatccgtcgcgggcgtctcgacgacgcccttcgcgccgcgcgcaccaaggtcgtcaagtggagtgcggcggacgccggcattgcagaaccggccaactgtggcttgcgaggatctccgacggtcgtaaagcgcgtgtttgccccaacttcccgcgaacaaaaggcaaggcagatcgacaccacaaataagccactgcgtgagatcgcggacggtctgatcgcggcaatctttgccgaccggccggccttgaaacacgatctcggcagcacgggacagcaaggagcaccagatgtcgaccgagaatcgtga

SEQ ID NO: 19881 - protein, 292 aa, Rhizobium meliloti
MHLVVCIKQVPDSAQIRVHPVTNTIMRQGVPTIINPHDLAALEEALKLCDTYGGEVTVVTMGPKMAEDALRKALTFGAHRAVLLTDRHFAGSDTLATSFALAQAIAEIGETFGTPDVVFTGKQTIDGDTAQVGPGIAKRLDLQQLTYVAKILSIDAASREITVERRAEGGSQILRTGLPCLVTMLDGADAIRRGRLDDALRAARTKVVKWSAADAGIAEPANCGLRGSPTVVKRVFAPTSREQKARQIDTTNKPLREIADGLIAAIFADRPALKHDLGSTGQQGAPDVDRES

SEQ ID NO: 19882 - DNA, 795 bp, Methylophilus methylotrophus
  CDS (1)..(795)
atgaagatattagtggcagtaaaacagaccgcagcactggaagaagactttgaaattcgagaagacggtatggacgtcgatgaagatttcatgatgtatgacctgaatgaatgggatgacttttcgctagaagaggcgatgaagatcaaagagtctagcgataccgatgtggaagtggtcgtggtgtctgtgggtccggatcgtgtagatgaaagcctgcgcaagtgcctggccaagggtgcggaccgcgcggtcagagtttgggatgacgctgcagagggctctgatgccatcgtggttggccgcattctgactgaagtgatcaagaaagaagcgccggatatggtgtttgccggtgtgcagtcttctgaccaggcgtatgcatccaccggtatttcagtcgcttcttacctgaattggccacatgcggccgtcgtcgccgatttgcaatacaagccaggtgataacaaggccgtgatccgtcgtgagctcgaaggcggcatgctgcaagaagttgaaatcaattgcccggcagtgctgacgatccagcttgggattaacaagccacgctatgcgtcgctgcgtggtatcaagcaagccgcgaccaagccgattgaggaagtctccctggctgacattggactctcagcgaatgatgttggtgctgcccaatccatgtcacgcgtacgtcgcatgtacattccagaaaaaggccgtgccaccatgattgaaggcactatttctgagcaggcggcaaaaatcattcaaatcattaatgaattcaaaggagcatag

SEQ ID NO: 19883 - protein, 264 aa, Methylophilus methylotrophus
MKILVAVKQTAALEEDFEIREDGMDVDEDFMMYDLNEWDDFSLEEAMKIKESSDTDVEVVVVSVGPDRVDESLRKCLAKGADRAVRVWDDAAEGSDAIVVGRILTEVIKKEAPDMVFAGVQSSDQAYASTGISVASYLNWPHAAVVADLQYKPGDNKAVIRRELEGGMLQEVEINCPAVLTIQLGINKPRYASLRGIKQAATKPIEEVSLADIGLSANDVGAAQSMSRVRRMYIPEKGRATMIEGTISEQAAKIIQIINEFKGA

SEQ ID NO: 19884 - DNA, 762 bp, Deinococcus radiodurans
  CDS (1)..(762)
atgaatattctgactctggtacggcaggtgcccgacgccgaagcccgcgtgaaagtggccggcagcggtgtggacctcgaaggcgcgaccctggtggtcgacggcatggacgagtacggcgtggaagaagccctgagactgcgtgaaggcggcgctcccgtggacaccatcatcgccctggccgtcggcccgcagcgcaacgaagatgccctgcgcaccgccctggcgatgggtgtggaccgcgccattcacgtggaaaccgatgagaagatcgacgcggtgagcctcagcaagattgtcgcgcaggtcgcgcaggccgagaacgccggtctgattctggtcggcgggcaagaagctgactgggactcgcaggccctgggcgccgccaccgccgagcgcctcggctggccgcaactcacctggaccaacgaactgaaggtcgagggcgacagcgtgacgggccgtcacgacgtggacgaaggcaatgagagcttccgcgctcccctgcccgcggtggtcaccacccagcagggcctgaacgagccgcgttaccccacgctgcccaacatcatgaaggccaagaagaaggagctgcgcaaggacagcctcgacacctacggcgtgcagccccgcgtgcgcaccgtgaacgccgagatccagacccgcgcccgcctgaacaagatgatcgacggcaaggacccgcaggccgccgccgccgaactgctcaacctcctgcgcaatgaagcgaaggtgatcgcctga

SEQ ID NO: 19885 - protein, 253 aa, Deinococcus radiodurans
MNILTLVRQVPDAEARVKVAGSGVDLEGATLVVDGMDEYGVEEALRLREGGAPVDTIIALAVGPQRNEDALRTALAMGVDRAIHVETDEKIDAVSLSKIVAQVAQAENAGLILVGGQEADWDSQALGAATAERLGWPQLTWTNELKVEGDSVTGRHDVDEGNESFRAPLPAVVTTQQGLNEPRYPTLPNIMKAKKKELRKDSLDTYGVQPRVRTVNAEIQTRARLNKMIDGKDPQAAAAELLNLLRNEAKVIA

SEQ ID NO: 19886 - DNA, 750 bp, Xylella fastidiosa
  CDS (1)..(750)
atgaaaatcctcgtcgcctataagcgcgtggttgactacaacgtccgcatccaagtgaaacccgatggatccggcgtgatgacagaaggcgttaaagtatctgccaatcctttcgacgaaattgctctcgaagaagcgctacgcctgcgtgatgcaggcatcgccagcgaagtcgtcatcgccacactcgccccaaacgacgtgaccgcacaccttcgcaacggactggcgatgggggccaaccgtgctatccacatcgtcacccacaccacagtacaaccactcactgcggcacgcgctctactcaaactggttgagaaagaacagccagcactggtcatcctgggaaaacaggccattgacgacgacgccaaccaaaccggccaaatgttggccacactatggggccgcccacaggccacctttgcatcaaaagtgaccatcgctgatggcaaagccaccgtcacccgcgaagtcgacgctggtttggaaacactgcacattgatctaccggccgtgattaccgccgacctgcgcctaaacgccccacgcttcatcaaactgccggacatcatgaaggccaagagcaaaccactggaaaccatcgccttcgccgaccttggcgtaacagcacacgatagcctgcaaaccacacattacgcaccccccaaaaaacgcaaccaaggcgtgatggtgaaaaacgtcaccgaactggtgactctcctcaagaaccaaggagccctatcatga

SEQ ID NO: 19887 - protein, 249 aa, Xylella fastidiosa
MKILVAYKRVVDYNVRIQVKPDGSGVMTEGVKVSANPFDEIALEEALRLRDAGIASEVVIATLAPNDVTAHLRNGLAMGANRAIHIVTHTTVQPLTAARALLKLVEKEQPALVILGKQAIDDDANQTGQMLATLWGRPQATFASKVTIADGKATVTREVDAGLETLHIDLPAVITADLRLNAPRFIKLPDIMKAKSKPLETIAFADLGVTAHDSLQTTHYAPPKKRNQGVMVKNVTELVTLLKNQGALS

SEQ ID NO: 19888 - DNA, 1833 bp, Sulfolobus solfataricus
  CDS (1)..(1833)
atgccggaactcaaagttgttgtttcaataaagcaagttccagatgtggatgaattaaggattgacccggtaactaataatttggtaagggaaggagtaccagctgttattaatcctccagatttacatgcaatagaagaagctgttagattaaaggagagatatggagctaaaactatagttataacaatgggtccaccacaagctgattcagcacttagggaggccctagctatgggaattgatgaagcttatctcataagtgatagggctatggctggagcagatacttgggcaacttcctatacgatatctaaggcggttcaaaaattgggtggggcggatctaatactctttggaagaagagctgttgatggagagactgagcaagtcggacctcaaactggaaaatggcttggacttccagttataggctatgtcagtgagataaagagcttagagaaggataaaatagtggtaactagaactactgaatttgatgaagaggttattgaggctcccgttcccgtagtattaactatattggaagttgcgaataagccgagacaacctgatatactaagcctaattaaagctaaaacggctaaagttacggtttggaataaggatgacattaaggctgagccaaacaaaattggcttagctggatcacctactaaggtaataaaagttcaacctccacctaaaactagaaaggctgaaataatagatggtaaaaaggatgttgaaaaggccgcaaaatggttcttagataagatttttgagtcgttaaaggaagatgagagtacgttaaaggagtacgtgaagcctaaaccaaaggttaaagtaaatggtgaaatctgggtatatatagatcatataggagaaaaaccaaacagagcgtcttttgagattatgggagaagcgagaaggattgccgacctaatggatacaagtctttctgcagtaatggttgggggagaggctacgaaatccttaatagaagagacttttgaatatggggcagataaagtatattttgtggaaactaagggattcgatagatacgataacgaagtgtacactagagcattagccaaggtaataaagaaatataagccagaagcagtcttcttcccagggactaaaaatgccagagaacttgcatcaacgactgcaattgaagtagatactggattaatagctgattgtactaactttgacgtggacgataaaggagttttactttcaacaagacctgactttggaggtaaagaaatgtccaccataatatgtcctagacatagaccagtaatggttacagttagagctggtgtattcatgccgttacccagagtccctgggagaaagggtgaattagcaagagaggaaattgatgacctattcactagacttaaagtattagactatagagttatagaaaagagaaatatcttagcggaggcagatatagtgataggtgtaggtaggggtattagaagcccagaaaatataaagatggctgaggaattagcctcattattaggcggagtagttggcgtttctaaaccattggcagatatgggttggtatcctaaggatagacaagtcggtcaaactggtacaacaataaggcctaaggtttacatagcattagggatttctggtgcagtacaacacttagttggtatactatcttccagaaagataggggccataaacttggatccaagtgcaccaatctttgagaattgcgatttcggagtagtcggtgatatcttcgagatattacctaaaatgatggaattgcttaagaaaaaggaggtaagctag

SEQ ID NO: 19889 - protein, 610 aa, Sulfolobus solfataricus
MPELKVVVSIKQVPDVDELRIDPVTNNLVREGVPAVINPPDLHAIEEAVRLKERYGAKTIVITMGPPQADSALREALAMGIDEAYLISDRAMAGADTWATSYTISKAVQKLGGADLILFGRRAVDGETEQVGPQTGKWLGLPVIGYVSEIKSLEKDKIVVTRTTEFDEEVIEAPVPVVLTILEVANKPRQPDILSLIKAKTAKVTVWNKDDIKAEPNKIGLAGSPTKVIKVQPPPKTRKAEIIDGKKDVEKAAKWFLDKIFESLKEDESTLKEYVKPKPKVKVNGEIWVYIDHIGEKPNRASFEIMGEARRIADLMDTSLSAVMVGGEATKSLIEETFEYGADKVYFVETKGFDRYDNEVYTRALAKVIKKYKPEAVFFPGTKNARELASTTAIEVDTGLIADCTNFDVDDKGVLLSTRPDFGGKEMSTIICPRHRPVMVTVRAGVFMPLPRVPGRKGELAREEIDDLFTRLKVLDYRVIEKRNILAEADIVIGVGRGIRSPENIKMAEELASLLGGVVGVSKPLADMGWYPKDRQVGQTGTTIRPKVYIALGISGAVQHLVGILSSRKIGAINLDPSAPIFENCDFGVVGDIFEILPKMMELLKKKEVS

SEQ ID NO: 19890 - DNA, 747 bp, Brucella melitensis
  CDS (1)..(747)
atgaaagtccttgtcgcagtcaaacgggttgtcgattacaacgtcaagatccgtgttaagggtgacggttcaggcgtcgagcttgcgaatgttaagatgtcgatgaaccccttcgacgagatcgcggttgaagaagcgatccggttgaaggaagcgggcaaggtgacggaaatcgtcgcggtttcggttggcccggcacaggcgcaggaaacgctgcgcaccgcacttgccatgggtgctgaccgcgccattctggtcaagaccgatgaaacggttgagccgctgggcgttgccaaggtgctgaagggcgttgtcgaagctgaaaagccggatctcgttttcctcggcaagcaggcgattgatgacgattcaaaccagaccgggcagatgctgtcggcccttctcaactggagccaggcaacctttgcctccaaggtggaactgggtgaggggtcggccaaggtaacgcgcgaagtcgatggcggtttgcagaccatcgatgtgaagcttccggccatcgtaacggtggatctgcgcctcaaccagccgcgctatgcttcgctgccgaacatcatgaaggccaagaagaagccgctcgacgaaaagtcgccggccgatttcggtgccgatattgccccgcgtctcaaggttctgaagaccgaggaacccggtggccgcaaggctggcgtgaaggtcggttcggtttccgaactggttgagaagctgaaggccgacggcgtactgtaa

SEQ ID NO: 19891 - protein, 248 aa, Brucella melitensis
MKVLVAVKRVVDYNVKIRVKGDGSGVELANVKMSMNPFDEIAVEEAIRLKEAGKVTEIVAVSVGPAQAQETLRTALAMGADRAILVKTDETVEPLGVAKVLKGVVEAEKPDLVFLGKQAIDDDSNQTGQMLSALLNWSQATFASKVELGEGSAKVTREVDGGLQTIDVKLPAIVTVDLRLNQPRYASLPNIMKAKKKPLDEKSPADFGADIAPRLKVLKTEEPGGRKAGVKVGSVSELVEKLKADGVL

SEQ ID NO: 19892 - DNA, 756 bp, Aeropyrum pernix
  CDS (1)..(756)
atggcccggatagggcctgacgatagtgtagatctcaactccatacccctcaagatttctgatattgatagaaacgctgttgaagaggctgttaagctgaaggagaagcttggcggtaagctatatgcagtctccgtcctaacatgggggcctgtgaagcttaggaataaggacctgaggctggcagtccaggaggccctggctaagggtgttgacgaggctatagtagttgctgacgatgaattaactccaggcgaccagactacaacagccaaagctatcaaagcagcgctggaaaagcatggggtgaagcccgagctaatactggcaggagaggctaccatagacgaggttacaagccaggtccctggcaggctggcctccctactaggatataagtatctgagcttcgtgagaaagttagacgtcgacaacggcaggataatcgcagaaagagatctggaagactatatcgaggtcgtggaggcaagtctccccgccgtagtgagtgtgacccaggagataaacgagccaaggcctccaacactcctgcagataaggagggccgcaaggaaaccggtaaaggagtatagcgcttctgagcttgagaatgtagggaaacctgtgaggcgtatagtacagattaggggagtccaggttaagaggaagcagcaaataattgagggcgataatcttgaagagatcgcggagaagctgattgaagcgttagccagagaaggtgttctaaagctctag

SEQ ID NO: 19893 - protein, 251 aa, Aeropyrum pernix
MARIGPDDSVDLNSIPLKISDIDRNAVEEAVKLKEKLGGKLYAVSVLTWGPVKLRNKDLRLAVQEALAKGVDEAIVVADDELTPGDQTTTAKAIKAALEKHGVKPELILAGEATIDEVTSQVPGRLASLLGYKYLSFVRKLDVDNGRIIAERDLEDYIEVVEASLPAVVSVTQEINEPRPPTLLQIRRAARKPVKEYSASELENVGKPVRRIVQIRGVQVKRKQQIIEGDNLEEIAEKLIEALAREGVLKL

SEQ ID NO: 19894 - DNA, 750 bp, Pseudomonas aeruginosa
  CDS (1)..(750)
atgaaggttcttgtagcagtcaaacgagtggtcgactacaacgtcaaggtccgcgtcaaggcggacaactccggcgtcgacctcgccaacgtcaagatgtccatgaaccccttctgcgaaatcgccgtggaagaagccgtgcgcctgaaagagaagggcgtggctaccgagatcgtcgctgtctccgtcggcccgaccgccgcccaggagcaactgcgcaccgcgctggcgctgggcgctgaccgtgcgatcctggtggagagcaacgacgagctgaactccctggccgtggccaagctgctcaaggccgtggtcgacaaggagcagccgcagctggtgatcctcggcaagcaggccatcgacagcgacaacaaccagaccggccagatgctcgccgcgctgaccggctacgcccagggcaccttcgcctccaaggtcgaggtcgctggcgacaaggtcaacgtgacccgcgagatcgatggcggtctgcagaccgtcgcgctgaacctgccggccatcgtcaccaccgacctgcgcctgaacgagccgcgctacgcgtcgctgccgaacatcatgaaagccaagaagaagccgctggacgtggtgaccccggacgccctgggcgtttccaccgcttccaccgtgaagaccctgaaggtcgaggcgccggctgcacgctccgctggcatcaaggtcaagtccgtggctgaactggtagagaaactgaagaacgaggcgaaggtaatctaa

SEQ ID NO: 19895 - protein, 249 aa, Pseudomonas aeruginosa
MKVLVAVKRVVDYNVKVRVKADNSGVDLANVKMSMNPFCEIAVEEAVRLKEKGVATEIVAVSVGPTAAQEQLRTALALGADRAILVESNDELNSLAVAKLLKAVVDKEQPQLVILGKQAIDSDNNQTGQMLAALTGYAQGTFASKVEVAGDKVNVTREIDGGLQTVALNLPAIVTTDLRLNEPRYASLPNIMKAKKKPLDVVTPDALGVSTASTVKTLKVEAPAARSAGIKVKSVAELVEKLKNEAKVI

SEQ ID NO: 19896 - DNA, 801 bp, Halobacterium sp. NRC-1
  CDS (1)..(801)
atgaaggttctcgtcaccgtcaaggaggtggctgccgtcgaggacgacttcgagatctcgggaacggagatcgagagtacgtacctggattacgacctcaacgagtgggacgactacgccgtcgaggaggccgtccagcttgctgaggccggcgacgacgtcgaggtcgtcgcggtcaccatcggcccggagcgcgccgaggagacgatccggatggcgctggcgaagggcgcggaccgcgcggtccgggtctgggacgacgccatcgaggagaccgagctgctcgacgtggagacgaaggcccggctgctggcggccgtcgtcgaggacgaagaccccgaactggtgttttccggggtgcaggccaacgacgacagcttcggcgcgaccgggatcgcgctggccgagacgctcggcgtccagtgggcggcggtcgtgaacgacctcgacaccgcgggcgtgctcgacgagggcgtggcgtcggtgcgccgcgaactggagggcggcgtcgaggagctcaccgacgtcgagttgccggcggtgctcaccatccagacggggatcaacgagccgcggtacgcgagcctgcgtggcatccgtcaggcgcagtccaaggagatcgcgccgaagagcctcgacgacctcgggctggacgcggacatcgttgcgtccagcctcgacatcaccgcgatgtacgagcccgagaccgagagcgacgccgagtacatcgagggcgacgccggcgaacaggccagtggcgtggctgacgtgctccgcgacgcgggggtggtcggcgaatga

SEQ ID NO: 19897 - protein, 266 aa, Halobacterium sp. NRC-1
MKVLVTVKEVAAVEDDFEISGTEIESTYLDYDLNEWDDYAVEEAVQLAEAGDDVEVVAVTIGPERAEETIRMALAKGADRAVRVWDDAIEETELLDVETKARLLAAVVEDEDPELVFSGVQANDDSFGATGIALAETLGVQWAAVVNDLDTAGVLDEGVASVRRELEGGVEELTDVELPAVLTIQTGINEPRYASLRGIRQAQSKEIAPKSLDDLGLDADIVASSLDITAMYEPETESDAEYIEGDAGEQASGVADVLRDAGVVGE

SEQ ID NO: 19898 - DNA, 729 bp, Sulfolobus solfataricus
  CDS (1)..(729)
atgaacattattgttggttttaagatagttccggacgatcaaatgattaaggttgtgggagataaactaaatactgacgctccattgaaggtaagcacttatgataagaacgctattgaagaggctatacggttaaaggaaaagttcggaggtaaggttactggtattacagtaggcaataacgatagaaagagcattagggaagctttagctatgggagttgatgaagtaatagcaatattagttaaagatccggacgtttacgttaccgctatggcgatagctgaaaatgtgaagaccctaaatccagatataatattgttttcagaaatgacaactgatagcggaacttcggccttaccagcttatgtttccgaactccttggcctaccttatatttctaacgtaaaatcactaaaaatcgagggaaacaaggttgtggcagataggggaatggtaagctatcttgagactgtagaatcaagtttgcctataattgttagtgttggtggcgaaataaatactcccagaattcccagcgttaagcaaatcatggaatcgtctaagaaaccagttaaagaagttaaattcgacgcacaatctaaggttagaataagggaaattaaaccaatgattgtgaatagaaagagaatagttattgaagagagcgatattaataaagctgttgataaattaattgaatatttaaagtctgatggggtgatctaa

SEQ ID NO: 19899 - protein, 242 aa, Sulfolobus solfataricus
MNIIVGFKIVPDDQMIKVVGDKLNTDAPLKVSTYDKNAIEEAIRLKEKFGGKVTGITVGNNDRKSIREALAMGVDEVIAILVKDPDVYVTAMAIAENVKTLNPDIILFSEMTTDSGTSALPAYVSELLGLPYISNVKSLKIEGNKVVADRGMVSYLETVESSLPIIVSVGGEINTPRIPSVKQIMESSKKPVKEVKFDAQSKVRIREIKPMIVNRKRIVIEESDINKAVDKLIEYLKSDGVI

SEQ ID NO: 19900 - DNA, 771 bp, Bacillus halodurans
  CDS (1)..(771)
atgaacatttacgtattaatgaagcgtacttttgacacagaagaaaagatttcgattagcagtgggcaaatcgatgatagcggggcagagttcattattaatccttatgacgaatatgcgattgaggaagcaattgttcttcgtgacaagcatggtggagaagtgacagtcgtaacggtaggagaagaagaagcagaaaaagaattgcgtacagcccttgcgatgggggcagataaggctgtccttattgatagtgaagaattagatgatttggatcaatatactacagctactttgctagcagcatatttaaaagatcaagagtttgatattattctcggtggaaacgtagcggttgatggaggatcaggacaagtggctcctcgtgtcgcggagctgttaggcattccacaagtaacgacgattacgagcttggacattgaagatgggaaggcgacaatcgttcgtgatgtagaaggggacgaagaaaccgttgcagcgtcattgccattgcttgtaacagctcagcaagggctgaacgagccgcgctatccatcgctaccaggcatcatgaaagcaaagaagaaaccacttgaaacattagatcttgacgaccttgaccttgaagaagaagatgtggaagcaaaaacaacgacgcttgatgtatttcttccgccggaaaaaggagcaggaaaggtgttagaaggggaagtcgaagcacaggtcaaagaattggtttcattgcttaaatctgaagcgaaagtgatttaa

SEQ ID NO: 19901 - protein, 256 aa, Bacillus halodurans
MNIYVLMKRTFDTEEKISISSGQIDDSGAEFIINPYDEYAIEEAIVLRDKHGGEVTVVTVGEEEAEKELRTALAMGADKAVLIDSEELDDLDQYTTATLLAAYLKDQEFDIILGGNVAVDGGSGQVAPRVAELLGIPQVTTITSLDIEDGKATIVRDVEGDEETVAASLPLLVTAQQGLNEPRYPSLPGIMKAKKKPLETLDLDDLDLEEEDVEAKTTTLDVFLPPEKGAGKVLEGEVEAQVKELVSLLKSEAKVI

SEQ ID NO: 19902 - DNA, 747 bp, Caulobacter crescentus
  CDS (1)..(747)
atgaaggtcctagtcccggttaaacgggtgatcgattataacgtgaaggcccgcgtaaaggcggaccagacgggcgtcgacctggcgaacgtcaagatgtccatgaaccccttctgtgagatcgcggtcgaagaagccgtgcgtctcaaggaaaagggtgtggcgaccgaggtcgtcatcgtcagcatcggtccggcgcaggcccaggaaaccatccgtacggcgctggccatgggcggcgaccgcggggtgctgatcaccaccgacgccgatcccgagccgctggccgtggccaagctgctggccgccgtggtggccgaagaaaatcccaacctcgtcctgatgggcaagcaggccatcgacggcgacaacaacgccgtgggccagatgctgtcggccctgctgggctggccgcaggccacctacgcctcggcgatcgaggtctcggccaccagcgccaaggtcacccgtgaagtcgacggcggcctgcagacggtcgatgtcgacctgccggccgtgatcaccgccgacctgcgcctgaacgagccgcgctatgcgtctctgcccaacatcatgaaggccaagaagaaggagatcgtcagcaagacggtcgccgactacggcgtcgacatcgcgccgcgcctgaaggtcctgaaggtcaccgagcccgccaagcgctcggccggcatcaaggtcgagacggcttctgacctcgtgtccaagctcaacaccgcgggggtgctgtaa

SEQ ID NO: 19903 - protein, 248 aa, Caulobacter crescentus
MKVLVPVKRVIDYNVKARVKADQTGVDLANVKMSMNPFCEIAVEEAVRLKEKGVATEVVIVSIGPAQAQETIRTALAMGGDRGVLITTDADPEPLAVAKLLAAVVAEENPNLVLMGKQAIDGDNNAVGQMLSALLGWPQATYASAIEVSATSAKVTREVDGGLQTVDVDLPAVITADLRLNEPRYASLPNIMKAKKKEIVSKTVADYGVDIAPRLKVLKVTEPAKRSAGIKVETASDLVSKLNTAGVL

SEQ ID NO: 19904 - DNA, 789 bp, Clostridium acetobutylicum
  CDS (1)..(789)
atggaaatattggtttgcatcaagcaagtgcctggaacaagcaaagtagaagtcgatgaaaagacaggagttttaaaaagagacggtgtagattctaaaatgaatccgtatgatttatatgctttagaaacagctttaagaataaaggaaaaggtaggaggaagagttacggttataagtatgggaccacctcaggcaaaggctgttataaaagaggcatatatgatgggtgcagatgctggagctttgctgtcagatagaaagtttgcaggagcagatgttttagctacctcttatactatatctcaaggaataaaaaaagcgggaaattttgatttgattttatgtggtaagcaaaccacagatggtgatacagcacaggttggacctgaaatgggagaatatctaaaaatgcctcatgcagctaatgttagaagaattgtagaggttaaagagaaatcaatagttatagaaatggatatgccaaatacacttgagattgcagagattaagttcccttgtcttctaacagttgaaaaggatatttttcaaccaagacttccttcttacaaaaagaaaatagaaacgaaggatagagaaataaaggtatatggattaaatgactttcaagataagaatgaaaatatgtatggattaaatggctctccaactcaagtagagagaatatttccaccagagtcaaatttgcataaagagatgtgggatggatcaggtaaagagctttctgataaattgtttaaaaaattaaaggaaatgaaatttgtttag

SEQ ID NO: 19905 - protein, 262 aa, Clostridium acetobutylicum
MEILVCIKQVPGTSKVEVDEKTGVLKRDGVDSKMNPYDLYALETALRIKEKVGGRVTVISMGPPQAKAVIKEAYMMGADAGALLSDRKFAGADVLATSYTISQGIKKAGNFDLILCGKQTTDGDTAQVGPEMGEYLKMPHAANVRRIVEVKEKSIVIEMDMPNTLEIAEIKFPCLLTVEKDIFQPRLPSYKKKIETKDREIKVYGLNDFQDKNENMYGLNGSPTQVERIFPPESNLHKEMWDGSGKELSDKLFKKLKEMKFV

SEQ ID NO: 19906 - DNA, 774 bp, Bacillus subtilis
  CDS (1)..(774)
atgaatctatttgtactgatgaaacggacgtttgacacagaagaaaaaatcgtcattgaaacaggaaagattcaggatgacggagcggaatggatcattaatccatatgatgagtacgcgatagaagaagccatccagctgaaggaaaagcatggcggcacgatcaccgctgtcacggtcggcggtgaagaagcggagaaagaattgcgtacggcgcttgccatgggttgtgaccaagctgttttaatcaacatagaagatgatcttgatgaacccgaccaatattccatttctcaagttttataccactatatgaaggatcaggagtttgatttgattctcggcggaaatgttgccattgacggaggatcaggacaagtggcgcctcggcttgccgagctactggacattccgtgtatcactacgatcaccaaactcgaaatcaacggcactgatgcagaagcagaaagggacgtcgaaggggatgttgaaaaaatcaaaacgacgctcccattgcttgtcacagctcagcagggcttaaacgagccgcgctatccatcgcttccgggaattatgaaggctaagaaaaagccgcttgaagagcttgaacttgatgatcttgatctggacgaagaggatgctgaaccaaagctgaaaaccattgaacgttttctgccgccgaaaaaagaagccgggaagcttctccaaggtgagcctgctgaacaggcaaaagagcttgtttcattgctccgcagcgaagctaaagtcatttaa

SEQ ID NO: 19907 - protein, 257 aa, Bacillus subtilis
MNLFVLMKRTFDTEEKIVIETGKIQDDGAEWIINPYDEYAIEEAIQLKEKHGGTITAVTVGGEEAEKELRTALAMGCDQAVLINIEDDLDEPDQYSISQVLYHYMKDQEFDLILGGNVAIDGGSGQVAPRLAELLDIPCITTITKLEINGTDAEAERDVEGDVEKIKTTLPLLVTAQQGLNEPRYPSLPGIMKAKKKPLEELELDDLDLDEEDAEPKLKTIERFLPPKKEAGKLLQGEPAEQAKELVSLLRSEAKVI

SEQ ID NO: 19908 - DNA, 780 bp, Clostridium acetobutylicum
  CDS (1)..(780)
atgaatatagttgtttgtttaaaacaagttccagatacagcggaagttagaatagatccagttaagggaacacttataagagaaggagttccatcaataataaatccagatgataaaaacgcacttgaggaagctttagtattaaaagataattatggtgcacatgtaacagttataagtatgggacctccacaagctaaaaatgctttagtagaagctttggctatgggtgctgatgaagctgtacttttaacagatagagcatttggaggagcagatacacttgcgacttcacatacaattgcagcaggaattaagaagctaaaatatgatatagtttttgctggaaggcaggctatagatggagatacagctcaggttggaccagaaatagctgagcatcttggaatacctcaagtaacttatgttgagaaagttgaagttgatggagatactttaaagattagaaaagcttgggaagatggatatgaagttgttgaagttaagacaccagttcttttaacagcaattaaagaattaaatgttccaagatatatgagtgtagaaaaaatattcggagcatttgataaagaagtaaaaatgtggactgccgatgatatagatgtagataaggctaatttaggtcttaaaggttcaccaactaaagttaagaagtcatcaactaaagaagttaaaggacagggagaagttattgataagcctgttaaggaagcagctgcatatgttgtctcaaaattaaaagaagaacactatatttaa

SEQ ID NO: 19909 - protein, 259 aa, Clostridium acetobutylicum
MNIVVCLKQVPDTAEVRIDPVKGTLIREGVPSIINPDDKNALEEALVLKDNYGAHVTVISMGPPQAKNALVEALAMGADEAVLLTDRAFGGADTLATSHTIAAGIKKLKYDIVFAGRQAIDGDTAQVGPEIAEHLGIPQVTYVEKVEVDGDTLKIRKAWEDGYEVVEVKTPVLLTAIKELNVPRYMSVEKIFGAFDKEVKMWTADDIDVDKANLGLKGSPTKVKKSSTKEVKGQGEVIDKPVKEAAAYVVSKLKEEHYI

SEQ ID NO: 19910 - DNA, 744 bp, Archaeoglobus fulgidus
  CDS (1)..(744)
atgaaaataatcgtgctcgcaaagcacgctccagatccggagtcggagattagcgttgccagcgatggcaaaagcataagccagagcggattggtttacgacatcaacgactgggacaggtatgctgttgaggaggccataagaatcaaagaggaaaagggcggagaggttgtggtggtaggtgtaggcacgaactgcgacgacacgctgagaaaatgcctcgccatgggtgctgacagggcaataaagattcccgttgacacgtcctttgacgcgtaccagacggctgaagtgataaaggaggcaataaaggacgagcagttcgacatgatttttgcagggctcatgagccaagacttgaacaacgcacaggtaggtgtactgctcgctgcaatgctggatttgccggttgctaccgccgttgctgagcttaaggttgaggacggaaaggttatagcaaggagagagcttgaaggaggctatcttgaggaagtggagcttcccactccgtgcgttctcacaattcagagcggtatcaacgagccaagatacgtgtcgattatgggtataaagagggccaagtcgaaggagatgaaggaagtcagcgttacgccaagcatctcaacgctcgaaatagagaaaatgtatctcccgccggtcaagaaggcagagatgattgagggtgatccgtcacagatagctgagaagattatccagatactgaaggagagggggttgatataa

SEQ ID NO: 19911 - protein, 247 aa, Archaeoglobus fulgidus
MKIIVLAKHAPDPESEISVASDGKSISQSGLVYDINDWDRYAVEEAIRIKEEKGGEVVVVGVGTNCDDTLRKCLAMGADRAIKIPVDTSFDAYQTAEVIKEAIKDEQFDMIFAGLMSQDLNNAQVGVLLAAMLDLPVATAVAELKVEDGKVIARRELEGGYLEEVELPTPCVLTIQSGINEPRYVSIMGIKRAKSKEMKEVSVTPSISTLEIEKMYLPPVKKAEMIEGDPSQIAEKIIQILKERGLI

SEQ ID NO: 19912 - DNA, 858 bp, Thermotoga maritima
  CDS (1)..(858)
atgaatgtggttgtctgtatcaaacaggttcccgatacaacgaacgtcagaatcgacagaaaaacgaacaaccttgtgagagaaggtgtcccgtctatcataaatcccgatgatgaaagggcactcgaacttgcctcacaattgaaagaaaaattcggagccacggtttatgtgatcactatgggaccaccgcaggcgaaagaggctctgaaggatgccattgccttcggtctcgatgaagcagtccatttgagcgacaggacgttcgcgggagcggatacgctcgccacgacgtacacactttactggggaataaagaagatcgaagaaagaataggaaagatagatctcattttgacaggaaagcaggcggtggatggagacaccggtcaggtgggacctggtcttgctacaagattcggatacgcgctcggtgcctacgtcgttcgaatagaggaaatagatccagagaaaaaagagatggtgatagtcagaagactggaccagggatttgaaaagatacggctcaaactgccagcggttctcacaatcacggatgagctgaacaaaccgaggtacgcagatctgcccaatctcatcagggcgatcaggtacgagcccatcgtctggactcacaaagatctgggtctcgatccaaaaaaatgtggattctttggatcacctacaagggttgtgagcacaaacatacccccggcgagaaaaggtggagacatcatttcaaaaaatgaagatccggaagtggcagcggagaaactcatagaagctttgaaaaaatttgaagccgttcgactcgtggaagcgttgaaacctgtgttggaaggtgagaaagatgagtga

SEQ ID NO: 19913 - protein, 285 aa, Thermotoga maritima
MNVVVCIKQVPDTTNVRIDRKTNNLVREGVPSIINPDDERALELASQLKEKFGATVYVITMGPPQAKEALKDAIAFGLDEAVHLSDRTFAGADTLATTYTLYWGIKKIEERIGKIDLILTGKQAVDGDTGQVGPGLATRFGYALGAYVVRIEEIDPEKKEMVIVRRLDQGFEKIRLKLPAVLTITDELNKPRYADLPNLIRAIRYEPIVWTHKDLGLDPKKCGFFGSPTRVVSTNIPPARKGGDIISKNEDPEVAAEKLIEALKKFEAVRLVEALKPVLEGEKDE

SEQ ID NO: 19914 - DNA, 747 bp, Agrobacterium tumefaciens
  CDS (1)..(747)
atgaaaatccttgtccccgttaaacgagtcgtcgactacaacgtgaaaatccgcgtgaagtcggatggttctggcgttgagcttgccaatgtgaagatgtcgatgaacccgttcgacgaaatctcggtggaagaggcccttcgcctgaaggaagccggcaaagccgaagaggtcgtggtcgtctccatcggcccggccaaggcggaagaaacgctgcgcaccgcgcttgccatgggcgccgaccgcgccatcctgatcgagaccgacgaaaccgtcgagccgctcgccgtcgccaagctcctgaagggcgtggccgaggctgagcagcccggtctcgtcatcgtcggcaagcaggcgatcgatgacgattcgaaccagaccggccagatgctggcagccctgctcggctggggccagggcacgtttgcctccaaggtcgtaccggctgacggcaaggtcgcggtcacccgtgaagtcgatggcggcctgcagactgtcgagctgaaactgccagccgtcgtcaccaccgatcttcgtctgaacgagccgcgttacgcctcgctgccgaacatcatgaaggcaaaaaagaagccgctcgacaaaaaggctccggccgatttcggcgtcgatgtctcgccgcgcctgaaggtgctgaagaccgaggagcccgcgggccgcaaggccggcatcaaggtcggctcggttgccgaactggtcgaaaagctcaaagccgacggcgtcctctaa

SEQ ID NO: 19915 - protein, 248 aa, Agrobacterium tumefaciens
MKILVPVKRVVDYNVKIRVKSDGSGVELANVKMSMNPFDEISVEEALRLKEAGKAEEVVVVSIGPAKAEETLRTALAMGADRAILIETDETVEPLAVAKLLKGVAEAEQPGLVIVGKQAIDDDSNQTGQMLAALLGWGQGTFASKVVPADGKVAVTREVDGGLQTVELKLPAVVTTDLRLNEPRYASLPNIMKAKKKPLDKKAPADFGVDVSPRLKVLKTEEPAGRKAGIKVGSVAELVEKLKADGVL

SEQ ID NO: 19916 - DNA, 846 bp, Azorhizobium caulinodans
  CDS (1)..(846)
atgcacatcgtcgtctgcatcaagcaggttcctgactccgcgcagatccgcgtgcaccccgtgacgaacaccatcatgcgtcagggtgtgcccacgatcatcaacccttacgacctcttcgcgctggaggccgcgctcgcgctgcgcgaccagcatggcggcgaggtcacggtcctcaccatgggcccgccctcggccgaggacagcctgcgcaaggcactcaccttcggcgccgaccgggccgtgctgctcacggaccgcttcttcgccggctccgacacgctcgccaccacctatgcgctggccaccgccgtgcggaagatcggcgagaccttcggcgcgccggacatcgtgttcaccggcaaacagaccatcgacggtgacacggcgcaggtcggccccggcatcgccaagcggctcggcctgctccagctcacctatgtggcgaagatcgccaatgtcgatcttgcgggccgcagcatccaggtggagcggcggtccgagggcggcgtgcaggtccttcagacccgcctgccctgcctcatcaccatgctggaggccaccaacgagatccgccgcggcgccatggccgatgcgctgcgcgccgcccgcgccgaggtcgtgatctggagcgccaaggacgccggcgtcgaggacatctccaaatgcggcctgcgcggttcgcccaccatcgtgaagcgcgtgtttgcgccctccgcccgcgcggagaaggcgacgatggtggacttcagcgaaaccgcgccggcggacgccctgatcgcggaaatcttcaagcgccagcccaagctcgaggacgacctcgcggccctggcgcgcggctactga

SEQ ID NO: 19917 - protein, 281 aa, Azorhizobium caulinodans
MHIVVCIKQVPDSAQIRVHPVTNTIMRQGVPTIINPYDLFALEAALALRDQHGGEVTVLTMGPPSAEDSLRKALTFGADRAVLLTDRFFAGSDTLATTYALATAVRKIGETFGAPDIVFTGKQTIDGDTAQVGPGIAKRLGLLQLTYVAKIANVDLAGRSIQVERRSEGGVQVLQTRLPCLITMLEATNEIRRGAMADALRAARAEVVIWSAKDAGVEDISKCGLRGSPTIVKRVFAPSARAEKATMVDFSETAPADALIAEIFKRQPKLEDDLAALARGY

SEQ ID NO: 19918 - DNA, 768 bp, Homo sapiens (man)
  CDS (1)..(768)
atggcggagctgcgcgtgctcgtagctgtcaagagggtcatcgactacgccgtgaagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgacgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttaa

SEQ ID NO: 19919 - protein, 255 aa, Homo sapiens (man)
MAELRVLVAVKRVIDYAVKIRVKPDRTGVVTDGVKHSMNPFCEIAVEEAVRLKEKKLVKEVIAVSCGPAQCQETIRTALAMGADRGIHVEVPPAEAERLGPLQVARVLAKLAEKEKVDLVLLGKQAIDDDCNQTGQMTAGFLDWPQGTFASQVTLEGDKLKVEREIDGGLETLRLKLPAVVTADLRLNEPRYATLPNIMKAKKKKIEVIKPGDLGVDLTSKLSVISVEDPPQRTAGVKVETTEDLVAKLKEIGRI

SEQ ID NO: 19920 - DNA, 846 bp, Azotobacter vinelandii
  CDS (1)..(846)
atgcacagcgtcgtctgtatcaagcagttgccggactcggcccagatccgggttcacccggtcaccaacaccatcatgcgccagggtgtcccggcgatcatcaacccttatgacctgttcgccctggaggaggccctgcgcctcaaggataagttcggcggcacggtcaccgtggtcaccatgggcccgcccatggccgaggcggcgctacgcaagtgcctgtccttcggcgccgacgacgccatcctggtgtcggaccgggccttcgccggctccgacaccctggccacttcctatgccctcagcgccgtcatccgcaagatcatggaagacatgccggtggacctgatcttcaccggcaagcagaccatcgacggcgacaccgcccaggtcgggccgggcatcgccaagcgcttggactaccagttgctcacctatgtgtccaggatcgtcgacgtcgacaccgcgaagaaggaaatccaggtggagcgtcgcgccgaaggcggcgtgcaattgctcgagacctcccttccctgcctgatcaccatgctggaaggcaccaatgaaatgcgtttcggcgatctggacgacctgtttcgcgccgcgcgccacgaactcaaggtctgggaccgcgtggccgccggcatcgatacggtggagatgatcggcctcaagggcagccccacggtggtcagcaaggtcttcgcgcccaagccccgcagcaagcgcgccgaactcatcgaaagccacgacagcgatccgaagaatctggccgaggccgcgctggccaagctgttcacccagcatcccaacttggaacaggaaatcgccaagcgggcggtctga

SEQ ID NO: 19921 - protein, 281 aa, Azotobacter vinelandii
MHSVVCIKQLPDSAQIRVHPVTNTIMRQGVPAIINPYDLFALEEALRLKDKFGGTVTVVTMGPPMAEAALRKCLSFGADDAILVSDRAFAGSDTLATSYALSAVIRKIMEDMPVDLIFTGKQTIDGDTAQVGPGIAKRLDYQLLTYVSRIVDVDTAKKEIQVERRAEGGVQLLETSLPCLITMLEGTNEMRFGDLDDLFRAARHELKVWDRVAAGIDTVEMIGLKGSPTVVSKVFAPKPRSKRAELIESHDSDPKNLAEAALAKLFTQHPNLEQEIAKRAV

SEQ ID NO: 19922 - DNA, 786 bp, Saccharomyces cerevisiae
  CDS (1)..(786)
atgtctgcaaaacagcaactacgtatattagttccggtgaaaagggtagttgatttccagatcaagcctagagtaaataagaccttaactgggattgaaaccagtggaatcaaattcagtatcaaccctttcgatgatattgctgtcgaagaagccatcagaattaaagaaaagaacaagagtttagtagaatctacgcatgcagtttctattggctccgccaaagctcaggatattctaagaaattgccttgctaagggaatagacacctgtagtttaattgactctgtgggtaaagaaaacatagagcccttagcaattgctaaaatcttaaaagctgttgttgaaaagaagggttctaatctggttttgatgggaaagcaagccattgatgatgactgtaacaacaccggtcagatgttggcaggtttattaaattggccacaggcaacaaatgcggcaaaggtggaattccttgataatggtagagttcaggtaacaagagaaattgacgatggagaagaagtaattgaagcttccttaccaatggttattactacagatttgagattgaacactccgcgttacgtaggactgcccaaactaatgaaggcgaagaaaaagcctattgaaaaattggatatagcaaaagattttcctgaaattaatattgaacctcagttaaagatagtgtcgatggaagagccaaagactaagtcacctggtgtgaaattgaattctgtggatgaattgattgaaaagttaaaagaagttaaggccatttaa

SEQ ID NO: 19923 - protein, 261 aa, Saccharomyces cerevisiae
MSAKQQLRILVPVKRVVDFQIKPRVNKTLTGIETSGIKFSINPFDDIAVEEAIRIKEKNKSLVESTHAVSIGSAKAQDILRNCLAKGIDTCSLIDSVGKENIEPLAIAKILKAVVEKKGSNLVLMGKQAIDDDCNNTGQMLAGLLNWPQATNAAKVEFLDNGRVQVTREIDDGEEVIEASLPMVITTDLRLNTPRYVGLPKLMKAKKKPIEKLDIAKDFPEINIEPQLKIVSMEEPKTKSPGVKLNSVDELIEKLKEVKAI

SEQ ID NO: 19924 - DNA, 765 bp, Schizosaccharomyces pombe
  CDS (1)..(765)
atgtcgaaaattcgcattttagtaggagtcaagcgaactctagactatatgttaaagcctcgcatcaatgccactaagactgctgttgatttatcggggcaaaaaatgagtattaatccattttgtgatattgctgtagaagaggctataaggatgaaggaaactttgaaaaatagaattgaggacactttagtagtgaccgcaggacaaacttcttctgagcccattcttcgccagtgtcttgctaaaggaattggccgagcagcacttataaatgttggcgaaaaagaacttgaacctctttcagtagccaaacttttgaaggcaacagtcgagaaggaaaaaagtaatctggttttgctgggcaagcaagctattgatgatgatgcacaccaaacaggtggtatgctggctgctatgcttggatggcctcaattcactagcgcaagtaaagtccgtattgaaggtgacaaagttatcgttacaagagaaattgacggcggtgaagaaaccttaagtagtacacttccagccattattaccaccgatttacgtcttaatgttcctagattcgcgaatttggcaaaagttatgaaggcaaggaaggctcctttaggcaaaatgtctcccgaagatctaggcgtaacaattgatcaaagactacagactgtttcagtctccgagcctgttcaaaagagacaaaacataatggtaaagagtgttgatgaaatggttaagacattaaaggaacttggcgccctctaa

SEQ ID NO: 19925 - protein, 254 aa, Schizosaccharomyces pombe
MSKIRILVGVKRTLDYMLKPRINATKTAVDLSGQKMSINPFCDIAVEEAIRMKETLKNRIEDTLVVTAGQTSSEPILRQCLAKGIGRAALINVGEKELEPLSVAKLLKATVEKEKSNLVLLGKQAIDDDAHQTGGMLAAMLGWPQFTSASKVRIEGDKVIVTREIDGGEETLSSTLPAIITTDLRLNVPRFANLAKVMKARKAPLGKMSPEDLGVTIDQRLQTVSVSEPVQKRQNIMVKSVDEMVKTLKELGAL

SEQ ID NO: 19926 - DNA, 783 bp, Clostridium thermosaccharolyticum, Clostridium tartarivorum
  CDS (1)..(783)
atgaatatacttgttttgattaagcaggttccggatacgaacgaagttagaattgatcctgtaacaaagacacttatacgtgaaggtgttccaagcattattaatcctgatgacaaaaatgccttagaagaagctatcaggataagagaaaaagtcggcggaaaagtaactgtaatatcgatgggaccaacacaagcagaagtagcattacgtgaggctcttgctatgggtgctgatgaagcatatcttttgacagatagagcatttgcaggcgcagacacttatgctactgcaaaagcactatcaaaagcaattgaaaagtttcagtacgacattgtattttgcggcagacaggcgatagatggcgatactgcacaagttggaccacaaattgcagaacaattagacatacctcaggtaacatatgtaaggaaggtagaaatagaaggagacaaactcatagttgaaagagctcttgaagatggatatgaaatcattgaagttaagacgccagtcttattgacagctattaaagaacttaatgtgcctaggtatccttcaataaaaggaatattcaatgcttacaataaaaaagaagttaaaatcttaactgcagatgatttagaagttgataaaaatgaacttggactaaaaggttcaccaactaaggttgtagcaacgtcaactccaaatactgaaagagctggagaaatatttactggcaatataaaagaagctgttcagaatctagttgaaagattaaacagcagacatgtgatatag

SEQ ID NO: 19927 - protein, 260 aa, Clostridium thermosaccharolyticum, Clostridium tartarivorum
MNILVLIKQVPDTNEVRIDPVTKTLIREGVPSIINPDDKNALEEAIRIREKVGGKVTVISMGPTQAEVALREALAMGADEAYLLTDRAFAGADTYATAKALSKAIEKFQYDIVFCGRQAIDGDTAQVGPQIAEQLDIPQVTYVRKVEIEGDKLIVERALEDGYEIIEVKTPVLLTAIKELNVPRYPSIKGIFNAYNKKEVKILTADDLEVDKNELGLKGSPTKVVATSTPNTERAGEIFTGNIKEAVQNLVERLNSRHVI

SEQ ID NO: 19928 - DNA, 801 bp, Mycobacterium leprae
  CDS (1)..(801)
atgacgaacattgtggtcctgattaagcaggttccagacacctggtcggagcgcaagctgactgacggcgatttcaccttggatcgcgaggccgccgacgcggtgctagacgagatcaacgagcgcgccgtagaagaggcgctgcaaatccgtgagaaagaggccgtcgacggcatcaaggggtcggtcactgtgttaaccgcgggaccagagcgcgccaccgaggcgattcgcaaggccctgtcgatgggcgctgataaggccgtccaccttaaggacgacggtatgcacggctcggatgtcatccagactgggtgggccctggcacgcgcgttgggcaccatcgaaggcaccgaactggtcatcgccggcaacgaatccaccgatggcgtcggcggcgtggttccggcgatcatcgccgagtacctgggcctgccgcagctcacccacttgcgcacaatctcggttgagggaggcaaaatcaccggtgaacgcgaaacggacgagggagtgtttaccctcgaggccgtactgcctgcagtggtcagtgtgaacgagaaaatcaacgagccacgcttcccctcctttaaaggcattatggccgctaagaaaaaagaagtcacggtgttgacgttggccgagatcggtgtcgaggtcgatgaggtcgggctggccaacgccgggtcgaaggtgttggtgtcgacgcccaagccggccaaaaccgcgggcgagaagatcaccgatgaaggcgatggcggtaaccagatcgtgcagtacctggttgctcagaagatcatctaa

SEQ ID NO: 19929 - protein, 266 aa, Mycobacterium leprae
MTNIVVLIKQVPDTWSERKLTDGDFTLDREAADAVLDEINERAVEEALQIREKEAVDGIKGSVTVLTAGPERATEAIRKALSMGADKAVHLKDDGMHGSDVIQTGWALARALGTIEGTELVIAGNESTDGVGGVVPAIIAEYLGLPQLTHLRTISVEGGKITGERETDEGVFTLEAVLPAVVSVNEKINEPRFPSFKGIMAAKKKEVTVLTLAEIGVEVDEVGLANAGSKVLVSTPKPAKTAGEKITDEGDGGNQIVQYLVAQKII

SEQ ID NO: 19930 - DNA, 750 bp, Neisseria meningitidis
  CDS (1)..(750)
atgaaagcactggtcgcagtaaagcgcgtagtggactacaacgtcaaagttcgtgtaaaagccgatggttcggatgtggatatcggcaatgtcaaaatgtcgatgaatccgtttgacgaaatcgctgtggaagaagctgtccgtttgaaagaagccggaaaagtaagcgaaatcgtagcggtttctttgggtgagaaaaaacccgaagaaaccttgcgtacagctttggcgatgggtgccgaccgtgccattcatgttgaaaccgatactaaactggagtctctggccgttgctaagttgctgaaagccgttgcggacaaagaaaatccgcaaattttctttttgggcaaacaagcgattgatgatgatgccaatcaagtggcgcaaatgctggcagctttgctgaatgcggcgcaaggtacgtttgcttcaaaagtacacattgaatgtggtgaagtacagattgtgcgcgaaattgatggcggcgaagaaaccatagcattaaaactgcctgctgttatcagtgctgatttgcgtttgaacgagccgcgctttgtcaaactccccaatattatggcggcaaagaaaaaacctttggaaaaactgactcctgacgatttggttgccgacatttcacctcgtttgaaaacggtgaaatttgccgaacctaaggcgcgtcaggcaggcgtaaaagtagcaagcgttgccgaattggttgaaaaattgaaaaacgaagccaaagtgatttga

SEQ ID NO: 19931 - protein, 249 aa, Neisseria meningitidis
MKALVAVKRVVDYNVKVRVKADGSDVDIGNVKMSMNPFDEIAVEEAVRLKEAGKVSEIVAVSLGEKKPEETLRTALAMGADRAIHVETDTKLESLAVAKLLKAVADKENPQIFFLGKQAIDDDANQVAQMLAALLNAAQGTFASKVHIECGEVQIVREIDGGEETIALKLPAVISADLRLNEPRFVKLPNIMAAKKKPLEKLTPDDLVADISPRLKTVKFAEPKARQAGVKVASVAELVEKLKNEAKVI

SEQ ID NO: 19932 - DNA, 768 bp, Debaryomyces hansenii
  CDS (1)..(768)
atgtcgtcaaaattgaaaattttagtaccagtcaaaagagtgattgactttgcaatcaaaccaagaattaataaagcacaaactggagtggaaactaagggagttaagttcagtatcaatccattctgtgatattgcattagaagagtcaattaggatcagagaggcccacaagggtttagttgaaaagatccatgctgtttctattggaccaaccaaggcacaagatatattaagaactgcattggctaagggtgctgactccaccacgttgatagacgtaggcgacgaagaagtcgagccattaactgtggccaagctcttacaaaagacagttgaaaaggaggactccaacttagttattttgggaaaacaggccattgacgacgattctaatcaaaccgggcaaatgttagcaggtttgttgaactggccccaagccaccaatgcttcaaaggttgaaattgacggtgataacatcactgtaacccgtgaaattgatggaggttcggatactttgcgtgccaagttgccaatgattgtcactacagatttaagattgaacgagccaagatacgcttctttgccaaatatcatgaaggccaagaagaagccattagaaaaattgaaagtcagcgatttaggtattgaattatccaagagattagaaaccttaaaggttgaagaaccacctcagagagaggctggtgttaaagtggaatcagttgatgaattgatcagtaaattgaaagaattgaaggccatttaa

SEQ ID NO: 19933 - protein, 255 aa, Debaryomyces hansenii
MSSKLKILVPVKRVIDFAIKPRINKAQTGVETKGVKFSINPFCDIALEESIRIREAHKGLVEKIHAVSIGPTKAQDILRTALAKGADSTTLIDVGDEEVEPLTVAKLLQKTVEKEDSNLVILGKQAIDDDSNQTGQMLAGLLNWPQATNASKVEIDGDNITVTREIDGGSDTLRAKLPMIVTTDLRLNEPRYASLPNIMKAKKKPLEKLKVSDLGIELSKRLETLKVEEPPQREAGVKVESVDELISKLKELKAI

SEQ ID NO: 19934 - DNA, 771 bp, Yarrowia lipolytica
  CDS (1)..(771)
atgtccaacaagctgcgtatctttgtgcccgtcaagcgagtaattgatttcgctgtcaagccccgagtcaacaaggccggcaccggcgtcgagaccactggagtcaagttctccatcaaccccttctgtgatattgctgtcgaggaggctcttctgctcaaggagggaaacaaggatctggttgagaacattcacgtggcctccgtcggtccctccaaggcccaggatatcctgcgacaggctctggccaagggtgctgacgactccactctggtggagatgggtcccaaggacaccgagcttgagcctctgggtgtggccaaggtgctcaagaagctgattgaggaacagaagtccaacctggtcattctcggaaagcaggccattgacggcgacaacggccagaccggtcagattctcgctggtctgctcaagtggccccaggccacccaggcctccaaggtgtctgtcaacggcgacaaggtcgaggtcacccgagaggtcgatggtggtgtcgagaccgtcgctgccaaactgcccatgatcattaccaccgatctgcgactcaacgagcctcgatacgtgactctgcccaacatcatgaaggccaagaagaagcccctcaaggtggtcaagatcaaggactttgacggcgttgccaaccgactcgagaccctcaaggttgccgagcctgccaagcgacaggccggtgtcaaggtcgagaacgttgatgagctggtcggcaagctcaaggagactggtactctttaa

SEQ ID NO: 19935 - protein, 256 aa, Yarrowia lipolytica
MSNKLRIFVPVKRVIDFAVKPRVNKAGTGVETTGVKFSINPFCDIAVEEALLLKEGNKDLVENIHVASVGPSKAQDILRQALAKGADDSTLVEMGPKDTELEPLGVAKVLKKLIEEQKSNLVILGKQAIDGDNGQTGQILAGLLKWPQATQASKVSVNGDKVEVTREVDGGVETVAAKLPMIITTDLRLNEPRYVTLPNIMKAKKKPLKVVKIKDFDGVANRLETLKVAEPAKRQAGVKVENVDELVGKLKETGTL

SEQ ID NO: 19936 - DNA, 780 bp, Kluyveromyces lactis
  CDS (1)..(780)
atgtcgtccaagctaagaattttggtgccagtgaagcgtgttgtggatcatgccatcagacctcgtgtcaacaagcagtttaccaacgttgagaccaagaacttgaagttctctatcaatccgtttgacgatattgcagtggaagaatctgtgaaattgaaggaaactcatcctgatgccgtcgaatcaatccatgccgtttccgttggcccactgaaggcccaagatgtgttgaggacagctttagccaaaggttgtgattcttcaactttggttgagcatgattctaccgaattggagccattggtgatcagcaaggtgttgaagaaaattgttgaagacaagaatgctaacttggttgtgctcggaaagcaagccatcgatgatgatagcaacaacactggtcaaatgctcgctggtttgttgaactggccacaagctaccaacgcttgtaaagtagaattgttagaagacggcgccagtgtcagagtcaccaaggaaatcgacggtggtgaagaaatcgtggtcgcaaaattacctatgatcatcaccactgatctacgtttgaatacgccaagatacgctacgttaccaaatttgatgaaagccaagaagaagcctttggagaagttgaagttgaagaaagattttgaagggatcaatttggacccccaattgaaactgctaaaggtcgaagaacctccagtcaagagtgctggtatcaaggtttcctctgtcgatgaattggtctcaaagctaaaggaagccaaactggtttga

SEQ ID NO: 19937 - protein, 259 aa, Kluyveromyces lactis
MSSKLRILVPVKRVVDHAIRPRVNKQFTNVETKNLKFSINPFDDIAVEESVKLKETHPDAVESIHAVSVGPLKAQDVLRTALAKGCDSSTLVEHDSTELEPLVISKVLKKIVEDKNANLVVLGKQAIDDDSNNTGQMLAGLLNWPQATNACKVELLEDGASVRVTKEIDGGEEIVVAKLPMIITTDLRLNTPRYATLPNLMKAKKKPLEKLKLKKDFEGINLDPQLKLLKVEEPPVKSAGIKVSSVDELVSKLKEAKLV

SEQ ID NO: 19938 - DNA, 750 bp, Acinetobacter sp
  CDS (1)..(750)
atgaaggctcttgttgctgtaaaacgtgtggttgatgccaacgttaaagttcgcgtaaagccggacaatagtggggttgacttaaccaatgttaaaatgtcaatcaacccattttgtgaaatcgcagtggaagaagcggttcgcttaaaagaaaaaggaacagtatctgaaatcgttgtggtttctatcggtcctaaagaagcacaggaacaaatccgttcctcaatggctctaggtgcagatcgtggtattttggtcgaaactgcggatgaaattggtgctttagaagttgctaaaattctaaaagggattgtagaacaagaaaaaccagaattgattcttcttggaaagcaagccattgacgatgactcaaatcaagtcggtcaaatgcttgcagctttattagatgcaggtcagggtacttttgcttctgaagttaaagtagacgctggaaaagttcaggttactcgtgaaattgacggtggtctacaaacggttgagctgacacttcctgccattattaccacagatttacgtttgaatgagcctcgttatgcggcacttccaaacattatgaaggcgcgcaaaaagccactagataccaaatctccagcagattatggtgttgcaacaggtacaaaacttaaaactgtaaaagttgagccacctgctgatcgtaaagctggcgtacaagtgaaatcagtcgatgaacttgttgaaaaattaaaaaatgaagcgaaagtgatctaa

SEQ ID NO: 19939 - protein, 249 aa, Acinetobacter sp
MKALVAVKRVVDANVKVRVKPDNSGVDLTNVKMSINPFCEIAVEEAVRLKEKGTVSEIVVVSIGPKEAQEQIRSSMALGADRGILVETADEIGALEVAKILKGIVEQEKPELILLGKQAIDDDSNQVGQMLAALLDAGQGTFASEVKVDAGKVQVTREIDGGLQTVELTLPAIITTDLRLNEPRYAALPNIMKARKKPLDTKSPADYGVATGTKLKTVKVEPPADRKAGVQVKSVDELVEKLKNEAKVI

SEQ ID NO: 19940 - DNA, 780 bp, Candida glabrata
  CDS (1)..(780)
atgtcgaagccattgcgtattttagttccagtcaagcgtgtggttgatttccagatcaaaccacgggtgaacaagacactcactgggatagagaagagtggcatcaagtttagtataaacccattcgatgatatagctgtcgaagagactgtgaggattaaggagaaacatggtgatctggttgagcacacgcaagcggtgtctatcgggccagctaaagcccaggacatcttaagaaattgtcttgccaagggtatagataatgtgtccttgatagattgcaaggatcttgagttggaaccattggctgtcgcaaaagtattgaagaacatagtcgaaaagcagaacattaacttgattatcatgggtaaacaggccatcgatgacgatttcaaccatacgggtcaaatgttggcaggtctcttgaactggcctcaggcaactaatgctgcaaaagttgatattctagctgatgagggtaaagtgagaattacccgtgagatagacggtggtgaagagaccctaaaggcctcactaccactgattataaccactgatctgagactaaatactcctagatacgtcggtttgccaaatctgatgaaagcaaagaagaaacctatggaaaaacttacattagagaaagactttgctgacattgataccaaacctagactagagatcttatcagtgaacgagccaaatgccaaagaacctggtattactgttggctctgtcgatgaactagtccagaaactaaaggactcaaaagtcttgtaa

SEQ ID NO: 19941 - protein, 259 aa, Candida glabrata
MSKPLRILVPVKRVVDFQIKPRVNKTLTGIEKSGIKFSINPFDDIAVEETVRIKEKHGDLVEHTQAVSIGPAKAQDILRNCLAKGIDNVSLIDCKDLELEPLAVAKVLKNIVEKQNINLIIMGKQAIDDDFNHTGQMLAGLLNWPQATNAAKVDILADEGKVRITREIDGGEETLKASLPLIITTDLRLNTPRYVGLPNLMKAKKKPMEKLTLEKDFADIDTKPRLEILSVNEPNAKEPGITVGSVDELVQKLKDSKVL

SEQ ID NO: 19942 - DNA, 747 bp, Bartonella quintana
  CDS (1)..(747)
atgaagataatcgtcgctgttaaacatgttgttgattataacatcaaaatacgcgtcaaacccgataacacaggcgttaatctgtcccatgtaaaaatgtccatgaacccttttgacgaaattgccgtagaggaagcaatccgccaaaaagaatccggcaaaatttcagaagtcgttcttgtttcaattggaccagaagcagcacaagaaaccttacgaacagggcttgcaatgggtgcagatcgtgcgctccttgtaacaacgcaagaaacactcgaacctttagcaattgctaagattctcaaggtcattgttcatgaagaacaaccagatatggtttttttaggcaaacaaactattgatgatgagagcaatcaaaccggacaaatgttagctgcccttcttggttggggacaagcgacttttgcctcaagcctggacatagaaaatgggcacgctatagttatccgagaagtagataacggcacacaaaccctttcccttcctcttcccatagttatgaccgctgatctaaggttaaacgaaccacgttatacttctctccccaatatcataaaagcgaaaaagaaacccattgaacaaagagctcttgctgatcttggtatagagacacgagcacgtttaacagtcttacttgttgaagaaccgaaaccccgtcaagctggtgttaaagtagctaatgtagcagaacttatcagcgcattaaaacaaacaaattgcatttaa

SEQ ID NO: 19943 - protein, 248 aa, Bartonella quintana
MKIIVAVKHVVDYNIKIRVKPDNTGVNLSHVKMSMNPFDEIAVEEAIRQKESGKISEVVLVSIGPEAAQETLRTGLAMGADRALLVTTQETLEPLAIAKILKVIVHEEQPDMVFLGKQTIDDESNQTGQMLAALLGWGQATFASSLDIENGHAIVIREVDNGTQTLSLPLPIVMTADLRLNEPRYTSLPNIIKAKKKPIEQRALADLGIETRARLTVLLVEEPKPRQAGVKVANVAELISALKQTNCI

SEQ ID NO: 19944 - DNA, 747 bp, Bartonella henselae
  CDS (1)..(747)
atgaaaataattgtcgctgtcaaacgtgttgttgattataatatcaaaatacgcgtcaaaccggatagcacaggcgttgatctatcccatgtaaaaatgtctatgaacccttttgacgaaattgccgtagaagaagcagtccgccaaaaagaatccggcaaaatttcagaagttgttcttgtttcaattggaccagaagcagcacaagaaaccctacgaacaggacttgcaatgggtgccgatcgcgcactccttgtaacaacacaagaaacactcgaacctttagcaattgctaaaattctcaaggtcattgtccaggaagaaaaaccagatatggtctttttaggcaagcaagccattgatgacgagagcaatcaaaccggtcaaatgttagccgcccttcttggttgggggcaagcaacttttgcctcaaacttagacatagaaaatggacatgctatagtcgtccgcgaagtcgatgatggaacccaaaccctttccttacccctccccatcgtcatgacggctgatttacgattaaatgagccgcgttatacttctctgcctaatattatgaaggcaaaaagaaaacccattgaacaaaaagctctctctgatcttggcttagaaacacggaaacgtttaacggtcttaagcgtagaagaaccaaaacctcgtcaatgcggtgttaaagtagcaaatgtagcagagctggtcagtgcgctaaaacaaacaaattgcatttaa

SEQ ID NO: 19945 - protein, 248 aa, Bartonella henselae
MKIIVAVKRVVDYNIKIRVKPDSTGVDLSHVKMSMNPFDEIAVEEAVRQKESGKISEVVLVSIGPEAAQETLRTGLAMGADRALLVTTQETLEPLAIAKILKVIVQEEKPDMVFLGKQAIDDESNQTGQMLAALLGWGQATFASNLDIENGHAIVVREVDDGTQTLSLPLPIVMTADLRLNEPRYTSLPNIMKAKRKPIEQKALSDLGLETRKRLTVLSVEEPKPRQCGVKVANVAELVSALKQTNCI

SEQ ID NO: 19946 - DNA, 783 bp, Saccharopolyspora spinosa
  CDS (1)..(783)
atgaacatcgtcgttctggtcaagcaggtgccggacacgtattccgagcggcggctcgcgggtgcggatcacgcgttggatcgtgagtcggcggatgcggtgctggacgaggtcaacgagcgtgcggtggaggaggcgctgcagatcaccgaggcacagggcggtgaggtcaccgttgtgtgcatgggcccggatcgcgccacagatgcgattcgcaaggcgttgtcgatgggtgcggacaaggcggtgcacctatccgatggggcgctgggcggcaccgacgcgccggcgacggcgcgggcgctggcgaaggttatcggcaccgtcgaggacgtcgacttggtgatcgccggtaacgaggcgaccgacggccgcgtgggcgcggtcccggcgatggtggccgaggtgctgggctggccgcagctgaccttcgcgcgcaaggtcgagaccgacggttccagcgtgaaggccgagcgggagaccgacgcgggcatcgtcaacgtcgaggctgggttgccggcggttgtgtcggtgacggagaagatcaacgagccgcggtatccgtccttcaaggggatcatggcggcgaagaagaagccggtcagcgtgctttcgctggcggacgtggggatcgaggtgggcgaggtcgggctggctggcgccgcctcgcaggtggtggcctcggcgccgaagccgccgaaggccgcgggtgtgaaggtcaccgatgagggcgagggtggcgtggccgtcgccgggttcctggccggcgagaagctggtctga

SEQ ID NO: 19947 - protein, 260 aa, Saccharopolyspora spinosa
MNIVVLVKQVPDTYSERRLAGADHALDRESADAVLDEVNERAVEEALQITEAQGGEVTVVCMGPDRATDAIRKALSMGADKAVHLSDGALGGTDAPATARALAKVIGTVEDVDLVIAGNEATDGRVGAVPAMVAEVLGWPQLTFARKVETDGSSVKAERETDAGIVNVEAGLPAVVSVTEKINEPRYPSFKGIMAAKKKPVSVLSLADVGIEVGEVGLAGAASQVVASAPKPPKAAGVKVTDEGEGGVAVAGFLAGEKLV

SEQ ID NO: 19948 - DNA, 1824 bp, Picrophilus torridus
  CDS (1)..(1824)
atgcttaaaataattgtatcaataaaacaggttcctgacgcggacgatctcaggatagatcctgttacaaataatcttgtaagggaaggtgttccagctgtaatgaacccgcctgatctgcatgccatagaggctgcccttcagctccgtgagaaatatggcggcaccgtgaccgtaatatcaatgggccctccgcagggtgatatctcattaagagaggcaatagccatgggtgcagatgatgcctatttaattactgacagggcaatggcaggttctgacacatgggcaacatcatatactgtatcaagggcaatagaaaagcttggtggtgctgatattattatatttggcaggcgtgccgttgatggtgagacacagcaggttggaccgcagacgggcaaatggcttggcattccagtatgcgcatacacgaaaaaaattcttgatgttgatgagaagaataaaaaaataaggcttgaaaaggaaacagagtttgaaattgagaccatagagatgccaatgcccctggtcataaccgttacagaggattcaaacacacccagagaaccagaccttgagggcatgctcagggcaaagacatttaacgttaaaaggttctcaaaggatgatataaatgcagatccatcaatgataggtctggcagcatcaccaacaaaggtcataagggtgaggccaccgccaaagatgaggaatgccgagataaaaaatgcaaatgatgatcttaaaggttccgtggactggttaatatcaaagataaaggagtcaatgacaggaatgaagacctcatccggggtctatgaaaaacctgaacctgtaacaaaggttgatcacgatatctgggtatacatggatcattacgatggtaatgtgaattcaacatcccttgagatacttggtgccgcaagaagggttgctgacctaatgaacaccaaacttgccgccgttgtcattggggatgaaatagataatattatagacacggcgtttaaatatggtgccgacagggtttatgcaggtgtaacagaagggtataaaaactatgataacgatgcctatacagaggcattatcattgatgataaagaagtacagccctgaggcaatattttatccagggacatcaaatgccagggagcttgcatcaacaacggccattcaggttaataccggactgatagctgactgcataatctttgatgttgatgaaaagggccagctgctatcaacaagaccggatttcggcggtaaggaaacatcgactataatatgcccaaataacaggccaataatggttacaacgagatcaggagttttttccgcaatgccgcccatggataaaaagggcgatgtaataaaagaggatataaaggatttaaaaacaaggataaagcttctagaatacaagaagcttgaaaaaagaaacatactcaatgatgctgacattgttataggcgttggccgtggcattgtgaacagggataatataggcatcgttgaggatcttgcaaacaggcttggtgctgttgtcggggtcagcaagcctcttgcggacatgggatggtatccaaaggacaggcaggttggccagaccggaacaacgatacatccaaacgtttacattgccataggaatatcaggtgcaatacagcaccttgttggtattcagggttcaaagaagatcattgcaataaacaatgatccatcagcgccaatatttgaaaactgtgattatggtatagttggtgatttatttaccgtagttccagaattaataaaaaggttgggtgaacagaatgcttga

SEQ ID NO: 19949 - protein, 607 aa, Picrophilus torridus
MLKIIVSIKQVPDADDLRIDPVTNNLVREGVPAVMNPPDLHAIEAALQLREKYGGTVTVISMGPPQGDISLREAIAMGADDAYLITDRAMAGSDTWATSYTVSRAIEKLGGADIIIFGRRAVDGETQQVGPQTGKWLGIPVCAYTKKILDVDEKNKKIRLEKETEFEIETIEMPMPLVITVTEDSNTPREPDLEGMLRAKTFNVKRFSKDDINADPSMIGLAASPTKVIRVRPPPKMRNAEIKNANDDLKGSVDWLISKIKESMTGMKTSSGVYEKPEPVTKVDHDIWVYMDHYDGNVNSTSLEILGAARRVADLMNTKLAAVVIGDEIDNIIDTAFKYGADRVYAGVTEGYKNYDNDAYTEALSLMIKKYSPEAIFYPGTSNARELASTTAIQVNTGLIADCIIFDVDEKGQLLSTRPDFGGKETSTIICPNNRPIMVTTRSGVFSAMPPMDKKGDVIKEDIKDLKTRIKLLEYKKLEKRNILNDADIVIGVGRGIVNRDNIGIVEDLANRLGAVVGVSKPLADMGWYPKDRQVGQTGTTIHPNVYIAIGISGAIQHLVGIQGSKKIIAINNDPSAPIFENCDYGIVGDLFTVVPELIKRLGEQNA

SEQ ID NO: 19950 - DNA, 702 bp, Picrophilus torridus
  CDS (1)..(702)
atgatagatcttgaccagataaaaatagatagcagtggcagacccatcactgagaatataccatataaaacagagatattaagcaagaatgcaatagaggcagctgttcagctcaaggaaaaatacggcggccatgtggtatcaataacgttcggcaatgaaaaggcaggccaggttgtaaaagaggctcttgcaatgggcgttgatgaatcgtatataataacaggctatgatcacagcgatccactggcgaccgggaaggttcttgcatcaaagataaaatccatgaattatgatgttataatacttggaaaccagtccgctgattcatacacgggacttcttccgggcatattaagtggattattaaatataaatattataagcaatgcaatttcaatagagattgataataataaggtaagggtaacatccgcccagggtgttaactatcttgaggagacaaacatgcctgtaataatatccgttgcacaggagattaacactccaaggctgccaacgataatgcagatcatggccgcatcaaagaaaaaaattaatattgaggagtcaaaaccagaatacaatgatgtgaaaatcttatcaaacctggcaccaaagagcgagcgcaaaaagataatatacaaggatgataatggcatagatgaaatagcaaaggttttaaagggggtctcaagatga

SEQ ID NO: 19951 - protein, 233 aa, Picrophilus torridus
MIDLDQIKIDSSGRPITENIPYKTEILSKNAIEAAVQLKEKYGGHVVSITFGNEKAGQVVKEALAMGVDESYIITGYDHSDPLATGKVLASKIKSMNYDVIILGNQSADSYTGLLPGILSGLLNINIISNAISIEIDNNKVRVTSAQGVNYLEETNMPVIISVAQEINTPRLPTIMQIMAASKKKINIEESKPEYNDVKILSNLAPKSERKKIIYKDDNGIDEIAKVLKGVSR

SEQ ID NO: 19952 - DNA, 804 bp, Photobacterium profundum
  CDS (1)..(804)
atgaaagtattagtagcgattaaacgtgtgattgacccttacgtaaaggttagggttaagagtgacggttcaggtgtcgagaccaataatgtaaaaatgacgatgaaccccttttgcgaaatagcggtagaagaggcggtcaggctaaaagaagcagggcatgcagaagaaattattgtggtatcagtcggtgatataagctgtcaggaacaattgagaacagcactggcactgggcgccgatcgtgcgattcatattgatatgccatcgtcaccagaacctctcgttgtggctaaattactgcgagctgttatggcgattgaagacccaggaattgtattactgggtaagcaatctattgatacagacaacaatcaagtggcgcaaatgctagctgccatcacgcagcgcccccaaggcacattcgcatcagaagtgaccgttgtgtcagaagaatctcctgtatctgaagagcctattgtatctgaatcgaatgggcagagtaatgccgtacttgttactcgtgaaattgatggtggtcttgaaacggtaaaactgaatctacctgcaattatcagtactgacttgcgcttaaatgaaccccgttatgcctctcttcccaatattatgaaagcaaaacgaaaaccgttagatgtgataacaccagatgaattaggtgtggctgttactcagcatcaagaaatacttgatgtaatgtcaccgcctgaacgagccgctggcgtgatggttaatagcgtattggaactggtagaaaagctgaaaaatgaagccaaggtcatttag

SEQ ID NO: 19953 - protein, 267 aa, Photobacterium profundum
MKVLVAIKRVIDPYVKVRVKSDGSGVETNNVKMTMNPFCEIAVEEAVRLKEAGHAEEIIVVSVGDISCQEQLRTALALGADRAIHIDMPSSPEPLVVAKLLRAVMAIEDPGIVLLGKQSIDTDNNQVAQMLAAITQRPQGTFASEVTVVSEESPVSEEPIVSESNGQSNAVLVTREIDGGLETVKLNLPAIISTDLRLNEPRYASLPNIMKAKRKPLDVITPDELGVAVTQHQEILDVMSPPERAAGVMVNSVLELVEKLKNEAKVI

SEQ ID NO: 19954 - DNA, 774 bp, Bdellovibrio bacteriovorus
  CDS (1)..(774)
atgaagatttttgtgtgtatcaagcaggtgcctgacaccgaaacaaagattaagatctctcccgaccagactggtatcgacacggcgggtattaaatgggttatgaacccttatgacgaatatgcagttgaggaagccaacaagcttcgcgatgcaaatccgggatcccaagtatgggttctgtctgttggaccaaaggctcgtgtcgttgaatccttgcgtacggctttggctatgggcgctgacgaagcgatcgtggtgaacggcgaaggcctggacaactttgccacggcaaaagctttggctgaagtgatcaaagctgaaggcggcgcaaaagtcatcttctccggcaaacttgcaattgatgacaatgcttcctctgtcagccagatgatggctgaattcctgaacgttcctcacaccacagtggtatcgaaattcaatttcaatggcgaaaacgttgtggttgagcgcgatatcgaaggtggcgcgaaagaagttgtgcaaatgatgactccggcggttgtggcggcgaacaagggtttgaacatgcctcgttacgcaagtcttccaggcatcatgaaagccaaaaagaaagtgatcaaagaaatcgaattcgcttctttgaacatcccggcttctgacatcaaaatcaaatactccggctttgctcttccggctgataaaccagctgtaaaaatgctttctggcgatgcttctgcacaagcgtccgagctggttaaacttcttcgcgatgaagcgaaggttctgtaa

SEQ ID NO: 19955 - protein, 257 aa, Bdellovibrio bacteriovorus
MKIFVCIKQVPDTETKIKISPDQTGIDTAGIKWVMNPYDEYAVEEANKLRDANPGSQVWVLSVGPKARVVESLRTALAMGADEAIVVNGEGLDNFATAKALAEVIKAEGGAKVIFSGKLAIDDNASSVSQMMAEFLNVPHTTVVSKFNFNGENVVVERDIEGGAKEVVQMMTPAVVAANKGLNMPRYASLPGIMKAKKKVIKEIEFASLNIPASDIKIKYSGFALPADKPAVKMLSGDASAQASELVKLLRDEAKVL

SEQ ID NO: 19956 - DNA, 750 bp, Rhodopseudomonas palustris
  CDS (1)..(750)
atgaaggttctggtgccggtcaagcgcgtggtcgactacaacgtcaagatccgcgtcaagagcgacgggtcgggcgttgaactcgccaacgtcaagatgtcgatgaatccgttcgacgagatcgccgtcgaagaagcgctgcgcctcaaagaggccggcaaggcgaccgaagtcgtcgtggtctcgatcggaccggcgcaggcgtcggaaaccctgcgcaccggcctcgccatgggcgcggaccgcggcatcctggtcaaggtcgacggcgtcgtcgaaccgctggcggtcgccaagatcctcaagggcatcgccgacgaggaaaagccgggactgatcattctcggtaagcaggcgatcgacgacgacagcaaccagaccggccagatgctggccgcgctgctcggctgggcgcaggcgaccttcgcctccaagctcgaagtcgaaggctcggacttcaccgtcgcgcgtgaagtcgatggcggctcgcagaccgtcaagctcaagggcccggcgatcgtcaccaccgatctgcgtctcaacgagccgcgctacgcttcgctgccgaacatcatgaaggccaagaagaagccgatcgcggagaagaccgcggccgacttcggcgtcgacgtttcgccgcgcctggaagttctgaagaccgtcgagccgggtggccgcaaggccggcgtcaaggtcaaggacgtcgccgaactggtttcgaagctcaagaacgaggcgggtgtactctga

SEQ ID NO: 19957 - protein, 249 aa, Rhodopseudomonas palustris
MKVLVPVKRVVDYNVKIRVKSDGSGVELANVKMSMNPFDEIAVEEALRLKEAGKATEVVVVSIGPAQASETLRTGLAMGADRGILVKVDGVVEPLAVAKILKGIADEEKPGLIILGKQAIDDDSNQTGQMLAALLGWAQATFASKLEVEGSDFTVAREVDGGSQTVKLKGPAIVTTDLRLNEPRYASLPNIMKAKKKPIAEKTAADFGVDVSPRLEVLKTVEPGGRKAGVKVKDVAELVSKLKNEAGVL

SEQ ID NO: 19958 - DNA, 846 bp, Rhodopseudomonas palustris
  CDS (1)..(846)
atgcatatcgtcgtctgtatcaagcaggttccggactcggcccagatccgtgtgcatccggtcaccaacacgatcatgcgccagggcgtgccgacgatcatcaatccctacgatctgttcgcgctcgaagaggcgctgcggctgcgcgacaagttcggcggcgaagtcacggtgctgacgatgggcccgccgaccgcggaagattccttgcgcaaggcgctgaccatcggcgccaaccgcgccgtgctgctgaccgatcggttcttcgccggctccgacacgctggcgaccagctacgcgctcgccgccgcgatccgcaagatcggctccaccttcggtgctgtcgacgtggtgttcaccggcaagcagaccatcgacggcgacaccgcccaggtcggccccggcatctgcaagcggctcgactttctgcagctgacctatgtctcgaaggtctcatcgctcgacctcgaggctcgcaccattgaagtcgagcgccgctccgaaggcggcgtgcaggtgctgcgcagcaatctgccctgcctgatcacgatgctggaaggcaccaatcaggtgcgccgcggctcgatgatcaacgcgctgaatgccgcccgcgccgaagtggtgaagtggagcgcgcaggatgccggcgtcgaggacatccagaagtgcggcctccgcggttcgccgacggtggtgaagcgcgtgttcgcacccaccccgcgcgccgagaaggccaaggtggtcgaggccgccggccagccgccggcggaagcgctgatcgacgaaatcttcaagctccggcccaagctcgagaacgagatgttcgagctggcgcgcggattctga

SEQ ID NO: 19959 - protein, 281 aa, Rhodopseudomonas palustris
MHIVVCIKQVPDSAQIRVHPVTNTIMRQGVPTIINPYDLFALEEALRLRDKFGGEVTVLTMGPPTAEDSLRKALTIGANRAVLLTDRFFAGSDTLATSYALAAAIRKIGSTFGAVDVVFTGKQTIDGDTAQVGPGICKRLDFLQLTYVSKVSSLDLEARTIEVERRSEGGVQVLRSNLPCLITMLEGTNQVRRGSMINALNAARAEVVKWSAQDAGVEDIQKCGLRGSPTVVKRVFAPTPRAEKAKVVEAAGQPPAEALIDEIFKLRPKLENEMFELARGF

SEQ ID NO: 19960 - DNA, 795 bp, Corynebacterium diphtheriae
  CDS (1)..(795)
atgcccgctattgtggctctggtcaaaaatgttcccgacacgtggtcggtgaaaaagctcgaggctgattacacgttggatcgcacgaacgtggattcagtcatcgatgagattaacgagtacgcagtggagcaggcattgcggcttcgcgacgacaacccagatgctggatacgaagtcgtggcgttgtctttagggccaacaaatgccgaagaagctctacgcaaggcattggcgatgggtgcagatcgtgcggtgttgctttccgacgacagcctcgcaggttctgatgttctgggtactgcttgggcattgcataacgcgattaatcaaatccctgacgttgcaatggttgttacgggctctgcatcttctgatggctcaatgggcgttgtccctggaattttgagcgaatatcgccaacagcctgcattaacacacctacgttccgtggctatagtcgatggtgtagtcaaaggcattcgagaaactcatgatggtgattttgcggttgaggcgccactgcctgcgattatttctgtaaccgaaaaagcagataaaccacggttccctaatttcaaaggcattatggcggcgaaaaaggcggagattacccgcatggcgttgtcatccattggcgtagcacctgaacaagttggattggcacacgcagcaactgtagtcacggctgcaacggaacggccagtccgtgtcgccggtgaagttattaacacatcctctgctgaagcagcggcaaagattgcagacttcttggctgcggaaaagcttatttaa

SEQ ID NO: 19961 - protein, 264 aa, Corynebacterium diphtheriae
MPAIVALVKNVPDTWSVKKLEADYTLDRTNVDSVIDEINEYAVEQALRLRDDNPDAGYEVVALSLGPTNAEEALRKALAMGADRAVLLSDDSLAGSDVLGTAWALHNAINQIPDVAMVVTGSASSDGSMGVVPGILSEYRQQPALTHLRSVAIVDGVVKGIRETHDGDFAVEAPLPAIISVTEKADKPRFPNFKGIMAAKKAEITRMALSSIGVAPEQVGLAHAATVVTAATERPVRVAGEVINTSSAEAAAKIADFLAAEKLI

SEQ ID NO: 19962 - DNA, 852 bp, Rhodospirillum rubrum
  CDS (1)..(852)
atgcatatcgttgtctgcatcaagcaggttcccgacagcgcgcaaatccgggtgcatccggtgaccaacaccatcatgcgccagggcgtgccgaccatcatcaacccctatgatcttttcgcccttgaagaggccctgcggcttcgtgacaaaatgggtggcaaggtgaccgttctgaccatgggtccgcccatggccgatgaaagcttgcgcaaggccttagggctaggcgccgatgccgccgtgctgttgaccgaccgtttcttcgccgggtccgataccctggccacctcctatgccctggccgccgggatccgcaagatcggcgaggaggagcccgtcgatatcgtcttcaccggcaagcagacgatcgacggcgataccgcccaggtcgggccggggatcgccaagcggctgggtcttaaccagttgacctatgtggcggccatccgctcgctcgatctggaaaaccgctcgatcgtcgtcgaacgccgggccgagggcggcgtgcaggtgctaagcaccgggctgccttgcctgatcaccatgcttgaaggcacgaacaccctgcgccgcggcgccatggacgacatgttccgcgcctcgcgcgccaccatcgccacctggtcggcccaacaggccggcgtcgatgatatcgcgctgtgcggtttgcgtggctcgccgacggtggtgaagaaggtcttcgcgccgcaaccgcgcaaggaaaaggccaagatggtcgagaccgccggcaagtccgatgccgagatcgcccaggccaccctggataccctgttttccgccaatccgaagctggagaccgacctccgtaagctggccgcggcgtcgtaa

SEQ ID NO: 19963 - protein, 283 aa, Rhodospirillum rubrum
MHIVVCIKQVPDSAQIRVHPVTNTIMRQGVPTIINPYDLFALEEALRLRDKMGGKVTVLTMGPPMADESLRKALGLGADAAVLLTDRFFAGSDTLATSYALAAGIRKIGEEEPVDIVFTGKQTIDGDTAQVGPGIAKRLGLNQLTYVAAIRSLDLENRSIVVERRAEGGVQVLSTGLPCLITMLEGTNTLRRGAMDDMFRASRATIATWSAQQAGVDDIALCGLRGSPTVVKKVFAPQPRKEKAKMVETAGKSDAEIAQATLDTLFSANPKLETDLRKLAAAS

SEQ ID NO: 19964 - DNA, 723 bp, Rhizobium sp
  CDS (1)..(723)
atggtcgacttcaacgtcaagatccgggtgaaggcggacggcaccggcgtcgagctcgccaatgtcaagatgtcgatgaacccgttcgacgagatctccgtcgaagaggcgctcaggctgaaggaagccggcaaggcttccgaagtggtggtcgtctcgatcggcccggccaaggccgaggaaacgctgaggaccgcgctcgccatgggcgccgaccgggcgatcctcgtcgagaccgacgaccaggtcgagccgctcactgtcgccaagatcgtcaagggtgtggccgaggccgaacagccggggctgatcatcgtcggcaagcaggcgatcgacgacgattcgaaccagaccggccagatgctctccgcgctcttgggctgggcccagggcaccttcgcctcgaaggtcgagctcggtgacggcaaggtcaacgtcacccgcgaggtcgacggcggtctgcagaccgtcgaattgaagctgccggcggtggtcaccaccgatctgcgcctgaacgaaccgcgctatgcctcgctgccgaacatcatgaaggcgaagaagaagccgctcgacaagaagagcccggccgacttcggggtcgatacggcgccgcggctgaaggtcttgaagaccgaggagccgtccggccgcaaggcgggtatcaaggtcaagtcggtcgccgagctcgtcgagaagctcaagagcgaagccggcattctctaa

SEQ ID NO: 19965 - protein, 240 aa, Rhizobium sp
MVDFNVKIRVKADGTGVELANVKMSMNPFDEISVEEALRLKEAGKASEVVVVSIGPAKAEETLRTALAMGADRAILVETDDQVEPLTVAKIVKGVAEAEQPGLIIVGKQAIDDDSNQTGQMLSALLGWAQGTFASKVELGDGKVNVTREVDGGLQTVELKLPAVVTTDLRLNEPRYASLPNIMKAKKKPLDKKSPADFGVDTAPRLKVLKTEEPSGRKAGIKVKSVAELVEKLKSEAGIL

SEQ ID NO: 19966 - DNA, 798 bp, Myxococcus xanthus
  CDS (1)..(798)
atgaagatcctcgtcaccgccaagcgcgtggaagaccccgagtcgaagatcaaggtcaagccggatggctcgggcatcgttcaggaggggctgaagtacaagatcaaccccttcgatgaaatcggcgtcgaagaaggacttcggctcgtcgcgaagcaccagggcgaggtcgtcgtggtgtccatcggtggcaaggaagtgcaggagcagctccggcacgcgctggccatgggtgcgcaccgcgccgtgtgggtgaaccacaccggtccggtggaccagctcggcatcgcggccctgctccagaaggtcgtggagaaggagcagccggacctcgtcatcctcggcaagcagtccatcgacgatgaccagaaccaggtgggccagtacctcgccgagttcctcggctggggccaggccacgttcgcttccaaggtggagtccatggagagcgagcaggagaagaacaaggttcccgccatcgtcgtctccgccgacaagaagagcgtgcaggtgattcgcgaggtcgacaacgggctggccacggtggagtgccagctacccgccgtcgtcaccacggacctgcgcctcaaccagccgcgctacgccagcctcccgggcatcatgaaggcgaagagcaagcccatcgaggagctgacgccggccaagctgagcgtggatgtcacccccgccatccaggtcctgaagatgtccgcgcccccggcgcgcaaggccggcatcaaggtcgcggacgttcctgccctggtcgagaagctgcacaacgaggcgaaggtcgtctga

SEQ ID NO: 19967 - protein, 265 aa, Myxococcus xanthus
MKILVTAKRVEDPESKIKVKPDGSGIVQEGLKYKINPFDEIGVEEGLRLVAKHQGEVVVVSIGGKEVQEQLRHALAMGAHRAVWVNHTGPVDQLGIAALLQKVVEKEQPDLVILGKQSIDDDQNQVGQYLAEFLGWGQATFASKVESMESEQEKNKVPAIVVSADKKSVQVIREVDNGLATVECQLPAVVTTDLRLNQPRYASLPGIMKAKSKPIEELTPAKLSVDVTPAIQVLKMSAPPARKAGIKVADVPALVEKLHNEAKVV

SEQ ID NO: 19968 - DNA, 1288 bp, Homo sapiens
  CDS (187)..(1227)
gtgctgggcagcttgagttttccccaggctgctctattgttgcctgtagctgtgatttttcaggcaggctgctcctctgaggaccacccttaactgtctacctaactggtttttccttttcttctcctcatttgtatttatgtatcagtgtattatgtatttatatacacttggagatacagtaaaatgtacctctcactgtgggttaccataaatactgtaaatttgagaaacactctttcaggcctgagaggagcagtgacaacagtagggatgatcaagtcagatgtccctggtacccaggaatggctggatgagagaaggagacagggtgacctgcccctgcctacaaactctaacccagttctgtccctggagctgtgtgaccccggacaaggccctgcccctttccaggctgtcgttgtcctcatccagcctgggagagggttggcgctgaggcccccaccttcttgcctgtttcctcctgaccccaccccttcccctcctgctgggcagatccgagtgaagcctgacaggaccggtgtggtcacggatggtgtgaagcactccatgaaccccttctgtgagatcgcggtggaggaggctgtgcggctcaaggagaagaagctggtgaaggaggtcatcgccgtcagctgtgggcctgcacagtgccaggagacgattcgtaccgccctggccatgggtgcagaccgaggtatccacgtggaggtgcccccagcagaagcagaacgcttgggtcccctgcaggtggctcgggtcctggccaagctggcagagaaggagaaggtggacctggtgctgctgggcaaacaggccatcgatgatgactgtaaccagacagggcagatgacagctggatttcttgactggccacagggcacattcgcctcccaggtgatgctggagggggacaagttgaaagtggagcgggagatcgatgggggcctggagaccctgcgcctgaagctgccagctgtggtgacagctgacctgaggctcaacgagccccgctacgccacgctgcccaacatcatgaaagccaagaagaagaagatcgaggtgatcaagcctggggacctgggtgtggacctgacctccaagctctctgtgatcagtgtggaggacccgccccagcgcacggccggcgtcaaggtggagaccactgaggacctggtggccaagctgaaggagattgggcggatttgagcccctcccagagatggcaataaaactgactctcaacatctaaaaaaaaaaaaaaaaaaaa

SEQ ID NO: 19969 - protein, 346 aa, Homo sapiens [sequence omitted]

SEQ ID NO: 19970 - DNA, 744 bp, Thermus thermophilus
  CDS (1)..(744)
atgaagttcgtggcggtgatccggcaggtgcccgacggcgagagcaagctcaggatccagggggatcgcgtggacctctccggggccacgatgatcctggaccagatggacgagtacgcggtggaggaggccatccgcctcaaggagaggcacggcggggaggcggtggtggtggggttcggccccgagcgcaccgaggaggccatccgcaccgccttggccatggggatggaccgcggggtccacgtggtctacgagggctttgccgaccccgtggccgtggccgaggccctggtggaggttttgaaggaggaggcccccaccctggtcctcaccggggggcagcaggcggactgggacagccaagccctagggggcgccctggcggaggccctaggggtgccggtggtggcctggaccaccgccctcgagctggaaggggacacggccaaggccaagcacgacctggacgagggggcggagtgggttagggtgcggcttcccgccgtcttcaccacgcagcagggcctgaacgagccccgctaccccaccctgcccgggatcatgaaggccaagaagaaggagatccggaaggtgcaggcgagccttacccccaaggtcaccctgatttccgaggagatccaggagaaggccaggctcggcaagatcctggacggcaaggaccccgtggcggcggccgaagagctcgtgcggctcctccacgaggaggccaaggtcatctag

SEQ ID NO: 19971 - protein, 247 aa, Thermus thermophilus
MKFVAVIRQVPDGESKLRIQGDRVDLSGATMILDQMDEYAVEEAIRLKERHGGEAVVVGFGPERTEEAIRTALAMGMDRGVHVVYEGFADPVAVAEALVEVLKEEAPTLVLTGGQQADWDSQALGGALAEALGVPVVAWTTALELEGDTAKAKHDLDEGAEWVRVRLPAVFTTQQGLNEPRYPTLPGIMKAKKKEIRKVQASLTPKVTLISEEIQEKARLGKILDGKDPVAAAEELVRLLHEEAKVI

SEQ ID NO: 19972 - DNA, 792 bp, Mycobacterium paratuberculosis
  CDS (1)..(792)
atgacgaacatcgtggtcctgataaagcaggtcccagacacctggtcggagcgcaagctgacagacggcgactggacgctcgaccgcgaggcagccgacgcggtgctggacgagatcaacgaacgcgcggtggaagaggccctgcagatccgcgagcgcgagggcggcgagggctcggtcaccgtgctgaccgcgggccccgagcgggccaccgaggcgatccgcaaggcgctgtccatgggtgccgacaaggccgtccacctcaaggacgacggcatgcacggctccgacgtggtgcagaccggctgggcgctggcgcgcgcgctgggcaccatcgagggcaccgagctggtgatcgccggaaacgaatccaccgacggcacgggcggggcggtgcccgccatcatcgccgagtacctgggcctgccacagctcacccacctgcgcaagctgtccatcgagaacggcaaggtcaccggcgagcgggagaccgacgacggggtcttcaacctggaggccacgctgcccgcggtggtgagcgtcaccgagaagatcaacgagccgcgcttcccctcgttcaagggcatcatggccgccaagaagaaagaggtcacggtgctgacgctggccgagatcggggtcgagcccgacgaggtcgggctggccaacgccggttccagcgtgctgtcctcgacgccgaagccgccgaagaccgcgggtgagaaggtcaccgacgagggcgagggcggcaaccagatcgcccagtacctggtcggccagaagatcatctaa

SEQ ID NO: 19973 - protein, 263 aa, Mycobacterium paratuberculosis
MTNIVVLIKQVPDTWSERKLTDGDWTLDREAADAVLDEINERAVEEALQIREREGGEGSVTVLTAGPERATEAIRKALSMGADKAVHLKDDGMHGSDVVQTGWALARALGTIEGTELVIAGNESTDGTGGAVPAIIAEYLGLPQLTHLRKLSIENGKVTGERETDDGVFNLEATLPAVVSVTEKINEPRFPSFKGIMAAKKKEVTVLTLAEIGVEPDEVGLANAGSSVLSSTPKPPKTAGEKVTDEGEGGNQIAQYLVGQKII
